United States Patent 7,868,149 (PLANT GENOME SEQUENCE AND USES THEREOF) - sequence listing, part 93

SEQ ID NO: 48570 - DNA, 10228 bp, Oryza sativa
  unsure (1)..(10228): unsure at all n locations
gcgaaccgcctggacgagttcgccgccgcgtagccgctggtggcgttaagaagggtggcggcgccggcgtcgaacacctccgccgtcgcgctcgcgttctgcgcgttcatgagcatcatggggctcccgttgtccgtggcggaggcgaggaggttgcggttggtgaagcggaggtagcagaggtcgtagacgatgaacacgtccttgttgtaggggcacagctgctggcccccctggaaggcgttgtcgacgcaggactcgcaggcggaggcgttggcgtcgccgcggcagagcgcgagcgcgtagacgatgtccgggacggtgccgaggctaccggccgcgaagagggcggcggaggcgttcttggggagggtggcggagagctggcggaggttggactggtacgcgctgttcgccgagaagttgccgctctgcccgcagaactgccacggctgggccgccgccatcggcgcgacgaggaggagcgcggcggcgaggaggcagcgtacgcggtggcgcgccatgaccgcggagacccgtcgtcactcgtcacctgtgggttggagaaaagttgtcccgcaagctatgtaacgtgcggctttagtttgaccaattgaccgtgtggtgctggctgagaatgacaggtggggcccagcttctcggtgctcaactgctccagaacctgcagagacaatcatcgcagaagaaatttgctgtgatgtgacttgtctgccgactctgacctcagcctcagcgtcgaagacttcaagaaactgttgatcagctcaactaaaatgatatcaaagacttctctcaactgaaagaattcgtagtttagtttgaccaatttcatacaagtgaaattttccattatgaaagaattcgtacaaataatgaacaccaatctattctggcagtcacattctgagtttcagatcatctaggatagggatcagtattggtgacatcatttacagagaatttatcctcaacaatcacgccactcttatcatacatgtagttgcgatgtctgtgttgttgttgataaactgaactgaagtcccctccaaagaagaatgccggttgccgcggttgctggagttttattctgcgtctggttaacattagaatcactgaagatatgcttggcctgtcaatggggctctcttggacacaaagaagaccaatgtggatgcatcgtagcactttgctgtcggaatatccatcaagtgattgatcagccagctgcagtgccgtcccctttgtccagcaattccacacctgttatatcaatgtagtcatttttttttcagttgaaacttgaaagtctcttcagattatcaagcagtagaggccaccataaaagttctaaatcaagtagagctgaaaatagggcttacttctgtcaggagattcactgcgttgtatgtggtgtcgaaaccgctattccttctcccggttacaatttcaagaaccaaaacaccaaagctgaaaatatcgatcttaggtgataccttcccaaatagcgcatactctggtgccatatacccgctgcatgtagaagatcagcaataagtctacactttggaactgggaaacttacatttatctcattcaagtttcagttatgtttgtgaacttactatgttccgacaactgtagccgtcttagtctgagtatggccacctcctagtagccttcccaacccaaagtctgcaatttttgggttcatgttttcatccaacaatatattgttcgctttcaaatcacggtgaatgatccttatgcttgaatcttcgtgaagatacaatattccctttgcgattccaagaatgatattgtaccgttgctcccagttaagtgtcttcgccctactagtatctgtttcaacaaaataaattatttgaattaaacattttttatcatatacaatatatggaaggccatactacaatcatgtcatatctaaaaaaattactacaatcatgtaaatggagattgttaattgtacattctagtattagctaatttctgtagcaactcgtttgccgaaaatgctacagtgcttggattatccatcacactccatcactacttatacaatactcatttaattcttgtcaatcccttggcatagctggttatagtatagctttttagaggaaaattaacaattttgtgctcaaatgtaacataagttcaaaagaatcagtttcagtgtgtcaccagacaaatactggtcagcagccatgaggnggaaagtaccaaaagaagatgtcaggctcccgncttaatgtctcataancaagcatcatctcatcctgtgcgagcaaaaacccagtaatctaacaaattcttgtgctgaactcagcaacaactgaagtcattgtgcactggtcagtccctctctggtgactgtgcttggacagcttcttactgctactttttgcccattaccaagctttccctgcaaaacgaacctgttatagagaagaagaaaaatggtagtcaggtctattttttttttatcttacatactatgggtatttaccctgtacacagtaccgaaaccgccttccccgagcttattactgttagagaagttatcagttgcaatttgcagtgttggtaaatcgaagatcgcgcaatttcctcttttgattttgttcggtgctgggatgattggagctggcattggggtaaaaatggcatcaacagactgaaactcatgctaattctgaatgaaacataaaatgtgtgccactcactgttctggtttttggaagccttcctcctcttcaagcagatgaaaacagaacctgaaataatcaatacaaagacaatggaacaagcgactgatgcagatattatcacagctgtcctctttcttcctgcatgaatcattatttacaaacagaaaatagtattagtactcgcagaaatggtcaaggaaggacacctccgcgttaaatttgtcattaactggtcaattaagcaactgattgtgacgggactgataaattaagaggtagcagatccggtttttatgcaggcgatgtgtagtttggtcgtgcctacccctaccaaactttgttgacaatggtgaaacaagttaaaactggagataatcttttcgatatgagaggaggcaaacccatggaaaacgatgtaactaacgagatttatcgatctaataccttgagcttgactaacaaccatatgataatcataaagtggacaatttataccttgagcttgactaacaactataagatgtgcatggctaacgcgctttgaaaatatttccatcttcttcttttgatgtctttgtagcctgacttttcttatttgacctcgtaaaactaactagaacattttaaaaaaaaacagagaaatgtgtataccacataacttatgttatgaaaaaatgactcttcagttactcgctagtcgctaaactatgcgctccacaggttattggtattagtactcccttcatatcaaaatataaaaacatattttgtttcggcaggacaaaattttgatcaacaattgctctattaggatatcttatgtgatacatattataaaagcataatgataactaagtactttcgaatacgaatataataaattcaattttgtgtcacctaaatatattataataaagtattgttggtcaaaaacttgtcctaacaaaataaaatgtgccttctctttcgaaacagaggaaataatgtacaaattaaaattttaatcatatggtgactacattttgaatcatattgaattactagatggaaagaatagtctacagcagttactacctgtcaattattaatttcaaattatagaataaaataaaatactgattttataatccatcctagtaatatagtttctgtgtttttttgtgttttatttaatattttggagttttggaattaatcataagtaattagtgttggggtttcaatttaatatttcaaaattaaagattaataaatatagggttgtcctcatattggactttggaggcttataattagcacttttatgtcttttttttttgctcaaaattcggatataaaaattagtaaatactccagtttgtaattgatatagccttttgttttatctaaactacagtattataagtaggagtaaagattaaagagtccaccatatttctataattgcatgttttattgaacataaactctaaatacgatatacggtcacaatcatataatccatccagggttgacggcacggcagagactaacttgagatgtaaaccattttgtcactgacactacaagaaaacaaaatgcccttggcggtcaatttagttattccgtcggccgaccttcaaatctagagagccggagatattaagaatttcttggtagctaaccacttcctccgtttcacaatataagtcattttagcattttccgtattcatattgatgataatgaatctagacatatatatgaatgcgggaaatgctagaatgacttacattgtgaaacagagaaagtataagaaaaaaattttagatctctatcaactgtcaaaaaaaaaaagaacaaaaaaaaactcacctgctctgtccgccggtggtgtcgtgtccgccgccaccggagcgggtgatggcgccggcggcgatacatcaaacgccggcgcgtcgagacgcagcagtgggcttcccgggaagaacggatgcacgtcgtaccagtagttgcaccgcaccccaagaaccctcccggtcgggctcccgctgaagtagtcgggatcgttcacccacgagattatgccggccaggcagctccggcagccggccggcgacatgtccggcgtgcactgcaccagcgcgtagatgtcgcggacgccccagccgcggaacgcctccacgcccgtggcgaaccgcctgggcgagctcgccgccgcgtggtccgcggtggcgttgaggagcgcgaccacggcggcgtcgaacacctccgccggcgcggtcacgttccgcaccttgctgaagtaggccgcgaagttgtcgccgtcggcggcgaggaagttcctgccggagaagcggaggtagcaggggtcgtagaacacggtggcctccctggcgtacgcgcacagctgctgcccgtcctggaacgcggcggcgacgcacgcgccgcaggcggtggcgttcgtggtgtcgccgcggcagagcgcgaggccgtagaccgtgtccggcgggtcgccgaccccgccggcggcgaagagggccggggaggcggaggcgttcttggcgaggccggcggagaggagcgcgaggttggactggtacgtgctcctcggcgcgaagacgtcgccgctgctgccgcagaaatgccatgccttggcaccaccgggtagcgcgacggcgaggaaggcgaggaggagcgtagtggtgcacgggtgcatcgccatgagttgagatgagagttggtagtgatcgattatccccgcgtaatcttttttgtaaatgatggagatggttttttgatccgggtcagacgacaaagaatatgattatataaacggtagtacatgtgttcacaatatcctttgatccggaatgaaagaaaggacgaggtttaatgaaatagacatgacgtctatatatgaacacgctgactacctacaatattccaacgaattttgacactacaatgaaagcgtgctaaattttcgtcatgaaggggttgttcaaattgaagtcatttcaaactatacaatttttttaagttgtcaaatatgtgtatccatttagtttcttactaaactctggtaaatatataatggtaaatatataagaaattctaccaaaacttagcaatattgtcaaattgtcaaaatttggtaagatttattttagctacaatctgaacagacttgaattcttaacccaaactaatttagcaacatatagaattaaataagtaattaaagtcccttaaaaaaactaaacagcgaaatcccgtagaatatcttgaattaaataagcaattaaaagttaaaaaaaaaaccaagaatcctgtagagacaggaatagaataagtggaaagccatctagctttccgctctatagtttgtgtttttgcagcgtgtggtgtcggggcatgtgttttggtgtatatccttcctcgatgaaaaaccttattgtaaccctttttccctctatcttaataatatttgaatgacttctttcggtcatcctagcaaaaaaaaaaaagaaagaaaagaaaagaaaaaaaccatctagccttacctattccccttctgtctctctagggtttagaaagagtgtcacaccccaatctgataccgccgtacaacggcacctgacaggagcgtgtcgtagggaaaacggcgcgaaccgcttcctacgaaaccgcgatctcggtaccagtcccaggacatagtgctggtacccacggtgacaaatatgaatcatagcaatccttaaaataaatagaggacttatttaccttaacttaggttgcagctcagacagcccgagaatacaaccgacgacgcggacgaggaagcaccaacagcagcagcagcagcggaaccaacggtctaacacccaacaccacaggcgacggctgggaaccaggacgaaaccctaatcttcacttcaccttatcttctcttcagggcgggggaactatatatatatttatagagcaagggtgagtactttcgtactcagcaagtcacgggaatttaggtgtttaatgcaagcttggaagagaggcaaggttgttttgcaaatcttttgtttgaaatcattttgaaatcactaagtgatttatttctttctatgtttgggcgaaaagagacttgcgtctcgattcgactttaagagatgcttttcaacaactcaattggtaatgtaccgacctcccgggtcggatcattacttctcggctcccagagccatttcacttggttaatcggctcccagagcctttttcattttctcggactcccagagtccagctgcccagcagcacaacaatccgcttccactcgggaagcctagtctatgatgcccacagacatcctgaatcacacagattcgtttctgaccactcaggtcatccatctgccacataggctgattctggttacgattcccacaccacaacaacttttcacaaagcacaggcaaacaaatctacgcaacgggaaccacctcacatccgcccatgaccgtgggcacggctgttcgaacagtttgttaacctctgcagaggggtacactttacccacaagacacgaacttactctagacactggccggtgtcagaggttcgcgacaaagcctttcccaagccgacccagggatacctcatgccacatagaaggatcaaatcctcacataaatataggccattttaggcatacacaaatcaaactccaaccacctcgatcggtaatctggcaagcttcgcgttcttgccttaccaggaacccggtttggctccaaccgaccccgccccggcgttcccaactattggcatgcgaggtttccctgaaccgactagctacttagccagggtgtcccattccaccttgtggttgcactttgattatgttcgatgagtttcccacaggaatcggtccttatatgcgaatacgggacagtgccacataggcacaacccccgcatcgcgagttttcacaattcattttattttcaaacacaccgacaccacatgtcgggtttcgaaggcttcacaaacccatttcccaagtttttgacaagcaacggtgtatgtgggatatttggtatacgcgctcagagagcacgaataccgaggtaccacaagggtggagcgacaaggaatcagggtagtacgacctacggaaattagtgcgactactgggtaggtccgtcggtttggcacgcaaaccgaggccaagcaagttaagtgtgtgattctaataatgcaagttaccaacaaaataataatgattttccaattataggagcaattggtcaaagggtgacttgccttgctcaaggtcttcacgaagcttcacgaatcttcgagaaaacccgcgatcgacgaaaatccgataaccgcagctatacgcaaacaattgaaaacctacacaagacccaaaagaaagatcctatttagcctaattaatagtgccattaaatagatctcaattttacggaattactggaagtggaacggagtcaatcggaagagcggttgggaagatatgaattttggaagtttgatttggattttctggtcaaggaaatgatttatcggaattttctagaatacgagaaatggtttatgggatttgtagaaataatattcccaagaatattattgacagtcactgtcatgtgggaccaaaggaaatggtttatggaattttggaacaaggaattgatttatgggacaaaggaaaaaggatttattaaatcactgaaaaagaaaaggatggagggatgtatattagactttttcgggcggcaaggacgcggcccaagggtcgaaggaggctcggccaagccatttgggccggcgcggtcgcgggaaaggcggcccattagggcgcgcggaagggggagggagcggtccggtggaccgggtgcacctcgcggggtcccgggtggggcccacatgtcggcggcaaggttcacggtggggagagcgcacgcgggtgtgttgctagggtttggtgggtgcggtgtgcgggcggtgcgccgggtggatcggatggcagcgggcccacatgcagccggttggcgcaccgtggaccgcgcgcacgggagggggggaaggaaggaggcggctgaccggctcggctcggtcaaagccgaggtggcgccgacgtggcgcctacgtggcagccacgcgggccggcgggaggaggaagaaggggcggccgagatggacggcggacggcggccgagttcaccggagctcatcgcgacgattcgagagagagggagtacaccggaacgatgggacggacgagaggaagtgagccaccggatcggattcgccggaaagaggccagaggcggcggattgcggcgacgcacgctggcggcgagaaaaaggggaaacggcggaggggcgacaaggattaaattcaaggtggtgggagtatctccggggttcaaggagttcatctccggcgtcggatggggcagagcgacgccgtggagatctggcgacgagcggcggcctccgggagcgagcggcgatggtgacaagcctatggcgggtgacggcattgctagggaacggtttggggagaccctagggagctcaaggacggtgtcggtgagggtggtcgatgagctggggcccgacgacggcgcgcgactgcgcgcggcggctgaaacagagcaacggcgaggcgcgcggcgcattgtgcggcaggaggaggaatacggtgggggagctcaccggcgagggaggagcggcgttggcgacgcagagggagtcgtgacgaggcggtcgcgacggcggggaggcgcggcaccgagagggcgcggccgggcaaggagggaggcaacgaggccgaaaggatgatgtgtgcatgcacacgctcttggccacggcagtgcggcaccgagcttgacgaggccgacgccgaggctcacgcggccattggcacagcgcggcagcgaggaggcagtcgcggggcgagcagctagcggctggcaacaatggcgcgggtggttcgagcgaggcgaagacgaaacgagaggggagggcgcgggctttataggcgaggaggagaggtcggtttggaggagggaaaccgacattggtggtcaagcttcttcggctggcgcggcgcttgcggtcaaggagcggcaggtggtgacagcggctgtggtcggggaaaaaggcaaaaaggggagggaaaagagcttggctcccttgccactttgggaggaaggagaaagagagaacgagggagaggagcacgagctctgtctcttggttttggaaggatgcggcatgggggcatcggggccgagcgatgacagcggcgatgacggctaaaggcgagcggggccgggcggctgcgcggcgcaggcgcggcagggccgacgcggcggcgaccgggcggtcggccacgcgcgagcgcgcgcgcggacgtgagggcgtggtcggattcaaacggcggcggcgggaaatcgacgccgg

SEQ ID NO: 48571 - DNA, 17537 bp, Oryza sativa
agagctctctctcccgagcggctcatgtgcggcgcacgtgggaagggggaaggcggctgagggagggaggtgggctgagggagaggaaatcggtccatccaaaatacagggaggtaaagtagacttttacagagaaaactgatttggatagaattggagagattttagggtttggactcgaattcaaatttgatattcgaactcgagggtttggggatatatcaagggggattcaaggagaagtcatggaaaggattcaaaaggaatacttgggtatttgttctcgggaacatagggtggagtcaaggaaaggattcgaggcgggatttgaataattctggattcgtagaagtatttggcgaggattcaaaggaaggatttgaatttcagaatttgatttcagagactcgaatcggaaaaggaatttggaggtggaggattttggtttcgatgagagggaacaacgggattaaattgagatccttggcacaacttagactcgcacacaaagaacgaaaattttcgcaattaggattttgccgaattagtttttaacgactcacgaaaagcggagcgttacaaagagctacaatgaatttgtgctttatatatgtgtctaaattcatacttagatgagatatgaagataccaaaacgtcttataatatatgacggaggaagtatgtaaataacccttcaggaatgagtatgcgtatgtgaagtaacatacagagggttacaacttacaattatctgcttatactatcattttgctagtatacatattatattaccgtgccctactatatgtggatcatagctaatatttctttgaagtctgatggtgtaataatacatatgatcggctgtgttcggatagcagggatgggaacccaatctcccctcacggaaaacggagcggtccattagcacgtgattaattaagaatcagctaatttctttttaaaaaatggattaatttgaatttttttaagcaactttcgtatagaaactttttacaaaaaatacaccgtttagcagtttgaaaagcgtgcgcgcggaaaacgagggagaggggttgggaacttggagttccaaacacagccgaagtaggtctttccctacatcagcattttttttttttttttgcaaaacaaaaagggtacaatatgaattcagcatcacattggatttatcttggctcaagctcagtgatcgaaacctcatttggtgacataggcgatctatctgtggactatagttggccatgtgggccgcccggcacggcacggcccaggcccggccgtgcctgggccgagacttgtcgggccggcacggcccgaccgacgcaccgggccgtgccgtgccagcccacgtgccgcactcacggcccaggcacggcccaacacgcctcgggccgtgccgggccggcccgaaggcacgatgggccatcgtgcttttcctcagaataagtctaaatttcctccctcctattgggctgtgacatatgtacagctacaaaaagtctattttacctccctcttctttgggctggggtatataaatagctaaaataagtctatttaaggtccctattctttagacagttacatttatatgtctatttttagtccctgtactttatgtaccgggcctggcctaccggcccatcgtgccgggccggcccgaccgtgccgggccagcccagcgtgccggtggggaggcccaggcacggcccgacagtcgggccgggccagcacgggcccgacccaagtcgggccgtgccgtgcttgggccgggccaaaaaggcgtgccgtgggccgggccttcgggcctcgggccttatggccaactatactgtggactgattagctccacggaatggctccgagtacgaatctgagttgacactactcttttggatgcaaaatgccggcctagatggagcttgtaaagacacggtgctgctgctaagcatcacattcaccatcgacatcattggcctctccgtggggtcttcttgaacacacaggagtccgatgtggacgcacttcaagatctggtctccaggacaatgccccgccatggatgaatccgcaagctccacaactgttcctgccaaccagtgctcccacacctgcatattttgataggtaatgtaaatgctctgatattaatacaaaacattacttgggtgtagagtttgtaatatatagctgatctctcctgaggtactcactaaagttaagagatcaaccgattgctcggagtcgtaggagacattgtttttccttcccgtgacgatttctaaaatcagaacgccaaagctgaaaacatctgatttgatggagtaatgcccgcgcatagcgtactcaggggccatgtatccactgcagtgagaaattctgttatgtcaaggactaatgtgtactaccgaatatattagtagccaataatatcatcagaacttactatgttccgacaacacggttcgtgacgtcttgtgattgatcattcccaaatagccttgctaagccaaaatctgaaatcttaggattaaaatcggaatctaacagaacattacttgcttttaggtcccggtgaattatcttcagctgagaatcttcgtgaagatattgtaagcctcgagcgatcgcattgactatctttaatcttttccaccaatccagcacattgcttctatcaggatctgtcacatagaagaaaaaacttcaaaattatacataaaaaagtttcagttattgattcactgttgaaaaggctgaagagtacccaccaaacagaattgtgtcgaggcttttgttaggcatgtattcatacacaagtaatttttcatgttcttccaagcaaacaccaaggagtctaaccaaattcttgtgttgaagcttagcaaccaaaacaagctcatttttcaactcctctatcccttgtcgagaactttgcgatagccttttcactgctatttcttgatcactagggaggactccctgtacagatagagaatttttactggctgaaactgtaaagtattgaatataaaaactaaaatggaatggtataattagcaccttataaaccgcaccaaaacctccttcgccaagtttattgctgtcatcaaagttgtttgttgccactcgtaaagttgatatactaagaataagtgaatcaatactttctatgtccgctgggtctgttggatctattgtttcagaaaaaaaatacaacaataatggtgtaatgcattaatggaattcttgcttttgtatgagaatgaagtcactgcatagacaaaaacttaattttgccatttcaagtgtattgagaacacgtactggaaattaatggaatttgaatgaactacaggaacttacctgctattgatggctttcttgctcgttccgtcttcctcttccagatataaaagcaaattactacagcagccagtattgcagcgactataggcaatgcaatggctaaaaccctaccagtggtgttccctgttcatcccgtaaacggaatgcatcaattaatgtaagacataagacagaaacacaagtataaataattttgacatcattaaccagtatacactaaccatctttttttttttgaaaacttacactaaccattcttaaaggagcaattttacgatcctttaggaggtatcaattttttattgtaaatttggtacctcacagtacgtaccaaattttacactaaattttttgtacttcatggtacctcctcaaggatcatagaattgatcttcttaaaaaagaaactgcatggactacaaaagaaaatgacaaatacatatttacttacacattatttttatcaaaattacagtgcacttacatatcatatcaactgaatttacaaatgtaattttagttacatagatctataattttatattttaaagaaaataacaaatgcatatttacttacacaatattgttataaaaatacagtgcacttacatgtcatattaactgaatttacaaatgtaattttagttatataggactgtaattttatatgtttttaaaaaaataacaaatacatattcacttacacagtatttttaatcagaattacaatgcacttacatgccatatcaattaaatttacaaatgtaattttagttatgtaggagtgtaattttatattttaaagaaaataaaaaatgcatatttacttacacgatatttttatcaaaattacagtgcacttacgtgttatatcaactaaatttacaattgtaattttagttatataggactgtaattttatttttatttttttatttttagttgtcttattttttcaatggttaaagaaatcaatttttacatagaaaatcgaaagaaagggagagagagaatgagaaaagaaagcgcatgaaagagagagcgagaaggaaggcgggagagagagagagagtgagaaatacgccgtaacagctagaaaatggccagaaaattcggaccagaccggcccacgtggctccccacgtggcctcatagcgctaaatccaccaccaatctagacgcacaatccgacggccagaaaaacgtcaaatttcagacgagaaatcacgcgacaaacgtttagcaaaattgatcattagcaaaattgatcatggaaacatctggtatatgactagtctaaaaggaaactcatagattcatgcgattaaagatgtgaacatcagaccagtccacaaaatgacaaagaaaatattttcttccaaattaagttgttcgtactaaaaaacaaatcatgaaagactaatctaacttcaaaaagaaagacgagttcgtaacctctacacagggccggccctagccctatgcagccgaagcgaccgccgggggcccatgatggtggggggccatgttagggggggggggcatctaattctagtagtaggggggggcatctaattctagtagtcgagtacctcatccgatgttgagatcaatgatttttattcagaattaaaggtgttgcaagtgagtttaccagattcttcgatgtctccgcgcctgagattttaaagtttgttatggatgcagattgctatacaaatgtttcagctgcctatcgaattcttttaactgtacctgtgactgtagtttcagctgaaagaagtttctcaaaaattgaagttgttgaagaactatttgagatcaactatgtcacaagaaaggttaaatggcttggctatgcgctcaatcgagaaggatatcttgaacactattgatcttaataccgttcttgatgattttgcatcaagaaatgcccaaagaagtatcttttcatgggaagcaatggatatgatggggttctattcttcattaagttaatgaataatgatattagttccaagttacaaatatattgttattttgatcgattttatttcttgataattaccatacatgttaaatttaatatatggatgtttttgtttttgttttgcaagtaaaattagcatatatatatatatatatcataaaattttatatataccttagagggtccatcgtgatgagtttgcctagggccctcaaaatcataggactggccctgcctctacaacaacttctatggctaggaatcagtcacgatggacaactcgaggtttacaaatgccattttcaccaaaaacaggtccctagaggttttttcaatagccacgacaatggaacggttatcgacaaaaacaggtagaatttggacaaattttgccaaaaaaataaattttttttctgtatttggacgattcagtttcttcatgtggaccgactcaaagccaataacagtgttgtggaactgtggaccaatcgataattagattgctgatagcatacttaggtaccgaatcaaatatcgtttcaaattcctacggtgaaatcaaacaccacttctattcaaacccatcgaactaaaattgctgcacacatgcatggactgatcctctgtccgtgaccaacacaaaattcaggccatttaggatatcaggatactgttttccccccttttgagtttagcatatcgcattgttgaaatgagatctacttcgtatatcagtttcacccaactcacctcgtcgtctggtaccggtggtggtggccggcggcgtgacgtttacggccgccggagatggcgccggcggcgctcccagtgatgccgccgggagctgcagcagcgagaccccgtcgaagaaaggatatatctcgtacctgtagttgcaccgcagtccgagaaccctgccgccctgcttcccgctgaaatacttgggcatcatcccgacgattccccccaggcagctccggcaggtggccgtcgccatgtccggcgtgcactgcgccagcccgtaaatcttgctgccgttgaacccttcctcccccgtgccgaaccgcctggacgagttcgccgccgcgtagtcggcggtggcgttgatgaggacgcccacggcggcgtcgaacaccttggccggcgcggacacgttctgcgtgttcatgaggatgaggaacttgttgtcgccgttggtggaggcgaggaagttctggttggagaagcggagcgcgcaggcgtcgtagaagacggtggcgtccttgttgtaggggcagagctgctgcgcgtcctggaacgcggcggcgacgcagccggcgcaggcggtggcgttggcggtgtcgccgcggcagagcgcgagcgcgtagacgatgtccgggacggcgccgagggtggcggtggcgaagagcgtgcgggacgaggaggcgttcttggggagggtggcggagatgctccggatgttgccctggtaggtgctgttcgccgtgtagttgccgctgtcgccgcagaagttgccgaggggctggcccgcgacgggcggcggtaggagggaggttaggagcgccgccgccgccgcgacggcggcgacgcaggcggggagatggccacgtggcgtggccatggcgcgagggtggaggtggtcggcgagcaaagagggataaatggagaagagatgatagatgagcggtgggcccttggttgactcgagtggagcttgcttgactcgtctatgttgcgctgtcgtcgatcctgacatcatgggacccaggcataaatgctggtgggcccacgtcaagctgccgtgacgaccattgcatggccggcgtgagggcaaacaatggggattttttatattttagatttttatttacaaaaacttattttataaatagataggctagacagcaataagtagtgtcgagagcctattcgtgaaaggaatatttttaattaaaaaaggatttacttgtaatataaaaatatttacatatagctctcagtgccatgttattggcattgaagtcctatttgtaaataaaataggtccttaatactaatatcattagcacctatacaacactatcatgtttagacgggataatatcttaaaagatattatacgtcgatacctaggaatcgcatgatacatataagtatttcgaatgggatacatcattataccattatcctcagcaataatatccagtgcgcttccatcacggcaaacaatgtgccgaaacatgaattcggcaataataaaagggggtagcgcacgagccctaaaagtggatggatgcggagacaaatgatttagacaggttcaggccctctcaatgagaggtaataccctactcctgtttggggatttgaatccgccgggtgtgtattgatctgacgatctagttgtgtctcatgccccctagagggcctcctgcccaccttatataggatggggggcaggattacaagatagaaaccttaaccaacacggtatcggtttcctaaatctactttacaatcttatcaagccaggactttaggccgttccataatatacagggaaacgtaatacccaagtcatgatctgttacatatttcatagatataagttatcccatataactagtcggataaccatgccgtgtgggtatggggtacccataatctccacagtagcccctgagaccttcacagtcgaaaagataatcttctctcgaactagattactccaaagccgagtgcttcaatcatctttgccatgacttcccgagtacttttaccaaatctgaagactgtggagggctgaaaaataaagtcaggtgcatcgactagatgcacctaataggtgtagcccccgactatgtggttaattgaacaaaccaaacatatagtcaaggaataaataatctaaccaaccgagtggtttcgataatagcatatgatgtgtgaatccctgaataatatgatccaagtgatataccgactgctttgtaaaatatgatgcgtgtaacttaaagtcgactacattattgaaaattcacatagcaaaacagctataaagaagcttgtatgttgtgaataaagaaatttccaaagtattgggcatacgccatgcgcacactgctttaacagatgtgcttaagtccctaaagacacatggtttcaccacacctgaaaatatatggcatatgtggtgtaaaatccgagtaaataaactcataaaggatttaccaaccgcctagaaaatgaccaaaatatataatcagcccaagccataatattggtcaataaaagtgtacacttacgtggcaaaaaacaatgatattgtatccaatcaattgctttatgaacccaaacagcaccttgacttatataaaaaagtcagcgggcagctatataaagcattactgtttggcaccttttaaaatgcattgtaccaactcctaaaaagttgagtaactgcggtataaaaggattttaaggtattgggcacataatcacgcgcacttttgcctaagcaaaaagatgcctaagtccctaaaagaacgtgacaggccacacctgaaaatatgggctgcagacatattaggcctaggccaaaacatatgccctcgacaccctttaaaggatgacgcatgtaacatgctcccgagtaataaatcttccgggtaatatagaccaagcgtagctcatatgaatagcttctgatctgagtgattatcccttatgggatactccaaaatagatataaaaattgaatcccgactggcgcaagtattcggttgataacccttacggagaataataaatagtccagtctttgagcatagaaaatagacccatgatcatgaattcatgttgcatgtaaccggaacaagtccaaattgaaggtatgatacttgtgtttgaactagtaagcctctgagcatatagcttgtccttctttgtagtcacaattgtccatcgatggtagctgacgcagttggcatagagacaagacgaccaatatagagataatattgcccaccagaggtggcaaaaatattggtggtagtgaagatagtgataccaatcaaaagtactgaagtcgcatagccatggaggcgaagaaaccagtcggcggcaaacagatcaactaacaatgaagatgaaggcgcccagcgataaagttgtgtagccatggcagcgaaataatcagtcggtgacagacgaggcagatcaaatgcgatgacgaaatccaccaatcatgaagatgaagaaaatagttgacgatgacaaacgcaaccgacatgatgaagatgacgatgtcgatgatccagtcaatagcagtgtagcaaccaatgataatgacaaagacgctcatcagcgtttgcatagtaggtcaaccgtgaaggtgaaataataagtcggcgaaaacataatcatccattagcaacagcggagatgtcagggtcgatgaagcagaggtgctggtgatgatgtcagtgacaataatctatcaaattaatgttatagctgttgtagatgctttacttggaggagagttgatgttgttgcccaactcgtctaaaccgaaatatttgaagttgttgaagtagaatgtctgctccgaagcaaagatgaagataatgactcctggagttgactcgttggctgattaattgatttcttcagcttgacataaaatttgtcaaattttgagccttgtatttgtatagcccccgactctttgattagttgggaaacaactgaacatagagtcgagaactgtagcttcttgtcgtcgaatagttattgcttgattgaagatatgtgttgaagatgtccaagtagaaatcctgaatattggagagccacttgttgtagtaaaataacacggcatcgcatgccgagatgtcgagattcacaaagacgtcgtggttggtgaagtagcgaaacttgcgaagtagcagcaatagagtttgccggtgccgaagataataaagatgaagtcgctctaccatgatgacaaagttgcattgccgtgatgaagtgaacacgagtcggcgtcaacagaagcaaaccggtagtgaagacgcgcagttgtgaagataaaagcaccagtcggcggcggcataaccagtcggcgacggaagacgatgatgtccatcagtagtggtagtggtataaaccagacgtagagacgagggcactagtcaacagcagacgagatgaccggcggtgaagaagataaggccaatcaacactggcagaatcatgcagccatggaagtgaataaactagtcggcagcagacgtagacagcttgcgtttgaatatgatgacgcctattagtggtgacggcgacgtagccggccgtgaagaagatagcatcagttggtgtcataacaggccagccgtgcaggcggaaacaccagtcggcggcggacgagggcaagccggtcggtgaagacatagacgcccaacaacggcggcataataggccaaccgtgcaggcggaaacaccagtcggcggcggacgaggcggccggtcagtgaagacgtagacgcccaacaacggtggcataataggccagccgtgcaggcggagacaccagtcgacgacggcgaaggcaagccggtcggtgaagacgtagacgcctaacaacggcggcataataggccagccgtgcaggcggaaacaccagtcggcggcggacgaggcggccgatcggtgaagacgtagacgcccaacaacggtggcataataggccagccgtgcaggcggagacaccagtcgacggcggcgacggcaagccggtggtgatgttctgactgatccattcctgcagtgtaagagataagcttaaagccatgaatcccttttatgcatatctggatttggatcctgcagaacaaacatataggatgagtagtatctgatgtaaatataatactcgagaaaaatgcaagtattttaaaatatttataaatatgtatttctcctcttgtcaattttgatttccccgagcagatgactccttacgtttaaacactctgcccgactaatcatagtccccaagcatcgggagtcggcctaggcacttcccaaacatgcatatgagtgacatgagttcgtcattaatggaacaaagtttcacggatcagaatttactactcgggtacttttgcaattattaagagcaaaaaaaaaattatctcatctctatgcttttgatttattccgaataatacttagcaccttgcgttactcggtccatccaacaagctcccgggtgctaggaatcggcccaaagtcaatcatccattggcaaaccaaacggaaagcataggaagatagaactccataacccgataggtacttttgtactcagattatgtcgcaagcaatcaagataaatgttatgaaaaatatgatataacatctgtagcccccgactcactactcaatggaaggccaattggtgtagtgaggcagaggaaaaggaaaaatatcatataaagaataaaataaatgatgacttagctttatcgtattcccttggtgacagcagaagtagccgatgtgggaacgaagcagtccatctcaatagcgatgaaaacacctgtcggcggcggcaaaagcaagccggtggtatagatgacgaggcccatcaacgacggcggagtccgccaaccgtataggcgaaaacaccaatcaaaggtggcgaaggtgcctggtcggtgaagacgatgaggcccatcaacggtggcggagtccaccagccgtgatggttaaaaaaccagtcggcacggccgtgggcgaagaagatgacgcctagcaatattaatgcagttgaccaacctattatgtatcccgcgtcttggaaaaaggacttggagcctatgtttgccgagtgctgatatagcttgctgtgtgcccataaccatatgtctttattaaattggaagaattgatgctgagtccgagtggattaaaacatccattaatcagcgagtctgaatttgaatctactcatgcacgcctgatacgagatgcgatgcactcatgctgctcggtcagctcctattccgatctgacatgatagtaattaacaggcaggcatatacatcttgacaaggaaacgagggccctctggcgctgcgagttcagccaatggaggactcggaagtcgtagccgataacaaaacatgcaggaaatctttagattgatttgatcagaagattgtgttgacggcgacggatcaatgtatctcctggcatatggcttgcatggtgtcagctttgcatgtaatgacctagtcatccttttgattgtatatctccacggctgatctagagaaaagaaaaaactccatggctgtccagtcttgtatcttgcttgattgctttaattggcgagtgatctcttagccgactaattggagcatgtcggattttcggcagcagtgatgaagtccaagaagatcctggggaagacggaagtgaaggtggtggcagccatagtagattgaaactgtcttgactggtttgaatccgagtcaaagagtaagagcttgtcgaaattgtcgacgacgaggaagcgaaaactcccaaaacgaagacgaagccggcgaccgataaagttgattccatcgcacttgtcgatagaaactcgacgcacccctacctggcgcgccaactgtcgaaacatgaattcggcaataataaaaggggtagcgcacgagccctaaaagtggatggatgcggagacaaaggatttagacaggttcaggccctctcaatgagaggtaataccctactcctgtttggggatttgaatccgccgggtgtgtattgatttgacgatctagttgtatctcatgccccctaaagggcctcctgcccaccttatataggatgggggcaggattacaagatagaaaccttaaccaacacggtatcggtttcctaaatctactttacaatcttatcaagccaggactttaggccgttccataatatacagggaaacgtaatacccaagtcatgatctgttacatatttcatagatataagttatcccatataactagtcggataaccatgccgtgtgggtatggggtacccataatctccacacaataatagtcaagtgatgtgacaggctccaattggaacgttgtccattgccggactcggtaaatgcagcgatcgatcgtatgatgaacgctattggattttttacgatttcattcttttgaaaaacttatttcgtaaatagatctaagaaacaacttatccccggaaatagtcttttttgggcgccagagtcattggcactgtcgtccaacgggagggcgccagcctcctgccaccgtagcgggtcggcgctagggtagcagggggagagcgccaatgtagctggcgtcctccccccaatttttttttatttttcttttgatatagcacatgagaaccaatcatagaaaaattaaactcaaatagatgaaatatgtgacatgtagaattttccaaagctctaccgaaaagcttctcgtctcgaaaacataatattgcaagtggaatttggaggttctaattttgcctaacccgacgaatcggggagaatcggatgtaactttttctatagatgtcagtggatgtattatttgcctgattccgagtccgtatgagaaaattatgcatgttttaaaaaatgatacccaaatgtaacaaataaaacacaaaccctaactttttttcatgtaagaaaaagctaagattgttcgaaatctaatctatttttttgactttatgaaaaactaaaacaacgaagagcaggaaggggcttttcgatatagctttgaaaaattctacaagtcgcatatttcgtccatttaagtttaatgtttctacggttgattcttgtgcgctcctaagtgtgaaaaaaatatattataataataataataataataataataataataataataataataaaggatgcatatatttctcctctacactagagaggaaaaaatgcctggggggcagccacataggcgcgttctccctaccacctcagcgccgacccgttggcagtggcggagctagagagaattgaagggggggtgcaccactcaatcatgtgttcatacccatcgaaccatatagaattttcaagtgatatattatactaaataattgcgcctcccatcaaatattaaaaaatgaaatcaatatgtgatgccaattgtatcaaaagaggagtgcaatgataaaaatactgtactgaccaatatgagtgaatgcattataccagcaaaactaaaatacattgccccaacctccatgttagctctcaactaaaaaagcttatgaactaatcatgtcaaatagatacatcatacattaccttctactatttatgactcaatatttaatttttttaatgtttgttaaacagtaaggcaagcctagatatattatatatattccttcactgttggcttgttctatcgtccacttcttttataaaaaaaaatcccaaaaaaatcacctatacaacattgataaatagtccttaattttactattttaggtagtatgatctaatccatcagaagccttgctatgaacacattagtgcattgaaaatttgaaaccttcctagtagcacctgttcggcctggtgatctgcagtgcacgcgctgggctttacgcctctgtggcttaactttcagtctgggggtacacatacgtgaggcaaggggggtgcccacatggtcattagggggtattaatcactaattttactttcctagccgggttcctaggaaccccctcgggacaacatagcttcgtccctgcccgttggacgacagcgctagcgactctggcgcctaaaaaaattatttttagaataaattattttagagtctatttataaaataaatttttcaaaatgacccaattgtgaaaaatccagatgaacactacgatcgctagtctggatcattcgatttgcgtctgtcgatgtcacgatagtgtgtatgcgatgagacttctcacttctcaggtcaggacgtcaggtacaagccccacgataatgcatggccccaaataaagatacaatatatatatatatatatatatatatttaatttaactttaggggccacagtatcgaccattatcttttcctcccaagtgttgggaaggtctcaaaataggcagaaaccctcacgggtgtattagttagggtgttcagatatagaggtgtaaagtacttgcgtgtcatatcgggtattatataaagtgtcgtatggggtatttgggcactaataaaaaaactaattacagaatccgtcagtaaatcgcgagatgaatttattaaacctaattaatccattattagcaaatatttcctgtagcaccacattatcaaatcatggagcaattaggcttaaagattcgtctcgcaaattagtcgcaatctgtgcaattatttattcttttacctatatttaatacttcatgtaggtattcaaatgttctagtgcaaccccgggaaaaattttagagtgggattttaacagggttccattctttgtggaatcaaatacttcatccattttatttcatattataagtcgtttagattttcttcctaagttttattaaatttggctaagtttagtgaaaaatttagcaatatctaaaataccagattagtttcattgaattaaacatttgatatattatgatgatatatttgtcttatgttgaaaatgctaatatattttttataaatttggtcaaactgtattaaatttgatttagaaaaaagataaaatgacatataatgtgaaatggagggcagtattatataggaataaagcttcaaaagtaaaccatagtactaggtagcaagacaggcagacacaatttcgggtactgctatttagttccacgtttgttcgtagtgcgcactttttcctgaaaacttttatctcagtatatgcacatttatcagttcgcactctccaatattacatcagtatcatcctttccatttgatcaatcagaagagcaagagaaaatatccctattaatttctgaatgaacagtcttagacacgaaaactgcatctacatcttgtgtagaaatgtgcccttttcttttgggcaactggattttgcttgttctgtggtctacgatcaaccgcggctacagacagaagttgacaaccctgtaccaaatggaatttgaataccagtgaagagtccgaccaagatctccaagaactctggtttgtctacattatatttgcatttaaccaagttggagtattctatgatatttgtaacaacttttcgaattaacaaaaccagatgaaatatacctgaactgaacctccacctatggcagccgattggcctgggttcttctccttctaccgtctccccattcctggaggaaaatgaacagaacacaggctattccgatcacttcgaacaccaccatcacagggaaatcatagatcgaaacaattttccaccaaggtgaagtatctgaaaaaaataaaagaagaagaaaaatgctgattcggatgatgcagagtctacctgaaattctgaatcaataaaggaaggcgaacaaaatcacagtataatcaaaagacaaaaatttatcgagctattccctccgtccaaaatataagtatttttttctctaacacggtctccaagatgatactttgacttgcaatatctacccctaattaactgcgcattgtaaggtttggtctcgttttctcctaaaaaccagacaccttctttttatataaaacgtcgtcaacagcctgactgttcgaaaaaaaagaccagcaatatctataaaaataatatgttttaaataaaaagagttacatattatgatagttgtccaatgacaaatctagtaacattaattttacataattgatcttttttatttttttactattaataattaaagctaaaaatatttgactttttactatgctaaaaatttatattttaggatggagggagtaacaaatagatcactcacggcgaacggctgaccggcgcgcatctcccgctccatgcgttcgacgtcgtggtagccgacgcggcaggcgccgag

SEQ ID NO: 48572 - DNA, 1075 bp, Oryza sativa
gcataataggccagccgtgtaggcggagcaccagtcggcggcgacggaggcagcccggcggtgaagtagtagacgcccaacagcggcggcataataggccagccgtgtaggcggaggcaccaatcggcggcgacggaggcaagccggcggtgaagtcgtagacgcccaacagcggcggcataataggccagccgtgtaggcggaggcaccaatcggcggcgacggaggcaggccggcggtgaagtcgtagacgcccaacagcggcggcataataggccagccgtgtaggcggaggcaccaatcggcggcgacggaggcaagccggcggtgaagtcgtagacgcccaacagcggcggcataataggccagccgtgtaggcggaggcatggacgcccatgaacggtggtgtgaccaaccaaccgtataggcgaggacaccagtcggcggcgacggaggcaggccggcggtgaaagcgtagacgcccaacagcagcagcataataggctagccgtgtaggcggaggcaccactcggcggcgacggaggtaggccggcggtgaagtcgtagacgcccaacagcggcggcataataggccagccgtgtaggcggaggcaccaatcggcggcgacggaggcaagccggcggtgaagtcgtagacgcccaacagcggcggcataataggccagccgtgtaggcggaggcaccaatcggcggcgacggaggcaagccggcggtgaagtcgtagacgcccaacagcggcggcataataggccagccgtgtaggcggaggcatggacgcccatgaacggtggtgtgaccaaccaaccgtataggcgaggacaccagtcggcggcgacggaggcaggccggcggtgaaagcgtaaacgcccaacagcagcagcataataggctagccgtgtaggcggaggcaccactcggcggcgacggaggtaggccggcggtgaagtcgtagacgcccaacagcggcggcataataggccagccgtgtaggggaggcaccaatcggcggcgacggaggcaagccggcggtgaagtcgtagacgcccaacagcgg

SEQ ID NO: 48573 - DNA, 6068 bp, Oryza sativa
  unsure (1)..(6068): unsure at all n locations
actgaggtggtgccgtacgttgacgaacaccttgcagttatccgacatgagaacccaggccgatcagagagttgggtcaggaataagcacatgtcttctttcaacgagtggctgaagaaccgaattgccaggttgcagaacttgtctagtgaaacacttcagtgcttgtcacagggtcctgaatggagtgccaccacctggcaaggatatgacataaatggatacacctttcacacggtaaagcaagacagcaaatgcacagtgcagaacagtgggttacgcatcgaggctactagtgacggtggtcgtcgtgatcaatactatggtaaagttgagcaaatattggagctagattacttgaagttcaaaatcccgttgtttcgttgtcgatgggtcgatcttcgcaatgtaaaagttgacaatgaaggtttcaccactgtcaacttggctaacaacgcgtacaaggatgaaccgttcgttctcgccaaacaagttgttcaagtgttctacatagttgacccgtgtaacaagaaactacatgttgttcgtgaagggaaaaggagaattgttggattggacaacattgcagacgaggatgattacaaccagcacgtccacggcataggtcaagaaatacctctagaagaggaggaagaagaagatgaagttcaatatgcacgtgtcgaccatgaggaaggattatttttgtaatttatgtacgtagtttatgtctacatgtctgttatctgtatgactctaatatgttcgcaatgaaatagtcaaataaaataattaagtaaagcacccactagaagtgaattaaaataattaagcaagtataagcattggaactaaaataattaaagtagtatagtaatgaagtgcaattacaactgttagtgaaataaaataattaagtataaaaaaatatgtagtgtatgtgaaaatatgttaaggaaaataaaagaactaagtgaaataaaattgctctaggcaaactcacctgtgacgggctctatctgtagggccgtcacaggtgacctcacctgtgacggcccagagtgttgggcccgtcacaggtggtattacctgtgacggctccacggttggcgcccgtcacaggtgagggcacctgtgacggccacatagttggcgcccgtcacaggttcatgttccgttgtgcgagtcctggtccggttcatgttccgtgcactggaagcgtggtcccgcacacagtaccagaaggacggcttgtgaggcgacgttaacggcgttaacggatgtgagaagttgccgttgcgcctcggcttttccgtcagagtcagggcatccaatgctctcgatccctctttcttcctcctctcgctgttgcttccgcggtcgtcgatgcgacgcaggcctggcggagaatccctctttcttcccctccgctgcaggctcccgtcctcccctttcgactgtggcttgcaggcccgtgccccccccaatcgattctcgtccgcgcgtcgtcttgcggcagcggtcggttcaaggtgctcaaaatcggggggaagtggaagagctccacgcctgtcgagctgtctgcgtcgtcctcgaggggagtaaaagctggccggcgtgctcgctgtgaagcagcaagcagtctggctgcctgtgtgctcgtcctctctgcctctcgggtcagacagtgctggcctgaagagtctcatcaaggcatccaagctggcggagttgaggagtctctatttcaggccgagcgtgtgcgtggtccgatggagacgacagcgaagaagcggaagcgagagcgggatctattgtcgatccaagaggaggggacgattgttcaatcccctcaaacaggggagatctctgtccgcggcgccgatctggagtccggcgaggactcctccgactctgtcacctccgacgctggcagcgccaaggctgctcccgacgacgtgcttcatatcgcgcatgccctctgcaaagtttgcgccaagtctcctagagccgtcatcgactttgttcgaagagtgagccctgccaccgtcggccgttcgattgattgggacgtcgtccgcgaggaagagtcatgtaaggtattggtttgtattaatttgttcatttccgattcaattttatttgacttgcacggagtagatgggcgatggccgtagccggtggaccgatatggaggttcgtgtgtttcttgagagctgcttggaggagatggcagcgttcaccatcacctccaactcccccaagccgcaggcatggcagaacctaatacacaagatgtacaccaagtgcaagaagaaggtgaacaaggctcaattggagtacatttgggggcagtgtaagaagcggtacaacaggtgggtgtggctagaatcgcatgcaagcgggctgggtcgtgatccccatacatcagccattgttgccgatgatgagtggtgggaaagcaagaatgcggtacgtacacttgaccataaatattttgaaccaacaattttgcctacaattggtattatctgaaatttagtacatgcatgcaattatgaatacagttttgtgaggtgtaataatttttttgttcaaattgtgtgtgccaacaaatgactagctgcagtaaaatggaaggattgtgatcacatatgtttcatagttgttactgtcatgtcgtttttagtaatgtgtgccattcccttgtatttaagttaacaaaatgatgtttaggaaagatctatatgtagtgtatatgtagtgtatcagtaaattaggaaagatcttgtacaagtcatttaggaacatgttaatacatattcaactagctgtacacaccttctttgtgatgtatatagagagaatgaacaaaaatgtgctcatctacaaagaatataatatatgcagtttatcttatgtttacaatgttcaaactatctttctttcattctgtcagatgtgtggcccattgtaacatgtactcctgattatatttgataacttggtaccaatgtgcacatttactgccagcattttagtagtaatgcacattggactgcacatattcattatgttcaatgtttgcacaagcctaatgcacttgccttgtactaacttatttttactgtctacttatgttgcagcaaaataaaggtgtcttaagcttcaggaatgatcctctgaagcacattgaccttcaccacgcggtattcagtgggcacacagttgtcagaaaccactccgccgtcgcaggggcagccccataggcaccgcaaggagcagttcagtggcagaccatcgacatggcgcagctcgctgctgcttatagaccaccacctccaactccacccccaacggcagcagaccggggcaagggaaagaggccagcagcaaacactactgcctcagggagttcttccaagaagtcacgnnnnnnnnnnnnnnnnnnnnnnnnnnngaggattgcggacatccgagagcagagctaccagagtcgtgttgctcagatggaagcagagaagtctatgggccttgatgcgtgcatggagttggtggaaaatgatggccatgaaattggaggaagtgtgtggtatgctgcttgtgcgctattccgtgacccattcacctgcaaatgctttgttcgaatcaaggacgccgctaggcgcttggaatttatacgcactggtggtactggacagtcatctggtggcacctggtagtttgtgcactgtactttactttgagttgtgatgggcgatgtttttcaaataaaccattatttatgtttagaactcagtgtgctaacaatttttacattctgtgagtccgtaaacatttgtggctttatatccaattcgagcaactacgtattccattgcattgcttttatatccaaataattcttcgattgcatagatcactgccattattaatttctatccttttgattatgacaaacattgcatattcttcggttctcatatgttaaaggaaatcggcgatgagttacggcgcgggtggatcgagttggaatggaggcggtcacacaagcagcgaagaagaagatgccatcattgagtacatggctgctacccttgatttcaatgagagggcaccaaggagaataccggtgcaaaccggtatcagttggatgatggacacgatggcaaatcgaagccaatgcagggcaatgttcaggcttactgcagaggagatacacaatttgcatgatctattggtcacttcttttggtcttgtaggaacagcaggggtctgttccatggaaaagcttggtattttcttgtacacgatgggtggaaatcgtccaatcagagacgcgaacaatcggtgggtccgctccaactcgacagtgtcggttcacttccaccatgttttgcaggctatgaatgatctcgctgggaaaatattgaaaccggttgatcccaacttcttagattacaaccctcagattctgcaagagaatcctttcaagcctttctaccaatcagtgggagctgtcgatggcacacatattccagttctgcctaatgcagctagcgctatgcaacacaggaaccgtcaccacataacaaccagaaatgttctagtaatatgtgatcatgatgggagaattattttctgtgatgctggctggcctggatcagttcacgaccaaaggattctcaatgaggcagtgcaggcttacccctacgatttcccacgggtaccgttaggtgagttgtatcggtcaatacacttttttttattgccaaatgtcttgattttatttaattctatacatgtgcactaatatttaattatgcgccgttaaccaggcaggtacctacttgtcgactccggatttcctaccaggatgggcttccttgcaccgtacccacatgtacggtaccacagggatcaacttgcggtcgagggagccccgccacccgtaggacgggaagagactttcaaccatcgacactccacgttgcgagggatcgtggaaagacaatttggcatcgcaaaaaagatgtggaaaatattgaaagaaatcccttattaccgagatgacgacatccctgcacgcatcattcatgcagctttcgctctacacaactttaggttggatagtaaagatccgacctatcggttcactaatgctctctacaacggcaatccagtgccgctgctgaacgattcattcgaccatatgtattacgcaacaaatagcgaggccgctatgtgcatgttgcgtgactgtattgctgatgatgcgtacaataactaccattaggtaggtgatgttatccataatgcttgtcgtatgttcagtacttcaattttcaggattgtatggtttaccatttatttatgtccgaatcttcacatattatgaaaattattattaaagaaatcacatgtgtgtgcatatcaaatatttctttcacaattggtgccgcgtagcaaatatctctttcacccgcgtagcaaacacccattaattcgcatgctacagtacctccactgccagcccctgcccggcatcgcacggcacggcgacggaaagtgtcggccatagacggcgtccaggctgccgctttcaatattttccagtgtctctgacgccctgacactgctacagtggtctacagtactacatgttcccaacccaaaagtcaagctccgatccggcacttgcgaacgaaagtgaaataaaattgctctaggcaaactcacctgtgacgggctctatctgtagggccgtcacaggtgacctcacggttggcgcccgtcacaggtgaggccacctgtgacggccacatagttggcgcccgtcacaggtgagtttgactaggcttgacctagggttggacatcgatccagatccggcacccactctcactccactctcatctctcgaccgccgcctcgcccctatcgacctctccgctaccctctacgccctcctctccaccggcggctcgacctcttcaccgccgccctcgccggcgccaaatccggcgacctctctgcgctcaccctctccgtcgaccttcccgacgccg

SEQ ID NO: 48574 - DNA, 1519 bp, Oryza sativa
  unsure (1)..(1519): unsure at all n locations
ccatcacagaatacagaatgcatggggaattttggtggattggtcagtgtagtccaaggccggancccgccctagncnccaaaattctccatgcattttgttttctgtcattctttgataatgaaggaactttattaggtttagggtttgaaatttatatacccttgttgatagattggccacagattacctacacttgttgatttatatacccttgttgtctatgaataggtgaattgcatgaattgttgtttatatacatgatttatatacccttgctgtctatgaataggtgaattgcatgaattgctttttatatacatgatttatataattttttttgatgccttgctgtctatgtttgcccatgctgctgcctatggttgcctgtcattttgttttctgtcattctttgatgatttatatacccttgctgctgctgcccaatgtgttccttattaaatggccagtgatgaattgctcaataagaacagattttgtgcacttgctctttttttatgcataagaacatattttctgcacttgttcatttttttatctacaataatatatgcatgatttatataccactgctgttgttgcccctgtacttcttgttaaatggccaaggatgaattgcttaataacattctatctatacctgttattttctttatggataagaacagattatctacacttgttgatttatatacccttgctgtctatgtgaatttccctctgctgttgctgtttatgtgaatctccccctgctgttgctgcccctgtggcatatatacccgtactgatgttatatggccctgctactgctcttattgctgctattatatggccatgctgttgctactgctctaatttcctgcacttgctcttttctttatggataagaacagattacctacacttgttctattttctttgggttgcttttttctcctagtagctgatttcctctttttatcccttcatgcaaatgattgtaattgatgcatatttctcagcaaaactgaggccatatctttcatagtataccccgtattacattggatctaatgctatttagtctaatggtaggaaatttataatctttttcgcgaaagttaaaccatgtcaacgcccggcgcaaacccaccctccccaacacctgcgagggtccaggaagaagcaaacccagccacagaggcagttgcagaaggtcatcccgcgacaacggcggtccaacaacacgaaattcatggtaatttataggataaattttcaccacatgaccacataaattttagctagcaccccttagcaaatattgccttctgtttgtgctgcagaattgccgcatgaacaacatacgtcgatgtcgggcgggacaagtgcaagtaggtctagtagaaatccgcggtcacataatatatggccgaccacagtgcaagttataagagaggttgacgctagtggtaggcccacggcgcccaggactgtcattggaagatggtctaactgc

SEQ ID NO: 48575 - DNA, 22225 bp, Oryza sativa
tccgagtttgtaacccgcccggcaatcatacgccgttcgatgaataccctcaaataaccgaagcggtgtgggaggaattctgctctctcaagaccacccaacagtttagggaatcaagcgaggcacatcgcgtactgcaacagcggaatgagcacccgcatcggctgggcaccgcagggtacatcggcaaggaggcaatatgggcccaagaagatgcagccgctgcagcagcgaatgtccctgccccgttttcagacatccctgaacaaagagctcgcaactgggcgcgggcaaggggtaaggtcaacccggacggctctgtcacatttgagaacaaaagtgatgccgtcgtctatcaggaactggtgagttcactacttaacctaactaatttccgttcgtataaagtacaagttcgtataaacgactatcttcttttctagttgggcttggttgctgaacaagcttcacaaagcgaggttgagtccgcgccgaagaggcgcgaagatgacatcctcacaaaggcgctcggaaccaaagaacatcctggccgaactcggggaattggtagcgatgtgccctggaagcatggactccctcagtacagatcccaatacaggaaacggaaagtctccaaggaagagagggacgctcgtttgaaggccgaacttaaggttgaggtcattcaagaactagaagctagcatggatgcaagggtggaagaaagggttaacaaggtcctcgccgacatgaatataccccgagtcacaacacctgctgtgcaaccaactcctcgtgtacaacacgacgcgagtccgtcacagcataggagtagttgtgcatccacagaggtgccggcccctggtctccctatcgcaccactagctgcagtggaccacatcgaggtaattgttgttatccgatccatatgtaataaaagacatgtacacattccaatattaaattcaaactttcaccttatgcagggcgcagcacaatgtgtcctactagcgagagtccacccaactttcgctcctgaagtcgctgagggcatggctttcaagccctctgttacagacaaggtccacggcgcagacctgctagctgggtatgccaaggtgtccatcgatacagtaaaggacacctggtccggctatccgctgcccgtgcccccaaatgatgaaatcatgactttgggcgatgcgcgcaagacgttcatacaatggcccaaagaagacatagttgtgaagatgactcctcgtccaagtcgaccgacggagcttacacctcccaagtctaagctatcatttgaggctccccgtggaccggcattgtcagtacctcattctcccggtggagctgatatggacttggcagatatagctcaaagcttggctccaataaagaccacaagaaaggccgatagctccccaccacttgtcaagggccagaagcgtgaacgcggcaaggggaaggtcggggagttggcgccggagccaaaaaggggcaaggctgcgacgtcgatgccggtgagcaaatcggggaaggtcgtgagggcgccagcccaatttgagctaggcatgccattggtggaggacaatgtgttagctgtgatgggtattgcttgccgagagctacataagcaatacatggagctaagcaatgccaagcggaaaatgagggagtcatccatagttggacatcacgaccaccagccgttcctatcgtcgcctgtatatataactctaggctttgatgacctcttcgaccttttcaggatccggaagttggacactggtcttctaaaatgctactccttgtaagtgcataccttctatacttgtgatatgactggactatatctcctaattaaattagttctaatacgtacatattttaaggttgtgttggatcgagagtcgtcgccatggtaatcaggttgggttccttgatccatccatggtgaatgaggttaatttacgacagagcttcactgaggtggttgactatgtcaaccggtgtttatgggcccatcaagacaaggagtacatcatgtgcgcacacaaccaagagtaagaggacaatacccttcgtgtatattgtttttgaagttaaggttcttagtactaacgctacataaccactgcgcaggcgacattggattctcctagtcatcgtacctaagtggagtagggttacctaccttaactccaataagtccaaagattatgatttcagtgaaatcaccaaggccttaaatatggcttggggcccatatgtggaaaagggtggtaggcacaaggagggcaagaatgaactttatcatgacaccaagtttgcatgcgcacaacagatcggagaccaatgtggtttccacgtgtgccacaacatgtcaacacttgtaagagaggtgaaagatttcgaccctgaggttgttgctaatggcgaataagctcatttcaatatctacattgctattcaaaacgtgctaattaacctcttatttattaaacagaaaggtagagctggcttgaagatctcacccatcaacccccccgctatcagaggcgaattgtgcgcctttattcttgcagaaataatgaacaagaaaggacgttttcatgccaaatagactcatgaacttggctagataatttattgtgatgtaaaaaagatgtttttataatttctggcgatgtaaaaaattatgtttttcatatgtgcaatatttatggtactttactaaattgtcatcacatttgatcaactacgatttatgttgtactattcatctgttttctccttttttttttccttattgacaggttgtgcaggtcgatgacattatggctttaatccatttggtaagtatatatgcggttctatgagcaacgaccgaaattgtggctttcaaggggtgtgaatttgctgtgcaaaattgtggcatttgaactgcatatatgtgttgttggggatctgtgatgttatattgggggggtgatgtatctgtgatggatctgtgactggaatatatctgtgatgtttctatttttcagagggcatggctagcaaatcctgaggctagccaatatttagcatttattttttttctggaattaactcatcagtgacgggtcggaacaaaaatccgtcaaaggtaacataacctgtgacggactagcaaataaaggcccgtcagaggtgacctacctgtgacgggcctttacttttggagccgtcacaggtagatcacctgtgacagcttctaactacggagacctcaacctctgacggcctttatttaaagggccgtcagagatgagtcacctgtgacgggtcctaactcgctcaaggctagcggagaccaacacctctgacggacttctagtaacttgcccgtcagaggtgggtgtcacctgtgacggccggccacccgtcaaaggtgactggactcaccagtgaccactgatcattgaccatgcgcgaagccgtcaaagatgagggtttgggcccgtcacaggtgaccttggccagtgtagtggttatagttttctgaaatttactcatttaaaataaaggaatttagagaaagaagagttgacagttaatgtgtacatgcatgcacgccttatattatgaaacatagagaaaaaatggttgtgccttactccctccatcccagtttagttgtccctgcggggtagctagagtcattgtcccagaaaggatgtcgtttaggcccggggcagctagcaggttagccactagctagcatgagtacttctattaattttcttccttatgcttgttgcagacatatcagaatggcagacgcagtattagtttagtgtcaatttttaagcattgaaatgattaacataggggcacattagtcatttttacaacaccatattttgtaatttctttgatagaacgactactgaactagaacagagagagtatattttaggatggatgagatattacttatagaaaccttagtggtggcggtgactccaatcctggcacacgccgattctcgaccgttcatcttgatatccaatgctctgaatctctcgtccatacctcgcaacccgcacctcgctgcatcgttttgcggttccctcctccaaaacccatgctccctcacccatcacacccccatcgctcttccccaaaacctaatctcctatatccactattcgccgccgaacttcgacatgcagatcgccgttatgcgtcaccagtcccccacagccaggtcatcattgcgcctccatttatcaaaattgtgcccttcctatccccgctcgctccgcaacacctcgccaattggtgacaagaccccttgcatccttcccacgctcgctcagatccatcacataggtcatcgtcgacttgccactgttcagtctccgttgcgccgccacctgactgtccctggcgattggtcttcctcaccgtcaagcctcctcaccctcacgtcgaggcagggccacgggtgtccgggcgaacaagtgggatgagctcgatggacgaccacataactagggtaaggagagtaggttctgtcgctggcccacttagtctggttcatatatatgacctcgggtagggcaacgccgtctccttctcacaccgatgtcatctcatggtccccatctcacccaggtacctcaggtggtaatgggccagtgctcattggcccttttgcaacccacctcagcccttaaatatttttagataaaaaatctattaaatctcagcctaattctttttgcccaaccctcacattttgtatgctaaaatattaggcctattaccacctcttggtacccctccattacttcagccttcctcttctctcctcttgaatcactagttctgatataataggtgtcgaatatactagtcctatttgattataattggacttggagttgtaataggtggtagggggtgaagttagagtcggactctgaaacccgacatctctcttaaatagagaggggggcaccacaatataactatagcgaccacaatgtaacgtagacacgtaaggaggggatagcggcgaggtcatggactcgtagcggctaggagttatattggttggggatgggcgcccataatcagagcctcggggatgtaggtttcggctgaacctcgttaacaaatatcgtgtgttcatgtgtcgttatcttgtgtgtcttggatgatcaataactgaatcgatcgagaaggttagtcgtcattccgctatatcgactaacatttattacaagttcgcgattttcttctgctcatcaaacttcgagtgttagtcaacatcacaaatctccggtcaatcttcgaggtgtgccatgaatcggagattgcagacatggtcatactgtaccgcctacccctgtaatcgtttaggcgtgttaccgatgtacgttgtttttcttctaatatattaacgtgcaaggtttttgtgcgtttgcgaaaaaaaatctcctgtcaactatgattggcaaatcggaatcatggtatgtttaattttcacttgaggaggataatcagcagtaatttggtaaactggttactggaagaaggaaaatgcgcctattaattcttttgatgtacattcttattagcaacaaaaaactggatctacatattattgtacgaaatgtgcccttctcttttgcgtcaaactgaatttgtttgttctggtcagcgatcaatcggcttacaaacagaagttgataccctgtatcaaacggaatatgcacatcagtcaagagtccgtcaaagttgataaacggtacgatggtttgtgacgtttgtctgcggggataagtccattttacaccctccaactatttatgttgtctaaaatacacccaaaactttaaaaccagatatttcaccccctccaactttcaataccgttcactttacaccctcaggtagtttttcagctggttttcatctacgtggcaatgatgtggaagtctactcagcaaataaaactaaaaataaaaattagagccacacgttagtggccacttcttcccccatctcctcttccctttctttctctatccttcttcctcccagacagagagcagcggtggagctgagcaggagatcggtggccatggagcaggggactcgttgcggcgacggagctcaagcacatccccagccttcccttccgtgccgaccgccggcgagcacgagctcaaaggtctacctctcctgccggctccaggagctccataactccatcttctccatgttcgagctcgccggtggaactcgagctgcttggggatgaggaactcaagctcaacgaggcggcggcggatgtagagcttgagctcgacctcgtcctcgaccaagcggtggcggcgcgagcgcatagggatgactcctccccgcgcgtatggctccggcgaggtcggccacttctgagcgaggcagcaagctcgtgattcgcagcgtcgccgccctcacaccagctccccgccgccaccgccctcgcggctccacgccgacgccgacgccaccgccctcgcggctccacgctgccaccgcagccgccaccctcgcagctccacgcaaccgcagccgccctcgcagctctacgccgccgccgtagctgtcgatttcgcagctccgcgccgccgatgccgcagctgccgccctcgcaccagctccccgccgccactgccctcgcagctccacgccgccgccgtagccgccgcccttacagctccacgcagccgccgccgccgtagccatcgatttcgcagctccgcgccgccaccgccctcgcagctctgcgccgcctccgccgccgccgccaacggccgtgagagaagataatgaacaggggagggggagggagagagagggggagagaatatgggcttggcccatgttaatgttttgcgctgatgtggctagggctgacgtggcatccgatgtggcatccgacgtggcaaaaaccacggtaaaaatagcccggggggttaagtgtccggtattgacagttcgagggtgtattatatccggttttgtagttcgggggtgtattttagacaagcacaagagttcgagggtgtagaatggacttttccctttgtctgcgttacatttgcatttaaccaggttgaaatggtttatgctaactactagcgtaataattctgtaggaaatgaataaaaaccagatgaaacagacctgaactgaacagatacatcatacaggcatacagcagcacctacggcagcagcttggcagtgcctctttttctgtctcgccattctcggaggaacatgaacagaacacaggcgactccgatcacttggagacttacttgaaacgcaatccttttataccaattatgcaacctaaagttccaccagaatgacgtatctgaagaagtggacatgaaattcggatgaagtcgaatctacgaaaactaaaataaaggcgaaccaaaaatcaaagcataaaacgcatcatataggaggtgtttatatatagggttgtaaagtttcgacgtatcaaatcggatattatatatatagtgtcgtatggagtgttcaggcactaataaaaaaattaattatagaatctgtcaataaatagcgagacaaatttattaagcctaattaatccatcattaacaaatatttactgtagcaccacattgtcaaatcatagagcaattaggcttaaaagattcgtctcgcaaattagttgcaatctatgcaattagttatttttagcctaaatttaatacttcatgcagatgttcaaatgtttgatgtagaatggaactaaacatggccatattcataatccaaaagacaagttttgtagagcgagtagagatcactcacgctccttggtgatgcctccggaggacaccacaccatgagcacctccgcatgctccgtgcgctcgacgtcgtagtacctgacgctgcacgcgccgccgccgaggtggaccacggcgtgccggctgtacgggcacagccgccgcgcgcaccggaaggcctcggcgacgcaggcgccgcagtcgtggtactccgacgacgacgagttgcaggaggccgacgcggcgatcaggttcggccgctcgccggcgaggacgtcgacggaggaggaggaggatccgttcatcaccttggctgggagcgtggcggcgaggtaccgcaggttggcttcgtaggtgctgttggcagcgtacggccccggcaggatcccgcacatgtggaacggcggcggggtgtggccgtcgtcgacgagggcatcggcgtcggcggctgacagctgcggcgcgacgagggcgagcacgaggaggaggatggtggcgcgaggcatcgccggaggaagaggtgattgatcagctgaagggaggtggtggcggtggactggtacgtacaggatctgctccagtcttgtagcacatttatatccacgtttccatggtggattgtttgagctagttgttgacattgaccgttgactacctacgaccattgattagtccagaaagatcaacaatggattacattatgttagttgtgttgatgggatcttcttttcatcttcctgatgatgatcaacgtacgtatatatagttaacatacttactttacatattactctctcgatattttaatgtataatactgttgaatttttttatcaacgtttgaccatttatcttacttaaaaaaatttatgtaattataatttattttaaataaatcaacagcgttatacattaaaatacggagagagtataatactagcaactcatcgggtttcaactagttgttgatgggatcttcttttcatcttcctgatgatgatcaacgtgcgtatatgcagttaacatattttaccgattagtacaatactagcaactcgggtttaaagaaaagaaaaatactagcaactagttgatgggatcttcttttcatcttcctcatgatgatcaacgtgcatatatgcagttaacatattttacagattacaatacccaactcgggtttaaaaaaaaaatactagcaactaggctatacgcaggacccatcatttctgaacgaaactactcgcaccgtcccaataaaaaaagatttggtttttaatggaatggatggaatacttggttgcagttttacatattactatccggttattctaaaagacatggctacctataaaaatgtctaaagaatttttctaaaaaatctttcaaatgtaattacagtgtaacaaacattttaataactcgggtgtaactatgtaactaatatgtaactcgtctagtactataacctttcagaaacttgcgatagggagcaaggtcctgagttcgatcccctgcaagcgcacaagctaattctcactagaactcttcctactcggtttgccttcaccgttcttggattggctgggccggtagccacggcgcataggcccagctacttgaaaaggcatgataggtgcgcacattttaaccgagaatgctaattcacgcacgcgcgttgccgacgcacacttccggcccacacggcccacacacgcgcgtttcttttcttttttttttaacgcaagctaccgctatttcttttttttttcttttttcgcagttcgctgccgcacgggtaggagaaaaaatcgtaattagtttactaatgattagtttcctatttttactagtaatttttaaatcttaacttaaaattttcaaatttggacttgaaagttttcgaatctcgagttgaaagtttttaatctcgagttaaaaattttcaaatctcaagttgaaagttttcaaatctagacttgaaagttttcgaatctcgagttgaaagttttcaaatatcaagttaaaaattttaaaatctcaagttgaaagttttcaaaattttcaaatttggacttgaaagttttcgaatctcgagttgaaaattttcaaatctcaagttgaaagttttcaaaattttcaaatctagacttgaaagtttttgaatctgagttgaaagttttcaaatttcgagttgaaagttttcaaatctgagttgaaagttttaaaaatttgactctaaaatttaaatcttaagtcgaaagttatcaaatctaacttaaaaatttttcaatctgttagtaaaaaaatctcctgaaaaaaatcttcacaatcttttctaattactgtcattagcgttaactaacggagttagttacgccggaagtgtgcactagaggcgtgcacgcgccttctagctttcccccattttagcaggaccaaccaagtctcccaagtacgaaaaatgttaactgaaagtgcatctaggcccctaataattttgatgattaattacaatgtgattagagagaactaacatttttatttaagcaaatgtgagggttgttatgtcctcaatgaattagcataatgcatatcccgccaaatacgttgatgagatgtgatgtggcaaaggacaaatagtatattgtaacttttcttttcatttgagtcaataggaaagtcgcactattaagagggatgatgcattgacatatgaggagtgatcaaagtgctcaaaatctatttttaaaagtgtttctcctcagtttggtgtgttctggattttttcggagttttccaaaactcattttcggactttccgaaaacacacagaaccaaattttcgcttctggaaattttcggatatgtccaaaagtgattttcggactttccgaaaatgactgcgaaggcaaaagtggttctgtatattttcggacttgtccgaaactgatttttggattttctgaaaatcatcagtagagtcaatttcgcttctgtatattttcgaacttgtccgaaagtgattttcggacttttccgagaacatccagaacgatgttgttgttttcggacttgtccgaaaagttttcggaatgtccgaaaaatacttcgttgactttgctgtcggtgctgagctggaattttcgaacatgtccgaaaatctttcggaatatccgaaaatctcaattattgtgcataacgggcagaatttgggctgtggctataaatatccccctcccctcacttgtgagggctgctggttccatttcaatcatttgtgcccttggcttgctctctctctctagcccttttgagccttgctttcttgtttcccctctcacccgtgttcgatttggattaggtgtgtgtgtgagagttatggattcgagttttgtgagtgcttgttgttgacttcgtgaagatttgtgagcacttgcatcatctccgggagttctttgcttcatttgttactcttggaggttgaggactcctaggcggctaggtgtcgctcccgagccaccgatctacttgtggttggccgggagaagtttgtgaaggtcggatcttacctccgaaagggaagagatacccttagtggaaggaggagtgcttagtgcaaccttttgaggaaagggttagctaagacccggctcttagtgagctcctcaacggagagtagaatcccctcaaggattcgaacttcgggaacaaccttatgagcttcaactttggtgactttacttcctccctctccactagctttgcttgtttgagccgctataggtctagttgctgtatgtgctagcatattcttgttgtaggcaactagatctaggatttactttgctatttgtgctgactccgaaaaattttcggatatatccgaaaatttcggaaatatccaaaaattactgcttccgtttttaattgatttttaaattagcctattcaccccccctctaggcctaattgacactttcaacccattccacaagcaagggaaaatgtatatctgaggtctctcatcttgtcaccgaattacaaaattgtccctaaacccaaaaacaagatactccctccatccacaaaagttacacctatttcacatttaagtttttccaaataagttgtttctatttatagtctttatacattcaagacttaaatgaagagataaattaaatattttattagaacctaaggagtcatctaaatactcattggttgcatgcttgcattcactcattgattttgtaacatctaaggtgacttaatttctccttggtcttagtgtcaaaagtaatatgtgtaacttttatggatggagggagtatatggcatcccttaacttataaaaccggatcactctgagtccttagacaatattaactctggttgaccctggttttgtccgacgtggcaactgagttagtgtaggacccacgtagggcccacatgtcagtgaaaccttagcttctttataccctttcccctctccctctccatctccctctcttcccccaacatgtgatgtcagggacgattttgtaattcagtgacaagatgagagatctcagatatacttttccacaaccaaataagaaataacggcccatatgctacgagtatatgctctgatgggctgttctgggcccagattgctaggatagaactccgcctacaatagacgaccacaaagattactggaaaaagtccatttgagtccctcaaatataggtcggatctgatttatatcttttaaccgtaaaagcgggtatattgatctcttcaactatttaaattgtgtaaaatgactccctcaactattgtgaggatggtttcagctgacatgatgtccacgtataacccagtcatcaaaaaattaagaaatatgatacccacatgtaaatggctacactcatctccttcctcattcactctctcctctctccccctttctcccctcgaggcaacacctgctacacctacaggtagcgcgaggagggggtcgtcacccaggtaacagtgaagagggccataggtgtaacgctccgcttttcgtgagacgttaaaaactaattcggcaaaatcctaattgcgaaaattttcgttctttttgtgcgagtctatgtcgtgccaagatctcatttcaaatcccgttgttccctctcatcgaaatcaaaatcctccacctcaaattcctcttccgattcaagtctccaaatcaaattccgaaattcagtcgcatcctttgaatcctcgctaaacgctcgctcccaattcccaaaaatgccaaactctatcttgagccttccttgattcctccctgaaccctcgagtttgaatatcgaatttgaatccaaatccaaactccaattctctccaaatcagccttctctatgaaagtctattttacctccctctggctcggtgggccgactcttcttccccggcccatctcctttcagcccgctcccctcctcacgtgcgttgcacgtgccctgcctgagagaaagtgcctctctctcccccgatctctctctctcgttttctctcgctctctctcgcccgcgctccgcgctgcttctttgtcgttcaaacccgccaccgccttcgctctttcccgcgcgcgcgcgcgtggccgaccggccggtcgctgccgccgtcagccctgccgcgcctgcgccgcgcagccgcccggccccgctcgccttttgccgacgtcgccactgtcatcgcctggctccgatgcccccatgccgcatccttccaaaaccaggagacagagctcgtgctcctctctctcattctcacatcctccttcctcccaaaatagcaagagagcaaagctcgtttccctcctcttttcacctttttccttagccagcgtcacgcccgtgaccgcctctgccgccgattggccgctagctccgagcacgaccgccagttgtcgccttgaccgccccaaggtcggtttgaaccgacctcccgcgcgaaccgacctcgcctccactataaagccgagtccctcctctcaatccctcccgcttcagtctccaccgctgcagtgccatcgccgccttgctgccgccatcctcgccttcctccgccgtcgcgtgtgccgggaagacggcgtgcgcgcggagccaaagaggactctggtcgccctctctccctccccttccccggcccgagaccgaggtgatcccgcctgtgctgtcggacgctcttcccggcgatctcccgacgcggtagcccccgttctccctccctactcttcctctcccccctagcttgcgcatttgctagcctagaccttcccaaacgcgcgtggacgctgccccgagccccgccgccgcccggcatggcctcgccgccattgccgtccgctcccggaggccgccgctcgtcgccggctctcctcggtgctcctccgtcccatccggtgccagaaaaggattccttgaaccccggatatgctctcaccaccgtgaatcgatccctctcctctcccggcgagttttcctctttccctcaccggcggtgacctctgccgtgattcgtcgtcgtcggcccttccccttctaatccgtcccgtaggctcactcctcctcgatccgctcgtcgctccggtggtattccctcctcccgccgtgcctcgcaccgccccgccgacgcgcgccgccgtccgccgtccatctcggccggccttcgtcttcctcctctcgccatccgacgcgaccgccacgtaggcgccacgtcggctagaccaagtcaacccgccagcctcgtccccgctcgcgtgcgctcggtgcatggagagcctaacggctgcgcgtgggcccgccacccttcggtccacccggtgcaccaaactgcgcgccactcctatccgaacactagcgcgcgccgcatgcaccgctcccacggtgagccgcgccaccgacaagcgggccccactcgggaccccacaaggtggactcggcccaccggccctctctctccctcactctccccgcgccccttgggccgcctctccgggccggccggcccattagttcggccgagccgcgcctctcctctcgggccgcgcccaagccgcccgagggagtctaaatcacatccctccttcaatttctttccaaaaagggtttaataaattattaagtcctttttcctttgattagtaaatccaataaacttcgaaaatccatatattcccaaccgctcatccgattgaccccgttccacttccagtaattccgtaaaattgagatctatttaatggcactattatttagtctaaatagggtctttttcttggtcttttgtctaggttttcaattgtttgcgtatagttgtggttaccggatttccgtcaaccgcgggttttctcgaagattcgtgaagcttcgtgaagactttgagcaaggcaagtcaccctttgatcaattgctcctataattggaaagtcattattattttgtttgcaacttgcttcattagaatcactcacgtttaacttgcttggcctcggtttgcatgccaaaccgacggacctacccagtagtcgcactaattcctgtaggttgtactaccctgattccttgttgctccacccttgtggtacttcggtatccgtgctctctgagcgcgcataccaaatatcccacatacaccgttgattgtcgaaaacttgggaaatgggtttgtgaagccttgaaaacccgacatgtggtgtcggtgtgtttgaaaataaaatgaattgcgaaaactcgcgatgcgggagccgtgcctacgtggcgctgtcccgtattcgcatataaagaccgattcctgtgggaaactcatcgagcataatcaaagtgcaaccacaaggtggaatgggacaccctggctaagtaactagtcggttcagggaaacctcgcatgccaatagttgggaacgccggggcggggtcggacaaaccgggttcctggtaaggcaaggatgagaagcttgctcacttaccgatcaaggtggttggaattgatttgtgaatgcttaaaatggcctatacttacgtgaggatttgatccttctatgtggcatgaggtaaccctgggtcggcttgggaaaggctttgtcgcgagcctctgacaccggccagtgtctggagtaagttcgtgtcttgtgggtaaagcgtacccctctgcagaggttaactaactgttcgaacagccgtgcccacggtcatgggcggatgtgaggtggttcccgttgcgtagatttgattgcctgtgctttgtgaaaagttgttgtggtgtgggaatcgttaccagaatcagcctgaatggcagatggatgacctgagtggtcggaaacgaatctgtgtgattcgggatgtctgcgggcatcatagactaggcttcctgagtggaagcggattgttgtgctgctgggcagctagactctgggagtccgagaaaatgaaaaaggctctgggagctgattaatcaagtgaaatggctctgggagccgataagtaatgatctgactcggggggtcggtacattaccatttgagttgttgaaaagcatctcttaagtcgaatcgagacgcaagtctccttttcgacccaaacttaaaaagaaataaatcacttagtgatttcaaaaatgattttaaacaaaggatttgcaaaacaaccttgcctctcttccaagcttgcattaaacacctaagttcccgtgacttgctgagtacgaaagtactcacccttgctctatataaatatatatagttcctccgtcctgaagctgaagatgaagtgaattgaagaatagggtttcgtcctggttcctagccgtcgcctgtggtgttgggtgttagaccattggttccgctgctgctgctgttgctggtgtttcctcgtctgtgtcttcggttgtattctcaggctgtcctgagctgcaacctaagttaaggtaaataagtcctctatttattttaaggatttgcaatgattcatatttgtcaccgtgggtaccagcactatgtcctggtactggtactgagatcgcggtttcgtaggaagcggttcgcgccgttattcctacgacacgctcctgtcaggcggcattgtacggcggtgccggattggggtgtgacaataggggtggcaccttggttgatggcgtcctccatgccctgtagcatttggtgaggtcaacatagtgattgtggccatgcaaggtgagggaggcgttgtgacaggaagttgaatgaatggcaggacccatggtcggtgtagtccttcgcttgggacgcaacagtgtggactacctctctctatccatattctttttccaagccgccttccatatctgcttgatcatgagggggatcaagtgaggccaatgacaacattgtgacaaggagtagacaccggcgtacgtggagaattttgtgttggatctgctctaggaggctagttgggtatcagagctccttcaactgatgtcaagccctaaactgtcatagacctctagtctcctgcgccaaactattccatctcgagctcattcctccgctgctacgtcatcggcatggcagagtctacttgttcgacggcgtcgtcatactcgcgctcttgcctgagcaacatgccatcgaagcggaggtaggcgaaaggggatccccgccctttgccctccaccacgcagggcgacggtgagatcgggtagcggcatgggaaagcctcgcctatttgcgtcagacgccgacgagcttgagtgggtggggagagatagagaggaagatgatgcgttggcatatgaaccccacatgctgagtcagccagttgaccagggtcaatgagccaccttagccaaaatcgctctcaaactaccctgggagttaaattattctggtttaaggctgcgttctttacctccggttcccaactttcctccctcattttccgcacgcatggttttcaaactactaaacggtgcgttttttgcaaaaaaaaattctatacgaaagttgcttcaaaaaatcatattaatccattttttttaaaaaagcaaatagttaattaatcacgtgctaatcgctcatccgttttctgtgccagggagtgagggttcgaacacagtctaagcaattgaaggagtcgttatacctggttttacggttgaggaataaagatcagatccaacctacagttgagggagtcatattggactttttctataataaacaataacaaggtgacatcgcaagtgatgcctacagccctacattgatttctgtatctgcatatttatcagtccgcactctccagtctccaacattatacggagtatcagtatatcgccttttccatttgataaatcggaggaacaaggaaacagtccctatcaatttctgaatgtacaatcttgtatggaaatatatgggcccttttcttttgccgcaaatggatttgcttgttcaggatcagccgatcggtcgaattacaaacagaagttgaaaccctgtatcaaatggaatatggatatcagtcaagaatccgaccaagatctcaaagaactctggttaacttgtctacattatatttgcatttcaaccaagttgaaacattctatgatattataacgaacttttcgaattcttgttgggaataaacaaaaccagatgaaacatacctgaactgaacctcccacctatggcagccgattggcctgggctcttctccttctaccgtctcgccattcctggaggaacatgaacagaacccaggcgactccgatcacttggaacaccaccatcatagggaaatcatgggtcaaaacaattctccaccaagatgaagtatctggaaaagaaaacgactaaaatgttgattcggatgaagcaaagtctatctgaaattctggaatcagtactgaattaaggcgaacaaaatcacagtataattatatctatcgagctagcagtagcagatcactcacgctcgtcgaagatgcgaacggctaatgaagcttgtatctccagctccacgcgtccgacgtcgtggtagctgacgcggcaggcgccgaggtcgaccatggcgcgcctgctatacccgcacagccgccgcgcgtaccggagcgccttggcgacgcaggctgtggatattatgggtaccccatacccacagggcatggttatccgactagttataggggataacttatatctatgtaatatgtaacagatcatgacttgggtgttacgtttccttgtatattacggaacggcctaaagtcctgatttaggaaaccgataccgtattggttaaggtttctatcttgtaatcctgccccccatcctatataaggtgggcaggaggccctctagggggcagatatgacataacctgatcgtcagatcaatacacacccggcggattcaaacccccaaacaggagtagggtattacctctcattgagagggcctgaacctgtctaaatcctttgtctccgcatccatccacttttaggtctcgtgcgctaccccttttattattgccgaaatcatgtttcgacagttggcgcgccaggtaggggttgcgtcgagtttcctatcaacaagcgcgatggaatcaatttcatgagtcgccgacttcgttttcgctttgggagttttcacttcctttccgtcgaccacttcttcaagctcctcttctctgacttgatccaaatcagtcagggggaaactcaatctgatttttatcattatttatcgtactgatttttaatcccagattaatctcttgctattttttgttgttgttcgcatataattacgcggcactattgaggcgattgatgctggtcatagactcgaggcgtctcagctttccggtcgatcggccgcgagtccactctgccggcttgtcttcgccaccgccattgctgataacaacaacgacttcaccgccggcctgcctccgtcgccgccgattggtgcctccgcctacacggctggcctattatgccgccgctgttgggcgtctacgacttcaccgccggcctgcctccgtcgccgccgattggtgcctccgcctacacggctggcctattatgccgccgctgttgggcgtctacgacttcaccgccggcttgcctccgtcgccgccgattggtgcctccgcctacacggctggcctattatgccgccgctgttgggcgtctacgacttcaccgccggcctacctccgtcgccgccgagtggtgcctccgcctacacggctagcctattatgctgctgctgttgggcgtctacgctttcaccgccggcctgcctccgtcgccgccgactggtgtcctcgcctatacggttggttggtcacaccaccgttcatgggcgtccatgcctccgcctacacggctggcctattatgccgccgctgttgggcgtctacgacttcaccgccggcttgcctccgtcgccgccgattggtgcctccgcctacacggctggcctattatgccgccgctgttgggcgtctacgacttcaccgccggcctgcctccgtcgccgccgattggtgcctccgcctacacggctggcctattatgccgccgctgttgggcgtctacgacttcaccgccggcttgcctccgtcgccgccgattggtgcctccgcctacacggctggcctattatgccgccgctgttgggcgtctacgacttcaccgccggcctgcctccgtcgccgccgactggtgcctccgcctacacggctggcctattatgccgccgctgttgggcgtctacgacttcaccaccggcctgcctccgtcgccgccgactggtgtccccgcctatacggtcggttggtcacaccaccgttgatgggcatcgtcatcttcaccgccggcctgcctccatcgccgccgactggtgcctccgcctacacggctggcctattatgccgccgctgttgggcgtcttcgctttcaccgtcgaccgccttcgtcgccgccgactggtgtcttcattgttattgatggacgactttgttcccacattggccacttctgccatcaccaaggggaatattacaaagctaagtcatcatttattttattctttatatgatatttttccttttcctctgcctcactacaccaattggtcttccattgagtagtgagtcgggggctacagatgttatatcatattttttataatatttatcttgattgcttgcgacataatctgagtacaaaagtacctatcgagttatggagttctatcttcctatgctttccgtttggtttgccaatggatggttgcctttgggccgattcctagcacccgggggctcgttggatggaccgagtaacgcaaggtgctaagtattattcggaataaatcaaaagcatagagatgagataaatttattttctgctcttaataattgcaaaagtacccgagtagtaaactccgatccgtgaaactttgttccattaatgacgaactcatgtcactcatatgcatgtttgggaagtgcttaggccgactcccagtgcttggtggctatgactagttgggcagagcgtttaaacgtaatgagtcatctgctcggggaaatcaaaattgacaagaggagaaatacatatttataaatattttaaaatacttgattttttctcgagtattatatttatatcagatactactcatcctatatgtttgttctgcaggatccagatccagatatgcataaaagggattcatggctttaagcttatctcttacgctctaggaatggatcagtcagaacatcaccaccggccgcctcgtccgccgccgactggtgttttcgcctgcacggttggcctattatgccgccgttgttgggcgtctacgtcttcaccgaccggcttgccttcgccgccgccgactggtgtttccgcctgcacggctggcctttatgccgccgttgttgggcgtctacgtcttcaccgaccggccgcctcgtccgccgccgactggtgcttccgcctgcacggctggcctattatgccgccgttgttgggcgtctacgtcttcaccgaccggccgcctcgtccgccgccgactggtgcttccgcctgcacggctggcctattatgccgccgttgttgggcgtctacgtcttcaccgaccggcttgccttcgccgccgccgactggtgtttccgcctgcacggctggcctttatgccgccgttgttgggcgtctacgtcttcaccgaccggccgcctcgtccgccgccgactggtgcttccgcctgcacggctggcctattatgccgccgttgttgggcgtct

SEQ ID NO: 48576 - DNA, 18417 bp, Oryza sativa
cgaatggtgtttccgcctgcccggtggcctattatgccaccgttgttgggcgtctacgtctttaccgaccggcttgcctcgtccgccgccgactggtgtttccgcctgcacggctggcctattatgccaccgttgttgggcgtctacgtcttcaccgaccggccgcctcgtccgccgccgactggtgtcaccgcctgcacggctggcttattatgccgccgttgttgaccgtctacgtcttcaccgaccggccgcctcgaccgccgccgactggtgtttccgcctgcacggctggcctattatgccgccgttgttgggcgtctacatcttcaccgaccggccgcctcgtccgccgccgactggtgtttccgcctgcacggctggcctattatgccaccgttgatgggcgtctacgtcttcaccgaccggcctgcctccatcgccgccgactggtgtttccgtctgcacggctggcctattatgccgtcgttgttgggcgtctacgactccaccaccggcctgcctccatcgccgccgactggtgtttccgtctgcacggctggcctattatgccgtcgttgttgggcgtctacgactccaccaccggcctgcctccatcgccgccgactggtgtttccgtctgcacggctggcctattatgccgtcgttgttgggcgtctacgactccaccaccggcctgcctccatcgccgccgactggtgtttccgtctgcacggctggcctattatgccgccgttgttgggcatctacatcttaatcgccggtcgtctcgtctgttgctgattagtgcccttacctctacgtctggtttatacagctaccactactgatggacatcatcatcttccgtcgccgactgattatgccgccgccgacttgtgcttttatcttcacaactgcgcgtcttcactaccggtttgcttctgttgccgccgacttgtgttcacttcattacggcaatacaactttgtcatcatggtggagcgacttcatctttattatcttcggcaccggcaaactctattgttgctacttcgcaagttttactacttcaccaaccacgacgtctttgtgaacctcgacatctcggcatgcaatgccatgttattttactacaacaagtggctctccaatattcaggatttctacttggacatcttcaacacatatcttcaatcaagcaatgactattcgacgacaagaagctacagttctcgactctatgttcagttgtttcccaactaatcaaagagtcaggggctacacaaatataaggctcaaaatttgacaaattttatgtcaagctgaagaaatcaattcatcaaccaacgagtcaactccaggagtcattatcttcatctttgcttcggagcagacattctacttcaacaacttcaaatatttcggtttggacgagttggacaacaacaccaactctcctccaagtgaagcatctacaacagctataacattaatttgatggattattgtcactgacatcatcaccagcacctctgcttcatcggccctgacatctccgctgttgctaatggatgattatgttttcgccgacttattatttcaccttcatggttgacctactatgcaaatgctgatgagcgtctttgtcattatcattggttgctacactgctattggctggatcaccaacatcgtcatcttcatcaacatactgtcaagcctcttcaacattgcccactctactactgtttgatgagcaatttcgtcatcatagtcgatcatctctgttgctactgacggttgcctttgtcgtcgtcgactattttcttcattttcatgattggtggatttcgttattgcctttgatacgtgtctacatcttcaccgtcggcttgctttcgtcaccaccgactggtatcctcgccttcacggatggcttattatgtcgccactaatgggcatcttcatcttcttcaccggctgcctcatctgtcaccgactgattatttcgccaccatggccgctcaattttgtcgatgttgctggatgccttcatcttcactgttggctgacttgtctgctgccgattggtttcttcgcctccacggctgtgcaacttcattatctttgattggtgtcactgttttttactaccaatgacatcttccgttacttttgatgagcaatttcgtcttcatgttggtcatttcatctccatgccgactgcgtcagctattgccaataaacaattttgactatgacagaaggacaagctatatgctcaggggctcatcaactcaagcgtgaggattatatctccaatttggacttgttccggatacattccacatggattcatagtcatgagtctattttctatgctcaaagactggaccaattattattccccgtaagggctatcaaccgaatacttgcgccagtcgggattcaattattatatttattttggagtatcccataagggataatcatttagatcagaagctattcatatgagctacgcttgatctatattacccggaagatttattactcgggagcatgttatatgcgtcatcctttaaagggtgtcgaaggcatatgttttggcctaggcctaatatgtctgcagcccatattttcaggtgtggcctgtcacgttcttttagggacttaggcacttttcgcttaggccaaagtgcgcgtgatcaagtgcccaataccttaaaatccttttataccgcagttactcgactttttaggagttggtacgatgcatcttaaaatgtgtcaaacagtaaagctttacatagctgccccgctgacttttttatatagtcaaggtgctgtttgggtttatcaagcaattgattggatataatatcattgctttttgccacgtaagtgtgcatttttattgaccaatattatggcttaggctgattatatattatggtcatttttctaggcggttggtaaatcctttatgagtttatttactcggattttacaccacatatgccatatatttccaggtgtggtgaaaccatgtgtcttctagggacttaagcacatctgttaaagcagtgtgcgcatggcgtatgcccaatactttggaaatttctttattcacaatatacgagcttttttatagctattttggtatatcactcggatcatgttatttggaggattcacaccgcatatactatatattgatatcaagtcacttggttgattacgattatcaaaaccacttggttggttggattatttattccttgactatatgcttggtttgttcaattaaccacattgtcggggggctacacctattaggtgcatctattcgatgcacctgactttatttttcagccctccacagtcttcagatttggtaaaagtactcgggagaccatgacaaagatgattgaagcactcggctttggagtaatctggttcgagagaagattatcttttcgactgcgaaggtctcaggggctactgtggatattatgggtaccccatacccacagggcatggttatccgactagttataggggataacttatatctatgtaatatgtaacagatcatgacttgggtgttacgtttccttgtatattacggaacggcctaaagtcctgatttaggaaaccgataccgtattggttaaggtttctatcttgtaatcctgccccccatcctatataaggtgggcaggaggccctctagggggcagatatgacataacctgatcgtcagatcaatacacacccggcggattcaaacccccaaacaggagtagggtattacctctcattgagagggcctgaacctgtctaaatcctttgtctccgcatccatccacttttaggtctcgtgcgctacccccttttattattgccgaaatcatgtttcgacacaggcgccgcagtcggagtactccggcgccgccgacgagttggcgccgcagaaggccgacgtggagatctggtcgggccgctcgccgacgaggacatcgacgccggaggaggaggaggaggatccgttcgccaccatggctggcagcgtggcggcgacacgccgcaggttggcctcgtacgagctgttgggagcgaaccgaccctgcaccatcccgcacatgtggaacggcgggcggtggccgccgcgccgtcgtcgaggacggcggcggcggcaagcggcggcgcgaccagggcgaggacgaggaggaggatcgcggcgagagtcatcgccggagaagagataattcagccggagtagtagtacaggctgctccagttcagtaggtatacatagataagcggggttagtgttgactttgaccgttgactacaaacctccattgtccattgactagtcagcagctgccaactaaagagctttcacaatgcattatattagttattaactcgatcacttttgatctttgcaatgatgaacatgtgcatatatactccacatatactattcctatagacaaagattcgtaacctttgggttgcacatgctattgctagatattaatattttagtagtattttaaacgtgttgtttactttcaaggctgttcatattaaaataagagttcacatcagttacaacttaccctctctattttaaaatatagtgtttttgaattttcatatagtcatcaagatcctagtttgacagataatatttataaaataagttattttaaatagaatcaccattctatttctagttgcatgatttatttcatttggactctacacacatgatctacgttcacgacaataggatctaacaaattaatggttagatctttctaataaaagtagtagcttcttagaagtaactaatctaattagtatatgtctgtatagatagatagatggatggatggacacatatatcttaactcttgaaaagagaatcccaaaacataagaagaatgagccatatcatctaataaataataaccgttagatcaacaagcaaacaaaacaagagaataaatttcagccattggataaaagagggtgttatagagctttccatgtctccatatgtgggagagggatatagagcaacgaagagacgcataagaaataaagaaaaaatgtttgtatggttgagagaaatgataaaaacatatatttctatcttaaaacaaacatatattttatatattttcacaacaaattcttcagtgacataatatcagtaatagattattcttaaacactaatcagaaaagatagtgatagtcacacgcatgcgcgacttcatgcactagaatgcaataaaagatgaaattagagatatcaatataatgaaataacatacatgcatggatgccttaatgcatgcgaccacgatcaggggtatgttgtgacttcggccctgtttagatccttcaaaatgacaaaagttttgccattttgaagcactttttgtcattttggacctaaacactagtagtaaaacttagcaatttggcatttagcatttgctagtccatagtagcaaattgtgccaaaaagtgctttaggactactccctctctctttctctctctctcactttagtactagaatggcaaaagtttaggatgcatctaaacaccaactagtacttttgcaataccaaaacttttgccatttaccatttgccattccaaatggatctaaataggcccttcattgtctgatctctaatttatatatctccacctgacaaacatgggaaaagatgtgccctgtttagatcctccaaaatggcaaaagttttgccattttgtagcactttttgtcattttggatctaaacactagtagcaaaagttggcaatttggcatttagcatttgctagtccatagtagcaaattgtgccaaaaagtgctttgggaccactccctctctctttctctctctcactttagtgctagaatggcaaaactttagcatgcatctaaacaccaactagtacttttgcaatgacaaaacttttgccaccaaaacttttaccatttgccatttaccattccaaatggatctaaacaggcccttaaacattcttcttagaaggaaaaagtggctacatctcccatggaaaataaaatatacatcaataagaatgtgccctttctttgtgagcgatcagtcgacttagaaacacacaagtgtaacgccctgtatcatatcaattggaatacgcatatcagtcaacaagcgtctaaccaagttgataaaacagtacggagtagtgatctctggttgttataaaggagagacctgattcgtctacgttacatgcaggtctataagatgtaaacaactcgacatattgtacactatttgtagtgaaattggtagcaaatttgttgggaataaaccaaattaattaccagatgaaacatacatacctgaactgaacttacatatactgatccacatctccaccacctatggcagcagagagcagactggcagggcctctcctgcgatcgggacgccaccggtcgcaggatcgagacggaggcggcgatcttgttgggtctctcgccggacgccggcgaggtggccgaggaggaagaggatccgttcaccttggctgggagaaggagcgtcgcggcaattgatgagggaaaaggaggcgatgtgtgccacctccaaatgatgacccatacgagttagcttgggtgatcggccatgttcggcccagaaggcttacgcaagggcgcaagccgatggcggcagatgactatggcctatgggccatgtggccagcgaattctcttggcccgaggcaacacaatttgttagctgatcgagagcaggtataatagcaggctataagccagctataaatatattttaaaaagataaaggaagagagagaagaacagcggactacagatctgtagccagctgcagcacggattataagacgtaatgtgtgtatgacaagtaggaccagatattaatagtatagtaagcaactatgtactgtaagaattagctattacattggctatagatgatttggagttagtagtgggctatattatcaaacttgctatgagacttcggtgatcgatctttgatctaaaaagccgagactacggaagtacggaactgttgggatgcagaattgtcaataggcaagtacaagatccacccactgtccgcattggagaagaaatgtgagggggcagcagcagcagggcgagacaaaagaaccaaggagagttagggtttagaccactttgagcaattttattgtaccaaaataatttcatgtaaattttggagcttttaataaataaggtaccgagatacactaaataaattttagatatagaaaatatgataactataggtacccttgtaaggactacgaaaccactcttatagtttatataccgcaaataacaaatctagattgccaggttgagatttaattgttgaaattcataccatctttcaaatggttgtttaggacatattttgtggaaaggacttatctgttgagatgatgtctataaacggatcgtaccgaagtgacaaatagacttagctagactcatatttttcactaaatagaattgtgtcgtgagcatgttcacattgtgggcacgagcacagttctttgaggtggctatgattaccatccaacactttaaagaagctgaagaaaataaacgcattttagccaacttagtaaagtaggaagagcaaaactttttaaaaatgtaacgagtggtctttaaatatattagaaagcattagtatggattaaaatataaagaaatttgtagtcctaattttctgggaccatgttatgttatcatatatttattggtaaccatgccaaaaaaattattattattattattactgctgctgctgcagatgagaggtggtggtgggatgaccttgtgtattattttgaaagggaaacacacattgtcccatttttacaaaggggaaaatccgtcgatttccatcagtctgtactgtactgcattattttctgctgacgacaactaccaagctcacacgtgctccccccgcgaataaatcgtcaaccatcatcaagtttcgcttcgcattaacacggcttgaattaatagtcggccgcacgccacacctaacatgggggtgttcgtggcaaaaggaaaccaaccatgcaatcgacaccccaaaccccaatttgcatccaaccatccttgtactttcttttcatccatcaacaaacactgtacgtaccagctttagtcgtacactcttcacacaaaagttgtacaaaagaaaaaaaaaaaacaccctctttgttggctcagccgctcaggtactcatccccatatacgagttgtctctgtacaacgacgtaacatccatacggtgatgcaaccatgccaaccaccactgttgcgccctgcctatcttcgacttcgatcgaccacaagtggagtacactcactcacagatgtctcacgaaaaggacgcgttggccacatgtgaaggccagccagcgaacgcgtaaacgtaatgatcgaaatgccggtgagatcgatcgaccgctattatctcccttcctcgatggtggtgatggtgacgtcgttggtgctgcacgagtcggtgaagcgccaccgcgacggccggaagccgccgccggccggcgacccgcggccgccgtcgtcgtagtcgtcgccggagaccctcagctggtagtgcggcggcggcagcgggtccggcagggggacgccgtcgctgccgagcatcgccgccacgtccgtcatcgtcggccggtccgtcgcgttgtcctgcacgcacagcaacgccaccttcacgcaccggattatggccgccgcctcgctgccgctgcactcgcccagcgtcgggtcgatcagctcgcaccctctctcttctctccacagctgccacgcctgacaaaaaataataatatattttttaaaaaaactctatgtttgaaatatataaatcttttatattctaatagatagtagtatttatttatagtacatcttttaattattagtattggaattcataaattaatagctcagattatattatagaagaatcagctgatgataatatatataatcggaatataattgtaacagtagagagcacgataaagttattgaaaaagatgccaagttgatcaaccaatttattaatcctcgttagtgatgactaatcatgttgctagctagcgtaagtcaaacgtagctacagtgtagacgtgaaaacgtttcgacataattgataattgtacaggataagccgcgtgcccatttattaatccacggacgacaagtacggttttgattaagaacacacacacaaaaaggtcgtactagaatagtaacacgccattatttcagcgagagagaaaaagaaattaagatagaaaaaacaacgtaaaaacgtacgtatccgaggaggttgacgaattcgccgtagtgctggtggccgctgttcctcttgccgctgacgatctccagcagcagcacgccgaagctgaacacgtcggacttgaccgagaaaatgccctccgatgcgtactcaggagccatgtatccactgcacacgtgaacaccaaaacaacaatcaataccactagctagtaagtacagtactgcaggtacctgatcttatcctccaaaaataaaggtacaaacacctgaaggaaaacatcacggctattaatcaatttgcccagccagttgacatgctaaaacttaataccagattaccagtactctctccgttttaatttacttgttactttagtttatttaaagtcattttaagtgtttatatagtttaattagtaacatgtcaattatatattataaaaattacatctcatggtgaataaaaacataaatattatgatgctaaactttataatgttttagtaattgatggttaaatttacgaatgtttgaacttaaaaaaaattaaaatgctaagtaatttaaaataggagtgtaattaaaatgataagtattgctacgatatatatcattattctttttcttactaggtgccgacgactctgttggtgttggcttcagtcatgttggagccgaagatcctggccatgccgaagtcggagatcttaggattgaggtccttgtcgaggagtatgttgctggccttgagatcgcggtggatgatgcgtacacgtgagtgcttgtgaaggtagaggagcccctgcacgacgccctcgattatgtgcagccgtttcttccagtccagcaatggcccttgctcctggtctacatgcgtgaaaacattatcgaagattagtaaaacgttgacggtaacaaagtcgttcagaagtaatccatttcacttttttttacttgtttaattaggaaaccatttggatatggaaaccatttggatatggaaaccatttggcaatatacattttctttcctaaaccgtacttgaaaaagatagaaaggattaggaaaatcggaagatgagtaaaacgtcgacggtaacatagtcttttgaaattttggcacgttgattttttttaacagcagtttgacacgctgtttgatcaagtggactacaaacaaaagtaattgtcttttccctttttacctgttatatattcagggcatttgcttttgtgttattgtttttaattaatcgcatagttatgaaaatgataaaaagtttttaatctataaaaaaactcaatttcatatctcaaatattagtattcgacgaacatatgaaaattacactaatttagtcctaagcttgagaaaattttagctccgcccctgtctactccatccgttccgaaatataagcatttatagatatgaatctacacaactgtatgtctaaattgtaaattgttaagtataattttggacgaagattgtattgaacaaaaagagagaataataccgaagatgaagaagtccaggcttctgttgggcatgtactcgtagaccagcatcttctcctcctcctgaacacagcagccaacgagcctgacgaggttggtgtgctgcagcttggcaatgagctggatctcgttcttgaattccttcagcccctgcccggactgcgctgccagcctcttcaccgcaatctcggctccatcagacaactcaccctgaaaacacgaacagacaaagcaaataataatcatgcatgttagcatcaccaagtcatccgcattttcgtcaacattgactgctaaacaatagggacagcaactatgatgccgcagattattagcatatatagcgacaaccattcacacattttggtcaaaaatcgactgtaaaaacaaaaattataggagtttcagataacttgccctgtagacaggtccaaatccgcctgtgccgagcctgtgatcttcagagaagttgtccgtggcagcggcaagatcgccgaagtcgtagagcgtgaaatcggtgctgctctcctcggtcctccacagcttcagtgcctcctctgtcttggagctgttcctggaatgtgcttccagctgccgattcgacttcctccctgtgatcaatgatggattggacatttgtggtttggttgattaattaagaactttgtgatgctgaaatggagggagaaaatgatgttcattatgagagggagttagtggcatcgtgttgttaccgtctcctttccgtagtttttttatcagtaggaggcagccgaccagcatgaaacagaagaccgtgattgacacggatagaacgataactaaggtcttcctgtggttggttcctgcataaataaagaagaaaattagtagtgatcatacagagattgtttcaatgttatttgtagaaaagataatgcactgacagaaaacaccaccattaagtggttacgtatttgaccattgtgagctcacaaccaaacatgacagtaatagtaataataatatgatttgtctttgccaattcaaacaaatttatggggcgttcagatcgtagtcaaaataaattttaccaaaatttgatatttttggcaagttgacaatattactaaaattttagcaggattttttatatatttaccaatgtttggcaacaactaaatataggcattttttaagtaactttaccgaaaaaaatattatgattgaaaatgatataatctgaacagcccctatgtaacaaatctatctgtttacaccttatactaattaagcactatgagatctctcatgttaaaatgaaagatctggttgttgattaggtggattatattatcatgccatagattgtattcagaatttgagttaaataaaaagatgacattaaaattaataccatgcatataagctggacaatcatgaaatctcttattaatagtatataaacgtaacccccaaattcaaaattaataattactactagcaagttttaattgatatggacccttccttcaatctaagctccaataattccaaaaaaaaaacacaatcaatatggtcaaaagtttaacatttataacaacgtacaacaatagtagttaagctccaactatagcttttgagcaaatttattcggaggagaagaaatgatcgtgtgtgtagcatatgtgttggttgttaccattgtttgcggttggtgagggtgcgacgtcttgcaggccgatcctgacgtccggcgtgccggcgtagaactggtagctctcgtaccggaagttgcaccggacgccgaggatccggccgccctgccggccgtcgtaccactgccggttctgctcctggagcccctggaagcagtgccagcactgcgccggcgacaggtccggcgtgcactgcgccagcccgtacaccgtcggcagctgcgggttcacatacatcacggcgctcgcgtaccgccgcgccgacgagttgtacgacccgtacatggccatctccccgaacagcgtccccaccagcgacaggaagaagctccgcgtcgtcgcgttccgcccgtcccacccgtagtaggtggacgcgttcgcgtccagcgcgttgatcaccggcgagttgtcgtccggccgcgacaggaagtcgtcgccggagtagcgcaccacgcacaggtcgtggtagtacgtcgcgtcgcggtcccggccgcagagcgcgcggaggcgctggaacgcgccggagacgcaccccgcgcacgcggcggcgtccctcatgtcgccgcggcacagcgccaggccgaacaccctgtcctccggcgccgcggcggcgcccacggccgccgacgcgaacagcgaccgcgacgacgacgcgttggcggggagctccgccgcgaggagctccaggttgagcccgaacgcgctcccctccgtgaagttgccccgggtgccattgcacgagtactccgtgtaggcggcggcggcggcgagcggcggcgagaggaagaagaagaacaagacgacgagaagggacatggcgtgtcctcttcttttctgattgcttgtgaacagaagaagaagaagaagaagaagagattgtttgattagtgcgtgtttctttctcagctttctccgtagttatgggctctctcgatctctcgcttaagtactttgggcgatcacacaagtcaaagggcttgaaattaagaaggtggttggcaaatggaattgtagccgtgatttgttttgttgtattagtcaaatcatcaggctgctgcgctgttgctggaaaatgttttttttgttctttctttctgaagcctaattgttgtgctaaatattgactcatagattggcagcaatggaagattctatgttactgcagaactaggtagtactacatgatatacatctgtaccacatggtgtgcactgaatactaacagtatttactatgaccatgtcgtcgaatgttcctggacgcaattaagttttctgttgttcctagcatgacgttacatgcgtcctggttatctgcaaacagttagagctggcatcagccatcatcaagtgctcaacgccgccggtgtcctccttcgatgagcctcagcctcatctgcagatcatcgtgacgagtattgcagataaacatcacggtgtgcaagtgcaaatgcaatgaattgcaggttttgcaactgcatttttgtcgttggaacgatagaaatttgaaggaggagcaaccagccaaccatctgaacccctaagtgtgaatgccggcgagcactgcgaactgggaaggatgcagatgatggtgtcgcattattaggttaattgtccgatgacgtgttctattggccccaccacaccacactagctgatctttgaccttaccatgacatgtataatgtgttgaaacttgaaaggcttcaaaacatcgctgttgctgggagttttattttcaaaagagaacatcgttatcttattttctactgcaagggatcaaagtcataatagtttggacattgacagcaaacgggaagtttggagaaaatatcatactaaattcaattacagagaacaatttatttgcgactactctacaacacagaaatagtttgggaaaacggtgacaactgaaaactaatgctagatttgcatagctttctttgcaggggatgcccaaatatggtttaatacgccctttcatgtggccaaaagaaaatatccaattatccattgctctttctcgcagcgggtctgaaaggaagtggagaatcggatgtaactaccaggtctcaactctcaacaccacaataattattgggaggcttggtcactttgacagtaatttagaacagagataattgaagagaattagaacaaaatttatgccattgttgatttaaacatgttgtaacttagaggaattcaaagtggaagtaatttagaatggagacaattgaagtgattgatacttgttggaacttaagaagaacataatactagtttttatcatggtttgcagcaggtaattgggaaatttcagaagggtgatcataaaaggaagacagtgcagaatagtttaactattttatcactttttggttacccatctttgttatctttcatttctagaatgttctgcagtttcttgttggtgcaccattgtacgtgctcttgtttgcactctcttcttctccagcaagtaagggcaggggaagcaatgcccaaattaatgagcattatagatgaccaaacaaaaacgagtggaaatgatccaggagacaataagctgcatgggcacattgccgcaacacagacaagtagttcagaaagaacaaaaggggaaaagaaggcagaaataaaagaagtacatatgatccaacttccaaagcatttgtcactgttccataagctgactgctggtacaatcaaaaggtatgtcttgttaacacaggacataaattttaactagcatagggcatagggtaaacaccagtgaaaaacaagacataaccttcagaacaggacataccttccgaaaggccaagttacgtgccatctatgatttcacaacattcttcaaaacaacacaaatgagccatcacacaagtacgataaaacagaaattcataattcatattagagattggctgctgaccctaagcctgattctcattacggtacaaagatggttttgcaataacataagtggagccgcacctctgcatgttagcaccacccatcaggtaatgactcagagaacattggaacatatggtaggtatggcaggcatgactcatgtccgagtttgcgtatgacacggacttccttgcgatccatttcatacgccatcaaagtattgtgccatccataaacaaagaagatcaaattgcattctggatgaactgcaattacttggtagtcaaaatctaattggtatttctttcgtccaaacagattaattgagctaacggtgtgctttaagatccaattatctgtatcatagtcttcaagaaaccaaattgacagttcgaggatatcatttggatcaacattaaaagcacacaagcgaccctgagtttgatgaattatcccaatatcaccatcaggatccggcatgggaatcttcctccatttcttcccctccatgtcaacagccacaatatcgcaagtcgtgacagaatgcagaaaaccattaaggaaaacccttgtccgatcgaccggaaggctaaccataacttcatcatcccatccatttacatggagactccataacccagttttagacgaatagatcaccacccctgtgaccagtgcgtcgtattcatcttcatcctccacatactcttcatcctccacatactcgagcacatggaaatgcgacgagatggctggatcgaaacacaagcaggcggtgcggttctcgtcaatagcccagttggcgtccggcaacatcacacattccccggtcgcaggattgcacacagcatactggaactgcaaagtctcacgagacacgtggcagcggcagaggaggaggccattgcagctatccaagatgacgacgtggtggcactggggcaggaaggagaaggtcgggcagacgagaggcatgcctctcccagtggcgttggtgaaatggcgcgccatgtgcgggcagcgctcgtagtcgatgctcttgtagaagaagcccgatagcgtctgcggcagcttcttgcggtgctcgtggtcggcgatgagtttgcgccatgacttgctgacgcacttgaagcggcacacggagcggacggggaggcggcggaggatctcgacgatgagctcgtcggtgatgctggccgcctgctggggaggttctcctccatcgggggtggggtggaggagaggaagtcgtcagcctgcaaccgcgggaaaaggattcaccgcggcaagagcagatcaagcaggtgagcagatggggattaaatcaaacaagacatcaaaatggtgaagaaagaaaaatctggctacaaatcgacatcatgggttcgttaatccacctactaaacgaactaatctgagatcaggaacctaccgatcaaggcagggaagagcgatgctgccgcgcgcgtgacttgccgctcggcctcggctgacctgtgtggagctcgtcggacgggacacctggacggcaaacctagcgccctcgccggttaaggccaaccattgcgcccgctaccctgctgcgatgtgcgcccgtcacggagaagaagagctagaagcggcggcggcggcgacggcgccgagacccctagatgccccaaaatccccaattcaatgtctgctgggacattggttccaaattctagtcaccctacgccattaagaaagttggagattacgtgtgttccaaaaaaaaacttttgagttacctggcatgagacaaactttcttttgcctatgcgccactttgggtgggatacccttaccggaaccaaacggaggtttcaaagatctattttacccttgctaatggatggaatcagcattaatggcacgccggcaagggccgccattagcgccgaaagacaacgttattggcgccgacgaccggcggcggcggcatgccggcgacggcgtgccggcggcggcgacgaccggcagcggcggctagaggcgcgccgccggatagacgaggcgaggcggcgtgccggcgaggcgacgaccaacagcgacggcgacgaccggcggcggcggcggcgtgccagcgaggcgaggcgactagagaggcggcgacggataaacgaggcgaggcggcggcggcagatagacgaggcgcgtcgccggatagacgaggcgaggcggcggggacggcgtgccggcgaggcgaggtggcagtggcggcgtgccggcgacggcggctaggctagggcacgggagaggagtagtagagatgaaaatgcttcaggggcaatttagtcattttcatacgtgggtcccacatgtcagagctcattctctaacagaaggtggatggaatggcacgcgggtaaacgaaagtttgcgtcatggcatacaggtgactcaaaactttttcgtggcacacgcgtaacctccaactttcttaatggcataggggtaaaagactctccaaattccacttgaatcgggcggtcgggccttagtttgaaggaataagttcactttgggtccctctatttatcgcccaatccaattttcatcccttcatcgcaaaaccgggtacgacaggttctccaacttacgaagccgtttaaataaggtccctcagcagtattgtgcccagttttggctgaggtggtgcctacgtggctaattttgactaggtctttgtccaacgtttcattgacgtggcgattatgtgacaattagatcaaaaaaaaataataaaatctatgggacccataagtcagttgcacatataaataataaaaaatggtgggcc

SEQ ID NO: 48577 - DNA, 15331 bp, Oryza sativa
  unsure (1)..(15331): unsure at all n locations
ataaatagaggacttatttaccttaacttaggttgcagctcaaaacagcctgagaaatgcaaccgacgacacagacgaggaaacaccaacaacagcagcagcagcggaaccaacggactaacacccaacaccacaggcgacggctgggaaccaggacgaaaccctattcttcacttcacatcatcttctcttcaaggcggaggaactataaatatttatatagagcaagggtgagtacttccgtactcagcaagtcacgggaatttaggtgtttaatgtaagcttggaagagaggcaaggttgttttgcaaatcctttgtttgaaatcattttgaaatcgctaggtgattaatttctttttaggtttgggtcaaaaagagacttgcgtctcgattcaacttaagagatgcttttcaacagctcaattggtaatgtaccgacctcccaggtcagatcattacttctcggctcccagaaccatttcacttgattaagcggctcccagagcctttttcattttctcagactcccagagtccagctgcctagcagcacaacaatccgcttccactcgggaggcctagtctatgatgcccgtagacatcccgaatcacacagattcgtttccgaccactcgagtcatccatctgccacataggctgattctggttacgattcccaatccacaataacttttcacaaagcacaggcaaacaaatctacgcaacgagaaccacctcacatccgcccatgaccgtgggcacggctgttcgaacagttagttaacctctgcagaggggtacactttacccacaagatacgaacttattccgaacacccgtcggtatcggaggttcgcaacaaagcctttcccaagccgacccagggttacctcatgccacatagaaggataaaatccttcacataaatataggccatttcagttttcgcaaatcaaactccaaccacctcgatcggtaatctggcaagcttcgcgttcttgccttaccaggaacccgggttggctccaaccgaccccgcctcggcgttccccaactattggcatgcgaggtttccctgaaccgactagttacttagctagggtgtcccattccaccttgtggttgcactttgttatgcttgatgaatttcccacaggaatcggtccttatatgtgaatacggaacagtgccacgcaggcacaacccccgcatcgcgagttttcacaattcattttatttttaaacacaccgacaccacatgtcgggttttcaaggcttctcaaacccattcacaatttttcgacaatcaacggtgtatgtgggatatttggtatacgcgctcagagagcatggatactgaagtaccgcaaaggtggagcgacaaggaatctggatagtacaacctacaggaattagtgcaactactaggtaggtccgtcggtttggcacgcaaaccgaggccaagcaaattaagtgtgtgattctaataatgcaagttacaaacaaaataataatgattttccaattataggagcaattggtcaaagggagacttgccttgctcaaggtcttcacggagcttcacgaatcttcgagaaaacccgcgatcgacgaaaatctggtaaccgcaactatacgcaaacaaacaaaaacctaaacaaaagaccaagaaaaagaccctatttagactaaataatagtgccattgaatagatctcaattttacgaaattactggaagttgaacgaagtaaatcggatgagcggttcaaaagatatggattttcgaagtttaattggattttccggaatatgagaaatgatttattgcaattctagaataaagaattgatttagggaacaagggaaaaaggatttattgaattttctggaaaagaacattctcaagaatattcttttatcactcattgacatgtgggggccaacatatggcgagagagaggtgaattgggagggagcagatatagacttttggtcactgtgtttggggagggagttataatggacttcctttctcttatcaggccgaggaggagggtggccgatgggccaagcccacaagcacgggagagagaggagggggtggctgactgggcgctgacggggcaggcgcgaccggtcagcttgacttggtcaagccgatgtggctgccacgtcggatggggagggagaggaggctggcggcgcatcggacggctgacggcgcgcggcggaatccggcgaacggtggcaaaccggagtgggcggcgggcaccggaagcgagagggggtcacggaggttccatccaccggctcggatgtgggagaggaggcgcgacggaggccgtgcgacggcgggatgggtggcatggcgcgggagcaaaagaggaggccggcggcggaattggcggtttggggtggttcattggagctcaaggtgggtggcggcgaggggattcggcgcgggaccgaccggcggcgcgcgggcggcggcggaagcaaagcatcggcaagggcgcgatttggaggacgaacgcacaaactaccatgccccagtgctgtttaggagtcgctagaggatatagacgagaggatttgggcggggagctcacccacgagcgggaacggcggggcggatggagtcgcggcgaggcagacgcgacggctgggcggcacggcgcggagatggcgcggccgggaaagcaaggaggggcgcgagggactccgttggcggcgcttggccgagcggcggcgcacggtggcgaacgcgacgccgaggcgggcgctccgaggaaggaggggacacggggtggaacggcttggtgtcggtgcggcgttcttggccgtggcgacgaaggaggcgggggtagtacttcgttccaaggagcacggggcgaagggggaaaggattgtgggcgtggggttgggattttataggcgaagaggcgctcggctggcgacagcggcgttttcgtgggcgatgcgaaagcggcgacgacgtggatgcattgggcggcgaaggcggtggatcgtgcggcggaaattgaaccgcgggagcgggaggagcagcgccggctggcgcggggcgagctggcgctgggtcaaggtgggggcggcgagctgacggctgccgtcagcggctctgccttcgagcgcaagcggactgtaacgccccgattttcgttcgggattaaaaatcatttaataatacattttctggaaattaaataaaagttaaagcaatttaatcaagtgaaataatgggagaattaaaatttttcccttaaaaatcattggccgggaatattttgtaatattctttgtgccctaatgtactctccggaattttccgtgaattttcggagctcgagaaatagtttcaataacacaaagatcattgcatcaaataaaataaaaagaaaacaaataaaatttcccccttcctctctttgggccattttcggcccaagtcttctttcctctcccgcggcccgcgcgccttctccctctctcgggccggctcccctctctcttggcccgctcgcaaaagtctgttttgcgtccctccttctctcccttcgccgacaggtgggaccggcggtcccacccgtcagctcctcctcctacctctcgccggccgatcccaaccgccatagccgtccacgtcgccgcaaaatccggcgccctcccgcacccgagctcgcatccaacgacgtgggcacgatcccctccacgtcctccaccatttcccccactctccccgcgaaaatcggcgccggttaacccctccaccaccccacgtcggcgccccacttcgccggccgattccgccacgtccggcctcgatcccgccttcccgagcccataaaaaggcatccccgtgctcccctcatccattttccccattttccccaagccgccgcgccctccctcgctctccccgcgccgagcccacgcaccgccgctctccggcgaactccagcagcgccgcgccgccgctcccgtccgccccgcactgcgccgtcgccctccccggcaccgcagtcgccgtgcgcaccccgtccaccgctcctcttcgccaatccaccgccgcaacgccgcttccaccgccaccccgagccaccttcgcctttagccgcctccatccgctccccgccggcgagcgccgcctcgcccggccgtgcttttgcctccaacggcttcgccgcgtcgtgccgcaccccggcatccactccgtcctccccttccacccccgcagcaccattcccaccgtgcaccgagccacagccgcctttcgtcacctccagtcgcgcgccaccaccgctcccgtcgctgccgcgctgcgctaccaccgccatcggcatcgccgttcctcgccgcaccccggcccctactccgtttcccctccctgcccctggaacgccgccgccgcgttcaccatctctttccgccgccagccgcctccctgtggtcgtctcgccgtcgccgtcctcggtgagaatccccaccgtcccttctcctttttttcctcctccgccgctccccgtgcccgctgccgcgacgcgccgctgtcgccggcggtcgtctggccgcacgccgccgcgcgctatcgctcggccgagccggtttcatgccgtgcccgtgccctagccgcgccgcctcgtggccgtccgatcggcttcgggccgatctgggccatccacgtggtggacgcgcacccgaggccacgtgtggacttggtccaccgtgcgccgcccctttgtgccgctgacgtgcggggcccgcctgtcggcgctggtttccccttgctgacgtcagcgaggtccatttcctttgtaaaaataaataataattgcgcaataaatcgagtttaattctagaaattcattaaaatggctcaaaacttctaaaatccatatctaattcattcgaactccgaattgagctgttcaacttgcaaaattcatctaaaattgagctctacatgtttgtttactttttatgtactgtttccttggtttttattagagtttttcctcgttttgcgtgccagcgtgtagtttccgtcgtttcggaagtccgcggtcgcgaggaaaagagttcggaagatcaaagtgaagaagcaaggcaagtcacacattccccttgagcatgttgatcctaatttacaaatgttttaccgtttgcaaataaatatgcatgttttgctaattacacgggatcagggtttacctatctgctcgcttgtgccatgtttacttgatatctgttctttgtcaaccttgggtaataaatcgactagctcatgttacttatgtgacctagctagaactatatgcttagccatgcttaattactactagctcagttgatggggtaattacagtattagacctttttagtatcagattgagctgtgtgctcgagacacctggccatgcttcatggtcgtaattatccaactaaaatgcgactacatggtgggctgtgggtgcatggttttgctggtcgcacccatggcagttaaggaccggttcgcgggatgccctggaagaacttatcgtacttaccacaagccagcgtgggcaacggctgggcttgtagtgtagctttcctctagtcgacgcatccaggcaagggtgggcgtgatggagcggggcgggccctgcgacggcctctgtcgcttccggattcacctaggcacgagaggggactgcccgttgcccgctggggacgggggtgaaacctgaggtgtggtgtgcttggctagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcgaccagattcaccgtgattagtcccacctcaataaatcgacctaatacactgtagtttaggtgggttggttgggcctgttcaacgtggtgtagcgttgatcagtggagatttaatgttactttaattactcaactgttttactgttttgctcaataaaatgttttacaaccgcctttatgcaaatagccacaaaccgtccttgtgttccccttgcacgtctgcatcgttggtgtggcttgctgagtacggtggttgtactcagccttgctattattcccccttttcagaagtgtagtgcttctgagctgaagacgaagttagaggaccaaggctcagaccccagttgagttttgcctgtggagtggagctgaagccccgctaggatcgcctttttccgctgctgctgcttttgtttcggtgcgaggactaagtgcctcttttgtaagtattttacgctttatttacgtttggaactgtatattacttgtcgttttgtgtaccctggctggtcctggacagggatttaatacacaaaatagtctggaaatttgggctaaatttctgggcgtgacacggacaagggcgagagagcgagcggttgagcccgagggggaaaaaaggcgaagagggcggtggaaaggggaactcgtcccttccgttttgggcggcgggcaggcgagtcgcggaaaggcggtcacgcgaggcaggcgacgaccgggtggtcggcctccacgcgagcgcgcgcgggaaaggcgaaggcggtgggagcggcgtccttgccggtcggccatgcgcgagcgcgcggaaaacggtgacgcggccggaattttggggcggcgtcggcgggaagcgacgccgagagagagagagagagaaaggagacggcgctgtctctcgctcccgaacacgtgcgacgcacgcgcgagagagctgggccgagaggaggggatgggccgggagagaggaatcaacccatcgacaagggaggcaaaatagactttttctgaaagattttgatttggagagatttggagtttgggttttgaatctaaatttgatactttgtacacaagggttcaaggagtcaaggaaggaaacaaaacgggagtttggatattttgggattcggaaatgtatttggcgaggattcaaaggaaggatttgaatttcggaattgatctaggaagttaaatcgggatttgaaatcttgaggtggagggttttgacagtgacgagagggaacaaggagattaaaactgagatccacggcacgacttagactcgcacacaaagaacgaaattttcgcaattcggattttgccgaattagtttttaacgtctcacgagaagcggagcgttacacatatccggttttgcgaccaagcaacaaaatcagactaggcgacaaattgagggacccaaagtgaacttattcctagtttgacagacaaaactcaaccacgggagttacatgggctgggttactcgtttttgactaactctcaaattacaggggaaataagtttatctgtggtcccttaacaacgaatccgatttcatcctttaaccgaaaaaccatatacaacggtcccttaactgtcaaaaccgatgcaatataggtcccatagcggtttgaacggcggttttcgctgacgtgatgcctacgtggctattttgactcggccttcacatgacgtggcaatgacatggcgcttacgtgtcaaatcgatttggaaaatattaaaaattgtagacccacatgtcagtttacacaaaaaaaattagattaaaaatggtaggacccacgtgggccccacatgtcattctcaccctcctctcttcccaactcccctgtgataatgaagttgtcgcagacccccggctcggtgaggtcgttgttgtcgacctcgatgtctctcagaaatggtgagtgcttgccgagctccgccggaagctggccggagagattgttctcgaacagcttcattatcaccagcgatggaagctgagcaaggcttgctcgtatctcgccggagaagttgttcgccatcaggactaagttagttaggttcatcaaacttccaaagctctctgggatcgttccagtaagctggttctcagatatgtccagataaattaagcttgctgctccaatcttgccattgacgacgacgtcgccggtgagctggttggtgtacaagaacaagtactgcagttttggaaggttccagatcccaggaggtatgcctgacgtctgacgagcactaaaacctggccaaaaccgaacacaggttttaggagagggattaggagaggcaaagggaatcatcccccacagggtttaagtgagatgggagggaccctggataggttcctttggggattaattcccaagcaaccgaacaaggacttatggggccaaaagaatattcattgctctttctcttcttattcttctgagaacttccattgctctttctcagaacaggactgaaagaaagtggagaactatatggaactaccaggtctcaaaaccacaatgattttagggaggcttggtcactttggcagtaatttagaacagagataattgaaaagaagaagaaaattcataccatagttgatttatacatgtcggaacttgaggagctcaaagtggcagtagtttttatcatggcttgaagcaggtaagtgggaaaattcagaacggtgcccatcggaggaagccagtgtggtaatagtataactattgtataccagtctttgttacctttgaagtctaaaatgttgtgtagtttcttgttggtgcacaattgtatgtgctcttgtttgcactctcttcttctccaactagtaagggtcagagaagcaatgttccaattaatgatcattgtggatcacttaacaaaacgagtggaaatgatctaggagacattaagctgcatggatgtaacatagacaagtatagttcagaatgaagaaaagggaaaaaggaaggcaaaaatcaacaaagtacatgtgatccaacttccaaacattagtcacggttccataaactgactctgctggtacagtcaaaaggcctgtcatgttaacacaggacataaattttaactagcctacggtaaacaccagcggaataaaacaagacataaccttcggaacaaccggacataccttccaaaaggccaacttacgtaccatctaggatttcacaacattcttcataacaaaggagccatcatccaagtactacaaacagaacttcataattcatattagagattggctgcccactctaagcccgattctcattagggtacaaagacggttttgcaataacaaaagtggagccgcacctctgcatgttagcagttaccgcccattaggtaatgactcagagaacattggaacatatggtagatatgactggcaggactcatgtccgagtttgcgtatgacacggacttccttgcgatccatttcatatgccatcaaagtattgtgccatccataaacaaagaagatcaaattgcattctggatgaactgcaattacttggtagtcataatctaattggtatttctttcctccaaacagcttcattgagccaacggtatgctttaagatccaattatctgtatcatagtcttgaagaaaccaaattgacagtttgaagatatcatttggatcaacattaaaagcacacaggcgaccctgagtttgatgaattatcccaatatcaccatcaggatccggcataggaatcttcctccatttcttcccctctatgtcaaccgccacaatctcatcagcaggcgtgacagagtgcagaaaaccattgagcaaaacacttcttcgattgaccgaaaggctaatcacaacttcatcattccatccattttcatggagagtccataacccagtttcagacgaatagatctccacccctgtgaccagtgtgacgtatgaatcctcatcctcttccacatactcaagcacatggaaatgcgacgagatggctggatcgaaacacaagcaggcggtgtggttctcttcgatagcccagttggcgtccggcaacatcacccattccttggtggcaggattgcacacggcatagtggaactgaaaagtgccacgagacacgtagcagcggcagaggaggaggccattgcagcaatccaagaggtcgacgtcgtggcactggggcaggaaggagaaggtcgggctgacgagaggcatgcctttcccggtgacgttggtgaaatggcgcgccgtgtacgggcagcgctcgtggttcatgctctcgtagaagaagcccgacagcgtctgcggcagcttctttcggtgctcgttgtcggcgatgagtctgcgccagtgtgaaaccatgtgtggttatagttcttttgtgatgggaaattgacaagtaccggaagtgcaagaagtgtgtgcgtagactaccattggtcaggttgcgatatctgtgccaagacaacggttgtttggctcatgtgtgtgcaggtgatcagagtcaatcttagntcaacggcggatcgggactagactcanggagaagttgaggtccagaacgatcaaggatgccgggtgacaagattggacacaaggttgcacacggtgggcggacaccgtgtgaggaggtctttgcaacgggcttcacaaggtcaagtgtgcaagcatcggattcgcgaagaaaattggaaggagaagaggactgtgcaaggacatgaagaccgagtgcattgctgctacagtaattcggcttactgtagctagcatgtatcatgtgcacgtgtgctgccatgattgaatggcaaggagaccaacaggagctggccactaggcttgtgggctggcagttcggttggcaggaaggccgagccaacccggcctaagcacgttgctgactcaagatggtgaaggctaggccgagcaagccctagacatgacgatggcccagctcggctcagcaaatgcacaggtgtgtgcatgcgcgcgcggaagcgggagatcgtacggcacctggaggcgtggcggccttctgttcgtcaaggaagcgaccgggtcccacgcggtttttcgcatggtgcgcgcgggaacatggttttcgcgagcgcgcgcagaagcggctcggtgggaggaacggcgacgtggcggcttcggactggtggtgcgcaggcgtgagaggagcaggcacgcgctctctgggacgcgtggcgcggatgcgttggcttggaggagcacgacgcggatcggtgcacgctgattggcttggagtggaatcacgcggatcgcacgagggcgcgcaacgtggagagctcggatcaacaacgtggcgactatccaggaggcttccttcggatctaaggaacaatggacagccaggattacatcaaggctagggtttcgccctagggatatttgagacaatgtcttaggggtcttaggctataaatagagagatggatgcaagggtggaggttgctccttttgtaatccttttgagatgctcggtgagagagtttcggtgtgagtttggagtgtgtttgctcgagaggcttttgtattaggattagtttggagtgtgtttgtccgagagattttaattttgtgttaatgttcctctgaaggtgtatgtttgcccctagttgagcggttattttgcatcacctatgaatgaaatgatttgaaggatttcgtttttgccttgttcatttaaattccgcaatttaaattctacttgcaatttgaactttgcgatgatgagttttgttatctcctcctcacctctcttctagtttgggaaattccttttctctttctcttctagtttcgggaatttctttctctcttcttttctagatccggcttctctaatagccgcggttctagtaaggatttttgagaaatccggcttgatgagtattttcgggggcaagatttgaattgctatattcaccccccctctatagctgttcttggtctttcaattggtatgagagcaaggttaagttcattgtaacctaaccgtggcaacgaacgccgctatggaggaaaaatattctgcgaaaccatttgttttcgatggacacaattttgtcatttggaaggcacgaatggaggcctacctccagtcgcaagggcataatgtgtggaataaggttaaatcaccttacactgtgcccgatgatgctgacatcacgcctgcaaatgtggctcaggttgattttaattatcgtgcaagaaatgcaatcattggtggaatttcttctggtgaatttaattgtgttcaacaccacaagtccgctcatgacatgtggactgctctgtgcaatttccataagggaaacaatgatattcaattggttcgtcagaatcaatttcataaagaatatcaaagatttgagatgcacccaggagagtccattgattcttatttcaagcgttttggagaaattgtttcgaagttgagatctgttggaaaagaattttctaataatgataatgctcgccatcttttgaattgtcttgattatggtgtttgggaaatgaaagttacttccatcacagagagtgcacctctgagtgaccttaccatggacaagctttactcaaagctaaaaacccatgagatggatattttccatcggaaaggcctcaaacactcgatggctttggtagctgatccctctggtagtacttcttctaatgactcagcttttgtgtgtggtggcttctctcttgccgctttacactcagtcactgaggagcaattagagaagattcctgaagaggatcttgctctttttgctagaaaattctcaagagcttacaaaaatgtgagagatagaaaaagaggaaaaaccaatgaaccatttgtgtgttttgagtgtggagagcctaaccacataagagtgaattgtcccaagttgaagaagaagagtgacaagacgaccaagaagcccgagggacaagggcgaaaggggaataaggatttgatgaagaaggcgatccataaggtcttggcggctcttgaggaggtgcagcttagcgacatcgactccgacgacgatgatcaagaaaagggggacaaggacttctccgggatgtgctgtctcgccaacaacgaggacttcatcaacctgtgtctcatggcacttgaggataaggatgactcatcggagcatcctgaggtatgtcttgatgatatcccttccttggatggttctctttgtgatgatttttgctcagataatgactctgttgatgatgaactaagcaaagaaagaatggcacacttgatgattgaaattagtgacaagtataggtcttctaagtataaaattgagaaactaaaatctgaaaatgatggtatggcgctagaaattgctaggcttcgatccatgattcctgaggaggatacctgttctacttgtgcttcatatctctctgaaattaatctcctcaaggataagttgaaatcatgtgctttaggagctgggaatccttctagtgctagtgttgcttgctctacttgctatgaaatgaaagttgatatgggtttgcttgagatggaattgaaagaactaaaagaaaaaaaatttcatgataggattggtaggtgtgaaaattgtcccattctcactagtgacaatgatgaattaagacaacaagttgccatgcttaggaccaagaatgatttgttagaatcttttgctactaaggaacctattcattcttcatgtgctaattgtgctatcctggaaactgaactaaaagatgctaaaactgtcattgattctatcaaatctattgattcttgttcatcatgcatttctctgaaagttgatcttgagtctgctaagagagagaacttttacctacaacaatctttagagaggtttgctcaaggaaagaaaaagttgaacatgatcctagactaatccaaagtgtccataaacaatcaaggtataggctatgattttgatgagtctttgaggataggtacccatgagatattaggtgtcacagatgggatgatagaactagctcaaaagcctataaccttcaagtctgcaggtttcattggaaacactagttctagttcacccaaaacctcagaaccaaagatggtacctatgactagcaagtctaagcctgtagagttacctagacccaaaaatccaaaacaagttgagcacaagcaaaaccagaaacaaaccaagcctgtagagaaaaccaagtatgagtgcacctattgtgggaaagctggtcatttggtaggtttctgctttagaaaggctagaaaagagcgacaagaacgttttaggactagaagagatactagagtccctgagaggttcaagtgtgcatgtcgttcaagtggtgtatctcgctttcctcgccgagatgtgcaccctcgacgtgacctagcaaggttggggcaaaacagacatggtcatcttgcatataattctgctcataacactaaagatgcttgtacccctcgcatggttcagtactggattcctaagtcatttctcactaaccccagtactgaatcatcgagatttgctttgtttttcttgtaggattttggagtggggagaagtaattcttggcttgtggactccggttgctcacgccacatgaccggtgaagccaagtggtttacttctctcactcgtgcatccggtgatgagaccatcacttttggggatgcgagcagtggacgcatgatggctaaaggaacaatcaaggtcaatgacaaattcatgctgaaggatgtcgcgcttgtaagtaagcttaagtacaatttgctctctgtttcacaactctgtgatgaaaatctagaagttcgtttcaaaaaggataggtctcgagttcttgatgcttctgaatctcctgtttttaacatttctcaagttggtcgagttttctttgctaactttgactcttctgctcctggtccttctcgttgtttcattgcctcagagaatagggatttgtttttctggcatcgtcgtcttggtcatattggctttgaccacttgtctcgcaatagtggtatggatttgattcggggtttgcctaagttgaaagctccgaaagatcttgtgtgtgcaccatgtcgtcatgggaaaatgacatcttcctcccacaagcctgttacaatggttatgacagatggaccgggacaactgcttcacatggatacggttggtcctgctcaggtccagtcagttggggggaagtggtatgtcttggttgttgtggatgatttctctcgctactcttgggtctattttcttgaatcaaaagaggaaacgtttggcttctttcagtctcttgctcgtagtttggctttggagtttcct

SEQ ID NO: 48578 - DNA, 2105 bp, Oryza sativa
atgtcccacaacagaatggggtggttgagaggaagaaccgcacccttggtggagatggcacgaactatgcttgatgagtttactactccaagaaagttctggactgaagctatttctgctgcttgttttatctccaatcgtgtgtttttgagaactatcttgcacaagacgccatatgagctcagatttggtcgtcgaccaaaagtttcacatctcagggtcttcagttgcaagtgctttgttcttaaacctggaaatttggacaagtttgaatctcgatctgtggatggcatttttcttggctatgctactcattctcgggcttatcgagtttatgttctttcaactaacaaaattgtggagacttgtgaagtcacttttgatgaggctagcccaggagctagaccagaaatttcaggtgttccagatgaaagcatccttgtggatgaggattcagatgatgatgacgatgattccatttctccacctctagacagtacaccaccagtacaagaaaccggttctccatcgactacatcgccttcaggagatgcaccaactacatcatcttcagcagctgaggagattgatggtggcacatcaggaccaacagctccccgacacatccagaaccgacatccgcctgactcgatgatcggaggcctgggtgaaagggtaactaaaaatcggtcttatgaacttgtcaattcagcatttgttgcctcttttgagcccaaaaatgtttgtcatgctttatctgatgagaattgggttaatgccatgcatgaagagttagaaaattttgaaagaaacaaagtttggtctttggtagaaccttccttgggttttaatgtgattggaacaaaatgggttttcaaaaacaaactaagtgaagacggttcaattgttcgaaacaaagccagactagttgcacagggtttcacccaagttgagggcttggattttgaagaaacttttgcaccagttgctagattagaagctattcgaattcttttggcttttgctgcttcaaaaggtttcaagctttttcaaatggatgtgaaaagtgcttttctgaatggtgttattgaggaagaggtctatgtcaaacaacctcctcgttttgaaaatccaaaatttccaaatcatgtgttcaaacttgataaaactctttatggtttaaaacaagctcccagagcctggtatgaaagattgaaaacctttttgcttcaaaatggttttgaaatggggggagttgataaaactctctttactcttcatagtggcattgattttcttcttgtccagatatatgttgatgatatcatatttggtggctcctctcatgcacttgttgcccagttttctgatgtgatgagcagggaattcgaaatgagcatgataggagagttgactttcttccttggacttcaaatcaagcaaacaaaggaaggaatctttgtacatcagaccaagtactccaaagagctcctgaagaagttcgacatggccgactgcaagccaatcgccacccccatggcaactacttcatcgcttggtcctgatgaggacggcgaagaagttgaccagcgcgagtacagaagcatgatcggctccctcctctacctgactgcgtcaaggccggacatccacttctccgtgtgcctgtgcgcgaggtttcaggcttctccaagaacatcacatcgccaagcagtcaagtgcatcttccgctacatcaagtctacacttgagtacggtatttggtacccctgctcttctgccctttcagttcgagctttttcagatgctgattttgctgggtgtaagattgatcgcaaaagtacttctagcacttgtcattttcttggcacttctttggtctcttggtcctctcgtaagcagtcttctgttgctcaatcaacagctgaggctgagtacgtagctgctgctagtgcatgtagtcaagttctttggatgatttcaactctgaaagattatggtctgtctttctctggtgttcctctgctttgtgataatacaagtgcaatcaatattgcaaaaattccagttcaacactctaggaccaagcacattgagatacagta

SEQ ID NO: 48579 - DNA, 1110 bp, Oryza sativa
tcgatatcgttgccaggttgtctcggtccttgaatgagcatggcaagcataatgtactttcttttgaaacacaaccagggaggaaggttatagttaacaagcagaactggccatgtactgtgacgactgctcaaatcaccaaaaggattaatgccgtccgtacacattgcgaaacgcatgtttcttgggtcatttgagaattcctggtaaatcctatcgattgtcctccactgtactgaatctgctgggtgcctcagcatagtatcgactttccgttcttcggcatgccagcgcacaagcttagcttgttccttgttcgcaaacattctcttcatgcgctccgcaattgggagataccacaccacctttgctgggcctcccctctttgacttacttccttcaccttcactctttgctcgtttgtatcttgatgccccacagatagggcagacatccaagtcagcgtattccttgtaatacaaaatgcagtcgttcggacatgcatgaattcttctgacctccaggcccaacggacataatacttgcttcgcttcatatgtcgtctgaggtaaattgttcccctctggcaacagatcctttaacagctcaaggagttctgtaaaactcttgtccgaccagccattactagccttaagcttcatgagttccaacacgcatgacaacttgctgtgcttcgacttgcatccatcatacaacggcatctggcaatcttccaccaacttactaaacttctcataatctctgtcgttgtcctctgcgtcttcaatgtcatgcaacattgtagatagacattgagtgtctaaatctatggtctctccacctaaaggagaaggtacgaacatgccttctcgagctgcggcggtgttctctacatcctgatccaacacttcttcagctgcgacatcaggcgcctcttgctctccatgcttggtccagcaggtatatttcttcatgaatccattcattatcaaatgagcatgcacttcatccttgtcttcgatcatctgttcattcttacagtccctacatgggcacaacatgtgcatgctcatcctacttattctgtcattatccgcaaatgtgacaaat

SEQ ID NO: 48580 - DNA, 1836 bp, Oryza sativa
agaggattctgagatatctaaagcatacagttaagcttggtttaaagattagtaaatctaactccttgcttgttagtgcgttttctgatgcagattgggcaggatgtttggatgacaggctatcaactggaggctttgctgtgtttataggacccaatcttgtgtcatggagtgcacgtaagcaagctactgtgtctagttcaagtacagaagcagaatataaggcattggctaatgcaactgctaagattatgtggatatagaccttacttcatgagttgggagttcaagcgcctaaaacagctaaggtatggtgtgacaacattggtgcaacatatatgacagctaatcctatgtttcgtgctcgtacaaagcatattgaagtggactatcattttgttcgagaacgagttgcacggaagttgttacaggtagaatacatatccacaaatgatcaagttgcagatggattcaccaagactctaactgttaaacagttagagatgtttaggaaaaatctaaaccttacaggataagattgagggggagtgttagagttcggatatattgcatgtacatgtgataatgctcccgtatggctgaggatagagtttgttgtgttagttagacaagataggatcaatttctgaaatttagctgtacacaacaaactctcactgaagctatttatctcttgtatcctgttgcctggtttgtggcattattatcaacacgtaacctcctctctgtaggagttcctcgcttccacactcggcgttgccacagcgatgtacacgcgtcgagcgcgcctgagaggtgtcggcgccgatatctccctctcacgttctctcttgtctgctggtcggttggaggagttgcacagagaggaagcgagccacagccactgatgagtgggcccaaaacgatgagaccaaggttagggagaaagggaagggtagaaacataggtagacttgatttttggacgattttccaggatatatttctcttcccttctttgttaattcattcattaatttgtgtcgcagatcaattcatgtggattttagtggaggtagataaagatacctcagattccatttattagattccattttctttggttgcactaaaaatatatggatagattactcacagaaattagcagacgatgggctcgttggaaactagttagaatttttagaagagctaaacaaaggaaataaattctggaaaaattatatttactcatgataattgaactagtatttgaataaattattttctctatacacttccatgcagttaaatgcacttttaaataaagtatggtttttgccgattaggaatagtctattattcgactggtttgattgatttatttgaggtatcaaatttagttattaaattgtatcaaaattactgtgtgttgtatatgttaagtgagcgtacatgaattttcccatgattttatcttgcacaaattattttagataattagcaagacttatctcttatatgtgtttccctttcctaaatgtatgtaaatgtttataaaagttatatttggactcttcttaacctgagatgatgttgatatgttagaattacagtttaccttacacatgtcataagcttcttacctatttatgtataagtttactttagtataaattaagagaatgcttatagagacgattaagatagaatttaccctatatgagttaatttatttattcactttcatgttcatgacttgtctttagatggatgaccaaattagttttgtggggcttgacatcggccttgttgatatattgtaaggtgtactatggtt

SEQ ID NO: 48581 - DNA, 24639 bp, Oryza sativa
  unsure (1)..(24639): unsure at all n locations
tatatcggatagtccgatattttttagccaacactcagacaaagatagagggcaaagttctaagaaatttcggatagtctgagcatcggatagtctgatcaggatcggatagtctgacaggaataaaataggaacagtccaaataaaggattttgagaactagtgttctaccaattatatgcatgtggtatccctcttaatagtacggcatcctaatacaaaacacaagatatacatggaatagaagacaattaccagaaaatatgccgcaaagcttgtaaattcaagttccactcctttttatccttgcatccatctcaacaaagagcattagtgaacctctaattgtgttgtcataaacaccaaaataaatgaggggtcctagatgcactttcaatctccccctttttggtgattgatgacaacacaattagaaataataaaagattaggatttaggtggagctccccctaaagataagctagaaaagaatatgagagctcccccttaatctatgcaaaagattagaaatcacaatataacctcatgcatatgcatatgacaagatacatcactcatttaagcatggataagagataatttcatataacatgcacataacatcatccaagtctgcgaggttcaacaagacataaacatgcataataaagactttaaacatgacacaaaagcccaatgttcaactagccaccacgaaaacgagatagattttttttaaaagttttgataggtaggttggttctccccctttggcatcaaggcactaaaagggaaaagagagtggatcactcatcctcatcaaaatccttgtcctcctcacttgactcctcatcattgtcatcttcctcctcttcttcttcttcttcttccataggagccttgccacgatctgcacgagaggagcttgcctcagctgcaaaggggtcctcaaatacatcctccccactgtcctcaacctcaaacccatcgggagaacacagctgtcggtgacatggggccgggggtatcgtgactagaggcttgggtagccgcggtcacccacgtggcctgaccccctcgggggggtcgggcccgagggtgacgtggccacccctccctctgtctccccgaggggtcgggccactcccgtttcggccccgagggctggggcgccccgaccccctgtggttttggcgccacgtgtgtgggttaggtgagcccaccgggctcacctaaccgcatttatagcaggttggacgagcgcgccacgccgcatttaatgcggcgcagtgcacgcttatccggtccgtgaccggtcacggtgtgtgaccggtcacagaccggtcagatcgcaggttaggtggcaataggcggcctgtcacacacctcgccccgtcccgtcggaatgatgagagcttcctggctctcgtccctagccggagccggtgtgctaactcctggagttagtatgtcagtcccggtcagatccattccaggcttcagcgcaagtatggcaaggaagtcgctggccattaaatgaatgttgaaatgggcgtccaccggaaaagcgggcgagcggggcaggaggcgtgtgctctgcttgtcagaggtcacttccggatgtagactagccctcattgtaaaaagcatgtttcttttcttaggcagcaggaggcccgtgtggtgaccccggaccagataaaaaggaggcccaggcctagagggaaaaaaaaggaggagagaaaagagaaaggggttgggactctggcgaatgggttctagagcctgaactctctctcgctctccggctctctgtattccttcacgcacagatccaccagaacacaggagtagggtgttacgcttctcagcggcccgaacctgtctacgtcgcccgtgtcttgtgcatttcctctctcgctgacgttcctcagatcgagggcgaagaacctcacttagcgcccccggccgaaccggcaaaggggggcctgcgcggtctcccggtgaggagccccacgctccgtcaacagcaaatgggcgttgtgaaggaggttcttgatccgccgagtgtccttcttccttgctctgcgttccttggcttgatgaactgagatggttttgcacatgttaaagatggacttgaagaaccgcaaagaagagttggagtccgacgaggtgacagtagcggagggaccagcacgagaagaagcacgagtggttcgaccagccggcacggaaacagccttgatgggacgaacttggtaaccggtgtgagccacttccttgtgaaacttcttcttggacacaatctcaatcatcttcataatgtaaggcccatagccatgtcctcgcttaggtatcatggagataagccagattttttcaaagatgaagtcaaaagcatcaaagagctgtgggtgtgccttcatcttgtggagcaaatttcttgtataggcaaggacattgctagcatcaccttccttaggattaagagttttgcgcaagagcttgttgagataggcatagaaaggaaggagacctttgatggtgcctaactcatagtccacatcttggtacaagaagtgaagagaatttgtgtccatgggcttctcatcatgaatcttgacacgattggtgcgagagcgagccggaaaccccaaaatggcagcaaacttggcatatgtcactgagtatatgatgccatctgtcatccaatggataatcttttctttgtttggctcaaagtaaacggtagcatagaattgtgcgatgatctctttgcaccatgggtattgcaagcccattagttccttcaagttttgccgagcacaagcttcaatgacttcattaataattggatcatgcaactcctccatatacttccaatcaacccactgcatgagaatcgcccccttcttaggtgcaatcactgtctcatagtagtcctgctgaaaaaggttccaaaaccgaggatcagtggacaactgttgatatttgtagggatctttcttacgctctttctccacttcagtccacttgcggttccaccttgtgactctccgatgataattaggatctctagagggagcagtgacaaagaaaggcccttcttcatgagcggcttgctgagcggcaatgtcctcttctaactgaatctcttcctcaaaggatggagcatgagaaccactatcttgccccagatcagaagaagccgtggggttgcctcgcctcactttgctagttggagcacttgagccttctccactgactcggctgcggcgaggggggaagaggagcacctcgctccacatttgccacttgagctgctatatcttcagaggcttgagcttgcgtgtcaatagcatctttgcgggattcggacattcgacgtatagcatggcgagctttggaagtgggagaacgacctcgagaactcattggaacacggcgagagtaaacttgattcttgaactgacccttgatcatgaggatacactgatttagaacagaggataatgattaagaataacttggaaggagaatatttaggcatgaatcaaaagaactttgatctaggccaaaaggaggtcggatagtctgatttgccgttggactatctgatggcatatcagacattccgacagccatttgccctagaccaacaaatctcgattcacacaaaaatatccgatggaatcaaatgatcttctaggaactaggtctaggcactaaaacaagatggttcaccgaagggaatatagaaataatgcaccatgacggagatcgaagaaaaacaaggaaatacctcaagaaccaccaagaaaatcactagggaaccagtgatttggaaggagttgagggagggaaaccaccccaaagcgaaggaatagcagtcggagacttcgaaacgaagatttttggtggccaagaactagagttttgagtggagagagaaaacgactgctccaaatgggtgaaggggtaaaaaaaattacccctggggaggttaagtccccttgccctcggccccacgtcggatagtctgatttgaaatcagactatccgatgtggtcggattgtctgacatcatgtcagacagtccgacatcctttggcagagacaataaaggatggcacaaagagaatgaacttgatggctagactattacttgggcaaaagcagcacaagagaaataacttagcaccctcgagagagggaatgtacgaatctatagcaaattgtgcaaggaccaagattcattagagaatgagacccccgtacacatagattcaagctatccacatagattatgactagtgtccattcatgaattgaatgtgcactttgtcatgatgtggcatgcaaacttattctagtaaatgaaaataaatgtatgcaaaagatcaagccacattccgagaatccaagatatttagttcatttctcaactcacaaaacctagcttcatctagaggcttggtgaagatatccgccaattgtttgtcggttctcacatgttggatgtctatgtcgcctcttgtggaatggtctctcaagaaatggtggcgaatatctatatgtttggttcgggaatgttggacgtggttattggctatcttaatggcgctctcattgtcacatatgagtgggattttggacacatttaggccatagtctctcaaggtttgcttcatccaaagaagttgagcacaacaactcctagccgaaacgtattccgcttcggcggtggatagggtgacggagttttgcttcttggaagaccaagaaacaagggacctacccaaaaattggcaagtacctgatgtgcttttcctatccactttgcacccgacataatccgcatcggcatagccaatgagatcaaacctcgctcccttaggataccaaagacctagattaggagtgtgcactaaatatctaagaattctcttcatggccacaaggtgacactccttcagagcggcttgaaatcttgcacacatgcacactaatcataatatcgggcctagatgcacaaaggtaaaggagtgatccaataatggaacggtataccttttggtcgacgtcttttaatggccatttgatggcatgggagtgtggattggcttcgcattctccattccaaacttcttgagcatgtccttcaaatactttgtttggcaaatgaaacttcctaccttgagttgcttgatttgaaggccaaggaagaacttcaattcactcatcatcgacatctcaaaacgcttggtcatcatcctactaaactcttcactaaaagacttgttagtagaaccaaatataatgtcatcgacatatatttggcacataaaaatatcattatcatgtcttttagtaaaaagagttgaatcggctttcccgatctcaaagccgtttttcataagaaaattgcgaaaacactcataccaagctctaggggcttgcttaacccgcagagtgccttgtggagcttgtacatgtggttgggatattttgtatcctcgaagcttggtggttgctccacgtataccaactcgttgataggcctgttgaggaaggcgcttttgacatccatttgatataacttaaaattgaggctagtagcaaaagcaagcaatatgcgaattgactcaagtctagctactggctcaaaagtttcaccgaaatctaatccttcaatttgggtgaacccttgcgccactaacctcgccttgttccttatcatgaccccggcctcgtcttgcttgttgcggaagatccacttcgtgccaatcacattttgccaaggtcgctccaccaaagtccacacttcattccgggtgaaattgttcaactcctcttgcatcaccatcacccaatctggatcatttagagcttcttccacccttagaggctcaagagaagacacaagcgagtaatgctcacaaaaatttgcaatacgagagcgagtggatactcccttattgatgtctcctaagatattgtcggtggggtgatctcgttggatactttggtagattcttgggtgagctagatttatcggagagggtggcacttgctcgccttcttcaccttgatccaagcttgaagtagagggatcgtcggcttgggtcgatgtaggtggctccacttgtgttgaggaagaggccccttgttgtggctccctaggacgtacgtctccaagagccaacctcttgattgcttcgctagggacctcctcttcacctaacacatgcgagtcaacttgatctacttgagagccgttagtttcgtcaaatgtcacatcacgcgtgatctcaacaataccggaggttttgttgaaaacgtggtatgcacactcatttaacccatacccaagcaagaacccttcatccactttaggagcaaactttgaggatctagccttcttattaagaatgtagcacttactaccgaaaacacgaaagtaagagacatttggtttgttaccggtaagaagctcatagggactcttcttaagaagacggtgaagacagaggcggttgatgacgtgacatgcggtgttgatggcttcggcccaaaagcggtgcgatgtcttgtattcgtccaacattgtcctcgccatgtcgatgagagtccgattcttcctctcggctactccattttgttgaggtgagtatggagccgagaactcatgcttgatgccttcttcatcaaggaaactctcgatgcacgtgttcttgaactccttgccattgtcgcttcaaatgttcttaatcttgaggtcgaactcgttttgggctcttcttgcaaacttcttgaagatggcttgtgtctcactcttgtcatgcaagaacacccacgtgaagcgtgaaaagtcatcaacaataacaagaccatatttgttacctccaatgcttagataagcaattggcccgaagaggtccatgtgaagaagttccaacggtcttgtagtagtcattacgttcttgaccgggcgatgagctccaatttgtttcctggcttgacacacgctacacaccctatctttctcaaaaagtacatttgttagaccaaggatgtgatcgtgctttagaagcttgtgaagattcctcataccaacatgggctagcctccgatgccaaagccaccccatgtcggacttagccactaagcatgtctcatgtttggctttagttgaggaaaaatccacaagataaagcatccccttaagaacacccttaaagactaccgaggagtcatcccttctaaatacggtcacatcaacatcggtaaaaagacaattgtagcccatggaacataattgagaaatggacaagagattatagtttagagattttaccaagaggacgttagaaatggaaagatcattggagattgcaatcttacccaatcccattacttttccctttccatcgtacccgaagagtatgttctcttgcaaagtgccatttggatcaagggaagaaaacattgattcttctctggtcatgtgatttgtgcatccactatcaatcacccaacttcttccaccggagagatattcctacaagagatcaatttctagttttaggtacccacactttcttgggtcatcttatgttagtgacaagtgccttaggaacccaaagaactctcttgatggaaacatttttgcccctaggcccaacatatttagcaaccacacgaccactagcattcttcctaagaacatatgatacatcaaaaggacaatgtgaagcatgaccattaggaaggatacttttggccttaacaaagatgctaagaccttggggcttcttgatcaacacactcttgtccacctttccttttggtggaggaacatacccaaggccttcatggttgaagttgtccctttgatagcctaggtatttctttagtaccttactacccatatggcacttaagcaagccattgtgaaggagtcccataagcttctcattttgcttttgcaaagcacttaaggaagtagagttagtagcacaagcatcaatatcaatatccttacacctagcacatggttcattgcttggaacaattttggaacaaggtgcctcgctagggagagagacactattctttaaggtttcgaacttctcttcaagagagagataagcttttgttgatgtaaaacatgaggcctgggagatctgcttaactctagtgcaggtccaaagctcgccttcgggtgtgttagcgtgccagttgatttgatcctgcaatcaacaagaaatagagacaaagaaaccgcggttaaacctataaatgatagacgatcggctaagtgccgatgacatatcatttatctttgagccgatgtcatatgtaaatcgatcggcggttataaatagataataaagtactaaacctactcgatcggctgtagatatcaacaatatataattttatatctatacttaaattgagtgattgggatagatcggtcgccatgtcgagacagtataaatcacttagattgaaatatatattaataacagaactatatatgtttatagcatagccgatcggatagatctagtatgtatcggctaatactccaatacaacactatgttaagatgttgaaacaaacagaatataccaaacataagcttaatatacttagatgcaataatatcctgacataaagggcagatttaacatgtcaatgaaacatataaagcaaatataattaaatcagataagatcagctgaaactccgatactaccctaatcggcaaccagaaggcaggctagagattgatattctaagcatgacttaataaatcaaactcaactgatacaacattaagtatgaaaagaagaacaatatctagacaatcaagtcgctggaagtttcatagagtggtggatatcttatataatctaaaccaacatcgatatttaacctaatcggctgccctctattaacagatgttagccgattgtaggctagatggcgatatcgttagagattatgtaagatatatgataactcagcaaattacataaacaaaattagagtatcataaagatggaaggactaatcccgagaacacaagccgacataacaagttttacctcttgttgaagatcgaaaccgatgcagctcaacccgaaagcaagaactcatcgaaataaaactaaagcaaaaagggtggcgatgcgccgaaattgtattgaacgtgtgtgttaaaaattacatagggctcggggtctatttatacccgagaattacaagatatgtccataccggacacgactattatctctaacaaactctaagataccataagtccttgcggcagacttttgcccatatttatctgtaaaaaatttatataaaatatcataattaatagatacaattgccttcccaggactttatccatgtatggcaatcatcttgaagtacgtcaactcaaacccgatatcgaatacaagtcgtattgtcggaatcggctgcatcacttaacccagtctgacttggacttaaccgatactaatcgtagccgatctgggctccagccgattcttgctctgttctcgaatcgatctccgccatcggctccacttcgatctaatcctcttttccgatgctgatattaccaaatttggtcgttaacacatgccccccaagtccggaatatttggtaatgtttcggattttcttaacatcgactccgagcaagtttcgcactttaccgttttccgactgttattcaagcgctttaaatactagggaaaattggaaccatgccattataattttgcaaaatttgagatatgccatcctgacccacatgtcattgactcatgtgggtcctgcatgtcattgagataccgatggcatatctcaaactttgcaaaattataatggcatggtttcaatttaccgatgccgcagagaaatcttacaccattactcccgttttcaccgctcaagtgaaactctgccttctctctaacggcgattcttccaatgcacaaagcgatttccaggcgacttcacccttggcgagatctccgcccgcaacgatgtcgtcctccgccagcccgtttgctgcgccatcagctgagtatgccgaggtaagtccccatcggctagatcccctttctcaacagcagatcgattttccttacctcacattgctcttcttctttccggttgctttggatttgcagcatctttccaacctaattgcgattcccagcttgtcgcatgaaaaccactattttctgggtccaatcggcaatcttgactccactgatttttcattggtgaaaccaataggatcccctttaggctagccaaccctaactgagccactggaaaaacactttcaagtcttggccatctcttgagaaaaccacccctgagaaaagttggatcacatggtaccagcgcgtatcggctaataagaaagttcactgggatgagattggaatcggccaagcacttgacctaaccatagcaacttagctaaggacgagcccttaatggcagccgcctcttatttttggtccaacaccattaacgccttcttgttcaaccaagggccaatgactccaactttgatcgacattaccatgatcaccggtttagatgtaacttcatcggctaatcccatgagcatgaacaccaaaaatcagtttgatttcagaaccaaaagcataggtggctggtctggctatatggcggcatatatgggccaaggatctgttacccctcgagagcatgtagctttcttgctcatgtggctagaaaagttcctcttctgtggatccagttgtggccctacaaccaactagcaatttgtagccgaagccttagaatcaaagaaagaatttccattaggcaagatcctcctcggttacttataccaaacattgaacaacgcatcggccaaaatagccgttggctcagtagttggtgcaggtagaccatggtggctgctacaaacctggttgaacctgatggttaggaaagttttcaatcagccgcctgtgacagaagctgagttcccattgccagagccgattgtaggagacgatggagaagaacgcactcatcacatatgcacatcatacggagaatatacatccacacaaaccgatgctcgagcgaagctatcggctgagctactcaaggactggttctgcagcttctacgaaggttttaagaaagatgcacgggtgtggttttcttatgaagactcagcagatcttgaacttccatcagactttagatttcaagacattaatcatgaaaaattccaaaaatctagagaagttcttacagcttcaatcagtccatgcatccttcatgtcaacattcaccaagggagaaacatctaagtctcctacgaattttatcacccaatgagctcggccagacaacttggattgtgccaactcccaatcagcttattctttgccgacaagattcagtgccgaggagaaatcacatccactctaatgatggatcggctacttaacctaccaggaccccttctgggcagtattgataatattgagttggcaggatttagaagcaaaaatttcgacagatggtggggtgaatggaagttgcacttgtttcatcaatcagcttcgatgtatatgacagatctattccctgatgtcatacctcaggtaaacctcaccattgttagcttgaataattgttagccgattcattacttgactaatctcttgtttttgttctacagacaatcgactcttcggctaattactcatagactttgtggttgcagaagaagaaaactgctgtgaagaaaaaaccagcagcaacaattgtcaagtcggctccaccagtaagatgtctttaattcttttacttaatcaatctcaaccggctctatataacacttgtctattctacagcctcctcctcctccttctcctcctgtacagcaaccgtcaagtgaccagactccatcggctgtggagagtcatcacatcgaggaggaagaacaaccagctgctcctgctatcccaataagtttttctttgtctcaataattagatcagctacattttacccagctcttactctttccgaaattgtctctgcaggttttagccgatcttttctcttttgacatcagagattatcttgataaggcagaagaagatacttcaagcaaagctttagctcctctatctgacgatgtaaagataacacttgaagatatctctcaacggctagctagaagcctcttctttagatagcttggtagttgactgcggatcaattaggacacggctgcatgaagttcaagctctgattcccgaagaattggccgatgtcctaactccagccgcttatcttgaacaacatcagttcaagctggaaaaagccaagctaagactagccgaacgccgtgagcgcaaggagattgaagccacaatccaggtcaatcggcagcttgtgcatgaagaaaaagtcaaactcgatcagctatctgagggtccgattaagtccaatattgatcggctcgaagctcacaagatcgatctcttggcacagcttgaagaatgcaatgctgaactggatatggagcacaaaaagctagccgatctcccaaaatctatcaaagaacaaaaggcaaggctcaaatcgactatcaagaatgttgctgacctaaccaagtccctgaaggtcatctctggaactgatgctcaagatgcccaagccattgaagaagttgaacaaattaggctatccagcagtacttatctcaataactcttgtgtaataggacctagaaatttttgtaatcggctaagatgccttaataccccgctgttttaacactacctttgtgccgattaatacaacttctaaatttgctcaaaaattttcactttcatcatgcgatttttgaatatatgtgccccccctaattttataatgtcaacagcattaataaaattatacaagcaacttagggcgatatagtaataccggccattgcacatcggtaaaccataaccgattacaattggaaaaaaaaaactaagggcgatataacaatatcggccatctctaggcgatgaaaattcatcggctatcatgtatcggcaacatcagccgatcatgcattaacccaaacacttaggtaatatttcttcaaatacttgccatttagtaattccgttcttctagagccgattctaacctcccatggcaaaatagcctcatgtccataaacaagcttatagggagggacttggatcgatccatgacacgccatccgataagaccacaatgcttcgtccaaccgagtatgccattgccgaggataatcagaattttttctcttaatcaatttgattaagctcttgttagatgcctcggcttgcccattagcttgtgcataatatggtgaagaattcaacatttgatacccatgctatcgacaaactgaacaaactcatcggacacgaaaattgaaccttgatcggttgtaatagtttgaggaataccaaaccgatagattatatgttcttgaacaaattgaattgcatccccagaatcaacttttttcaaaggaatcgcctctaccaatttggtgaaataatcagtcgccaccaatataaacttatgtccttgactcgatggtcgacttatcataccgatcatatcaattccccaacctctgaatggccatggcttaataataggattcatagccgacgccggcgctcgctgaattgctccaaacttctgacaatcttgacaccctttataatatttgaaacaatcttccagcattgtcggccaaaaataccttgcacgccgaagtaaccacttcatcttatgagccgattgatgagtaccacaaattccttcatgaacttcgccgattgcaactttagcctgatcggcactcaaacacttaagtaacactccatcaatcgtccgatagtaaagctcatcatccaatagagtatacttcaacgccttatatctcaatttcctagaagctgattgagatggattatgtaaatattgatgcacatcatacctccaatcaccggctgttattgctgcaatttcagccttaacatctttgatcatcggcttataccccgatgccccctgggccaaatcattagcttcaatattttgttctcgagacacatgctttaaagtaaccagccgaaattcctgcatcagttcttggcacttctcattataaaccattaatgtatcactcttgcattcatattcccctgccaattgactgattaccagcaaagaatcccccatgatttcaatagcatcggcttcaacttccttgagtaattgcaaccctttgagcactgcctcatactcagcttgattattagtcgcataaggttttatagtataagcaaacttgaaacatgccccccgaggggaaattataaccaagcctataccacaatcatgagtacacaccgatccatcaaagaatgaagtccatggcacaacttcaaccgagccgattgaatcatcacaatgttccacaataaaatcggctatagcttgtcccttaatagccttcggcgactcataccttagatcaaactcagttaaggaaaatatccactttccaacccttccttttaaaatcggagccgataacatgtatttgataacatcggctttgcatatgacagtacactcgttagatagtagataatggctcaaccttgtacatgaaaaatacaaacacaagcacaacttctccataggggaatatctagtttcaacatccaagagccgacgactgagataaaatacaacgcgctcttttccatccaactcctgaatcaagactgagccgattgacttctcaccggccgatagatataatctgaaagatatccctttctgtggaggaatcaaaacaggaggagagctaagatattctttaatatcatccaaagccttctgttgctctgccccccaagtaaactgctgatcagcttttaatctcaacaatggtgtaaaaggctctaaccttccagacagataagaaataaatcttctaacaaaatttatcttgccgttcatctcttgtagttctgtcttgctctccggaggctgaatcttcttgattgcattaacactcctttgagtcacctcaatcccctctcatgaacaagaaatcccaaaaactggcccaccgatacaccaaaagcacattttgtcggattcatcttcaggccatattttctggttctctcgaaaaccttcctcaaatcggctatatggtcctctatttctttagacttaacaaccacatcatcaatgtagacttcaaccaaccagccgattagatcatgatatatgtaattcatggctctttgatatgtagctccagcactcttcaagccgaaagtcatcacaacccattcaaataagccgattgcaccaggacatctaaaagctgtcttatgtatatcttcttcggccataaagatttgattatatcctacgtttccatccatataactcaaaattttgttccctgacgcagcatcaaccagctgatcggctactggcattgggtattcatccttcggggtagctttattcaagtctcagaaatcaatgcacaccctgaccttaccattcttcttaataacaggaactatactagaaacccattcagcatatcggcaaggacgaataaaacaagcatcatataatcgtttaatttcaactttgacaggttcaagcatatcggctttgcatcttctcagaggttgctggtgtggtctaacccctggtttgataggtagccgatgttctacaatcgatcggctgagtccaggcatctcataatactcccaagcgaagcaatctctgaattctttcaacagctctatcaacttggctctaaattctgtagataaattcttacaaataaatgtcggccttggtcgatcacctggacctatatcaatttcttccaaatcatcggccgatataaaaccctgtccttgtttgtcatcgagatcatctaccgtgtccttgatgtagacatttgaaccctccacaacgccctcgaaataacagcttgggttctccatcttcaattggctgtatattagaatcggacacttttagaaaatctctatcccaaacttttccagataaacaatcgagaccatccatctcccaaagagctaaatcagcactagcaacattgactgacctgtcggctggcacaatctcaatcttgtcgtcttgccactgaatcaagcattgatgcatggttgaaggaatgcaacaattagcatgaatccaatcccttccaagcaacaagctataagaaccattcccatcgatgacaaagaatgttgtagggatagttttgttaccaactgtcagttccacattcgaaactcctttggtttctgatagattgccgccaaagtctatgagcaccatgtttgtcttgatgagatcttcaacgtttctgcccaactttctgaatgtagcataaggcatcaagttaacttcagccccaccgtcgaccatcatcttggacattggcttcccattgacataaccatttatatacaatggcttaagatgccgattctccgtcccctctggcttctcaaaaattgcctgctctggcaacaaaatcaatttggctgattcttcttcaacttcatcgacatcggcttgcttggtcccaatctcagcaggcaacgtgaaaccatgttgaccgaagcagttacgacacttttccccttagctaacctttttgcctcctcagctgtagcttcatcggctacaggaacctgattcttaacacgccactcctgcctcgactttgttttctgcagccgatggttaatttcctgttcaacctcctaaaagcactccctgttcctcaatctttgaacccttctcttttgattcttcgtgaaaataccagaaggacaccactgatttttcctgatttcattgtcctcttggccatgatcttgattcactggacccaatctttgatgaacaggaactcttgtctgccttagccgattgcccctaccatatgatcggcttgaattcttggcaatatcactgcacccaggacagtcttcaatagacggcagccttagaccttcatttcaacaaaatctaaagaactcacaacctcaatgaggatcaaaaccatcgtcatcttcttcatgatgcttctcctgctgcttgtcatacttcctctgatatttgttgataatcttagccgaattcacctgaaaaccccttgcacggcccctatcggctgttcagccagctgtatgcaccatattaacaggaaaaggattgccatcaaccttcatcagcctcttagagtcgtcaaacttgattttgcctccctcaatagccgcttggatctgctgcctgaagaccttgcaatcattagtcgtatgagatccagaattatgccacttgcaatatcttttcttccctaattcttcagccgatggaattgtgtgaccggcaggaagttgaatctgtttctctcggagtagcaagtcgaaaatcttatcagccttggatatatcaaagtcatacctttcctctttacctgagttctttacccattggcatggtataaccttcttactccttacccactcggctgcagctatctcagaatcatcatcttcatcatccgatccatatttataagggcaaacatgattaaccttcctagaatttttcctagcctctgcatacctttgttcatgcaaggctaccttctgtgtaagatgtgacaggctttcaaagtcttcagatgataacttctccctaattggagcaatcataccctgaaaagccaaatcggctaactgggcgtcagttaaactcaagctgtaacacttatttctcatctccctaaatctctggatatactcatgtactggctcatcatgcttttgcttgattgacgtcagatcggacagtttcatctcatgaatcccactatagaaatagctatgaaactgcttttctaaatcagcccaactgttaattgatccatatggtaaagaagaaaaccaagtaaaggttgacccagctaaagacaaccggaataacctaactttcaaagcatccacagccgatgcttcaccacattgagctaaaaatcggctaatgtgctcataagttgatgtactatcttgccatgagaactttgaaaaatctggaactttgaaccggttgggcaaaggaactctctcaaaccacttaggatatggctgccgatatagatttccagcatctttcggcctaagcctgaactgctccttcatgacatctgcaatcaaatcggcccatggccactattgaggtgtcccttgaggttgttgtggcatcggctcgaattggttgtattgaagaacaaattggggctgagccgatcctgcttgctggtattgaacatgaggtgatggtggctgatattgataattcaaattgccccctggtaattttgaagatccggctgaatattacgcaccaaatgttcaggaataactagcggaattaccgtgccatctggttgtacgtgatgtactaaatgctctgggacaacctaatttgtagcatgttgcacaggctgcccaccaggtgttgcaaaccctgccgatgaattcattgaaccttgctgttgaatcggctggacaacctgttgccttaatggagtttgctgaaccggtcgtacaactcattgagctaggggtgtttgctgcactggttgcacaatttgttggatttggggtgtttgctgaatcggctgttgcgggttggatcaacagtgttttggggaggcaaaaacatagatgcaacctggtcttgtgttagccgatccacattttgtccagcgtgttgtggctgttctcttatcagcaatcggggattgaccaattggcctggagccgaaggtggtacagtaggtgcgggagccgatgctggtgccatcggctgagccgatggtgcaatagaaggagctgcttgaacggatggatgactgttggtgatcaaaggccgataatttggaaatactcctccttgcaaataaactgggcctgcagcttggtattcagctattgtaccatcgaccattgacttcatcatatttgacaatgtattgactaacatcccagattgattgatcaaagcattgtgcacggcatagtcaacccgatcttggaagttattgaaaaactcctatgatgcattgccatcctgattaaaatttcctccacgcaacccctaagcaacatcaccttgaactccatgcaccccatcaccttgaaccccatggactccttgagaattgtcacgttgacctcctagagaaccgtctgtagcaccattgtcactcggttgagccgagccgtccggagcttgtttcccgtcttcacctttagaagaatggtcccaggatcatcggcaactacctttactttatacttctgaaccactgttcccttgctagtctgcatgaatgagttcaagaattgatcccgtgcctgctgcatcatcgcgtcgaaatctttcttctgatcaggtgtgaatttttctggatcgatgggcacgacgtttccttcattgacgtcggtcaatcccaacttctggatcttttccttaacagtgcttggactagccgaggatggcgatagcggtggtttctcggccatgaggaagaattgcttgctgacttcttcttggtcccactgggcatgccaaaagcgtgttgacgtaaaacacgaggcctgcgagatctgcttaactccagtgcaggtccaaagctcgccttcgggtatgttagcgtgccagttgatttgatcctgcaatcaacaagaaatagagacaaagaaaccgcggttaaacctataaatgatagacgatcggctaagtgccgatgacatatcatttatctttgagccgatgtcatatgtaaatctatcggcggttataaatagataataaagaactaaacctactcgatcgactgtagatatcaacaatatataattttatatcgatatatacataaatcgagtgattgggatagatcggtcgccatgccaagacagtataaatcacttagattgaaatatatattaataacagaactatatatgtttatagcatagccgatcggatagatctagcatgtatcggctaatactccgatacaactctatgttaagatgttgaaacaaacagaatataccaaacagaagcttaatatacttagatgcaataatatcctgacataaagggcagatttaacatgtcaatgaaacatataaagcaaatataattaaatcagataagatcggctgaaactccgatactaccctaattggcaaccagaaggcaggctagatattgatattctaagcacgacttaatagatcaaactcaactgatacagcattacgtatgaaaagaagaacaatatctagacaatcaagtcgctggaagtttcatatagtggtgggtatcttatataatctaaaccaacatcgatatttaacctaatcggctgccctctattaacagatgttagccgattgtaggctagatggcgatatcgttagagattatgtaagatatatgataactcggtgaattacataaacaagattagtgtatcataaagatggaagcactaatcccgagaacacaagccgtcataacaagttttacctcttgttgaagatcgaaaccgatgcaactcaacccgaaagcaagaaatcatcgaaataaaactaaagcaaaaagggtggcgatgcgccgaaattgtattgaacgtgtgtgttaaaaattacatagggctcggggtctatttatacccgagaattacaagatatgtccataccggacacgactattatctctaacaaactctaagataccataagtctttgtggcagacttttgcccatatttatctctaagaaatttacataaaatatcctaattaatagatacaattgccttcccaggactttatccatgtatggcaatcatcttgaagtacgtcaactcaaacccgatatcgaatacaagtcgtattgtcagaatcggctgcatcacttaacccagtcttactcggacttaaccgattctaatcgtagccgatctaggctccagccgattcttgctctattctcgaatcgatctccgccttcggctccacttcgatctaatcctcttttccgatgctgatattactaaatttggtcgttaacagctttgtccaagccatccactctctcttgaagttgagcatttgccacctcaagattagcgtgagactctttggtttgcttgtaaagccgtaccaaagcctcatttttctctctccttagcaagctcacccttgagttcatgagaccgctctttctcacgaatgagtaatgcctcttgcctcctctcaagggttgcatactgatcatcaattctcccaagcaactcactcaagtgtggtagagactccttggttatggacttgaacaattcctcatccataacctcatcctcaacatcatcctcctcatcacaaacaagatcaacattgattgacttgagggaggaaggtaccttaggctcttttgccatgaggcaaatgggagcatcctcatcacttgagtagttgaagagtcttggtggtgatgaaggcttgacggcaaacgtggcaactccttcatcacttgagcttgactcggagtcggagccgaaaatcatcccaaggtgagcttggccataacgttcccgcttgctatgcttgtgcttctccttcttctcatccttcttttcgcccttcttatcttccttgatgtgggaaccatccttgaggtaagggcaatccgcaatgaattgcccgggctctttgcacacgtagcacacccttgcagaatgtcttccacttgacttgttggagtggtgcttggaagaacttcccttgaagaagcagcttcacctcatcaacttgccgaacttcttgacgaagagagccatttcttcatcatcgatctcctccttgctcttgctcttgcggctctattcttcttcttcctttgccttcaatgccaaatcttccttcttgatgcttgtcgttgagctttggttgatgtattggatgacctccttggactcttgcacaagcatgtcatgggctaggatgcgcccgagcaaatcatgaggtgtgagagtcttgttgtccagacgctcacgaatgatagttactaaggtagagttccttggagtgattgctcgaaccatcttcttgaccacaacctcatcggtcatgtccttggagccaagtcccttgatctcattgacgatcttgctcaaacggtcatacatgtcgcttgggctctctccatccaacatcacaaacctctcaaattgccctttgaggatctccaccttggactcgcgaacactatccgtgccttcatgcaaattccgaagcgtgtcccaaatcaccttggcactctcaataccgtccacgcggttgaactcacttccactcaaggcgctaagtattgcattagcggcttgagcgttcttgtgctcgttctcgtcatcctccttggtgggatcctcaggtttttgcaaaacatagcccttttcgactattctccaaatagatgggttaataaacttcaaatgcatcttcatcttatgtttccaagcggcatagtccgtgccgttgaagtacgaagctttgccgctataggtactcacataagaggtagatgtggatggatagtcataaggaaacgtagatcccttatcaccatctttgccatcccccgtttggcccgacatgatctctccaagcggttaagcctaattagtagattaggctctgataccaattgaaagggtcaattaggcctagagggggtgaataggctaatttaaaactttatgcggaagctcacactgagttagggtcggaaagtctgatccacagtcagaccatctgaaaatatcagatagtctgatgttggatcagactgtctgatccactaaagaaacacaacaagtagatctagtgcacaaacaggagtatagcgcaaacagcgactagatctatagcggcacaattaagcaaagctaaagaagggatgaagagatatcaccaacaatgaagttcaccgagttgttcccggagttcaaatccttgaggggattctactctccgttgaggagctcactaagagcggggtctttgctaaccctttcctcaagaggttgcactaagcactcctccttccactaaggggtatctctttccttgcggaggcgagatccggccttcacaaacttctcccggccaaccacacgtagatcggtggctcgggagtaacacctagccgtctaggagtcctcaacctccaagagtaacaaacaccacacaactcttggtcaaaccctagtgctcaagatcgagtgaaacagacagtaggccctcaaacaccaaatccacaaccaccaagatccaccacacaaagaacgaggagggatttgagagagggagaaagagctcaaatatccaaagcaccttagcaccaagctcaacccaaagtgaatgtgaatgaatgagttgggtaaccctagaaaagggttaggtggggggtatttatagatcccccaaaatgtggccgttgggagaaaatattttcatcccacctcggaaagtccgaggtgacatcggatagtccgatgtttttgacccccaagcacgccagagacagagaacgaaattctggagaatttcggacaatccgatcgatcggatagtctgatgttatattggatattccgttatttttgaatcatgaatttcatcctctcacagagactcaagttccattgaatttcagagtctctgggtcatccgatactccgatcacatcggatagtctgatttgaaaaatcactcaagaggaataaaaagcaattcaagacagagagtgaagttctgagaaagttcagacagtccgatgtatcggacaatccgaccttatatcggattgtccgatattttttagccaacactcagaccaaagacagagggaaaagttctaagaaatttcggatagtctgagcatcggatagtcttatcaggatcggatagtccgacaggaataaaataggaacagtccaaataaaggattttgagcactagtgttctaccaattatatgcatgtggtagccctcttaatagtacggcatcctaatactcaagaacacaagatatacatggaatagaagataattaccacaaaagatgccgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 48582 - DNA, 724 bp, Oryza sativa
tagaatcttatgataggaacagcgcagaaacctgcaatggaaatgaaagatcaggcgagtgtggctgctacgcacagccgggtgcacggagcgccggcggtttcggcgggagaatccccctcggcagtagcgcatgatgggacagcaggctcgggatctggaatccagggggactagcagcagcgctctcctgcgcgtccgacgcgttcgccgatgggaggccagtcagaagctggcacgtcgcctgccgtcaactctccccgctagcccagcagcatcatcacgtgcccagagcaggacgtgcagcagtcccatccacctggatcatctgtgcaaatggaggccgcacaacagggtgtgtctactgaggtaatgagaccgaaaaccaggttacaaagtggcattagaaaggataaaatttatactgatggtactgttagatatagttgctttacatcttctggggaaccacaaactttggatgaggctctaggggataaacattggaaagaggcaatggatagtgaatatcatgctgttatgaaaaataaaacttggcatctagtacctcccaagagaggtttaaatgtgatagattgtaagtgggtatataaaattaagaggaaagctgatggcagtctagacagatataaggctagacttgtagcaaaagggttcaaacaaagatatggtatagactatgaagatacctttagtcctatag

SEQ ID NO: 48583 - DNA, 26300 bp, Oryza sativa
  unsure (1)..(26300): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttgggatcccccacacttcgccctcttccgtcacttgttcaacctcaagccccagccttcctgagcaaatccccaggtggttggaggcgtcgtccaccagctgtggcccaagaagaagaaggattacttcaatcttcccctcaaatcttctttgaaggggtggaattttgagtgttttttactactcaaacccctccccttctcttcctccgtatgctagtcatgcccctcttatcttctttcaacaagttgaaggaggcgaatctggccgacgtctacatcgctttgaacttcgtgcttcggcacatccaaacactcaagaacagggtgcatatgagttttgagtattgtggcccccacatatcccacttgggaattggatgagaggaatagggacaatgaggccaccacctggacaaaaatcttcaagctaggcgtagtggttactaccaaggggtgcccatactctttcaacatcgagaatccacatctttaggtaaagctcgcacattattgtctatgtccttcgttttacttccacccataactgttagtcatcatgctaagatctttatatccgagcccctaagatggtcggagaagggctcctgaaaaaggcccgccaaagatcccgccgagttcctaagctccaagcgtgcagggaaaaagctaagaagcaggctcccagagtagccgctttgcgtggccccaaagtcggtagcctttgggtaggcgtgaggccacccttatccctcattagggatacgtcaacaaaagcctactaccccgcaaagagagctatctgaaagttcaagtgacattgatttggttttgatgattaataacaaatccaattatgtgagactaatgtttttataagcatttctttgcctattctcatgtggatatgaaattggagtgttggtggacctaaatcacaaggatgaaatgcatggagatcaagctatatgtatcactctttctcttcatgtacatattgatatgttcgtatataatatttccacgtgattggcatatgcatgtgagactaatgttttgtttgagtattatctcttatttagtctatttacattgagaacgtggagatgatgaaggtatatttttattttaatatctatatttgagaaatgccttctattcttgtataggataagctctcaatgtttaatatcttgttatgcatgctcttgcttcacacaaatattttgtatgcatacatttagggggagcaaatcctatactttagttatgcatgtaatcaatccaagttattcaccttcatttaattgggatctttacatttgaacatatatttgagtatatgacacttgtggtgttgattaatactcatcatttattcatatccttttatacatgcgatcggttggtcaacatgtggaggttgacaaccggatcattgggactaataattttattgagttgaatgaaagaaataggtcccaaggattacaaaggtgttgatgctcaagtgatatcattacacctaacaataccaagaatgacaaagtgaagatattgaagatgtgtgatacgaagtggctattatggcaagatggtgaagggcaagcgatgctcggtcgcgatggaccatgcggcggtgaagggcaagcaaggggcttggcgccgaaggaccaaatccggtggtggtaaagggcgagtgacggctttgtcatgatggaccgtgagagaccatttgaagctacaagtaaccgcatcaatcatttgaagaatatatggtgaaacggtatcggcattggcgtccctctagacaatgaaagaaggatgaaaaaaaggcattcctaatggtataattatcttcttatttacatttgagtttaggaatgccgtactattaagagggatgcaacgtcgaggtgtttgtgtatgtctcggtgctcaaagtgacctatcatagtgctaccttgagagaagcccaagctttaacctatcctttgagtggttttagaccttgtttttggttgagttgggtagtcctctgagtgagctttctatagagtccaagttcatcgaaaacggactcccgagtgaaaagttatagtcgttttactctgtgcttttcggaaagtccgaaaaattaccggaaactccgaaaattttcggacattccgaaagtggctgcgaatatgagatttgcttctgtaagttttcggacttgtccgaaaatgcttttcggaaactccaaaaattacagtcttggcctccaacggctagtttttgaggggctcgggtatataaactcctccacccctcttttgaggggctgctgctcttggggagtattagacacatccaaagccaaatagccatccccatttccctacctttgtggtgcctctttgtgagggggatttgagaaggggagagagttggattgagagagtgaggagttgagagctagtgagcttcactccatcctttgtgtgcctctttgtgagagggatttgagaaggggaaagagttggattgagtgattgagaagttgagagctagtgagcttcactccatactttgagcactcgagttcatagcaagcaaatcttcgattgtgtttgttactcttggagactaaggtctcctagacggctaggcgttgccggtgagcacccaaggttgtggtgtgccatggaaagtttgtgaaggcttcgatttcgcctccgcaagggaagaaatcaatagtgaaaccgaggagtgcatttgtgcaccctcgtgaggaaagggttgaaataggcctggcccttgtggctcctcaacggagacgtaggatccgtggatccgaacttcgggaaacaaatcacgcatctcccctcttggtttgcccgttcttgcattctctcatattgtgcttgagcttgtttttacctgatctacttgcatgcttaattgatttagtaggtgaccttatatcttgcttagataccttatttgtcaccttttgattcatatacattttgtttgtttgagctacaagttcatagctagtgtttattccgttatccgccgaacttttcgattgagaccggaacttccaatcccataccggaagtttcgatttgaatcaaaagttatcatcactctgatatgctatgaagttgtgataatttttaggaacgcctattcacccaacctctaggcgacatcaaggtcctttcactatccactcaatcatgtgaaaacgccaaggtaggcacatctactctagcactcatcgccaagagatttgcatcgctcgaggctaggatatctactaccatcgatttatcactgtcctcaccacctgcacattcatctcataggctcgaggctaggatatctgtcgttgccgcacgcataggcaagagtaggggtgaaaacggtacagaaacggatagaaaccatctttatcgttttcattttcatattttttttcggaattggaattggaatcgaaaacctcggatacgaaagcggaatcgaatattatcgaaactgaaaacgaagcgaaaatgaatcggcgcaaatactgtaacgaaaatttatcggaataaaaaacccatcaaactgataaatccaattctcaagtctcaacggtcaacgatttatcataaaacataatcatataagtccaattgttaagtattaacagtacatcacaaaacacaatctatgaaaaaaattatctatgtttaagagagtaatgatgttgataaatcccaatgtaggaaaaaaatattcttatgtaattttagatttgcataaaaaatattttttaaaaaataacagtaaaacaccatggtattcactattaagtgctttaaaaaataacgcagggtatttcagttacaaaatttttggaaattccgaaaaaaattccaaaaattccgagaaaatttttggaaagtttccaaccgattccgagttgctacggaaacttcccttatcattttcgattccgtttacgagaaaatatttcctcgtttccgttttcgaaaaattccgaccgtcagattccgttttcaaaaataggtccggaatccggaaagtttccgtaccgtttttggccttaggcaagagacactggtcctttgcctccacatcatacagaggagcaaggtgaggcgtcgagactcagctatcgtggcgctcccaccataaagttgtcaacttcttgactttggcttgaacttgcatgtgatgtctttgagtgtatcttgtatagctgtgatctatgcaggtggtcatcgaaagaaattcccgctacaaatgttagcgaaccatccccaagtgatgttgcgtcctctcaagagggaggagagattccctagccgagcgccacctagccatctatcccgactcctcgatggtggaagagtagccaaccaagcctggcccgtgcatgggctctggtgaggaacaaggttctaatcttctgataggtatttataactcttgatttggcggacacttgacacacatgatccggcttccaatcaacacgatccaaaccctacaatcgcaacaccacgtctcctctggtaatcaaccgtgtgctacccgattggcctcttcgagaaggctaatccctgcatgcgaattgaagaactcaagcaagaacaaggtatattacaacttattttgcagatgaatgattaagaacttaaagttgggtttccacaaactgaacttgcagcgaaactgcaacgacataaataatataagaaaaatccggctataaaactatgacagctaatgtgaattccgcaaagaggactaggctgggggttagccctaggtcgtccaccccttggacttagcccacgatatatttacaaggcccaaaacccaaatcagattcagactggattatgtatgtgacttgttttacatattctctacagccgagttgaaactttaatgtgggaccaaaaccatctgaaagtatgccgagttggaactttaatgtgggaccaaaaccacatgaaagtatgcgcatatcacggggttaatctaacgggttaattaactatttgccatttttaagatgtgaaatttaacaaatttgccattggatccggtggtaaatcgttaaatactacattgaagaatgggaaatagttaaatacctctaatctaacggctgaaaaatggataaattttaagggaaaaacctttgaaaacaaaaccgcaaaaaatggcattgggttcagtttgggccgaattttcggggcactagcccatcactagtagtacgagtaggccgtacgactccgcgggcccacctaccagtaccagtccaatacctccaacccaagtcttcttcctcgtctcgtccgttcgtctcctcgcccagatccgccaatcgcccatggagtccccaccccaccccctcctcctccttctcacgctcctcgtcgccgccggcgccgcctccgccggcgccgatgacctggtcgccgagctgcaatccctgcggtcccgctccccgtcgggcgtgatccacctcaccgacacctccatcacccgcttcctatccgccccggcgccgcgcccctactccgtgctcgtcttcttcgacgccgcctcgctccactccaagaccgacctccacctcccccagctccgccgcgagttcgccctcctctccgcctccttcctcgcccacaaccccgcctccgccgacctcttcttcgccgacatcgagttctcggagtcgcagcactcgttcgcgcagttcggcgtcaactccctcccccacgtccgcctcgtccgccccgagcacacccgcctcgctggctccgagcagatggaccagtcccacttctcccgcctcgccgactccatggcggagttcgtggagtcccgcaccggcctcgaggtcggccccatcgtccgcccgcccctcgtctcccgcaaccagatgatcctactcgtcatcctcttcttggtctccattccgttcctcatcaagaggatcatggacggggagaccttgttccatgaccgacgggtttggatggctggggcgctgttcatttacttcttcagcgtgtccggggggatgtacgggatcatcaggcacacgccgatgttcatcaccgaccggtccgatccaaacaagctcgtgttcttctaccaggggtctgggatgcagctcggcgccgagggttttgcggttgggttcttgtacactctcgtggggctcatgatcgccatggtgacacacttgctggtgagggtggagagcctgcagatccagcgttttacgatgctggcggtcatgataattgggtggtgggcagtgaagaaggtgattcttttggataactggaagactggatatagcattcataccttctggcccagcagctggaggtaaatgcttgtacaatggcagacgatatggatggtttcttccttcggtttctgaggtatggaatttcaccttcctttcatgtctgtaattttggatgaaatattgtaacttgaacgtttggcatgactgtgctttttttagcaactacttgttatgtttggtgtagattttggtaattcagaaattcttcttcagtcaaacactactctgccccaacttctgagtgacataacagattcctaacataaatcgaacaacagaatcaaagatcattcaatattttgtgcaggacttgctagcctcgttatataacactagttgctcacccgtgcgttgcacttgacagtattgtaaaaaatgtaaatatctgtcaaattttaaactgatgaataagtggttgaatgttttttcttcaaaatccctttgaatgattgaacttaatatttaaacgctaagagccccatcggttggcctaataagccaaagcaaaagccaaaatttgaatttttgaacttgattttgagcttgattttaagatatttttagcgtaatttctttttagtgttggcttttaagtcgctacaaacaaatatattaaatttttacctataaattaattttttattccctaataagccgtttgggcttattaggaaatatgggcaaccgatgaggctctaaagcacttgctgcaattacaaactcataaagagtaaagtccatcaccggtccctaaacttgtaccgctgtgtcatcccggtccctaaactcgcaaatcgaccattcaggtcctcaaacttgttcgactgtgtcatcccggtccctaaatttgcagatcactcatttagatcctccaacttgttcagttgtgtcaccccggtccctaagctgccatgcatcgtatattcctcttcttgctttaatttgcttcaatgcatgcatggccaattaaaagacgcatagtggtatttgattggttcatggatagaccagaatgcttttatttgacactgtgatctcgctttgtcttctttgtcttcactgttgagttctgtgccttcatgaatcatgatttcatgcaaattagtacatcattctctatcttctaactcagggcctgtttactttgatgccattttcaaccttaccaaattttggtaaagttgccaaaaaagtggctacatttagtttgctgtcaaattttggtaactatataagaaatcctgccaaaattttggcaagttgccaaaattttggtaactatgccaaaattttggcaatgccaaaatttggtaaggttttttttggcaataaagtgaacaggccctcaatcccacctacattcatcattttggttctctactactgttgtccatcgaattccgcttttgatccaatttgtgtcttcacccccaccatctgctgcccgctgcctcaatgcaatacaaaatcacaatttattgacggctttttctccataaattcagtgccacctaactgctttgtcgccacaccagctacagcggtatgttgtgttttgcggcaatatgcagcaaccctgctgctttgcctctcccaggtgtaccgcgaagctaagaaggcgaaggagatcgatatgccatgtctcgcagtcctagagtggctgtcgacgatacagtcgcgggcagagccatgaatttctacgatactgagcctgatagagatatcaatgtcattatggatgtagagattgcatccaaagagtccacgatattttcaggtcgtgttttatttagcacaaatcctaaatccaatctacggttataagaagatgatccatctaattaacggttagatctttatggttaacgtgggagctcctaggaagtgcccaatttctataggtggatagataggcatatgcatccttagtagttggtactttgttgtagctatgaagttccacgtattttgctattggcttctctaatggaaaaagggaccatgtcctttctgaagagccttaggatatgtatactacagtgacgccttatatgtgcttaatatgcatgaatttgctgttgttctaattgtcttttgtataacgtactgctagatgataagagcatgtgcatcccttaagacctattttaggtatcacggtggatgctttagcactttctccctcaagatgcttgttagttttttgtgctccatcgaagatgctaaggtcaatggtagatcaaggaattttatactattgggtcaattcttacccatatttaagtgaagtcatatctaattctttctggatttacacatgaaaatgaagttttacaaggtggttctaaaaagctgcggggttgagctgaccccacaatttctatgtggacagagttgtggacctgtcactggctaaggttatcaaattttgacagtgttgactaaaatcacgttgaaaaaaatatgtttcttagcactaggtgttactgtgttaatcttagatggtaagcatttttagctttcaaacctttagccgcacctacctttacattccttttttcatgaatacatatcggctccacattgcttagacccatggtagctttttttttttaattcttcgttagcacctttgagcacctaggggtgcttatgttctcatcaatgaactcggatgaaatgtataattaggcatcaaagtgtttagtctaggattgatgctatattgtttcttttagggtacattatgtttcccatgtgctctctatattggctttgctgttccacatcaatgcttcagtttcatcctgcatttgtaaacaatatgtgatccgtcatatagaacatgtgatcagctttttgccattgaccttgtctattgaaacatcttgtgtggatatgattgatgttcttggattttgggtttcttgatgctaatgcatgaacagtttcaaagactcattcaccaaggtttgtgtatagatactactagatttggctgtctcaaccaatgcctacttaataacaaattcaagttctactagctagatgctttgaccgcagtcaaaatattatctaaacttgtatgtaaaagtagtggctacttgtagaagttactgtatgttcaaacatttttgttgacacgaaaggagaaaaatacagtgcaagcttgggtcagtcttttttcaacttccctcctgtcctatttacaattagtttgttattactaagtaactcagagtagatgtaacaatatattttctttgactgtgctactctgggtcatactgttgttcaactccaaggggcataatgatttggccatttgggtggtgtactactatactctccaatcacgaccaagtgtcagaattggaaatgtgcagttaaaccattttggctatatcattatgaatagttgtagcagtcaataggattgttgaaagccaacgcagttcagattttttttatcctgatgatctaatgataggcacagtaatctcattgttgagcatacagttaactaatactttttttcaaagaaaactgatatgctcaatagtattttggacattttagatatgttaatagtctagctgcaaaattgttttggattccagtgcattcagttgatgatttactattacctgattgcttctactctgaaaacatgtatttcaactgtttgtcaagcaaatgggactctgctgatggctcagttgcttggcctgaccttacccacttgaacgagcaactccaaagtgccatgtagctaaaaaattgccatgttattttatgtcttaatgaaaataaattacctgcaatccacactccacacttttagaaaagtcaaacatgtagggctaatgcggccataccatattgtagttggaaaacacaagaagctatagggtttaaccattctgttcctgagcaacaaaagcttaaagcctaaaaatcatgtgtgcagttgggaggaaggcttaggcttggttgtgggcgtttcctaatgggaagatggttggggtttaacataatgttagttctaatggaaactttgggatttattaattgtgtatgcaaaacattattttgcaaacaatcttcttttatagtatgtttttaatgttcgaagattaatatttcattactttagtcttcaaaatgttttcaatattctggtaaatactagaaaagcatgataaaataatttttcatgataaatggtattagcattttcatataatctacatacttacctgatatttttagcgaacatcaacatcctagaagtggattgaaaaaaaatacaaatgccatgcatgaaattgtttcatatgccctgccattgataaacataacaagtagccaatgaatgttgtgtgtgatattatgcctatcagtatttggttcatttcacagtgtctagtctactctattgccagacaataaaaatgcatttgttctgattagtatccatgatggagctataatgtgattagatctcttttaagttcacgatcaattcgctgtttagcctctcctttgtgaaggccgcaaaaaagtgaagttgtggttaacaagtagttcatttatgctccggaccttgcgtcttgaatatagtagattaataatgaagctgccatgtttattttcaaaaatgggtaggttaaactacaggtttcttaaaagaatgtacaaatagtactccctccatcccagattgatcatcctctaagtaaagggcactaaagccaatgacatcaaaatactccctccataccacaatatatggcgcgcacacatattaagattcaacttttaaaacatttgaccaacacttagtataatatgaaattaattttatttattaaaaattatatcattagattgagatttaaatttactttaatatggttataattttgttgctacaaaccttatagtatatgagaaattataagctaaagattagttttggagaccgtgccagctttgaccgcgtgttatattatgggatagagggtgggatggagggagtactgtttactaattgtcatcatttagtctttttacataacaattgctatgctacgttggacaactatttcattatttgcttatgttatttcaggttatggaattatccaactttgaccgtgctgagatagagcatattttggagtgttgggacttgccaagtttatttttgcaaatttctgatgctgtagtatgaaatatgtagacctcaagtcatgttagttatgcagaggaattatgacattgcacatctatcacttgaacaagaaagtttggcttttgaattattggtttggtttcttcgaatgatgtatcgtggttgatgtagcttgtcaggtgcattgtcattttggaaaattgcttaatggaaatcattagcattgaaggggccaataggtcagtgacctctgtaaatgttggatgcgatatgcttgcttccagaagcaatccccgtgttcttttcacccatgggtggtaccgcaatttggcagcataattaggcaactagacaactactatatactgttagattagattgtattttaggtgccagcgttatataaagttcttcacctattgagtcgcaagcatttgaagatcaatctacaatctggatcatattcaatgaaatttgttaattgttggatcatattcaacgaattttagttgatcttgagaaaaaaaaattattgggaacataaccggcttgcaaaatttgaattatcacaaaatcttgctgcacggttatggggcacattttcacacggccaccaatttgcaaatgcactaacgttgttcagcttatgcatattcttcctccgtttcatattataaataggtcgctttgattgttttcctcattaattttttcaagtttgactaagtttgcagaaaaatttagcatagaatcttctgggtccaattctatgcgtgacgtgaacgtcagggtgtggtcgaagacatgggcacggacagccatacttagggctccactgaagatggcgaaatctgttcttgggagagttcctagacaagtcaagccactctgcactcctgccgagcacctaactttcgtaaattccctactatgacaagctccgtttgatctagtaacccgctgaaatgcagaagcgtagttaaagtgaatggagtccactgtcgctaacctcaactccgccttagtggctgatgctgggcctccgccccctcaagaccctctccagaacgatgaggttctcgaggacgctaacgctgccaacggccctatgccaacaacagtgagcatcgcatccccgagaacgcatcgccacgacgacatactcatcaaccgcctccctatcaaaatgctcacgatctccgcgaccaattgaacggccgaaggcgggagcaacaagaccaacacgatgccggacaccgacaacctcgcgaccagaattgtagagacaatcgtcgagatgacaatcgtaactgcgaccgagatcgagatcgtcatgattgctagagccgacaagacgagaacgaacgaggtcatcgaagtcatcgcgatgatcgagaatgacaagactcacgatctccagctctaaggcaaggccgaagccatgactaccgataccccgccttcatcgtcctcgtcatcatccaaggcggttcacgtggacctcatagtcgccgaccacccctattacctagaggtggatgcagagcctttaaagtcaactagcccttaaaattccgtcctgcagcggtagagaagtacgacatgagcatagatctagaggagtttttgcacgtctattctactatcctatacaccgccagtgcagatgacaatgcactggcaaattacttgctggcaacattgaaaggatctgctcggtcatggctggtgcaccttcctccctcaatatcttcctgcgcggatctttggaagcatttcatcgcgaattttcaaggcacctacaagagacatgtggtctaagatgccttgcatgccctcaaacaaaagcacggtgaacctcttcgagattttatccgacaattcaacgaatgtcagaatatgatcccagagatcaccgatgcatatgtgatatgagcattcaaatcagatgtctaagattgctacacaatccaagaactggcgacatgacggataatatctacaatgaagctgtttgaggtcattgataggtgtgctcacgcagacaaggccgttcgaagaaatgatgggaaggggaagttagtcaatgaaaatagttggccaaacaagatgctatggaatcaagttggcaatctagtcgcaagaaaggaggaaagcaaaaggcacagtcggaggttcttgtcgcagaataagagaaaagcgctccccaacgacctcctcctcaagatgatggccttgtactgcaatggtgtccggtgcacaagaccaacgctcacatgttcaaggagtgcaatgtattttagaaagccatgactaggaagatagcccaagacaagggaaaacgagtttgcatggtagagtagggcaccaatgaccttccgttcgatgccgaactagattttcctgacttcgatcaacatgtggcgtatatcttcggcggttcaaccttctattcttctaagcgggaatacaagaacacgaagtatgctctacatctcgggtatcgacgtctaagatgaattggtcaaatcagaagatagagttctctgacatcgactacccttctctgacgacaacccctggacgatacccgatagtagtcaagcctactattcagaacgttctagtcgcgcgatttctcattgacggtggcagctcaatcaatctcctcttcctcagcgcgcttgacgcaatggggattcctagaagcgagctcatcccctcagaacagcccttccatggcattaccccagagtcatcatcaaggttgttgggggaagattacattgcccgtgacctttggcagagttgacaacttgcagacatagcatatcattttgatgtagcagagttcgatattgcctacaacactatattcagaataacaacactcaccaaattcatggcggcttcgcattacgcctaccagttgattaagattccgggacctaaaaggataatcacggtgccagggaacgcgaagatggccgtgcaatgtgacaagatgagccttgatatagtcgagcaaactaccgcagtcccgccacaatcgagcctcctgggaaagtgagcaaacccaacttggcacccaaaccagacgacgccataaagataatcccgctgtctagtagcacacttgacaaacacggccaagattggcgccgagctcgactgcaaattggaactcaagctcatcaccttcctctatgacaatgcagatgtatttacctagcagccgtccgacatgtccggagtcttcagggaggtgattgagaacaagttgatggtttgacccgacgcaaaacctgtcaagcagaagttgcgtcgcttcacgccagatcgcaaagaggctatccaagaagagctcaataaacttttcaaagtaggcttcatcagagaaatcctccatccagagtggcttgccaacccaatcatggtacgcaaatccaacgataagtggaggatgtgggtacacttcacaaatctcaacaaggcatgcccaaggactattttccccttccacggattgaccaaccgatagattctatcgcagggtgtgagctgttgagtttccttgacacctactccgggtaccattaaatcagcatggccaaggaagacgaggaaagggcaaccttcatcaccacttcggtgtattctgctacgtcaagacgccttttggcctgattagtgctagatcaacttatcagcgccaaatccaaggggctttccaatcccaactcagcaataacgtggaggcctacattgacgacatcatcgtcaagaaaaaaaaaatcgagatcgtctgatcgatgacctaagggaaacattcaacattcttcggagacatcggctcaagctatatccagagtagtgtatgttcagagtactattgggcaaactgctcggattcctagtctttggacgaggtagcgaagcaaaccccaacaaaatcaaggccatcgaggaaatgaaatcaccgatgaggctcgaggaagtccagaagcttgccagatgtatgacaatacttagtcgatttgtggccaagatgggagaacgaggactgcctttctttaatttattgaagaaacattgacaggttcgagtggacatcagaggctgaagaggcattccttgtactcaagcgatacctcgccgatccaccagcacttgttgccccacaaccataggtggaactcttcctctacatcgccaaaacgccgttctccataggtactgtcattgttgtcgagcacgacaaggtccaattcctagtctactatgtcagttaagtccttcatgatgccaagactagatatccgaagatctagaagctgctctttgccatggtcatgacatcccgaaagctgcgtcactgcttccaaacccacaaggtcatggttgtcttgtcatacccccttggtaaagttcttcgcaacaaagaagtcataggatgcattgccaaatgggtcatcgagcttggccaattcaatgtccacttcgtcccacaaacgactatcaagtctcaggtacccgcagatttcgtcaccgactggaccgccccaaggacggcaaagtcgatcgtatggacaacgagcgatggacaatggcctttgatggagcattcaacaaccaaggagcaagagctgcattcgttctcacgtcaccaaccggagatcaatttcgacacgctgtccaattagatttctgagcaaccaacaacactgcagagtacgaaggacttagagcagccgcatcacttgtggtcaaacgactagttcagaaaggcgactcagaaatagtcaccaaacaagtgcataaggattacaaatgctctaatcctgaattgtccaagtaccttgtagaagtcagaaaactggagcataggtttgacgggcctatagtacaccatgtctaaagcaaagacaacgccgacgtcgacaaacttgctcgacgagcttctagtagagagcaaatggaacctggcatgttcctagaagtattaatcagtccatctgttaagagttcgctggacgacgacatcaatatcaccaccgacattggctcgggggctagttgatcgatcttggcggccgtctgtggagaaagagaaaacctttgccgaagacagttcatgttcatctgcggtcacaaaatacggatgcacgcgagcacatgaccaccagcgaactgattggtccgacactctcttgcttgaggcttttgttgatccaatgagcggtgccaaccaggtcatcgcatgtactccacagccagcctagataacctgttatggatctcttaggagctagacgaaccacatgcaactcttggcatagctgatcaagcgatgtgcaacaaccttcagtataagcttccatctggacttctctttccttgagaagcttcgagttctagcctttcttgatattgtcggttgctcgctccggctctttcttttcgaacttagttctccagtactcggcccagcgtttcatctcctcgagagaatgtttaagatctagaatagacagcgacaccattagcatcctttgttctgagtacaggagcaatacactataatttcgggttttcgcaccttgatatttctcacgaaggagcgtgagttgatcatcttgagaggccaacgtgccatcagaagtgacgacgaccagagcacggtcgccatcactcggggttgacgaggcctagggcgtactaggatgtgcaattaagcctgacgagcgtccgccttgctggacgttctcattctcgacttcaaagcatctacagaatacaaaagacaagatggaaaccttaaaaggataacagaagggaagtgttctcgggcaacagacgaaatacttgtccttaaggttgcaatgaaactaaaattagcatattactcttcaaaaaaggggatcacagactcctcgacatcctccaattctgatatcatgtcctcgcgacgcttgttggctcctcccttggtcatcatttgttcaatgttgacctccgggcgtgtgagtttgaggcacataagaacgtggcatgcgtcggtctggatcctagacctcattcccttgtctacttggtctgcatgggagctcgcggcggtctccagcttggttatcagcgacccaagggacaccaggaccgtggtttcgtcaggaaactcgggatgaggaacgctcatccccaggcccttttgcggccacatcgaggcgcccgtagttctagtgcagagcttgccagagtgaagccaggttgtccttggacttggtgattcctccgcgctggcaatctcctcctgcagcttggcgttgtccgcacgctcttccgttagatgggcttccagggccacaatgcggtgtcaaccgaataggcgacttttgcaagttgtccaagctcagccacggcatctcaggcacttgcttccaacaatcgataagcttgtagcagcttgttggaggcagaggtcgagcctgagatgacaagggcgccggccgacggaggaagaaatgtagggacaacagtagcagcagcagtagcatgaggcgacttggagctcacctcctcacaagccttggcacattgtcccgaggccgcaggtgaagggctgcattcaaaacatcttgggttacaaaagctacacgacgtcaagtggaaacaaaaaaaggtcaagttggtactcatccgactttttgtttcatcggtagcattcccttcttgatggaggcggactttgtgctggaagttatttgcaaacaagaaaggttaagatcgagaaggctaccatgattgtcagacaaacctgaaatagaagcctcacctcagagctgctcgtcctaactagtgtctccaccccagtagtcttctcgagagagggcaaacgttttcttttggatccactgccctgggcacgagggtggcggctgcttgctccaacacagccagctccttcaaagaagcgaacgcctagtggttgacaagctggccgatcacatccgttagaggccatgctagtatgggtcaagattactacttctatagccaaatatatgatagatatggagaatagtccgagatgcttacgttcacgatgatgtccttcttggcctatgggaggttgcttatcggcatcgggatgtcagcagtggccgatggtggatcgaccactacctgccctacccacttcaccacggctgcatcagaaacagctataacaaagataacagtgaaagattagatgttagagacagttcatagtactagggttatcagaaaactttgggttctaccaaagtgcgatatccacgtcatgtcctttgcccccatgtactcgtatgcagggtgagcacgggcttggagagactggattagacgacgaacaaagtcttctctacaacttcgtacccagtcagaccgcgttcttagagatcatgaattttgtcattgaatcccttcagagcaggggtcagagaatgtttggaggtccatgaccccagaatatgagggattttcttcgggaatagcaagacaaggagtggtatcagtgacatgaagataaaaccagctatccctctagtattttctagaggatggacagttaaaggggatgtatctacccttcatcttgtccctcagatggagactacaacatccagagattctaaaggcctccatccatccaagcttataaaatatctaaatagagctatgaaaagctgtaccccaaggtaagcctcgcataaatgagtgaagatactaaggaatcaagggagttaggattcagatggagaaggtgcatatcatagaaatcaagaagaagtgaaagaaactcggaaggactccggaagatccatggagagtcgctgaggagatgagggaagtttgtggcttagggttttttttttgcttgttggagcagtgggaaggtgcgcgaaggggaagcaaaatgtttgtttaggaaaacgtaacccaaatggatctcataagtggaatttataacccacgtccgacggttcgaatttggaggaagacggagaaatcaccgtcggagtttttgtggatttgtttatagcagtttaaagtttctgacttcaatccaaattcaaatttgagttgaagtctcggacaaagagaatagaaggaccatgtcatgtactctaaacttactcagctgttcgagaatggttaggtgagttcgacaatgattttcttcaggatctttgctctggaacattaacctactcatttgcattagagtcgggtgttactgtcagtgtcagggcgttactgtcagtgtcaaggataagacatacctcctatacatgggtttgtgtaatacggcaataccatatactcgatagtatatgagaatgtatcctttaattaaggaaatacgattgataaagaatgaaattatcttcctggaatataaggtgtccgagtcttagttggggaagataaggtcttcttaggcccatatcctgttttatctcttcgaattatatttggagaatagaataatctacgctataaatacaaggcccccttgtccagggaggggaattgagttacaagccatagccaaagccacatcaagaagcaatccggaggaagccagagccatattcgctgagtagatttcgtcaggtcgttctcgacagcttctggtcagtggatcagtctagttgtcctatttcccattgtaatctttgtggtattcccatccatatatccatataaacttgagtaggcttattactcatcctaagggctcgaactagtatcaatccttatcccatgtttgtatatccgatctcgcgtacatcctggttccaacgatccccatactttatgaataccatatagggtataacctgttgaacccttatcaagcaaatgctatgaaataatcacgacgaaaaaaaaatcacaaaatcaacttcaaaatttaaagaacaaactatgataaaaaaacataaaatcaacttcaaaaatgaaaattttaaatttatattatggctataaaataaactatgatgaaaaaaccacaaaaccaatcccaaaattaaatttaaaaagtatcaaattttggcttaaaagcgtaagtgtaagcgagataataggatgtaaatcatgtccaaaaagtttggactatttcaaggcctctttatagtgcaaaagcaaattaagaaaatttaaatacaaactcttggttcatatttaggccccatttagtagagctcctaattcaaactcacaactctaaacttcaactccagtgagagctggctcctttaggagctgaggtaggtaaaaaagtgtttggctagattactcagctccacgttaccacatccctcatcgccatttcgtccaacaccttgtaggcgttaccctggcgttgccgccgccgggcagcccgcgagccgctggcaccggtcagcccgcgagccaccgccgccggttggcccacgcatctccgccaccgcccctggccaccgactgtcgacgccgccgcctccccggctgcctcgcgcacgccgccacctatgccgccacctgtcgacgctgccgcctgcgagccgcggccgccgcccgcgagccgacgccaacacgccgtggcccgtgctcgccacccccgcatgctggccaacgtagacccgccgccgcccgccacaaccagttgtggccatcggagaaggatggggaagatgatggagaggagagagaccgggaggagataggtagcaaggggtagttcaatggcatttttgtgtaaatatagtaaaaaaattaaagggtaatgggtcttttggtgtggagttatggagcagcaaaaaactagctccacccccatgtacaaatttctggagccactttactaagttcgcttccaaaaaaaagggaaatccgtactttttggcacagctccgcttcaaataagtgaattgggaattggaacttggcccaaccgagccttaatgggcttgggtgatgtaaatggatagtactgtgcatgcccgtcctttccacatcatgatttggtaggtgtaatggacatccagtaatttttacctttgtatatttgggtatggataattcaactaaatggataattagggggtgtggctaatgggcgatcgatcgcttggagagatcgatccccatgccccccctgtacacacctctcctcccttcctcctccccttcttctcttcctactacactacaaatttaaaaaaaaataaaaaacaaagttggaaaaatttatgtatagaaatactatatataaaaaatatttgaattcaaatttaaatttgaagagggtaattaaacttttgacttataaactttgggtctataaactttaggtgtataaactttagatgtatagaaatactatatacaaaaaatatttgaattcaaattcaaatttgaatgggatatataatttttgatttataaactttgggtctgtaaactttagatgtgtaaacttgaggtgtacaaactttaggtgtataaatttactaaaataggaaagtaaagcggtgcctaaaaaggaaaccacgtggaggagaggggggagacccgatcgcccctggcgatcaatccccattagagcaactccagcagagaccctaaactcagcccctaatcagtttttgagggtttagagataaaaactagattcagcagggaccctactagagcccccaaagtgaggaggaccctagattctcctcccaagcccccagtcctgggggttccgagtacggcccccatcgactttttttcctggcgtgaaaaaaaatccgcttcgcgcgatctcgcctcgcccgcgcggcactacgaccagatctcctccgacggccgccatcgactcccccacccacctccgccaagatcgccccaaaaaaggtgaggattttttcctacctttgttgtcgtcgtcgtccacagggccttcgacctccgcttgcacgcctggcctccgcctgcatgccagccgttcaaacgctcggccatcgtccgcctggccacacgctgcttgcctgcacactgtgttagagtccggatattctttgtacatgtgataatgctccatatagctgtcggacagagtttgttgtgttagttagaagcgatagaacttatccatgtaatctaggttctcacaacaaactctgaaccgaagctatatacctcattgtaatcctggcacccattttgtggcaatcatcaacacgtaatctcctcaccgtaggagttcctcgcttccacatggtatcagagcctgttgctagattagattagttcgtctttgtgtttctgcaaatggcgagctcttcctcagcagcggcgatctccaatcctctgttcgggattcaaatctcggataaactcaccaagaaaaatcaccccctctggtctgcgcaaatccttaccaccctatggggtgcgcagctggaagggcatgtcaccggcacagttgaagctccggcggccgagtgcgagaaggaagatggcgacaagaaagtcaagaccaccatctccaacccggaatacatcaagtgattcagtcaggatcaacaagtcctggggttcctcttctcctccctatcacgggagatcctgcagcaggtggctggcgcgcagacgacagcccaagcatggaacatgatcaacgacatattctcctgcaaatccaaggcgggcgccatcaacgtcctcctcgccttgacgactactcagaagggacccatgtccataagtgagtacattgccaagatgcgatcccttggcgatgagatggcggcggcagggaagctccttgacgatgaagagctgatagcgtacatcatcaacggcctcgactccgacttcgacgcagcggttgaaggattgatggcaacgacaagaattgctcctctcttaatctctcatgtgtattcccaacttttgagctatgaaaacaggatcagtattcgccaaacctacctccctacttcggcaaacactgcaaatcgtggcggtcgtggtggtcgcggtggaaatcgcgggcggtgctcctcgcggcggtcgcagtggcggccgtggtggcgcaggcggggccaacactgggcgagggcgcggtaacgacacccacccggtgtgtcaagcctgccataaacgaggtcacattgcaagtgactgctggcaccgctatgatgagaactacgtccccgacgagaagctaggcgacgcggccacatatgcctatggtgttgacaccaattggtatgtggacaccggggcaacagatcacatcacagggcagctagataagctgactacaagggagaagtacaagggaacagatcagatccacactgctagtggcgaaggtatgaatattaaacatattggtcataccattgttcctacccctagtcgtcccttacatcttaaaaatatacttcatgttccacaagcatcaaagaatttagtctctgttcatagactcattgcagataattatgcctttcttgagattcatggaaaatattttttgattaaggacaaggccacgaggaggacaattcttgaaggaccatgtcggcgggggtctctaccctcttcctgtcggcacccccttgagacaagcctttgctgttgcgccatcgtttgaacggtggcatggtcatcttggtcatccctccaagccggttgttcttcgagtccttagtcaaaataagttgccatgtcttagtaattcagttaatgagtctgtgtgtgatacttgtcaacaagcaaaatgtcatcaattaccttttcctagatcatctagtgtgtcgaataatcccttggaacttattcattctaatgtttggggaccttcttctacttctgtaggggtaaagaaatattatgttagctttattgattattacagtaaatttgtttggatttatttcctcaaacataaatctgaggttttctagaaatttcatgagtttcaaaaacttgttgaaagacaattagatcgaaaaatccttgccatgcaaaccgattggggaggtgaatatgtcaagttgaataccttttttaatgggataggcatatcccaccatgtgtctgtcctcatacacaccaacaaaatggagctgttgagcacaagcatcgccacatagttgaggtcggtctaactcttctagcccatgcttctatgccactcaagttctgggatgaggcatttttagcagcttgctacctcataaatcgcctcccaagtagagttataaattttgatactcctcttgagcgtttgtttaaataggctcctgattataaatctctcagaacctttggttatgcgtgttggccaaatctccgtccctataactcataagctccaattttgatccaaacagtgtgtctttcttggttttagcaatcttcacaaaggattcaaatgcttagatgtgtctaccggcaaggtgtatgtttctcgtgatgttacatttgatgaacaagtttttccctttgcaacccttcatccaaatgccggtgcccgtcttagagcagaaatatctttgcttccttcaaatcttatgaacactagcacattggatcaagggggagaggaacaaaatgatcaaatgtttaatattcacataccaaatgctactaatgatgcctgtacagacgcagggataaatgacaggtgcagtgctgaggacagtggtcaaatcagcaacgaaaatggtgaatcagagagctgtgctggtacacacagccgggtgcacggagcaccggaaatttggcgggagaatcctcctcggcagcagtgcatgacgagacgacggcggtctcgggatctggaactcagggggagcaggcaggctcccctgcacggctgccgcgctcgccggcgagggaccaatcgggagccggcgcgtcatctcctgtcgccagctctccccgacagcacagcagtaccagcacttcctcggcgccaggtgtgcagcagtcacatccgtcaggatcatctacacaaatggagccagcacagcacggtgtgtctactgaggtaatgagaccaaaaactaggctacaaagtggcattagaaaggaaaaagtttacactgatgaacctgttagatacagctgtgtttcacatattctggagagccacaaactttggatgaggccttaggagataaaaattggaaggcaaattttgctacaggacattgctattgtgtggttttatccctaggacactgcccaaactcacttttgggggaaaacactccataaacgtagtaatttgctagtgggcaccacgctgattaaaataataatttccggttgaagaggagagagaaatcgcgtgaaagttgtataatgtcttggcgcccacatgcaatatcatccatct

SEQ ID NO: 48584 - DNA, 2630 bp, Oryza sativa
ccacgacgacacgcggcgatggcggctgcggcaaatgcggcgtgtggtgtatacgctttcgccgcgtggggtggcagtggcggaggatgaggacgacaaccaggaggctgtggcgaagggtgaggacgacgacgaggaggcgacggcggacggccccgagatcaagatcctggcgcgcggcggtggcagtggtggcggtggcgatggcagtggtggcagtggcgcttagttgcagcggcaattgcgacggctttgatggcggcggtggcgctgcgtcggcatggcgacggtgaatgtggcagcggcggcggcgacgacgacgacggcacgaaaacggacagcggtgacggccggccggaggagatcgagagagatcggagagggtggtaggtcgcgatggggatcaggcggagatggaagagctggcatgtgggcccaagggcatttttggcatttcacgcgatttcaatctcctcctcaactggaaattattattttagtcggcgcaatgtccaccggcaaaatatcatgtttatggagtgttttccctcaaaagtgagtttgagcagtgtcctagggctaaaatcacacaatagaagtgtcatgtagcaaaatttttcaaattggacagaggcaatgaatagtgaatataatgccctcatgaaaaataaaacttggcatctagtacctcctagcagaggattaaatgtgatagactataaatgggtttacaaaattaagaggaaaactgatggtagtctagacagatataaagtcaggcttgtagcaaaggggtttaaacaaaggtatggcatagattattagtcctgtagtcaaggttgctactatcagaactgtactgtctatagcagcttctagagggtggatgcttcgtcagctagatgtatagaatgcttttcttcatggaatcctagaggaagaagtatacatgaggcaaccaccaggatatgaacaaggtaactaggtgtgcaaacttgataaggctttgtatggtttaaaacaggctcctagagcatggtactctaggctaagcacaaagttacatgagctagggttcaagtcatctaaatcagatacatccttgttcttttatagtaagggagatattacaatgtttatgttagtgtatgtagatgacattataatagctagctcctcaaataatgctactgatgttctgcttaagagtcttaatcaagagtttgcactaaaggatctaggtgagttgcattactttctagggattgaagtgaagaaggtaaatgatggtatagttttaacgcaagagaagtatgctaaggatgtgttaaaacgagttaatatgagtgactgtaaagcagttaatactccactgtctatctcagaaaagttgagtgcttatgaaggaacacctcttggaccagttgatagtacatggtacagaagtcttgttggtgccctgcattatttgactttgactagacctgatttatccttctcagtaaacaaagtttgtcagtatctgcatgctccaacaacagaacactgggctgctgccaagaggattctgagatatctaaaacatacagttaagcttggtttgaagattggtaaatctaattccttgcttgttagtgctttttctgatgcagattgggcaggatgtctggatgacaggcgttcaactggaggttttgccgtgtttataggacccaatcttgtatcatggagtgcacgtaaacaagctactgtgtctagatccagtacagaagcagaatataaagcactggaaaatgctactgctgagattatgtggatacaaactttgcttcatgaactggggattcaggtgcctaaaactgctaaggtatggtgtgacaatattggtgcaacttatatgatagctaaccctgtgttttatgctcgtacaaagcatattgaggtagactatcactttgttcgagaacgagttgcgcagaagctgttgcaggttgaatatatatctactaatgatcaagttgtagatggatttaccaaaactctgactgtcaaacaggtagagatgttcagaaataatctaaaccttacaggataagattgagggggagtgttagagtccggatattctttgtacatgtgataatgctccatatagctgccggatagagtttgttgtgttagttagaagagatagaacttatacctgtaatctaggttctcacaacaaactctgaaccgaagctatatacctcattgtaatcctggcgcccgttttgtggcaattatcaacacgtaatctcctcaccgtaggagttcctcgcttccacacactggtccccatccgcacgccgctcgcccctacactggtcgcccgtccacgcgccagccagccttcacaccgcccagtcactcaccgatcgatttttctggagaactcagaagtagttttgtggtaggaatactagttcatcttttctgaaagcacttcttgatcggagtacttgtggtactgtggttgtcctggtggatctttactttttttaatacgttttgagaattgtgctagactttgtagaccgtagaggagaacctgaattctgacctgtatcactagggatgaaaatggatcg

SEQ ID NO: 48585 - DNA, 3672 bp, Oryza sativa
ctgtccatcatggacgtagttcttacagaaaatttaagtagttcttacagaaagtttaaatgcaacttgacgtagtagttcattacagacatagtttagatgcaacctgcaaattaaattgacaaacatttcattcaaacactcattgtctcattggcactttgtcgtcgtcatcatcatcaacatagtccatctcaatattaccatcaccatcttggccgacggcgccgacgaagaggtggctgttggctgacggcctgacgcgacgacgctgacgaacaggcggcggctgttggccgaggcgacgacaccgacgaagaggcggcggctgtggtgatgggacgacgccgacgaagggacgagacgacgaggcggcggcggcgaaggggcgaggcggcggcggcggctgtggcgaaggggcaagatggcggcggcggcagcggcgaaggggcgcggcggcggtgggcggtggcggcggccgccgtcatgcgtggccgcgtggggcggctgttgtgtgagtgtcgcctgttgcttagctagctagggtttgtgttgcctgttgcatgttgggttgggttgggctgatgggctctttgggctgattattctgaatggttgatgacaactccggatatccgggaaaaaatcccggatagtttccgaccgttttccgattccgtcggatatcacccttactgtattcgttttcgtatccgagaaaaaatatccgaattcgtttccgaatccgagagattccgaatagttccgaccgaatttttccgaatccgaaaattagtccggacggacggaaactatccgaaccagtttcatccctatgtatcactgtacctatattagtagcactgcattgtgttggactgcactagtattgcaatggatcgatctgaaccattgacatatatacttcatcaagtttatcctaaaataattgcttgtcctatgcatatatataatcttgcacatatatatactatgtgctgtgcatatgcttctgtagttgcatttatattctctaattttgcaatgttgtgatggcagtgatttttgtacatggacttttccgacgatgacgatgatctccttgctgaatggtgggagcaagaggtgttgtccgatgatgacaactactatattgcagctgctcttcttacggacatagagcataagagaaccaaaagaaagtgttgtggttcagtcccaggtcgtgagataattcatagggacaggtttgactgtatgcattggaggtggaagaattgcccaacaggctggaaaggacagtactcagggcatgtggatgggccaaccatgattcttgaagctgttgcatctaaagatttgtggatttggcattccttctttggattaccaggttcccttaatgatatcaatgtcctacagagatcaccgctctttcaaaggcttactccagggacagcgcccgagttggagtttatggtgaatggtaagaaatacaccatagggtactatcttgctgatggcatatatccttcttgggctacttttgtgaagaccatttctaatccacaaggtaacaaaaagaatccattacgcaaaagttcaaggagtgaggaaggatgttgaaagagcatttggtgttttataagcccgctttgcaatggtgagaggtcctgctagattttgggatacagagaccctatggtacataatgatagcttgcgtaatcatgcacaacatgatcatcgacaatgagcgagatgaagatgtagactttgactatgatcagggggacagtgaggtgttgaggaaggaggattaccagcgacgcgataaacatgtgttggagaagtttctaaagatacataaagaaattgaagaccaacaagcacatgagcaacttcgagatgatcttgtgaaatatttgtgggcacttcatggtgctcggtagtttgtcatttgcattttctatcaactatgggttattttcaatatttgcttgtaagatttatcattttcatgttagaaaaatttgaactcaaatttgaatcgtgatgtttgaaattgtaaattcgaatatggttaaattctatgtgctagaattatttatgtttgaattattatggtgttaaactatatataaacataaattatatactaaaataaaagaggaaaagaaatagaggctaagatatgagggctactgctagagttgatgacatatttaggtccaaaagaattggggcagcccccatttgacatttaggagctctaaactagaggttactgctactggagatcctctcaggagtttcgtaattagggtggatgtttgttatccatacatgtattgtccaagtgcaaattattgtaatattcccttcgagaactaggtagctcgtggagtatctgatacgtatgtcaaattgccaactcttgaatcgtgcgaacactatatattgtttataagcttgtcaaaattaaacattttcattggacagaaacatgcggaaacttctgctctagtacattaactaaaacgaggaggacgacaaattaagcgcagtatgcgttggtctccagaagcattgataattaattgcgcatgttagcaacgattagaggcatgtttcaattccatctggacgagcagctatccatctaccccatgcaaaatcaacccccaaatatgcactttatttgtataacaacagtacaatgccgcaacttgacacgtctgaattatgattagccaagtctacggctgaacgtagtagcgacgactttcagaaggaattaggcagaaattaaacaggtacggcgtaataagtgagtacgtagctagcacacgttgcctcgcaaatcgcaaatgtgttaagcaattacacttgttaagctacaacctccgtcctaaatataaagatttgtaggatatttaagttttatatcataatgtaagtatttctatactaattttcataattccaatcattgcaatcattctaaagctaattagattgaaaatccaagcaattaaaaaatttaaaaattaacaactaaaccgacaaaaatgaatcttttaatttaactacttcctccataaaaaaagataaatctaaaattaaatatgacattgacggagcgtggggctcctcaccgggagaccgtgcaggcccccctttgccggttcggccgggggcgctaagtgaggttcttcgctctcgatctgaggaaagtcagcgagagaggaagtgcacaagacacgggcgacgtagacaggttcgggccgctgagaagcgtaacaccctactcctgtgttctggtggatctgtgcgtgaaggaatacagagagccggagagcgagagagagttcaggctctagaacccattcgccagagtcccaacccctttctcttttctctcctccttttttttttactaggcctgggcctcctttttatctggtcaggggtcaccacaagggcctccagctacctaagaaaagaaacatgctttttacaatgagggctagtctacatccggaagtgacctctgacaagcagagcacacgcctcctgccccgctcgcccgcttttccggtggacgcccatttcaaccttcatttaatggccagcgacttccttgccatacttgcgctgaagcctggaatgg

SEQ ID NO: 48586 - DNA, 1661 bp, Oryza sativa
ggggtcggggcgccccccccccggggcccaaacggaaacggcccgtcccctcggggagacagagggaggggtggccacgtcaccctcgggcccgacccccccgagggggtcaggccacgtgggtgaccgcggctacccaagcctctagtcacgataccaacggccccatgtcaccgacaggagcccccggcgttatgccagagcgatcgcccccctcgagggaagcgctcgggcgtgacgccactccttaggcccggtgacaggtggggccggtccctataggcgggcagaaacccagcggtcgcaaatcgcgcgcatcggcaagggaaaaccgaccgacaataatgagcggcctctttaagactgctacattactcgagcagcgcgcgaatcgggacgagccggttcgtttcgcctggagacatgatgatggcgcttttcacggttggcgggcgtagttaatgcgcgcacgatctgccccatctcaaccgctacggccgcacatctgccgcgtgcgccgcaaacgggcgagtggggttagtggaggcgtgggcgcgagaaacgagggggcgaggtagcgggcgcgggaagcgaggagccgggcatagcattggcaagggtgtaaagacgccgagaaagggattcgtttctttcctctcgccactcttccccttgccttcgccacttgtgctctaactcttcgtttcctgtgccctacccttgccgcactcgctcgctctcaagctcctcctccaccggcgtcatggcacggggctccgcaccgctcgatggtagcgtgctgccgccttcccgcatcgtgagcgagaggcaggccgggctgccgcgccgattcatgccggaatctgccaccggccgggaggtggtcgcgctgggcgagggacgcccggcgccacactacccggggcggtccgtcttcttcctctctttcgcaatggcggggctggtccggccattctctatttttttcatggatattctggagttgtatgatctccagatggcgcacctcacccccaacgcgataatgacgttggccatcttcgcgcacctgtgcgagatgtttatcggggtgcgcccatctctccggctgttccggtggttcttcaccgtacagccggtgtcgccgccgacggtagtcggtggctgctacttccagccgcgggggcaggtgctgaaccgctacattccctgcgtcctccgcaaaaagtgggacgactggaagagcgattggttctacacccccctcgccgacgaagcgcgcctccgacttccgagccagcccccggcgcaggcctccagctggcgggcggcggtagatctgggagacggttacaaccccgttcttgaccgcctggcgggtctgcgatcccaggggctcacgggggccatggtgttcggcgactaccttcgtcgccggatcgcgccgttccagctgcgcgcccggggcgcctgggatacaccgggcccgaggactacatgaggacccaccaggggcgcaaatgggactgggaccctgaggacttcaggatggtggtccaacgggtgctgaatctcagctccgtggaggcatccctcatcccccaaggggtcctccccctctgctgcgatccagagcgcgccaagatcctggtcatcatgca

SEQ ID NO: 48587 - DNA, 33920 bp, Oryza sativa
ccatctcccaaggcgagttttcactcacccgtttctttttgtgttctggcttttcttctgccttagcgagatcccgtcgcgccccccgccattccaagtccggccggtctgaggccgaggagacggcgaccgcggaggcccggaggcgggaagctgaccggcgagaagccgcggaccgcctccgggaagccgaggaggctgcccaggaggccgtccgggttcgccaggctgaggaggccgctcgggaggaggtcagactccgctgggccggggagtccgtccaggaggcagaggcggcgcgcgcacgccaggcggcctgccaaacccccgacccgactccgcccgaggcgatgacgacttccgaggccacccacgacgaggccgcgggcacgccgctcgggcccgacccctcgggcgacgcttgggacgagccagcttcgggggacgcccccgagtccggcacgtcgatcggcgggccgagccgcgcggcacccacaccgagggggctctcccctctgccttccgctgccccactgagcgcggagcccctcctgcaggccttggccgccgcgaacagcacggtgctggacgggttaagtgcccagatggaggccctacaggcggagcgggcggagctcaacgcggcgtgggcgtgcgttgaggaggggcggcgctcggtggaggccatggtggaggcgggccacaaggcacaccgccggcacgcctcacagctcgaggcccgtcgtaaggacctggcggagatcgccagggaggtggaggaggagcgggagactgccctcatcgccaccgccgtgctcgacgaggcgcgggacgacctccgcctccaatacgggagccgggcggtggagctagaggagaagcttgacgccacctggggagtccttgacgccgccgctgcccgggaacggcgggcggcggagaacgaggcggcgtcccggcagcgcgaagaggcccttgaggctcgcgccacggcgctggaggagcgcgcccgcgccctggacgcgaaggagagagacctggcggaccgcgaggccaccgtcgccacccgggaggcaacactggcggcgcacgaggccgcctgcgccgaagaggagtccgcactccgcctccgcgaggacgcgctcaccgagcgggggcgagctctcgaggaggccgaggccgcggcgcagcggctggcggacagcctgttcctccgcgaggcagcgcgggaggagcaggcgcgccgcaatctggaaggcgcccgcgccgagagggccgcactggatcagcgggccgctgagctcgaggcgcgggcgaaggagctggacgcgagagcgcacagcggcggggcggccacgggccacggcgacctagccgcccgcctcgcagccgccgaacacaccatcgccgagctgcagggcgcgctggactcgtccgccggggaggtcgaggccctccgcttggcgagcgaggtagggcccggcatgcttcgggacgccgtctcccgtctagaccgcgccgggcggcaggcgggcctctggggcgggcaatacgcgaagtacgccgccaaccaggggggcctcgcccagcgcctctcaaagatggccggggccctcgagcggctccccgaggagctcgaggagacgatcaagtcatcctcgagggacctcgcccggggggcggtggagctcgtactggcaagctaccaggacagggaccctgacttctctccgtgggcagcgctggaagagttccctcccggaaccgaggacggcgcgcgcgcgcaggtccgggacgccgccgaccacatcgtccacagcttcgagggtacggcccctcggctcgcgttcgtgctcgactccgacgaggagggcggtgacgacggtgcggacgacagtgacgacgaggccgacgacccgggcgcgtcggagtgagcccccaggcccccgccaatcttaataacttttccttcttcttccgaggccttcgggcccccttcttgtatagactgatttaatctgcaatcaagtaaagaggaaatttctgcgtcagttctgtttgttgtgtgtatgagacgagaatggtctgtgccgcggtccttctgtgtcttggcttgaacaagggctcgtgcccaggtcccagcctcaaacggcgcgggtcgaggctagtgcctggggagatcctcgtgtcgagactggctaggccgggagcgcggtgaccgagggttatggatgacccgattgtgggcctttgccgattcccccccggagttcaccacgccccggggcacggctcggttctaggccccgtttggcgattttagccggcccgggccaccgagggcagggtcgagcacgagcgtgctaattcaagccaagattcttcaaaaggaaacgatggcacagacacagtcctcaggaaatcgaaaatgcttttattgaaatgcggaagagaaaaagggtaagtatatgcatgtggtagcccccggctaaccctgcacgcccgggggggggggtgcggggttggcccgagcccgagacatgacacccgacccccgctaggggtagaagcgacgaaggtgttcgatgttccacgggttaggcagctctgtgccgtcgcccgtggccagccgaacggagcccggccgggggacgccgatcactcgatacggaccctcccacattggtgagagcttgctcagtccagaacgcgtttggacgcggcgtaggacgaggtcgtcgacgcagagtgatcgggcccggacgtggcgctgatggtagcgccgcaggctctgctggtagcgcgcggctcggagggccgcgcgccgccttcgctcttccaagtagtcgaggtcgtctcggcgaagctgatcttgatcagcctcgcaatacatggtgacccgaggggacctcagggtgagctcagatgggaggaccgcctccgcgccgtagacgaggaagaaaggcgtttccccggttgctcggcttggcatggttcggttcgccctgagcaccgctggcagctcctcgatccacgagtcgccgtgcttcttgaggatgttgaaggtcttggttttgaggcccttgaggatttccgcgttggtgcgctccacttggccattgcttctggggtgggcgggggaggcgaagcagagcttgatgcccatgtcttcgcagtagtcaccgaagagctcactagtgaactgggtgccgttatccgtaatgatacggttaggcaccccaaaccgagcagtgatgcccctgatgaatttaagcgcggagtgcttattgatcttgatgaccggataagcctcgggccacttagtgaacttgtcgacagcgacatacagatactcgaacccgcccggggcccgcctgaacggacccaggatatcgagcccccagacagcaaacggccacgaaagaggtatggtctgcaggcctgggccggctgatgggtttgcctggcgtgaaactggcacgccctgcaccgccggaccaggtcgaccgcatcgttgagagccgtcggccaatagaaaccctggcgaaaggccttgccaaccaaggtgcgtgaggcggagtgggctccgcactcgccttcatggacatcggcgagaagctcgacgccttgttcccgaggaatgcacttcaggaggactccgttagccgcgcgccgatagagggtcctttccaccagcacgtagcgcttggagatgcgccggacgcgttcattcccttcgcggtcctcgggtagagtcttatctgcgaggtacgcctggatctcagtgatccaagcaatcaatctaggggagctgggagcgctcccctcgggtcccgaggcctggactccgacgggcctcgggggccgttcaggcgcgtccgtctcccatagggggtcgggtcgcgccgacggctgggcaagcctttcttcaaaggcgcccggtggggtctgggctcgcgaggaagcgagccttgagagttcgtcggcgaccgcgttatcccttctgggcacgtgccgaagctctatcccgtcgaaatggcgctccatacgccgcacctggcgcacgtaagcgtccatctgcgggtcagagcactggtactccttacagacctggttaacgaccaactgggagtcgcctaacacccggaggcggcggatccccagtccagctgccactctgagtcccgcaaggagtccctcgtactccgccatattgttggtcgcccgaaagtcgaggcggaccaggtatctgaggacgtctccgctcggcgaggtcaacgtgacccccgcaccggcgccctgaagagacagggagccgtcgaactgcatcacccagtaggcggtgtgaggcagctgcgaggggcccgagctggcctcgggggcggagacgggctcgggagctggggtccactccgccacaaagtcggcgagggcctggctcttgatcgcgtggcgtggttcaaagcgcaaatcgaattcagagagttcgattgcccatctcaccacccgtccagtaccctctcggttatgcaagatttggccgagggggtaagacgtaaccaccgtgacccgatgcgcttggaaataatggcgcaacttcctcgaagtcatcagaatagcgtaaagcatcttctgggcctgagggtatcgggtcttggcgtcccggagggcctcgctaacgaagtagacgggccgctgcacctttcggcggggccgatcctcttcgccaggggccgcatctccagggcgctcttcgtccgagaggccacgcggggcgcactcggcttctgtgccgacgacctcggggttagagggcgacaggcgcggccttcccgcaatggccccggggccatcctgggggtcgggggcacctggcaccgtcggacaagcaggcggagggccagctccggccgtcgggggcctcgggccgccgttcggctcgggggcctctcctccctgctctctcccgggtcgagtcgacacagggtggggatgcgcggagtgagggttgtcctcgtcgcgctccacgaccaacgccgcgctgaccacctgcggggttgccgccaggtagagtagcaacggctcatctggctccggggcgaccaggactgggggagaactgaggtacgccttcaactgagtgaaggcccgctcagcctcctccgtctaggtaaacggcccggagcgtttgaggagcttaaataggggtagcgccttctctcccagcctcgatatgaaccgacttagggcggccatgcagccggtgacgcactgcacatccctaagcttgctgggggggcgcatccgctctatagctcgtatcttctcgaggttggcctcgatgcctcgggcagagaccaagaacccgacaagcttgcccgcaggcacgccgaacacgcacttatcggggttcagctttatgcgggcggagcggagactttcgaaagtttccgctagatccgagagtaaggtctcttggttgcgcgtcttcacaaccaagtcatcaacataggcctcaacattgcgtcttatctggctacccaaagaaattcgagtagtacgttgaaaagtaggatctgcattctttaacccgaaaggcattgtcgtataacaataagttcctatgggggtaatgaatgcagttttttcctcatcctccctagccatgcgaatctgatgataaccagagtatgcatctagaaaacacaaaaggtcgcaccccgcggtggagtcgacaatctgatctatgcgtggcagggggtaagggtccttaggacatgccttgttaaggtcggtgtagtcgatgcacatccgaagcttgccgttcgccttgggaacgacgaccgggttcgccagccacttcggatggatgacctcacggatgaatccggcctccagaagtcgcgccacctcctcgcggatgaaggcttgacgttccggggcctgccgccgcactttctgccggaccggccttgcgcccggccgcacggtgagacggtgctcaatcacctccctggggaccacgggcatgtccgccggtctccaggcgaagacgtcggcgtttgcccgcaggaaggagacgagcgcgtcttcctatttgtcgtccagaagaccaccgattcgtgtggtcttggacgggccgtcgcccagggtaacctccttgaccgggacctcgtcgcacgtgaccatctgctgccttggggcggccgggatggaggtgctgagtctctcgtcgccacccgcgggcttggacgccgcggcaaggtggtccgcgcgctgctccatacaagcaagcgcgactttgaggtcgccatggacggtgatggggccaccggggcccggcatcttcatctggagataggcgtagtggaccgccgccatgaacttcaccaacgcgggcctccccaggaccgcgttgtagggcagactgaggtccgccacatcgaagtccacccgctccgtgcggaagttggcggaaccaccgaaggtgaccgggaggtcgatatgacccagcggccaggtgtgccccggcgtcacaccgatgatcggctgggacggccggagcaccatccccgggaccttgatggcgtcaaaggctgcgagggaaaggatgttgagggctgcacccccgtctatgaggacacgccccaacttcacattgcaaacggtgggggaaaccaccatcgcgatctgtcctccccaggcaacgcacggcgggtggtcggtttggtcgaaggtgaggggcaactccgaccaccgcgcccgccgcgtcgcctcatgggtaggggccgcggccagaagctctcgcttcatggccttgaggctccggcgagaagcgtgagcgcacgctcccccatcgacggtggcgacggtggcctcaggctcctggaaccccaggtcatcgtcgccatcatcgatgtcctcggcggtggccttctgcttggcctcacctcgccggttgccggcgggagccgccggggtcttgccctcacggcgctcctgcctcttctcctcctcccacttcctcgtccgctcagccaaacttttgaccgcgcggcagtccgcgaggtcgtggagggaggtgttgtgcacggtacaccacttgctggtcgggcgctccctgctgggagcgccggcctccttctttttgtcgctcgcaggcctcccctttcggggggcccgcgaagcgccctcgacggcgaggacatgaccctcgtcgtcggaacgggccgaccccttcttcctcctcctgtcccgccgccctgaccgagcggcggacccgggggcggccggagctgccacaccagaaccggaggagttccaggaccaggcctcctccttgcgagccacacggtccgcgagctcaaaaagctgcgctgtggtctggggctccttggaggcgatcttctcgagcatgcggttgtgccgcacgcccctcctgaacgcgtagatcaccgcgtgtgcggggatgcacggtatggtgttgcggacttgacagaaccgctgaatgtacgagcgaagagactcgtcgtcccttcgcagctctcatcattccgacgggacggggcgaggcgtgtgacaggccgcctgttgccacctaacccgcgatctgaccggtctgtgaccggtcacacaccgtgaccggtcacggaccggataagcgtgcgctgcgccgcattaaatgcggcgtggcgcgctcgtccaacctgctataaatgcggttaggtgagcccgctgtgctcatctaacccacatacgtggcgccaaaaccacagggggtcggggcgctccagccctcggggccgaaacgggagcggcctgacccctcggggagacagagggaggggtggccacgtcaccctcgggcccgacccccccgagggggtcgggccacgtgggtgaccgcggctacccaagcctctagtcacgatacccccggccccatgtcaccgacagacatatctgagtataataaatctagataaaacgttgcatctaatcttaatttttcttttatggaggaagtatcttataacgggcgagtggtagaagcctgcatttggatagatgattgggttgatctctctgcacagtgtatgcgtccccagttgcagcctctgttttaaaaaaaaaagttgcagcctcttagaataattgctgcagcgaccggcagcagtaggtgggggcgtcacccttggtgattaggatcgggagttatccgggggaggtttccgaaacaaacataaaatatatatgtcgaggtcgattctttctcttttccctttcttaatatttagggactggtagcaacctactacttaggcatattctaatctcctatgctaatcacctaaaaagaataatgccctataataaagcgacagtagtgcacgcacacgcaactcaataataacagagaaatatttttactagctaccaaatcatttaggaaacaaaacttggcattactaacaagaaaaggacactgcgatctttttgtgaaaaataaaaaactgcaatcatgtttacaagagcgtggccaacagagtgcctatactgcccatgatcctaattcctagattattgaggttttaagtaaaaatgggtattgaatagtagccctaaacaaactcttaaaaaaaaatctcatctcatctcttaaaaagtttgaagtcgttgcatacgggagcacgggaggagacgaccgattcgtttaattttttatgtggcccacctttcaaagtttaattgtgttagaagggaggatatttttatcctttaaacggatttgctaaatctctggcgccataaaattccattgattacagtcggtttgcatacctatgcgctataccacacaactgcacagaggcctcccaactgtgttaccgtgagattgaagattattttctcacatacatcatgatgagtgatgactatatattaattacattatatgtaattttaggacttacatatgtaattttcgaacttacatatgtaattttgagacttatattgtaaatacactaaaattacatatgtatttttgggatttacatatgtaaatttaggacttacattataaatacactaaaattacatatgtaatttgtaaatttacaatgtaaatatataccgactattttttttttgaaaaatatggcgtcataaatgtagctactccccctttaaataccattagagattaaaaaaagaggattgaattttggtagtatgttgatgatgctttaattctatttcataagatactctgaggtgcaagtttaattttttcctattctcagccgtccaagtggtacgagctggacggtcatcatacaaatgataaattaagatgatacacagaaagtcaaaatgatcggtcttgattttgaggacaagaggattactaatacaaacaaatttaatatatattctctgttcttgatcgagatgtagcaacgatcatatatgtttagttcgatcgatagacgataataattttatgcttttctttttcataccctaacgtatatttaaattttattgatctaggttttactgccaaggaggaatcataaattggttaagtgagagattatgtacaaacaaaaatatcaattgcgagcattcacgaccaactttctccgttcatattatgagtcatttaaattttgttattagcaaatttctaaaattttgaccgggtttatagaaaaatatatcaacataacattaaattagtttaactaaattcaccatgaaatatatcttaatattgtattgactttttattgtagatattggtataatttttataaaagtaattaaaatgagacaaatttaacttaggacaaaactaaaatcggaacgggtaaaggatagaactcgaaagaaagtgacttcttggtaaatgatttttttaagctttgaaccaagatggcgtgtgacaagagattctgaaaatgaatgttaaaagcataaacaatgtcctagttcgttttcaaaccaaatgactcccgcttctcgtcgggtctaatgatggcgaaggagcaggtttttattcgggcatccacgatgtaatgaagtagtggttaataagtattgaatgcatccctactaccagctattatacattgtggaggtggtaaagaactactaccagggtataagcttactaccaggtatactttatggtgggtcccatctatttttttaattgtggcaattggcatgactcatgtttaaataactttttagatgggtcccaccgtactatccactctacacactattaccacctgacatgggcccaccttactacctagttttgcaataaacattgatgatgccttagttaattcatggcaaaatgtggcatacaaaccagattataagggcatcctcaatgtatgtgggacttacaaaattaggttatagttgtttctatctctcacaatgtgtgagtaagatatggcgcacatgtaaagcaatggttggatagaaaagagagagggcgagagaggtaatagtttaatgtcttttatggcatagttgctatctcctctattatccacctccacaatgataaagtaaagggtcttacaacccatttttcatccatattgtggatgccctaaaggccatgtttcgttagacaaaattccctcaaataccaatatccatctttaacgaaacataaattttctcaaataccaatatccatctttatacttttttatgcgtataataagaggcatacacattagacaattaatatggcaagagaaatttattatattacacgaacgagactaccgatcgggcgctcgatccaggcgtggaaaaatcgggcgctgacgtcagcatatacgcatacgtgcaaaaccactttaaactattttttctcttaaattatttatccaaatcatgatctggttcaccattaaattcgttgcaattaaatcttcaaaacaagaccacacatggatatattccgatgaaaatttttttagcttattattgaattattttaaaatgttgcacgatgttccaccaagtatatcggaattgtttcattaagtagattgaaaatgtttcaatcgtttaaatcggtcattgtttcaccttatataaaaataatgtttcagcaagtagcgaaagaatgtttcagttcactgcaacatttgatccatacataatgaaacattataaatacactaggtgaaacatttttggtggaacaaaaaataaaatgaattcccttaatagagggtttctaaaatatatgggtgatttgtttcaatggagtatgtgatggagacacatgacaggtgggggcagcggcacgtgggtgaggccccagggggcgcgcacatcgtggagggagggagtgctcgattttcctccctcccccccgagcgaccgacggggaggattctcaatattacacagtaccttattgtgtccaagccgtcaaaatgttatggcttgcttctgtctgttcattctctgtaattcactaaacaaaagaaatatattatattattggctaagagatgtcctgttaattgttgtaaaccttggcaaggtgggaataattaactatttgctactcttacaagtggttctaaaggatttgccagtggacccacatgtcatagacagcgagtggcaaatcgttaattgccatatcttaaaagtggcaaatagttaaatgttccggcaagttggcataagtcgacctattctattttgagctttgtttgaattaacatggtgaaagagaaagaagaaaagatcagcgacctaggtggctgagatctaactaggtccgtcgttactttcaattaggacaaacattttcaatatattatatttcttactattttttgagttgtaatcctcgactaaagttaagtttgcaaagcaccggtgatttgcatgcatataatttcaaaccactacacaagttagtcatatatttgtaatggtattccaagggctcgaaaaggtataatgtttcagtaatttaaagttgtacattgctaggactaaaattttaatgatatctaatatacaattttattttagttaagcattaattttgttaccaatggttttactttatttttatctaagtttaattacttgtgcacatattactgtcagttattataaatttattttatttttatcttagaacaattcattgttgaaccttttatctaaatgagttgtatcaagaaagtaaatatgtgatatgcatcacacaagttaactctcctcgcagataccatatactgcaaaccatatttttgagtgtctctgtttcgtgtcaggcggttgggaacccaactcccctgcacggaaaacagagcagtctattagcacgtgattaattaagtatttgttaattttttttcaaaaatagattattttgattttttaaacaactttcgtatagaaacttttttaaaaaaacgcaccatttagcaattcgaaaagcgtgcacgtagaagatgaggaataggagttgggaacctgcccaaacgaaatcgtatcctaaggtgtgaacctcttactaggtatatctcatactgctaaattttattcataacacaactaccaaagtccgagttgagtacgacaagacaagtagaagttttcgttaggatcaatacagagacatagtctatctatcccataaaaaactaacctaagactgaatgtgacacttctagtataacaaatctagatatactaggatttgtcacatccattcgttatttttgtgatggagggggctaagctcttttcacaaaagctaatccatcaggagcccttgccacaacccatcgagatcacaatctcaatgtattagtttgctaggcttccaccatatactcttgtacatgtcaacatctagtcaacacataaatatgaggaaggctatttcgtatgtttccatgagcccagacctatataaatctcatatcttttatgtgatgtgttcttcgtacgtacgtatcttcataccaggttgccctacacacccacaactattgtaattgtgtttcaaccattcgacaagttcgaatagagaatgagggttgtggtgagagcctttagatttttatccaaagaatgtgaagcataagccatttgaaatgtagatattccattcacaattggccttgtttaacataatgaaatttattttggactttgcttcaaggaaattacaactaatcaatacaaaggagaaatgacgagtgactacgaattatgaaaaccactacttactttcattattttatagttggggagaatcatcataacattgtttgttctcaacgacttacaagttatatgtagtcctattttccttaactcaaaagtaaaatctcagaatcaatgactgattactgtgttgatagaatttcatatacattaattaccactgacgactgacatcaaactaaaacgaaagataatatgagagaatcatccgtctaaactctaaatcatgtcatcgtaattggccggcggaggcataatgaagaagctaaacaaatctgactgaagtatgtactttgtgttgaccaatttggctctacttaaataaaacataattagcgatcaaaatgcactggtataatattagcagtcgtttttctacgacgggaggcagaccgatcgagtgtgttaggagttaggaataatccacagattaagacgacgcagatcctaaaacacacaacatttataatcaaaatcaaaaaacattcctcgcgttcgcgtaaagcacagcaaaccgtgttgccccgctgcgcgcgcgtgtgattggctggcttggtcagggtcaacgttggttgctactactacttgctaccaacatcaacaagaagaaaacctgcatgatttgcggctcctctccgtccatccaggctgccggcctgccgctgccgagtagtagtagtaagcgccgcgagtacgacctcgtccagtctctccctccctccctcccaccctgcgcgccttcctccttccatcttccaactacggtccaaccccaactactctaccacctccaacttttcagaccgcatagcatatcccccaccctttctacttctgtgccttcctccgctctcgccaccctcatgctctttataacccgcaccacctcatccgtcgcatcgatcctccctccctcaatcgctcaaactgcattctacaacctagctagcattcggaaatcgttccgtgctcaccacgtactcaccagcgcagcgcgccatgatgattcttgaggcggagcattccttcttctaaccgccgccgccgccgccggcggcgcgagcaccgtggtggagcctgtcgcgtcgtgctccgcacggacagcttcgccgccgacagctccttcgccggtaacctgggcgcctcgtctcgctcctggaggccaaggccccggccatcgggttcgacatcgccacggtcggggtcggcggcgatggggaggatcagcgcgtgcacggcctggcgctctgccgcggcgacgtcgcaagggcaacgtgcgccgagtgcatccgggcggcgggtgcgctggcgcggcgcgtgtgcccgtccaagaaggacgccgtcgtctggctcgacgcctgcatgctccgctactccggcgagccattcttcggcgaggtcgacgccgagcaccgcgccgtcgtcccgccggcccgcgtcctgcggggcgcggacaggtcggccgacctcgacagggaggtgtcccggctgatgaagcggctgacgaggacggcctacctgtcgccgctgctgttcgccgccggggaggccgtggcggtcggcggtgcgcagaggctgcacgggatggcacagtgcaccaaggacctctccggcggcgactgcaagatgtgcctggaatccgccattgatcaactgctggcgaggggttgcgccaaggagggaggcaaagtgttgggtggaagctgcagcttgagatacgacttctactccttgtctgattcctaggctaatttggattttgcaattttaaacttgtaattaaggtgaccacattgtgcatagagattcccatgtaatcacatactactactactactagtactcctacaagaaagagctctgctcataaatagagcagaatattgtctttcaattttgacaattttcaattttctttggacactaacatcgtgaaatgtgagcatcatcgatcgtcatgaatatgtgatttgaatcaaatttgaatcctttggcccggcagtaatttgcaaagagttcaaacagcgacgcgctacaacgaggcaacttggtaacttggcatggtacaaatttgattcgagattcatgactcataggattgagattttacgggagtttggcaacgcgcaggaccaagtacggatgaaccaagtgcgatgggcgacacattcaacaagatgaattcaatgtcctgcaataagcacggctgaccttttggataactaaatacttttgctgttttcaagtcaaaactcttgacaagatcctaaggacaacatgacttcccgcgtgttttcttgtcatgttggaacgaattctatctccagtcacagaatatgtgatgttttggacaacggcgtgatcactatgacactagctcaataaattgtactacatcgggtataaaccgcatcgtgtttcgttttgcactaggtttagcatatactttcactttacaccaggttatcttgaaataagtttcacttaagttcttaacaccaggatacatcatcaaacctataaaactatcatgaaatttcacagaatctgaaataaacattgtgaaacatggtatacattcaagaagtttcatatatttttcttcagttatagcttagtgaacatagatgttctaacccaacaaatcacatacacatgcattatattccctacgtgttctagagtacgataacatcgacttttaaatatacatttaaccatttatcttgttaaaaaaaatatgttattgccatttattttgttctgatttttttaatcattaaataatttaagcatgacttatgcttttaatatttgcaaaaaaatatgagacaaatggtagttcaaaaattaacgacattatccgtcaaaaaccagagggattatactaaatacaaagatatttagacagcattttggtgtacatgtttacgccatgaccgtgtgagtctagtgtttcgtgggttttatgcatcccattatacttttaaaatgtaataccattttatttttattctccataatttcctgaccgagagaaagagagaagaaaaaaaatgtgttgtttagatgtctgcacaatataccactatactacataaatgatcttttcatgccgacaaaaactaattttcacaggcgagtgagcactcgcctggagcgccaggtgtctgcaaaaatcggcattttgcatgcgggcaacacaattgcatgcataaaatcattttcgcggacagatgacctaagaaagccgcttgcaaagacccgatttttgcatgcgggcaaataaggatgcttgattgcaatgatttaaaaaataaaaaaagaaaaaaaaatccaaaacccaaacccttggtcgccgccgttgtgtgccgcgctacagcccttgcccccgctgcctgcggttgtggttgccgctcgcgatgtcgtgccgcccttccgcctcctccgtgcagcacgcgaggacggatccgccctcttccaagcactcacatcgccgtcgtggtcgtggtcgccactcctggtgttgcgccacccttccgcctcctctccacatgtgcaagggcggatccaccactctcgagcactccggcagcgaatccaccattcctaagcttgtcgacggtgggttgtccgctctcgatttagcccgcacgtacccgcaagttcgtggttgccgttcctggtgccacaccacccttccacctcctctccgccacgtgtgagggtggatccgccgctcctgagcccacacgcagccgctgtggtcctggtctccgcttccagtgcggcgctgcccttccgcctcctttccaccggacgcgaggacgtatccgccgctcccgaggttgctggcaatggatccaccgttcctaagcccgccggtggtggatccgccactctcgagcccgcacgtagctacggtgatcttggtcgctgctcccggtgcaaggccgccctttcgcctcctctccaccaagccccgagggtggatccatcgctctcgagcccgctggtggtggatctgcccttccgaagcctaccaatggccggtggatctgctactcccgagttcgccgacggcaaatccacccttcccgaggactgtcgtcgccagattcgccgcgcctgttgaccgccactagaagagccgatcgtcgcatccacctcagccgctgtgtaggagaggagaaggggggagcgaaggggaagatatgaggagagggagtgggagaggagtgatgggaggtggagcagatggggaggcagcggacgatggagaggaggagaagagaaaaaaaggaggcacattgagtgagaagggggatgaggagaaaaaaggtgcgggagaaaaaagagtagtgcgtggccagtgcgaggacacgtggagatagcccacttgctctccacgttgcctgcttgcgaaaatctatttttgtaggcccccttaagaggcccacatgcgataattggtgtattattgcattggacctcttaagaggtcgccttcaaaaatagattttcgtatgcaacccttgaactgcgtttgggaagcgatttttgcatgttgggtagttatgatccgcctgcaacttgaaagtgtctcgcctgtaaaatttgattttgtagtgtacaacacattccgtggtaggtagtttgttggtcaaaagaagattttgttaagtaaactcaagtacgcgctaatcaaccacagtattatacttatttctaagtgttcaattaagtcaagctatgatactaaatacaggtagccctgaatagttaagaaactagttgcactacaacttgtgtggcgttgataaaatatactactcgctagaaacaggagtctattgagctgtttcaggcttgcaacaaactcacagaatttcatacaatttaaatcacacatcaatgattctatgataatgatcgctagtatacatgaacccccataggtgccagttagaaaccggcaataggtgtcaggttcttaccctatgaccaacacctatagtattaagtgaaataacaaaaaagagcctaagaagccgtcattgccggatccggcagctgacggcgaggcgcatggcgaggccagggaagagctcggtgaggggaggagtgcgacggccttcacctccacctcctacccagccaacggcctccaccttgccctccgagccggccttctccaccgccaccgtcgtcgccagatctggaggaggagaagggaggaggtgaacagagaggagggccaccaggagagaggggggagcctccttttccacctccatcttcttcctagtcaccggccaccacctcgtgctctgcgccagcctttgctgctacctccgccaccaaatcgggaggaggaggaggagaagggagggccaccggaaaaaagtacgaattacccccctgaactatcgcggtcgaccgaattaccccccccaaacccgagaaccagagatcgttcaataccggacaaattagcccctcgactcaatctagagcgatcttatcctacgtagcgtatgcttgacaatccagtcagcattttctttttttaatggtagggcccacctgtcatatatactctctcacctcctctttccccttccactccgtcggtctctctctctctctccccctctctctcgggccgccggtctctctctcccccctctttttaggccatctggcataggtcgagcggcggcgggaggtcgacgtgcatggcggcgtgcaggggcgggtggtgggcggtggtggcaagtcaaaatggccgtgtctctctttgtcctcggcttctccctctgtgtgtcatctcctggctccgaattgtgggcggcgacgacgagcgtggcggtggcggcggcgttcatggtgacgttctcgttggggttcgggtcgtctagcgcaggtcgagcagcggtggacggtcggcgcccacggcattgcgcgggggcgggtgatgggcggcagcgtgggaggcgcaccgcgggccacggatgccagcgaggaggctgtggggctgtggcgtcacggactcacggagagggcgcgggaggcggcgggctgcggcgaggagggcgcaccctcgccggtgcatcctccaacctcattcgccccctcctggcggcagctggatgccgtccacctcatccgcctgtcctcttctttggaggccgccggtcaggatctgccgcctcctccttgctcggctctcctgacggcgccatagagagagagagaacgagggggagagagagacgcctaccatctccaatgtccttagcgccgcccgctactcgtctcgccctccccaccgggctcgccgctagcctgaggagagagagagagagggatgatgatgatgacgtagctggcctcctccaacaccctcctcagcgccgcacaccgtgccattcccgtgctctgccgccgccccccacacgccgaccgcccgtccgcacgtcgctgccgccgcccactgcccgtccacgcgcgcccgagagagagaagggggaaggggaagaggggagaggggtaatgacaggtgggccctattttttcttttatttctttttgctaattggatttccacgtcgacgccatgtgtatggcacgtaggagaaaaaccgctcaggattgagtcagtggggtaatttgtccggtatcaatagttcgaggtttaatatgtgtggttttgtggttcagggggtaattcgtactgtcgcaatagttcagagggataattcatacttttcctatggtaaatggcaggataatttgtctttagtactccctgctatctcataatataaagcatagttaaatttatcatggtcttcaagtaaaactaatttttagctttaattctcatatgctatatgaaagtaaattcaaacgttaatctaagggcatgtttggcacagctccaactccagttctccaactctcttggactgatgctcagccaaacagtttcagttacagctaaaatgggagctgcactaggtgaagatctctcacaaaataagctagagagttggagctggatttaggctactccacaactctactccagacccaactcctggagctaaatttaggagttggaactataccaaacttgccctaataatactatattacatcggtacagctagaaatacatgcaaatccattcaaaatttcagctctgcgttaaataggttgcacttttaattatttatgagaaaaggaacatgtcattggtacaaaaatatttactaggtaagtattgcctttgttttatattatatgtcactttattttttctagtaaaactcttttaaatttaacctaatctataggaaaatataataatatttttaacacaaaataaacatattattaaaaatatattcaatgttatatttaataaaactaatttagcgatgtagatgtatcatattagacagagggagtactacatacacaaattaattctttataaatttaatatatcaccaagctggtatatatcaccgggttaaatgtgatactgtttgttcacctatatcaaattttattcacatgagcatgatgtactttgatgtacctgcaaatgacatttgcagatgaaattttccactgatatatccctaaaccgagattcagaggatgcctttgttttttggcaagaggtgaacgacatatacaaattaattatggctgtgtttagttaaacacaaaatttagattttagttaaaattagagatgatgtgattgaaaagttatgtgtgtataacagattgatgtgatagaaaatgactgaagtttggatctttggatctaaacacagcctatgtattttgatggtctgacttggatagacaaatgggttgatcgagcaacctaatcagcttattttttagtgccagaacaattaataaactggatgaccataattgaccgatcgataccaattttaaaatgagaagttcattacgtgtgccatacgtatacggtaagtatactatgtgtgtgcgctgcagtatatgcgtgctacgtgcagttctgctgttcactcggtggcgtgacgtgggctgcggcgagggcaaaattgagaacacaacctgtaccattcaagtattcaacctaccaagacacaaccctatatagcagcttcacgggttaggaacatattgatgctcattagcgacatgatgaaacacatccgcactggagctatgcgtacacgcgtgcaagttttcaaaaagcgattggcatggaaaagaaaacattggaggaaagaaagaacaatgtttaatcctataaaaaagagtgatttgtccctaaaagacctcgtgcataattgagaactcatggaagtttaaatggaataacttgctgatacaaaattctcacaataaacgtactattggaaccatttgagaactaatcaatacttcaagtttgcaccctttttaacaggaattagagattatacagctatcattcttcacattaatttggtggggtgatcaaaaaataagattgtctcttggcatacagttaaggctactgaagaatatgcaatgatgtttataaatatgatgcatacaatatgtctgcccttactatgatccttggaatataccaggttcaacttcctggagatgttagatatggagcagtaatatttttgcatttttgcagctttttttacaaataactgcaaacttttgagcgtcctgtagcgaatttttcaaaacattataaagatcaagggaaaggtcacccttacacatcacgataaggggtctgctccatcaagtagactgcaggtgaaatcattgtttaccagaactattttctctgcctccttgataacagcgtctagttgaagaggtgcaaaactccgaccagggccatagaaatgaggaaaatagtttgaatcatcagctgcctcataaactaagccatctgaaagctacaacaaacaagaagagaaaatgctatgaatgtgaagtggcacaacgaacagatgaattctactgaaatacaaacaggcatgggcttgctacttgcctagttaccagggcaaaatacatgtatagtttttgttcatgaatagagataaaaaaaaacctggtgcgttctgaagtatccatctattatattattaaaacaactttgaaagaagacaccacgttcgctgtgggggctagaaatttccacattaatcggagaaaaagaaaagaagagtccaactagaaatacaattttaaaatagctgaaattcgaaattaaaaataagcaatattgaaacaagaggccctataagaacccaatacgagattaatcaaaattaaaaataaaaaaataaaatccaaaattagcaaaaaaaaaaaggaaaagaagagttcgagtagaaatacaatttaaaaataactaaaattcggaattaaaattaagcaatattaaaagaagagaccatataaaatcccaatacgagattataaaaattcagaataaaaaaaataaaaaaaatcaaaattagagtggtggcggttgatgtgacatctaaaaaactattaataaaacaccaaatgtaatcctaatgacgattaataggagggataacgcgtaggccgtgaagtaacaggtcaaggcggtcggcgggacttcttagagagtaaaaaagcataatgatataataatattcaatttttaaaatctcaatggcaataaaaagaagaggcggcgggcgggttgtacaagagtacaatggcagagccgtcgacggttggtgggacttctagaaagtaaaaaatgaattccaatgatagttatgttcaaattttacaatcccaatgacaacaaagagtaagcggcagacgagtcgtagagtagtatagtggcagtgtttgacaggacttctaaaagttataaaaaatgaaacccaacgagacaataaactttaaaaactacgaggtccaatttttaaaggttcaggacttctaaaaggtaaaagaataatcatgtttgattttaaaatcgcaatagcaataaagaagggagacagtgggtgagccgtagaggagtacagtggcaaagtcacttatggtttggtgggacttctagaaagtaaaaactgaacccaatcgataattacattcgacttttaaaatcccaatgacaataaacagaagaagcagtggatgagctgtagaggagtataatggcagcgtttgatgggacttctaaaaattataaaaacgaaacccaacgagacaataaactctaaaaactatacgatccaatttgtaaaggttctaaggagaatgaatagaaaaagtggtagatcgagttagcaaataaaaaaaagaaatgacaaaagaaagttgtagcaattggtatgacttttaaaaactataaaattaaaaacacagggataataaagtttggtctttcaaagtcttaagtcttaagacaacaagatagttatctaataagttttaagtaaaatcatattaaaaaaatatataattttatatgggtgctagccgcgcaactagtttaatttaaaatgatctattatgtgactacatccaatggagtttaaatacactgacacacgttaccttggaagtgtcaacttgtagtaggtatagatcattccttcctaggaaaaagttcttaagcgttttcctcacctaaaacaggttgagaatgagttctaaagaatacatatacagtgccaaaaaggaatggttggaggtcatatataaacaacgcccagatcaaattacaagacaaatatattattcagtgtatcacgaaaagtatataaattgaagtacttatatgcaatagtagtaacatacttttgcacaaaattgttttgtagaacttgagtgtaccaaacaataggtgtcacagtttagaaatgtatatgggattgttgagtaagcaaaaccatttccatatatcatatatgaaaacacagccaaagaacgcaatatgaatagcaggccctttcttaataggccacaatttctgaaatttaacatcctgatataatgagatgccatgttttcttttcgctagcatttacctacaacctgtttgcataaactacaaatgggcaccaatttgcatgtctgtcaaagcaatcaagggaaatagtatgtccttctaaagccaaacagaacgacttccgcacattatctattatattattaaaggaatagaaaaagaagcatccacgttcgctctcatggcctagaaattctcactttaatcggagaaaaagaaaaagtagagtccatatagaaatagaatgtagaaatagctgaaattcggaattaaaaaataaggaatattagaacatgagactaaagtccatatagaaatacaatttagaaatagttgaaattcggaattaaaaaataaggaatattagaagaggagactagagtccatgtagaaatacaattaggaaataactgaaattcggaattaaaaataaggaatattagaagtagagtatagagtccatacagaaataaaattaggaaataactgaaattcggaattaaaaataaggaatattagaagtagagtatagagtccatacagaaataaaattaggaaataactgaaatttggaattaaaaataaggaatattagaagtagagtatagagtccatatagaaatacaattaggaaataatagaaatatggaattaaaaataaggaatattagaagtagagtatagagtccatatataaatacaattaagaaaaaaatagaaattcagaattaaaaaaataaggaatattagaagtagagtatagagtccatataggaatttaaaactaactaaaatttggaataaacataataaaattaaaagtagagtttagagtccgtataaaaatacaatttacaaataactaaaattagaaattaagaaaacatgggaagaagagtttaaagtcaatataggaatacaatttagaagtaactaaaattcaaaattaaaaattaaagaatattgaaagatgagtttagagtccacatagaaatacaattagaaataataaaaattcagaaataaaaataaataatattggaagaagagcatagagtctatataaaaatacaatttacagaaaattcggaattaaaaaatattaaaagacgagtctagagtccatagaggaatttatataatttacaaataactaaaatttgatattaaaaataactaataactaacacgtatataaaatataatatgaatattatacattagtagttttgtaaagttattgcaaaatttaaattatgttgtaattttaatatatttgaataatataatgggaaaacatatatgctattatatgagagaaaatataatgatgctacccgcgcaatctgcacgggccaccatgctagttatagataatatagattattcttcactgctttgttacggtcactgctcagaaacatcctaagggcaacagcaatgtatcttacctaactaagtaataagtagcagggctaagtagtaggcctttgtaaagtgggtcgcatgagaaaaaaatattgctttttagttgctttttgtccaactcagcatgtagtagtagcacatcttgtgttggaaggagagagtgagagagattttaatgtttttttattcttatgagtgggtcataagcttagtaccgagcattagttactacccacttccacaatgcttattactaagtcataggaatagtatattgcctactacctgcttttttctaacattgtggatgccctaaatgaatcaaaagattccaaaggaaatggcatctaggatggccaattggacacacgcaagaagcaggagatctccacacgaagctctgtaggcaaacaaaagatgaaatcacacatgctgcgagaggcacctctaatagcattactgatttgcgtccaacctccaacctgggttgtaatatttggatggctttatccctaattttaaacagcaattttcagcaaagtagtctagcaccctagatccactgaaaaatcagagaaccaatgactaggcccaaatctccacttgaaatgtgcatatgataaatagagagatccatggggatcccgcgagtcggaagaaatcagacgtccctgctttctaattgggaattacctgactgaggtcgctgaggtggatacagccggtggagcggtcgaggtcaccgccaagggtgccgccggtgcgctgaagctgcgcccactcatccgccgtgctgatacggtatacgaacgcctgcggcgctggtttatccatttcggccgcccgctgacagtgctgagggttgaccatcagatacgtctcctctacgtttctgctccagaggacagaagatttcacttgttcctttttttttaggaagcactattggttctggccagcaataaagaattttatagaagaacggcagtccaagttacacgctacaaattacaaaaccaaatgtatgtaggccatgtttagattcactttaaaatttttcaccatgtcacatcgaatatttagatacatgtatagagtattaaatatagaaaaaaatagataaataattacacagattgcgtgtaaattatgagacgaattttttaaacctaattagtccatgatttgataatgtgatgctacagtaaatatttgctaataacagattaattaggcttaataaattcgtttctcagtttacaggcgaaatctgtaatttattttattattagtctacgtttaatacttcaaatgtgtgtccgtatatccgatatgacacgccaaaacttttcacccttggatctaacatagccataacctatctaaatttatttttgggtgtgttagtcccggcaaaatttaaaggttgggtggaaatgggacgaagggccgaaagttggaaatttgtgtgtgtagaaaaagtttggatgtgataaaaaaatggaaagtttgaaaaaaaagttggaaactaaacaagggcttccttgactcgttgtatattctgtaaatatgcaagagaattccattctatttacaccggcccatgaagaagccggcctaattagtaagatcaaataaaatgttgttacaaagttcaataggaaagttactgaaaagaaaatctaaaagtcacactgcttagaaccattaggaggagtgagtggcggaagctggattaaaaataagatttaacgaaaatgtttgtttcataaggccaactaagcacaacaaataccatatctatactataatcgcataaaaatatagtataattacagacaaaaccattttaaaataaagtaatattttttgcgccatacataattcatcatacaccaaaaattttataaaacatggtcgatagatatctttaatatatatatatatatgtatgtatgtatgtatgtatgtgcgtgaccacaccatgtccttatccctgttcctctatgtccatagaccatagcagcaggacgaaatcgattaggcgctagccgctaggcagctagccaccacaaatgacgatgtcctgcacgtgtctgcacgtgttgcttgcgcttggccctggcggctggcctgtcgggcgctaggctgctagctgctgcagtgttgcactgctgcggactgttggccgcacggcagcatggccgcacggggatggccggccggccggactagacggtggtggggctagcacggccggactgcgacagtgacagcatcgcattgtcagcttagcaccaagcaggaggagagaaggcgaggagcgagctattggctgcgaggagccagccgtcgctcaacgccggcaggccgtggctaggtgtcgcgtgcaccgtgcggtgcggagagttgtcgtaggctctcttgacctcccattatatagatgaagtgaataatttatatcatcaaataaatataatgaaacattcgacgtctcgagagaagaatattggaggcattgctgggtctttagcctgccagtcaacttcagcctgagatgtgcccgtcaaactactcgaaggcagcgaccagatgtgttacacatttaggagactggacaaaaaggctaaagatctatatcatctcaaacattcttaactcatactcatgtgaatttagttctcaggatgtgcactagattcacactttcatcttaagtatggacatacatagcaaacacatttcagatgaaagcgattaaaatttacaactactttagagatacataggccgatcggccaaatagatgtatgagggaacatcggaagcttgtctacccaatccccaagcacaccgactagacgtttaccccattaagtttaagtcctagaagaagcaatcgattacccgcatcactcaaaagactaagtttacaacctgcaagcaaaaggttaatccaatagcaagagtcagtacattattagaataatgtactggcaagcaccaagacaaaactaacaccctacttgcaaggcatataatcaaggaaggcataatatggatttttttagcataaagcaagttttatttgcataaaacacattcaaatcagatttgctttcaaataaatttcagcaagctagtacttagcatatgggcatcaaagtagacattaatcatgtataaatatacacctcattgccatccacggcagcaaggagatcattctcaaatctcatcataatttgaagataaaattcagcatttagaagaataaacacaagtctatactcaatacatatccacacaccgctcataaccgcgagcacggctaattgattagttttaactctgaagagtttgtacactttacccacatgatgcgaaataataatcatgcaagagcatggcacgcgatacataagtacccgatttattacccgcatcaacgtttttccaaaattcatgatttagccttacaccagcacgatatgtgttactccatcctaagccatacacgttatataacctagaaccgttaagtggcgggcccacgccttaaacttaacactgtggtggcggacacaacgggaacccaccacgtggcacaataccattgtattggacacgcttagtcacctaaactaccacatcggggtaaataggaagctcctttgaattattcgaactcatatacaccggcctaccagaatgtaaggctaaaccataaataatttactaatcttgggctatcccatactagcacatgtggttatactgtatacgaaatgaactgacattgagtgaagtccttaggtcggtttaggcgcactctccccctatcggtacacaactaatcaccatatgtgcaccacttaaggcccaaacctagaatctatgttttccatcattttatttatcaaaatcacaagtattaaaattctgtccagattatttcaaaatcaattttcatatttgtaatgagcccataatgacaaggaagatcattctaagcatggctaagcattatagtaacctagtgacatcaaaactcatatataaagtgttataattatattattcctaaggttaggaatggggatatggatatacgtggggttaaggtgataatgcaagtagtagaagtttgtctaacaagtttaacaaaattataatttattagtgtacaatcgacatgcaagatttgcaaacattttcaataacctctaaaacataggttcaaagtgatcaaagagagagggaggtgggacttgccttgtaacttggaaaaagttagcaccaaaatcacttcttcaccgtttaagcaatcatctatacaaagtacacgttatgtaattaaacaccgaattatgcgaaaaatccaaaatgctctaaaatgcatgatttgtgcacagtggataggtactggtctaagatgaatttaggtgaaagaattcctattttatctctttttatttgggagttatgaaatttagaagtttactcggtataatataggatttacttaggtactattctgaatttgttgtaaggtgattcttattaagtttatatttgctgaggtgaagatctgtatttttaagactaacacatttagtttcataacttttggagttaatatgaattctttatgtattttacaagttataacgtattgtaggcgtatagtgttctatatgcacatgcctttgatatttgaagtccaaaacttattctactttaattgtgatgaatgaagcaaataattttgttaactaatctatccctagttcacaagtttaggacttttattattttagttcatatttttataaacaagaggaattaatatatgattaaagtgtactaagttttggtggaagggatggatctatgccttcattggttcaacaagttttatttgggtttcattatagctagagtgtgtttctatatgcatttatatatatgtattgcttaatcaatactatgtgattagaacctatcctataaatttaaagtttagagttgaaacctgtacagaaggtgccatattttactctactatgttaaattatattacttgctggttctatagaaatttggttcactccatttggactaaagatgaattttctacaaattttacaaattaaaggttgctctatattggttattacttacataaatatttagaggcttttatcatacagtaagtatatacttttattttacaacttggaagtatatgttttggttattctacagaacttgggtttactcaaaaaggatctaagatgaattttatatgaatttctaaagttcagcttatataaaactagttattttaaaggtaatagttttagaggcatttgatgcaaagcaagtatacctttttattttattctacaggagagcataagtttgtgattctgtggaatttgagtttatcccaaaataggttgaagtcaattttccatatatttttataagtttgtgcatgctttatgtgtgatttaacttagatgaattttagaggtgaaatttgtactgtgagtgaaagtttttatttcataactttaaatttcataatctagtgagttcacagaaatttgaatcatctcaaaataatctatatttgattttatatggattttacaagttctaggtatttctcttgtatattctccgattttatctccaggggtccactgtcagtctcttactgttttgcagaaaggtccctagtttttccataaatgaactcgcagtactaggccccacatgtaagtctctagtgctttacgctttaaaccctaagcttttagtttactacaagacagggtccttgtcttcaacctccagccgccgatgtacagggaggagtggtcgtgagcttggcgagcttgccggcggcgataggtggctcggatgacgttggggtaaaaatagaaaatttagatgagttctttgcaaagccaatggtggtcttgttacaagccatagtggacagaatagatggtggcgatggtggaaacagcggcatgtctcgggttgcttgtgcatgtcgagttctagagcaatgtgatgtgagatagtgcatgcatgtggtcttaaggtactcaagggtgctcaccgaagcttgaaaatggcttacagaggcccgacgggatcttgacgatggacggacatgacggcagcggcaagaacctccgaggtaacggcgtcggttcaatctacttgaagagtggccatgctgttgacgtttttttatcaacatatgatcacctaacgatttgcggtgtaaataatagagtcctcaaaatcgatagatcggctaatgaaaccgatttcgagattaattcacttccgcggaatcacacgactaatttacaagcaaattagaaaaatgataaatatcataattacgtgacgacaaacgattagtttctgggcaaactagcaaagataactgtggtgaaaccatgtgtcttttagggacttaagcacatctgttaaagcagtgtgcgtgtggtgtatgcccaataatttggaagtttctttattcacaacagcaagctcttctttatagctgttatgctatgtgaattttcaaagatattgtcaactttaggttgcacgcatcatattctgcaaagcagtcggtatatcatctggatcatattattcggggattcacaccgcatatgctatatattggtatcaagtcacttggttgactataattatcaaaaaccactcagttggttggattatttattccttaactatatgcttggtttgttcaattaaccacatagtcgggagctacacctatttggtgcatctagtcgatgcacctgactttatttttcagccctccacagtcttcagatttggtaaaagtactcgggagaccatgacgaagatgattgaagcactcggctttggagtaatctgatttgagagaagattatcttttcgactgcgaaggtttcaggggctactatggagattatgggtaccccatacccacacggcgtggttatccgactggttataggggataacttatatctatgaaatatgtaacggatcataacttggatattacgtttccctgtatattatggaacggcctaaagtcctggtttgataagattgtaaagtagatttaggaaaccgataccgtattggttaaggtttctatcttgtaatcctgcccccatcctatataaggtgggcaggaggccctctaggcggcatgagacaactagatcgtcagatctataatacacccggcggacttaaatccccaaacaggagtagggtattacctctcattgagagggcctgaacctgtctaaatccttgtctccgcatccatccacttttaggtctcgtgcgctatccccttttcatattgccgaaaatttctttcgacaataacctcctcgctttcgtggagaagcacgaccgtttttcagcacaaaatggcaaaggttaaccaaatcctaggattgctagaatccagctatgaaaacaaaatagaaaataacggaaaagtaaagaatgagaaaaatagtagattgatagattgttgggggttctcccgttctactgttaccgatatactccctccgtttcgaaatgtttggcgccgttgactttttagcacatgtttgaccgttcgtcttattcaaaaaatttaagtaattattaattcttttcctatcatttgattcattgttaaatatatttttatgtaggcatataattttacatatttcacaaaagtttttaaataagatgaacagtcaaacatatgctaaaaagtcaacggtgtcaaacatttcgaaacggagggagtatataccggcaaaatgataatggtcccacacaaaataaacaaggaaataaactaataaaaatccattcttatctttaccgctgaacgcgctaactcaccggttcccatgatcccatctcctgccaaccgacgccaaaactccatatcgcacgcgggacgcagcggcacccaaatttgtctcggtcagcaacacgaactcctcaaggatctgcaaatttgcatgca

SEQ ID NO: 48588 - DNA, 1570 bp, Oryza sativa
atcataagataatttcaccatctattccaaaataatttggcctgcacaaatgaactaactataagccaaattatgatcaaacacatgcatgcatgtccaagaggttgattaggtcccatagatggtgcatgtgcaaagaatcgatgaggggctcccagcgaaggagaatttggtcatggcgacagtggccgaagttgaagccgatggaggccgatctccgtccatggtgctccattcttctcggttcttgaggggtttttaagaggatctcatggaggagttgatggcgcgatggctctgcttgatttggtccagaacgacgggaacagcgacgaggtcacaacggcgtcgcgcagagcacgccccaaggccggcgatgacacagtggcgttcccgttgattcgctgtacgaaagaggatgaaatcaaaaggagaatcttgggcatggtgaggagagtatggaacgtggaagagatagggttggcgaagactcgtcggcgacgacgagcatcgtctttgtcacggctggtggtgagatcgaaggcgaggagagcagcaagagctctctccctcggttctctcggcacaggactggaggatgaggcgaggcgatgcgactgtgggagagatggagagtgagctcggtgttagagttcggatatattgcatgtacatgtgataatgctcccgtatggctgaggatagagtttgttgtgttagttagacaagataggatcaatctctgtaatttagctgtacacaacaaactctcaccgaagctatttatctcttgtatcctgtcgcccggtttgtggcattattatcaacacgtaacctcctctctgtaggagttcctcgcttccacatggtatcagagcaccccgctagattagattagctcgtttctgcatctctgcaatggcgagttcttcctcagcggtggtgatctccaacccattgttcgggatccaaatcttggagaaattcaccaagcaaaatcactccctctggtctgcacaaatccttaccaccctacggggtgcgcagctagaagggtacatcaccggcacagctgaagctccggcggccgagtgtgagaaagaagatggcgacaagaaagtcaagaccaccatctccaatccagaatacatcaagtggttcacccaggaccaacaggtgctggggttcctcttctcctccctgtcacgggaggtcctgcagcaggtggctggcgcaaagacggcggcccaagcatggagcatgatcaacgacatgttcacctgcaagtccaaagctggtgccatcaacgttctccttgcactaacgacaactcagaagggacccatttccatctccgagtacatcgccaagatgcgatctcttggcgacgagatggcgggtgcagggaagcctcttgacgatgaagagctgatagcgtacatcatcaacggcctcaactcggactttgacgcaacagttgaaggattgatggcaacagcaagaatcgcacccctttcaatttctcatgtgtattctcaactcttgagatatgaaaacaggggctgcagga

SEQ ID NO: 48589 - DNA, 748 bp, Oryza sativa
actgcttcgtattcctgcagcccataactccgtctctcaccatcatggctgtgaccatagatagtttcaccataaccggggaaccccgtgtgtatcggtttcatttgcttttcttactccgaaagcctatacaatatgtgtccttttctggataaggtgttggattttttttccgctgttgttagtactctttcaaaatattaaaacggggtgtttcgtgtaaaaaaactttaaatatataagtggctttaaattatcaagtaaatccaaaattttaaatttagagcaattaaaacttgattagttatgtgctaataacaagctcgttttgtgtgcactaatttttaaccttcatctacagcccacaaggcactgaacatctctacagccttcatctacaaccttcaaacagggccaaggtatgaaaactatgctcccaaatctctacagcccacaaggtactgaacatcgaagtcaaattaaccgcccacaaaacatacaagtcatttattcgtgtgctgcacaaagtaatacactcagtgtgtatggtggaaaataacgtctaaaatctcatttgtttagagatacatatatgtgcgggcgtgccaatgtacctaaattcacaatgtaaacaaaacgtagagaacatgctctctatgaatctgaaaagatcataaatactaattcccaatgtaatatatatgtatgcgcgctccataatctgtcattggacatatctgactcgtgc

SEQ ID NO: 48590 - DNA, 734 bp, Oryza sativa
ctgcagcccataagatatgagttgtgcaagattgtacaggaagctgaaaaattatatgaaaggaagggcattgtcggatgggtgaattatatctgatcgtccaaaatgggttaatagtgatcgttggcgtttgtacccgtctaacctttttggtctgaagtctaaaccgcagagcaccgctccaacaaggcgcccacataaggaaaggaaaacctgcaacaactccatggtctcctcccgtttcgatcaaacaaaagaccagaaaataaaagagaaaaaggtaatagtaagcctccgttcccaaactcccccaaaggcctccaagctcgagctcgaccccgaaccggaaacattcctcgtcggcgaggagcggcgagatcccccgggccccggccatggaggggctcctgtccaagctccggagcctggacgcctaccccaaggtgaacgaggacttctacagccgcacgctctccggcggcatcatcacgctcgcctcctccgtcgtcatgctcctcctcttcgtctccgagctccgtacgcctcctcgctctcccctccctccctccctctcacttccgatctagttccgctgctctcaaccctagcctccggatgggtgcctttggagatccgatggccatggatttgagtatttgaccatgggggatatgctggacgagggtttgcctgattgatttaattcggtgcgctagtgaggtgtgggccgttgt

SEQ ID NO: 48591 - DNA, 16761 bp, Oryza sativa
  unsure (1)..(16761): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctagaagattcacccaaaatcttcatagactgcgaccaacagtcaagctcacaaaggtgagttctttcaagaatgctctgcaggacaacatcttcgctaattaaagccaacagaactcattaaggcatagccaacctgccttgcagctcacgagagtacatgcatcttcacttggagagggtatatatattgatactctcctctagtttactaatggtttgttcttcccaggatctaattcacgggatctccgatcacatagactgggttaccaccatagtataactcacatgggtctcaaacccatctccttcgatgcattgtttatcacatttcgtgatagtcccttcgtgaagggatctgccaggtttctcgctgtttggatgtaattcaacgttataactccggagtttcttaatttcctgacagacttcaatcgtcttttcacatgtctagacgatttcatattatccttagaactattcactttgacaattaccgtttgattgtcacagttcataaggatagccggcaccggtttttcaacaacaggcagatccattaatagatcacgcagccattctgcctcaacagtagcagtatccagtgccgttagctctgcttccatggttgacctcgtcaaaatggtctgtttgcaagacctccatgaaacagcaccaccacccagtgtgaaaacatatccactagtggctttgatctcatccacatcagagatccagttagaatcactataaccctccagtaccgcaggatacccagtatagtgaagccccaattccacagtacctttcagatagcgcattactcgctcaagcgcacgccagtgatcatctcccggattagaggtaaatcggctcaacttgctcacagcaaaggagatatcaggcctagttgcactagccaggtacatcaacgagccaatgatttgggagtattccagttgattcctagcaattctcttgttcttgcgaagcaacaagctaggatcataaggtgttggagaaggcttactatcaatgtagccaaagcgattcaagatcttctccacataatgggactgcaagagtgtaatcccattctcacctctaattagcttaatgtttaagataacatcagctactcccaaatctttcatatcaaaattttgagacaagaatgatttaacctcatttatcacctcaaggtttgtcccaaatatcagtatgtcatcaacatacaagcacaaaataactccctcacccccaccatggcgatagtacacacatttatctgcctcattgactgcaaagcctgcagatgtcaatgttttgtcaaatttctcatgccattgcttaggagcttgtttcagaccatacaaagacttcaacaatttgcacactttgccttcttgaccttcaactacaaacccatcaggttgatccatatagatctcctcatccagctctccattaagaaaagctgtcttaacgtccatttgatgaacgagaagaccatgtgaggctgctagggaaagtagcacacgaattgtggtcaatctagcaacaggtgagtaagtgtcaaagaaatcttcgccttctttctgagtatagcccttagcaacaagccgagccttgtacttttcaatagtaccgtcaggcctaagcttcttcttgaacacccacttgcaccccacaggtttacacccatagggtcgctctgtcacctcccaagtcccgttagcgataatggaatccatttcactacggacagcctccttccagtagtctgcatcaggagatgcatatgcttctgaaattgacttaggagtgtcatccacgaggtacacagtgaaatcatcaccaaaagacttagccgtcctttgtctcttactccttcgaggagcttcactgacatcctcctcagagacaagttcatgtgtatgttcagtttgttctggtggtgtgattgaactgggaattatttcagagggttggttcgaaccactatgtgtatccttcattgggaaaaagctctcaaagaaggtagcatcacgagactccataattgtaccaacatgcatgtccggtacctcggatttaactattaaaaatctataggcaatgctatgatgagcatatcccagaaaaacacagtccacagtcttaggtccaagtttgcgcttctttgttattggtacattgactttcgccaagcaaccccatgtgcgcaaataagaaagtgatggttttctaccaatccatatctcatatggtgttttgtccttatttctgttaggaactctgtttaacacatgatttgaggtcaacaatgcctccccccaccatgccttaggcagtcccgcggtgtccaacatggcattcaccaagtcagtcagtgtgcggttcttcctttcagcaatcccattagactcgggagaatagggaggcgtcctctcatgtatgatgccatgttcctcacagaataagtcaaactcgttcgagaaaaactctccaccacgatcagacctaagcctttttatctttctgtcaagttgattttcaacttctgccttataaattttaaaatagtctagagcctcgtctttcgttttcaacaagtacacatagcaaaatctagtagcatcatcaatcaatgtcatgaaatatcgttttccacccttcgtcaacaccccattcatttcacaaagatctgaatgtaggagttctagtggtgccaagtttctctcctcggcagccttgtgaggcttgcgaggttgcttcgattgcacacaactatagcacttagaacctttgacaatggaaaacttaggaattaaacacatgctggaaagccgagacatcaagccaaaattaatatgacataaacgtgaatgccaaacattagcctcatcatccacactgccacaaatatggttcacagacttattgcagaaatcagaaaggaaaaagcggaacaggcctccgcactcataacctttaccaataaaatatccatgtttagacacgactactttattagactcaaaaaccaacttaaatccgtctctagtcagacgggagccactaacaagattcctgtcgatagaagggacatgctgcacgttcttcagctgcacgatctttcccgaagtaaacttcagatctaccgtgccaacaccatgaacagaagcatgtgacccattccccattaggacggtggaaccccgtgcgacctgataagaagaaaacaatgagatgtcagcacaaacatgtacattggccccagtatcaacccaccaattagtagattgattaactgaaaaaacagtaggtaaattaccatacccgcttccatctccagtgttgccaatggtcacattagcagacttagaagtctgccctgcaggtgccttcatccccttgcgctgtggacacttcctagccagatgaccaacttggccacacacaaagcaagtcctctcatcctgattaggattgttgttgttcttcttctgcttcttgaagttggtggtctgctgagctttgtatttccccttgctcttgttctgggccttgtgcacaacattggcactggactgcccaccatcgcccttagacgcggcatctttttcccgagctttctcctcaacatcaagagacgcaatcaacccctcaacggagtattcctgtctcttgtgtttgagtgcagtaccgaaactcctccaagatggaggtagttttgcaataatgcacccggccacaaatttgtcgggtaagacacacttaaggagttcgagttccttagccatggtttgtatctcatgagcctgttcgactacagaacggttgtcagccattttgtagtcatgaaactgctccatgatatacagatcattgctagcatcagtagcaccgaatttagtattcagtgcatcccacaactccttagcgtcggtcatatgcatatacacctcgaccagacgatcgccaagaacactaagaatgcatcccacaaagagagtagtggcttcctcgaattgcttctgctgttcagcagtaagaactccttcaggtttgccagtactcacccagaagcatttcatagctgtcagccacagagtgaccctgatctgccatctcttaaaatgcacaccggtgaatttatccggcctcagtgcatcggcaaaaccagccatagtaaaatcacagtgcctataataaggtttttggattgttgagattatagacatataatgatttaatctattccataaataaatcatgacattacagatgaaaactagcatgaacgcatcattagatctacacatgtaaactacacagtataacatgaacagatcaaatatgcgcaacatattgaacacgtaccgaggtgacgaaaagaccggctgcttggtcgaaacttttcgcaggtgtctacgaaggcacgaaacacgcgagcgaagaggaaggcgagccgtcgcgaacgaacagggagcagtcgcgcgaagcgcttcccaaaaaccttattgccgccttctcccggtgcaggacgtcaaaggcagaggttccggagacctgctctcccgatcgctggtgcacgccggcgagcgggatggagtaggctacgagcgacggcgcagtacagagtaggaggcaaaccctagattgattttgcgtatatattgcatgaagacggcgggtcggtttatatagagaagggtcgcttgatcagggcgcccgcacgatctctactgcgcgtaaccgaaccggataagtcgcgcgtaacttatccggactccacgccgtttgcacgcaccggatttttcggaacgtttccaacacaaaaacgaatccgaatttgcagcaaaacaaaactgcaaaaggaggctgcatctgcgcaagggtgaggagccaatttttcggaccattcgacgcgtacgtcgtgcacgcgcgccgcctgccaggccaggcgagcgagcgcgcgcgtgtgtttcccctcttctctccaccacacatgcttcaagtggctaggaggacatcctcccttttaaggaggtccccctctcctagaataagcaagatggtactaaactccacatgcatgccatcccatgaggtgggcttttgtgattttccaaagaattaatcttcgagtgggctaaggcccattcattaattccaacatttcttgccctgcaagcctgcaatgcaatgcagctagcacacatcgagttctgaattagctagatcctcacctagtacctgcctctgccccaacttgtcttctcttctcttctccatgatgtcttcgtcttcgtcggagcagtgcgacgtcatcagcctgccggaggaccaggtgttcgagatgctcacacgcgtctcgctcgacgacctcgccgcctgccgccaggtctccacccgctggcgccgcctcacctacgagcccgccttcgcgccgctccactgccgccgcgccgacgccgtctccggctacctcgtccagaccgtcgcgcgcaaccgctaccacgccaccttcgtctcctccatgcacccctcgccgccgccggccgacctcgtgtccctcgacttcctcccctccccgcacgtccgcgtcgaggccgtctcgccgcaccgggggctcgtctgctgcgtcgacgccgacgccgacgccgccacgccgcgcaagccggcgtcgtcctactacgtctgcaagccggcgactaggcagtggcgcgcgctgcctaacccgaggttgcgctaccgcacggccgccaccgcgatgctggcgcgccccggcggcggcggcggtggcgcggcggacttcaagatcgtccgcttctccgtccccacgctcaggaactgcctccgctgcgaggtgttcgactcgcgggggatggcgtggcggcggtcggcggacgtcgcggtgtggccggagtcgctcgtggaggccgccccggcggtgagggcgcacggcgccatgcactggctccggtggcccgacaggctgagcggcggcgccgaggacatcttcgcgttcgacgtgaagaccgagacgtggcgcctcatcggcctgccgccggaggccaccaccgagaagaggtgggcgcggaagaaggtggcggcggtggaggggaagctgtgcctggtggtggtggtcgacgaggaggtcgaggtctgggtgctggccggctacaggcaggagaggtgggagaagaagatgacggcgagcttgacgaggctggcaatggaggaaggcaactcattcatactcagagatctctacgcatctgacgttgcattcttcaacagcgtctacagagtgctgtggtaattaagctaactgtatatacttaataattgcttcttccgttttacacatatctaaatcaatttgcaaataattagctaaacagtagtagttttactctttggaacgcaagattctaaaaatacagaaacaggcaaaacatataggaatatgaaatgtgtattgtttggatggttgaaaggaaaaaaaaaacatgagaatttggtggattctatagagagagtagagagacaagtttgagctcattgtttgtttcctacggaattggtgtataggaagttaggaactcaatccacaggaatttatttaggctgtgtttagttccacactaaaattgaaaagtttgaagaaattagaacgatgtgacggaaaagttaaaattttttgtgtgtaggaaagttcgatgtgacgggaaagttgaaagtttgaagaaaaacgttgaaatctaaacagggctttacttcaaatcctttgttccaaatggcatttatagtaaaatttcctatggattgcaatttttcatatgagaatcatataacccaaaggagccttacaggtatgtgtttgttaattcatactatggccgtgtttagattcaaaatatttttttcaaacttccaactttaccgtcacatcaaatatttagacatatgcatagagcattaaatatggacgaaaaaaaaaattatatagtttgcatgtaaatcgtgagacaaatcttttgagcctaattacgccatgatttgacaatgtggtgttacagtaaacatttgctaataatggattaaatagtcttaatagtttcgtctcgcagtttaggcggaatatgtaatttattttgttattagtctacatttaatactttaaatgtgtgtccgtatacttaaaaaaatttggcacacgaactaaacactacctatgatttgcaggtatgattttttgagggggaagatagcggaagctccactacgccacaagtgcatccaacaagttttcaagtttgagtcagatttggtcccttttgaggagatagatgaaaggcccaattcagattttaaatgggtttgcaagccctgatgatgtcgacaaattcaattagctagttcatgcttacttttttttattctctcaaatccatccgtttagaaattaaagcatttttagacaagggctcctagtattccagtgttggtttgactctagttttgacattggcaaattttgatggggagacatggataattggtgactgctcgatgcctgcaaattaaatttatgcccatgtgaggcaatatatattgacatggccaaaattatgaacttatgatgcagcaaaactattgataaaacattttgtttgatatactgttatatttttttcctaggcagtcaatacacgtagtctataggtacataaaccgcatatacacacacacaaaccattatttttttagagtacctatgcatttttcgaaagatttttatgagtatcacgcaatttttaatctttggattaaaattcgatagacacagtaaaaggcaaaaagcaactaagaaacactataatggacactaaattaccatatcttcaagaaaaagactaaatccaatacaaatttcaaaacttacatgtaaagatttaaaaattacgttgtagcttaaaaaacaaaagttacaatgtaagtttcataaattacactgtaacttacaagaaaatgcactgtaacttacaagaaaatgcactgtaagtttaagtgagaaaatcgagtgaaagataagaaaaaaaattttcgagtaagatatagccaaaatcgattttttttcctcgaatcaaagggggaacggagaataaaatttcgatccctcttaaccatgggcccatgggatgcagcctgcagtaaccttcgtgagcaagaaaccatgggctttctggccttttcttagtgggcttcataacgcgagccccatgccggaatacgatccggcccatgggccaatgggagtccgtttcgtcttcgtcttcgtcgtcgtcgtcttcttttcttgcaagaaagaaaaggcggagcaggagcagcaacgagaaaaggcggaggcggcggcgcaaccgacaaggaaaagcaaagcgagagcaggaaaacctcgccggcggcgacaccaccaccaccagcaggcagggatggcccggtacgaccgcgcgatcaccgtcttctcccccgacggccacctcttccaggtggagtacgccctcgaggccgtccgcaagggcaacgccgccgtcggcgtccgcggcaccgacaccgtcgtcctcggcgtcgagaagaaatccacccccaagctccaggactccaggtaaatccttcaacccgccccctccccttcgccggatctcacccgcggatcgatctcccccccaaatccaggtccatgcgcaagatcgccagcctcgacacccacatcgcgcttgcctgcgcggggctcaaggcggacgcccgcgtgctcatcaaccgggcgcgcgtcgagtgccagagccaccgcctcaccgtcgaggaccccgtcaccgtcgagtacatcacgcgctacatcgccggactgcagcagaagtacacccagagcggcggggtgcgccccttcggcctctccaccctcatcgtcggcttcgacccctacaccgagaagcccgccctctaccagaccgacccatccggcaccttctccgcctggaaggccaacgccaccggccgcaactccaactccatgcgcgagttcctcgagaagaattacaaggacacctccggcaaggagaccatcaagcttgccatccgagccctccttgaggtatatatatacacttcacactgaataattttactagttaaaactacctctagctttgatccactaccactgaatcagtaactgtgcttctgaagacagatactcaaaagtaattcactaatttgtgttgcttatgttgactggttcagtaatttgtaagatgcccgcctacgattgaacatcgttatcttcgttaagttccatatgactcaatttggtgcaaagattaatagttccctgaatctttgttacaatcggctgagactataaatgcagtcatgaacctaaaatagagtgggatggatgggattggttttattgtgtttgcttccatcttaaagatgatacttattggtgcctggagtgatcatagcaattggtatggcttggatctgtaatctcataaatcatctccagctatttcagcatttgtatattggttttcatctgcacctcaaattttattgttgtagtgttggctataggtctttaactctttatccgtagtaaatcgtctctagctatttaatcatttgtgtattttgattgtcatctgcatctcatattttaagtgttaagcacggtttcaaaagtttttaaaggcattcttatgtgagtacatttttctcttcaaaagttattaaagttgtttgattagtggcatataaacttttgtttttctgttattgataatctgcacctgtagttctcttctattgcactgtagaagctgcaacttgcatgtattttgtcaactctgctgccgctttagtatgttgctgcttagatataggcacggatgcctagttcattgtatttactgtctaggtaaaaaaaatgtatatacaccattacaaaaatacatatcaaattaaggtcatctttgtttaggcttagacttattggcttgagattttaagtcagcttattggcttatatgttttataaaccggtggatttgaaatcctaagttcaatggttgagtcatacctccacttcatataatccaacaaaatggtttctccaacctagcttttggcttaacagtgtaagagtggcttgtggctttaaaaagggcaaacaaataagctgcttgtttgtttaggcttaggctttttggctcataagctagcttataagcctaaacaaagaaggcctaagtctaaatgtccttttttcattactgtaagtctctaactgcaaatggttatgttcctcaaggacacatagttcatagctaaatacttcaaatcaagttcttagcctgcatctggttatatattcgtttattggtggcttcaaatggttaacacatatgcacagccaccattgagtttatgctagctaatggtaagcagttgatcatttttgcaatctgttgctcatacagaccgtgaaaatgcacgtctcttgcacattttgtcatatacgtatatgtctgtacctcttttagtgaaatatcttgctttttttcgttgttggaagacaaagtagtatgttagtactttgtttcatgctttgccagttgccacatatgacaaactcattgaccttttttccattggtcagtggcagaggtagatgggtacatgggggtacatgtgtaccccaaactctttgctaaccaaccacactatacataaacatatacaatttatactcaaataagaaaactagctattcaagggaatgaagagtcacttattttattagatttgaactttcatgaatctatataccatatatgaaccaatttgataatttactggtaaatgtcactatattctaataatcatgccacttaggtcagattctgaacccctcattaagaatattctggctccaccaatgccattggttatcacatatgcacagttcatgatatccgaaatcaatttcttactctgcttatacattcattggtggcttcaaatggttatcacatatgcatattaactattgagtccatggtacttatttctttataatgacattactactgccatttgataggtaattaagcattttgtcagtctgttgcacatgtagaattttctgatgagctcttttagtgcaacaaatgtcatccttttttacttgtctgtagacagagatgcctgcttgctttgctttttttttttcatgacgaactcattggcctttgacctttgtttattcagtgttttttgctgagttggtttctccatcatagctatatcatttgatgcttggcattttatatgcaacaaatatcttaaatttgagtaatgggttgatgtctccaggttgtcgagagcggtggcaagaacatcgagattgcggtgatgacacacaaggatggcctccgcgagctggaggaggctgagatcgacgagtacgtggctgagattgaagcagagaaggctgccgccgaggccgcgaagaagggcgccccgaaagaaacctgacctgatcatcatgattcagcaaagcataatctctcttagcatgtgttgtttcttttctgttcttgtttgagaggaacgcagaactgtttggttcaactgaagtggatatggctatttgctgatcagcctacctggagtaaatcctcatgctatatgctttgtgatgttgcacaacactgctgcgatgctcatcgtgtcagttgccactcagtgggtctccttttatgtatgaatatatctgttgcctgttggttgtagacagtaacgaagaatagtactatgagctagtgcgggccgctgctctccgtcgcggggatctgggccaacttctcgtcttgtgtctggagcccatgcttttttgttctactgctcatttgttctactgctccttttagtagtgtgaggtatatcagtttttctttaatataatatagcacagtaggacctcttctgttgtttcacgtaagaaaaaaggtatatcagtttttattttaggaaacacaggactggttttactacaataaaccaaatcagttgagctacacttactttgctaaccgttagcttaccaatcacaataaaatattaaattttaaaactgaattttaaagtttatttcgctctcttgtagtctactttccaacactgaattttaaatcactagtaacatagatataaaaaaaattatttataagttatttttagttggcttatgtttcttaacttatcactcgtagctcgaatatcagaaaggtcattaaaaaaaattcataccatggcatacatgctctctccattacaggacattgcaatctagaattagatggggcatatcctaataatatgaatctggatgattttagatacgtttcatcttattttattcggtaacggattttaggttgttgtattctataacggatagagtaaacgataactcgcatgtaattaaaatattttcttattaacaaaagatccccgacaacaaatgttgccagttgccactcgaggaagagaaggatcaacggaaagcatgatgatcccgtggaccacttgtgcctccatgttggtgcgggtggcacacgcccacacacaccaccgctcccattggcctaagcttcgccgaaaagagaaaccgtgacaaccaacttgtctctctccgtctcagttgacaaatcaaaaaccaaaaactaaaaataaaaatgtttttcgagtttttttttttttgccgattcaacaagagagcccacccttttttccccatttcggataaggctcacctcgccgttctatggtggggcccctcggccccacacgctcacgcacactttaccaaccaaccaaccatcacccactcgcatgtcacctgggacccaccctccccttggagcaagtcgagcaacggaaagggaagtgcaagtaccaccctacttaatcaacctttattattcacttaattaattattagtccttctgtttataaatataattatttttagagtttagaaaaaataaacttaaaataatattactttaataccactgagagattacttgaaaaagttcacactcagcgatacgacaattgaaaaagtagtacttgagaaatgcttatatctataaccaaattctgaacattaaaaatacttatatttatagatgaaggaagtaaatctactgtcagcataccgtcagcttcacctgcgaacaagcagcatacgaggggcttgccttaattggtcgatctgatcatacaataatattttgctaagattcagatatatactactctacatttctatttttttagaatcatgactggcagttagtagaagctacaattattactctatcagcactgaatataattactccagctaatacatactcccttgatcccataatacaaggcattttgagtttttgtttacattgtttgaccgctcgttttattaaaaaaatttgtgcaaatataaaaaataaaaaattgtgcttaaagtaatttggataattaagcaagtaaaaaaataaataataattccacaatttttttaaacaagacgagtggttaatgtaagaaaaactcaaaatcccttatattaagggacggagggagtactatcaagggaaaaaaagaagaaaggatatctaagtcttcttcagccaatctgcttcacatcagagattagcagatgcagcacgctttgatcaaccatgggatcactaaagctcatctgggtgggtcccagatcggattagtgtccaaattaggactccacaatcaatcaattaaaccctccatcatcaccaagcagcagcaaaggtcgtcgccatgagagacagaattggcatcgaaacatactatccagaccactggatgcactagtgatgagagtagcattcatcgaacggcggtgaagacgacgagaggagatgaggcagtggagaagatagggagaggaggcgcctttacggcggtgacaaggcaaccgggataagcttgcgagtcactctcatcaactgctgcctcttgcataatagtctctcctttactatcctctttttttacacacttatcatcgtgcattagctccagaggataaggtagagagaaatttttgctatttttaaccttttaaatttttatttttcaaatataatatatatttatttaaaaaaaatctagagcttctaaccacaccacctccagccactcgtacttaccaatgttgttttcacattagtccaactggtgtgcaggggcggcactagaacaaaatgaagagaataagagatgtaccactcgcttaatttactctactttcgattaagtttacgctaataggaatgctttattttgaattgaggcggtgcatatatgggtgaaaatagatgaactatagcttaaaaaaattcttgaccgtgttcctaagcacccctctcctatgtagctccgcccctactgggtgttttgtaagggtgtttcaaaaattaagagtataaagggctgaaaaatgttactccctccgtctaataatataagggattttgagtttttgcttgcactgtttgaccattcgtcttattaaaaaaaatttagaattgttatttattttctttgtgacttactttattatccaaagtactttaagcacaacttttcgttttttatatttgcacaaattttttaaataagacgagtgatcaaatattatgagcaaaaactcaaaatctcttatattatggacggagggagtaaaagtgtaaggtagaggaggaaatatactctttgtaattaaattaaatacgcgtatgaacaagcacctggctccaaatccgatgatgcctgtggatgatgcaggtggttgctgtcgttataaaaagtccctgtctctctctcctctcgccattggattggagagaggtgcgcatttcgagctggttagttggtggaaatgagatcatttatctaacgacatttcacaccaaaccaaatcttgtctcgaatcatgttccagctgattcagtttgcagtcatgctatccaatccgaaatggatcattccaatccgaaacggagtacaaaatttgtgatgataaggcagatcactgaaccacctgacgcaagtgtgaattcagacgatctaatttcttggtggttggttgtgttctcaatgattggatcgatggatatgcaggagaagaatggttggctggaacttgctatctttactaggcattgttcaattcactgtgaccaatgtgccaaatccatcgctgttgcagagagtcacttttattttttcagtactacagtaacaaggaccagatgagagcaggatggttggagcatagcaccaccacacttgagaaaatggatcgagaatgtccttgtctagatggaaaatttggtgctggatttttgccaactccaacagcatcagcttgctgaagctgaatcgatctatggtctatctgaattctatctgccatccttctcccgatttgaatctttctcagttctcacttcttcaactatacctaccagctttgcctttgcctcctgttctatatccagataagtcttggcatgctgggttgtcattttgtcatgtcagttcgtggttgttgcgagagattatctgttgttaattttatctacccacgataatagtaattggttggtgcggatttagcccaacctgtctacttctacctgtgttaatcagcaggaatagtgcagctgcgtcgctgtaataacaacttaatgaggagaaacctgtaaccaaaacgctacttggattgatagaatttgtccatggagaagaaacaaactgatgagatgagaccaggcagccgcacctcctgttgatcggatggttgctcgcaactaccagagctagtaaacaacaacgccatggaaccaaaactgcaggcttgctgtctccatctctacctcataattggtagccagatgcagggatgaaaatggttacaaaggcctgttcactttgatgttatttttaaccttaccaaattttagtaaaattgccaaataagtggtttgctgccaaaatttggcaactataaaaaaaatcctatcaaaatttgggagtacctatacatctttcgaaagatttttataatcgtatcacacagatttttaatctttagattaaaatccgatagatataataaaaagcaaaaagcaattaagaaacaccataatggacactaaattaccatatcctcaagaaaaagaccaaatccaatacaaaatttaaaatttacatgcaaaaattcaaaaattacagtgtaacttacaaaagttacagtgtaagttttataaattacactgtaacttacaagaaaatgcactgtaaatttgagtgagaaaatcgagtgagagataagaaaaaaatctttcgagtg

SEQ ID NO: 48592 - DNA, 3591 bp, Oryza sativa
  unsure (1)..(3591): unsure at all n locations
aaaacctttttagcatcgtattgctattgacactaaataattaaattagtaaatatgatcaatatgacagaccaaccgagaatcattttcgaagatatgctactgttctcgatcactttcgaccattttcatcccacgcaagaacaatctgtcaatcttccagcaattttacatgttacagtctctgacaatcaccacttctcttgattttttttttttgactcctattcgctcacacgctgcacaattatggtttactaaggggtttcttctacgtatcatctaccaagtaggaggaacctatacgcatgtacatacgtacatgtacagtatctttcacattgtgcaatgtagaatgccctgctccgtaattcgagcaacagaagaagcgaaagtcagggagaggaacaagacagagaagagaactgattaacaccaaacttgccggaaaggggatctaacactgaatggcgatttggactggttttgtagcacaggtcggcagccactgttcaagacaaatcatataacttttagggcactgtattatggtcaatctttgcagtagcatacaattattatacacgtccaacaatataatatggcgattcaagctaacctaattaaatatatatatgattaagacaatttcatagctaataatctgtaaaaaaaagttaaagaagcaacaaaaaaaaatatgagtacaatctattatatatctttaaagtaatagaaaaaggagcctccacgttcgctctcatggtctagaaattctcacatttatccaaaaaaataagaaaaaagaaaaatagaactagattaggattagttaaaaactgaagaaataaaaaaaaaggcatattaagaaactcaaattggacaatcggtaaaaaaaaaaaggaaaacctaatcatactactggaatcggacaatccgtctacctaatgtactggaaagagaatgtacaatcagtaaaaaagaaaagaaaagaaaagaaaaacctaatcatactatacactggaaacggacaatattttgggaatacgcgtgttcacaccacttttagaaacattgaaagacaacaatcctaatcaaactctgccgttttcgaattgtatcagtattgtcatgccaataaatacataaccaagccaaaaatacataaccacgttcgctgtggaggctagaaattcccgcattaatcggagaaaaagaaaagaagagtccaaataaaaatacaataaaaaatagctgaaattcggaataaaaaatatgcaatattgaaagagaagtccatataggaacccaatacgcgggtaattaaaactcggaattaaaagtgaataaatttcgaaattaaaaaagaaaaaaagagggagtgagttggaattccatttaaaaattactaaaattccaaattaaaaattagaaattttggaattagaggccttataaaattccattccagaattattaaaatttggaatggaaaaataaaaaaattcaaatttagaaaaaaagaaaagaaaaagttcaggtaggaatacaatttaaaattaacttaaattctaaattaaatataagcaggtgttgaaaataagagtacatataacaaccttagtagattaattaaaattcgaaataaaaaataaaataaaatccgaaattaggcaaattaaaaagagaggttaaaataggaatacaattttgaaacaactgaaattaaaaataaaaaataaaaatatcgaaagaacacaatatgaaaaataaaataaattttgaaattagaaaaagaaaaatactaggaataccatttataaataactaanattggtgataggaaatcaagactattgaaagaaaataccatctaaaacacatagcgagattaattaagtaacatgactataaagaagtagagtggtggcggttgatacaacatataaaaactgttaataaaacaccaaatagaatcctaataacgggtaggctgtgaagcaatcaatcaaggcggttgccgggacttctaaaaagtaaaaaaaaaacaatgctaatcatattcgatttttaaaatcttaatgataataaaaaggagaagcagcgggtggggtgtatatgatagccaccgacggttggcgggacttctagaaaataaaaaatgaattcccacgatagttatgttcgatttttagaatcccaatgacaataaagagtagacggcggatgggccgtagaggaatatagtgacattgtttaataggacttctaaaaattataaaaaataaaaccaacaagaccataaactctaaaaactatgaggtccaatttctaaaggtttggaacctctaaaaagtaaaaaaaaatgataatcatgttcgattttaaaatctcaatgacgataaagaaaggaggcagcgggcatgccataaaggaaaacaatggcaaagccgctgacggtttggcaggacttctagaaaataaaaaaatgaattccaatgatagttatgttcgatttttagaatcccaatgacaataaagagtaggcggcggatgggccgtagaggagtatagtgacatcgtttaacgagacttctaaaaattataaaaaatgaaaccaacaagactataaactctaaaaactacgaggtctaatttttaaaggtttggaacttctaaaaagtaaaaaaaaacacaatgataatcatgttcgattttaaaatctcaatgacgataaagaagggaggcagcgggcgtgccataaaggaaaacaatggcaaagccgctgacggtttagcgggactttagaaagtaaaaaatgaacccgaacgataattatgttcgatttttaaaatcccaatgacaatatagagaaaagatagttgacgcccgtagaagagtataatgacagcgtttgacggggcttctagaaattataaaaactataagatctgatttttaaatatttcaaggagaatgaatagaaatagtggtagatcaagcaagcaaataaagaagcatatgacagaagtgaggggtagtagttggtgtgacttttaaaaactatattatttctcattagaaatacggggatgataagatttagtctttcaaagtcttaagacaacgagatagctatttaataaattttaagtaaaatcatactgaaaaatatatgattttgtttgggtgctagccgcgcaattgcgcgggccacccagctagttttcatatctatgttattagtggtttttataagctaatgctgaaaaataaattaggataaaaatacctaaagtcaactataaaattaatttaatgataagttgtctaccaatattttaagggcttgttgcagagacaattttcagacaaggtgaactttcccttttcgtgtacccctgcaagccgttcattaaccggcacttagtcctttaaatagcacttaggccggcttgactgtactaaacattccagaaagcacactagacaaaagggaatgaaacagcggcagcattcgtcatcagccgaaatgggcaacaatttgtgtgtagattagcatttagcctgatgcttcagacattacccaaa

SEQ ID NO: 48593 - DNA, 10345 bp, Oryza sativa
tcctgcagcccgacgtaatcatgtgaacattcaaaggttggtgaatggtagcaaactaaaccaaatggttattatttatgaatgccttaccattcacgacataggtgctgtaataaaattctcggaaaatcgaagcagaagatcattacaaattataatccagcaaaagtgacattaggacgaaccggaacctaccgatcggccgaaaatggcaggtgcaacaccactgtaatactccactgaataacaaaagtagattaatcaaaattaactagtactccctcgtcccaaaatgtttgacgttgttgacttttttaaaagtatttgaccgtttgtcttattcaaaaaatttaagtaattattaatttttttcttattatttgatttattgttaaatatacttttattatacatatagttttacatattttataaatttttttaaataagacgaatgattaaacatgtttaaaaaagtcaacgacatcgaacatttagtgaaggagggagtaattaattactagtagacaccaactagtggtactccaccttacaacttgggacaaaacaaggcatggccctcttggtctggaaggtgcttgtcgccttgtcatgtcggcaattaatagcaactgcataaacaaatccgccttccggatcgatccatctatgatgatcatctaccagctacctgctcgatgatcttgacagtgtttctgttcttccatctcgtgcttattatactaatatcctgatgaagaattaattaatcatgatacgaatcagttactaataatcagtctgatgtctgtgttaccctgaaaaatttcagaaacagagaatctgagctcatccctgcgtgctgccctgcaaagctgcaatgcacagcagctaattccgcaatctaatgctttttttctgttcatgtgagaaatgaaaggagtccttaattatgatgcatgaatcagttattgagcctgatgtctgttaccctgaaaaattcaattcagaaacagaatctgatctcatccatggagaagggtgcaatgcaaagcggcgcctggagcaagttgaggcagtgcaaggcctctgcttttttggcggcaacagcaacagcaacagcaccatctgaccctgcaacttgagatggaatagtaaaagagtactctctccgtaaaaagaaaaacaatctaaacacgaatatgtcattatatagtataacgaatctagacatatccagattcgttatacaatgtaatattatatccgtgtctaggttgattcttttttaggacagagaaagtatggagggagtattcagagataggcaggggctcacactgttgctgaaaaaaattaacgacggcgacggcagaaaggcagcagcaactttaccgaactagccggaggcactcactttgctcagtctctcatctcatgacctgtctttgtagcggttgatttcctcctcgcgcttttatcagtacactagttgttattggcgccaacccgtttgggacggacacattcatcgggtcctgaagaaaaaggtgaaaccctttcttgatttccttgagttttcggtagtacagtagactgttacaaggcgaccaagtacagtagattagactctttttgctcctaattcagagcaaatctgcatcttcagtacagttctccggtgtctgcactctgaagcagagaattgtcttgaagctgctctgttcatttcagactttagacttggagggatgcaaggaatgtttctgatttacttctttatttctttattgagttactgcatctagtcttgttcgtgaaattagtaacaagaattttcttctcggcaaggcatgacaaataccatagattttcagaccgagaacaaatttacatccaacaacctaaataaccatatcatcaactgaactaagtatgagtggaacagtatttacacaaaatggaggaagtgatcaacaagatcactgatcatctccccaaaggaagtattcctctatctgatcctaattaagaaggactaacactaagcagtaaccaaagctagctaagaaatcaagaacccaaaagagaagagaaagtgtaacgatcatggattggtttgcaggatcatttcatttcatggggaggcttctgaagtcgagcatgccagccctgaggccgaggaagttgttgccggcgccggcgccggcgccgccgccgctgcacttgcactccttctggaggccgaggctgcagccgaagcagaggccgccgcggcggcgctgcagctccggcgccctcacgatcatcgccggcttcgcctcatagtcatcgtcttcttcctggcacgacggcgggctgatgcagaggtccaggttgaggtcggggcacttgggcggcttgctgagtatgagctgctcctccttcgtcgttggcggcggctggggatggaaggagatggtggcggcggcggcgttgacggggcggtgcgtgacggggtcgatccccctgccgagaagcttccggcggatgtgcgtgttccagtagttcttgatctcgttgtccgtcctccccggcagcctcgccgcgatcagagaccacctgacagatgatgaaaatcgatggatggaagagaggcgaggtgaggcagaaggcaagaaaagagaagcgtagttacttgttgccgaggaggctgtggagcttgatgatgaggtcgtcctcgtcggcggtgaagttgccgcgcttgaggtcggggcggaggtagttgatccagcggaggcggcagctcttgccgcagcggaggaggccggcggccttggggagcgagcgccagcagccctcgccgtgggcgcggatgtaggcgacgaggcgctcgtcctcctccttggtccacgcgcccttgttagtgtgctccttctcgcagcacggcgacctccccatcgctgttggtctcggccggcggcgagtcgtcgtcgtcgtgggtggcgcacggcgggtggatgaggaggggattatataggcggggagggaagggaaaggcgccaacttagtttttggttaggttgggttggttggtgttggtctcgcgttggcgttggcgcgcgcgggagaggcggtgggtgccgccacgtcggcgcgcccgtgggatgggaagagaggtggattaggtaggtgcaaagcggaagcgggggcggcggcggcgcgtgcggtggccacacatgtggcggcggcggggcgagcgacctacccgccgccgccgtcgcgctcgctcgccgctgtaataaaatcctgcgcgcctcgcctgacacctagcttagctatgggctactatactactcgtaactgattgtaagagcaagtttaataatatagctaactagtagcttcaaatcttctataactaatgtaataaccaattcatataatagtacttgctatattattaatagctgatcccacctatcatacacatattacgttttggagtttgtgttacagctggctatagatctatagtccactgcttttctctatcttcttttatttctctaaaatatatttatagtgggttacagtctactactgtacatgctctaactagctgctgctgcttaggccctgtttagttaaaaaaaatcacgcggtcacctcgaatgtttagacacacatatggagtattaaatataaaaaaacaattatatagtttgtgtgtaaattacgagatgaatcttttaagcctaattatgccatgatttgacaatatggtgctacagtaaatatttgctaatgacggattatttagacttaataaattcgtctcgtagtttcttggtagaatctgtaatttgttttgttattagattacgtttaatactttaaatatgtctctgtatccaatgtgataatcaaacttaaaaaaatttcctcaactaaaccaggccttagccacgaagagttcgtggaatagtcacaattgcatccggtgattgcaatttcggttctaaatttgggaagacctcaccggcaaatcaatgcatcgaccaaaattttcggattctctcaatttctttttgttgaagttggtcaaagtttatttaactccggtcaaaatctgtcaaaatttcaaaaaaatggtacgagaactgccgacaatcaccgaaatttccatcgaaatcgaaagtgtaaacgttgattgtatctgttttagcagacacgtgttaaattgaatatatgagctttatttgattattggtggaataaagttatatttatggtataggtaaaagtggcgtcaactgtctaacctagtctattgttttaaatacagagagatatcacgttgtaaccatgataatatttactttcctattaagtttataactttatgatctctttccgaacacaacactttcgatttatttggttttcacgctcccttttttatttttatttttttctatggctacttccatttttttcaatagaaccgataagaaactactccctctgtcctataatataagggattttaacattttactctgtttgaccatttatcttattttaaaattttgtgtaaatataaaaaataaaaagttgtgtttaaaatactttggataataaagtaagtcaaaaataataataataatttcaaaaaaaattaaataaaatgaatggtcaaacagtacaatcaaaaaatcgaaataccttaccttacattttggacaaatggagtaactaactattcatagttggtcgaccgtcgtcaataacagcgatatctctgctaaaattgtaagtcgatgtagggtaaaatgacttacatcctgtagtagaggtagttgtatttagtagtatgttaatattagggaaggagcatatacaattagtgttccgaggattgggatcacctacagtatgaacagcgacggcaagttaactactgcatgcaattacatccattcattttggtgatgaatggaccaaatcatcagctacagtgtcaacgcaaaatactgaatattttttgctagtgatctacagtatccgggtgcatgtggaccgttagattcggatctaacaggtggtaatggactgcataagttgcagtcacagtaccaactgcacctgatccaaatccgtgttatgaggattaggatgtgttaaaattctcctgttattaaatattatattttaagtgtcgcgtcaaataatctcgcatggatatctcgtggatcaattctgctcgatgggaagatcatttcgcacaacggggcgatttttatgacaaattcatgtttttcttgcatggaattatgtttgaaattgggatacatgttctcgtgattaaaaaaaatcaaaatcaaacctgctttagttaacccatgttcccgaaggggagagatttgaacacgccgacctataaccatagacttagttgctcgttattgattaaactaaacgatggaaaatgacaggttttaaaatagatttgtactcgtgtatttagcatgcggctaattaatcctcgctggggatctccatttcgtggatagttcgattgatctgtcaaaggcgtaataaacgttgctaaattaatttcagttttggaagtgtgcctgatacattcctcacatagattggtagttcatgttttggtcagcatactggactaaagaaaaaatctcaccgaactcagtcctttttgaattgatttcaccaaacccatgaaatgatgaaattccacacgtgtactctgcgaagtaggatcacaaaaccttgtgcacgccaaattatgatgatccgattcttggtaaatagtcatcaggacatcaacacgactgggaaaaacacacctgttacctactccctcccagtaccatagtgtcaattgttgtactcaatccctgctcttctcaaagaacctcatggttatgatgttttccacctgtattaaaaaacaatctgaactattgatctcatttattaaagagttatgattaaagagttaagatttatttatatttttagtaaaaaaaagtgcggaaaggatataatatttatttagcagtgaatatttgtttttctttttttagcttttaatgtaatatgagcgatgccagcgcaatagatgatcatagatagatttagcaaaaaaaacataaaggataaagtaactctaccattgtattagaaaattacaaatttacccataataatattggtagtataatactaccaatagacaacatcatttcatttctagcagtaaacggctgtgattacatcagcttggcaacaactatagccgttttagcaccggtatgcttgtccaagcacactttagtaacatttgagatagattattcaccgaattattgttatgggttataattaaagcaaaggttctaactcctgttgcactccattcctttctccgagatccattgacacttaattaggtttcgactactgtggaaaagaatctagaagctaaagccctgtcaaagtttgatatgaacaaccatttaagtaggggacaatttcgtttttcccccactttcatctctaatattggttttacccctactttttagggttttcgtttttaccctcacttctttgaactgaaagaggcgtttacccctggattggatggaatttagtgggaccggatttatggaaggaaatatttgaattagtgatttacctttttacccctgtgaaatgttaacaatacagagactcttccttctctcgccgagaccgtaaagacccaggcagcgcaggcggcggcgagtgggcagcggcggcggcgatagaggaaactgggcgtcggccaggggccgctcctcccggcgcgtgtaggagagcggccggggagagggcgccgcggaggcctagcggcgcgcgctaggcagcggcggcggcggctaggggccgctcctccctgcggccggggagagggcggcggccaagcggcgcgctaagtggcggtggggtggaggggctaggcagcgacgttgaggtgctaggcggcggtgggaagaggggtaggcggcggggtggagggggctagtcgagcacggcgtcggcgcgacgcggcgtgccccgtcgagatccccccggtggacgaggtcggcgcacgcgaggacaagcccccccggcttgccgcccaccgcgcgcggcgacaatggcgactgctcggaggccaaggccgcgaccaagtgacggtgagcgttggcggcatccggatgtggcggcgtcggccgggcggcgaccaggcgacggcaggcgtcggctaggcggcggcggcatccggacttggcggcgtcggccgggcggcgaccaggcgacggcgggcgtcgggtaggtggcgacctgcaaggggcttggagatggtgccgagatgttgttgaaattttatcaaaaatttgttcaatttgtcaaaatgctgctgaaattttgtagaaattccatcaaattcagaatctgtgcaaattgttatgttaatgtgggtttatcaaaaatttgttcaatttgtcaaaatgctgctgaaattttgtagaaattccatcaaattcagaatctgtgcaaattgttatgttaacgtgggtcatttaaatatccttttgccaagaatttaaatttccaaagccatgcataaaatgggggcaaaaacacaactaatgaatagagatatgaaagggtataaatatcattttgacaagaatttaacaccgttaacttctccatccaaaacaggggcaaaaaaaaatttgttcggttcaaaaaagtgagggcaaaaacgaaaactctagaaagtaggggtagaatcaatattggatactaaagtgggggtataaacgaaattgccccaagtatatagctgtagctgggtaggaggaactaacaaatccatggcgacacatctgtactgtatgggctaataatctcttttgattaatacttgtgtgctaccgatcgattcgatgggcctctcttattggtgggtgagtacaatggcgatggaccattttgattgctcctgtagtagagtgtaccttcgagaaataaaaaaggcgtacacgtggccggtttataggacggccacgtcacatgtttatctacaccgctgtcctacattctcagtgactcattgtatgcagaaagctccagagcaattactgtgcacgactgtagggtcacctttttaagtacgtgtgtgatgtgtaatgatcaaataccaaacattagtatttaatttttctgattctcccatgcagattagtcttgggtgatcatgtgttaggttaggtagcagtgtacgattgttccagcctcacaggacttgaaaaatcaagtctgctactgctgtagtgctgttgcattccaattgatgaccttgaattctggcttaagaatcttaataccttcgagaactaggacccattgtacatggcttgtctaaagaatcgaaactgaagttgatgagccacatgatattaacaaacagtagacaagaacacatgatattttcttccacatgatgtgctaccatgtcaatctctactctttccttccaatttaattatgtcttcacaaaacagtggctagttccaaatcagttggtgggcgcaaatcctaatcaattggtcaataaattataacaattttgcctgaattcatcgcttgcctgtgacacttcttgcaaaagttgcgattgcttagaagtacaagaatcagtattgaataggtatagccgtcagttagccacggtcgtgtgttgggtcaggttggttcatcagcatgctcgtgaatactataatgaaaaacacacggtatgacattatctttgcacgtgttgttgtaagttgtaacaactactaccaactcctcatgagttgattacaattacaagcatccctctaaaaacgttatcatgtacgaattgttatcagttgccatcatatgactggaactttacgagtaaaaaaaaaaggaccttcagagccacgcttacgtaaaacataactggttggtctccggtataaaatatcccttcaggcaagttaattacttattccacctttggcgtctatcagttcttgaactgctagctagtgagttgaccaaacattcgaaggacacaaaccactgttcttgtagatattagagagcacacagaagacggaataatatatgtccaaagtgcttttaaatagtgaagctatgtcatctccatataattccccatgaaatattgatagggtatatgtagacatgaaggaagtgttcgtatggctggatcatcactagaattctgttatttgaccctgatacttactatgaggccatgctgatgaagaacatagcaatcttacttgctcttcttagaagcctcgtataggtagctcacgataactacagctgcagcaacagctaccccgacagcactctgtgcgagtacagcaccagttgaaagatcagatttcgtagatgcagggccgctgctccgtggagtgaagccaagttcagaaagcttcttgtgcgattcagcgtagtccttgaagaaggtgtcttcatcctgccatatgaacagaagaaatggttctgaatgtaaaacttatattatggagcaccgcaaggcatagtacgtcggcatgaaatattcacagttcttgtagcattttgaaaattattcacttccaattatatagcagtaaaagttgtaaaaatataatgctccgaaatcatatttgacaataaataaatctattaattgcattttcaactaacaaattcaaatactttatagtttgttaatggtcctatagtcctaaaaaatggatgaaagggcatataaaatgggggagttttaagtgcaaggaatagaaaaaaaatatatatataaaagatcctttttaccctggcataaagatccacatagcgtctaaatgaaggatcttccaacaatgccttgtcagttgggagcttcagaagcccctcagattcccccttcagtagctcactgcagttaaataaaatattacactgttatcttctaacctcaaatctagtgcccagaattagtacgtaaatgacccagttttgtattcaacttacagaaagtacgaattgtcaaacttcagaggctcctgagtccatgcgccttcaaatccagacctttcaggatgtgcccttcccttgaagtataaagcgagttgttaaaactgtgcttctcatgaagaatcaggattaccattacacaaattctacattaattagagcatttaccagagtgtgacccccagataaagctactatatctttgtctgataagccc

SEQ ID NO: 48594 - DNA, 11277 bp, Oryza sativa
attatacatatcaaaacaggattctggcaccagttattaaaatactaaaataggaactggcaccttgcatcccagtaaatgtaagaaaggaaaacagacttcggcagaaggaataggaaaacagataaataacataaaacaaattaccagacatacaacagcacctgctggtatgacacctaaatgacaactataccagatatgcaggaatataagataaatgaaagacgaggctcccatctatgaagagatgtatgtgtgtttaagataatgtacatattacggtatgtattgcatgaactgggttgtctcaagcaacactaagtactaaatgccagaacatgagtactagcagacaagtacaggagaaatgcatgggactaaatgtgatacatgtagaatactaacacatattttgactcattgcttcaaacactaggagtcaggaagcatgattataatgacaaaagaaaaggtagaccagttcaaagaatagtttgtggcaattacctttcttagcatcaggaagacgcccttcacgggggcaaactgacgaatcctgattcaggtcaaaagaacttaataagtgtgaatcaataaaagatgcatccattcataaagaaatgttatttcacgtacacgtcttccaggaatgaactcaacagttggacccccagtaacttcaactgcaacaactccagcaagctgtaagaaaaatctagttaggatcttaaaaatttacacagtaatcgataagataaaaaagatcaaatgtgcgacaagaaaaaaaaaagatgtcacagtatcaaggcactcttataataagttggcagcacaagaaccaattcaagcaacgctaatttacctgataaaggtcagcatatgtgatcttagggctcttggctttaataggctctgttacagtaaaagacaattggagaagcataagtaatcattcgatttatttcatcactgaataaagtgacaatataacaataaactagataacgtggaacaggtaaataatgcaattgtacagagaagagtggtgagtactgcaacaccattgagaatagttgcaaaaatatgggagtttcttgttttttagttatttctcccaaaatatttgatccccgaattagagaaaaaaaagagttagtttgtagtccgatcaaggtaaaacccaaaacaatagaaaaagaaaagaattttgagaaactgacaagaaaactcaaattgatttcttaagaggcatcaatcatatagctgatgagtggtttaaagggaactagagccattctgacaatgggggaaaagtgaaagctactttcgtctaatcatctaggaacacattggggacaaacaatacataccgagaagatcaatagcaatctttagaccagcatttgaaccgtgagtgtactcttcctcgtatctaattgaaccatttgcaccaccagtttttgtgttcacgtcataagtgcccgcgtcatgccatctgcaagggagtgcacaggaactaagttttagtccaagagtaatccaagagcacgcagaatatcctccatgataaatgagaaaaactcatagtacattacagaagaacactgtatacaacatataagataaaaaaaatcacaattccatatataaagtactaattaattagcaaatacacgctgcactatctgtaatggtgcgttaaatggtaatgcttcttctgagtccattcgtaattacaatatacatagaacatttgcagcagtagtgcaaacatcccctttttttagataatgaaacatcacttatttgttccagtttgtaacactggtctctcatcagctccacaaatgtaacacgaagctcatggagtggaacacctactatagacagaaataagaaattcgtcttagcttcctgcgatattgccgttatgacggaatatggggagtgattaaaaatgctcgctctcccctgctaggttgctagtttcctgactagtatgagagaaccaacggatcaacagaaaaacgcgtgcactctacatgtgaactagcgaactaaacatcgtccgccgttcctcgttaattccaaaggcgcagtcacacaatcaaaaccaaatctgggagccatccaaagcaggcgcgcacgcactcaaggtgttcgtcgaattgcctcgcccaacagccacgccacggaccagcgcaggtacccgccgcaagcaactaaccaaacccaatcatacagtctcgcaatcgcaagcgacccatctcaccaccaccagcagtaactcatcccaccactcgaggcaagcagagccgagcgggctccaaatccaaacacacgagagctccctccctcgccaccgccgcgcgaatccatcacaaggattaggaactaggggagggttctaggaggagcaggagatggggggtaggccggtaggtacgtacgcgaggcggagcatgatgggcgcgcatcccttggaggagatgagggcgcggaggtggcggcgcgccctgtcgacctggcggaggtactcggcgtccacgaccggggcggccatggcgtggcgtcgcgtcgccggcgaggttggaagccctagagagatcggccgcggcggcggagcggagcggaggcgtgcggcgtcaagccaagcgtgtggtgtgactagtactcactggctactgtgcgtgtgggggagaagagataacgcggggaggcagcgattggttgctccgccccctcgagtcgtcgtctgctgttactgtagttttacacctactgccatgactgtattaaggcgtgtgggccctcattgtcaatttttttttccttcaccttctttatttacttttttgacacgtccccttttattttctctcaaatattattttctctttttgtttgtttgaaataaaaaaatattgttttgttttgttttgttttatgtcttacaccttttcttcttcactttttttagaattacacagtacaacatagacactcacaacacacacactcactcctataaacacacgctgacacgcacgcaaactctacccctatgatcatctttgaagattgggccagcaaattcatcatggagattaatgaagtcactacaggtgtctcgctgtcaacgggtacgtcaaacccaggacctaagatgccactgaggctctggtaaacattaggctacatatcctttcgcttttcttcttcacttttaacaccgaggtatatactctgaataagaggatctctttaaactgatttgatttttgttcgcagatcatttacttgaattgtatcgtcgattcatggttggatttaaatattccatgcaatacttattttggactcaagtgtgcaaaaccaaaaaaaaaatcttatcaatggcaatccaaattactactccctccgtattttaatatatgacgtcgttgactttttaaccaacgtttaaccattcgtcttattcaaattttttatgcaaatacaaaaatacttatgtcatgcttaaagaacatttgatgataaatcaaatcacaaataaaataaataataattacataaattttttgaataagacgaaagatcaaacgtttgttaaaaagttaacggtgtcatacattaaaatacggagggagtacagattactggaccgctgcaatccagcaactgccttacctgttcatcttccaaactgatttggtttgtgctcacaaaccattcatacagattcatagttaaatctaacttgatcatatttgaacgagcactaatttgctgcagttgcatggcatccctgtcagttccttccaaaattaggctcctctcgatcttgcaccaccgcgcgccaaatccgcgtgcgaccgcgcgccgttttgacagcggccatggccgtacggacggatgcccttcgttcccgcgcggccactccttccaccaccacctccttctttaggagtagcagcagcgccaccaccaagcctttggtttctttcacgcgcgctcgccaccgccctccttgctcgtccttccttccttgcatgacatgtccgcggccgcggtgctcgccgtcgtcgccgccgccgtcgcagcgctcgccgcggcggcgtcgggctacgagctgaccaagaacgggaccgtcatcacctacgaccgccggtcgctgatcatcgacggccaccgggagatcttcttctccggctccatccactacccgcggagcccgccggacacgtggcccgacctcatcagcaaggccaaggagggcggcctcaacgtcatcgagagctacgtcttctggaacggccatgagcccgagcagggcgtcgtcagtacctcatcccctcctcacacattgctcaatttgcatttgatttcatccatctaattaaatcgtgtctaaatgaatggctgtttaatttgtttctaagtacaattttgaagggaggtatgatttgatcaagttcttcaagctgatccaggagaaggagatgtacgccattgtcaggatcgggcccttcgtgcaggctgaatggaaccatgggtttgtttgtgtggcttcaccatctcattcagacatgcatgcgtgttcatctctgcattttgcaactcctgtttatatttttgcctcttcttcttcttgttgttgtttttcttcagaggtctgccatattggctccgggagatccctgacattatcttccggacgaacaatgagcctttcaaggtgacaaatctgacaacatcatgatccaattttcttacgcagtatgactgagacaactaattgctccagtttctgaaaacttgtttggtgattgtccgaaatactggccaggtgtatttgaaatgcaggaatgttctaatatgatgattatctccttttttttgaacttcatgtatgcagaagtacatgaagcagtttgtcactctcatagtgaacaagctcaaggaagcaaagctcttcgcatcacaaggaggccccatcattctggcacaggttcatctttcaaattgatccctttcttcctgtttcttagaatctggcaatgtgctaaggaataatgacattctgaatgctgatggtgattcttggttacatgatcataacagattgagaatgagtaccagcacctggaggtggcattcaaagaggctggcaccaagtacatcaactgggcagctaagatggccatcgcaaccaacactggtgtcccgtggatcatgtgcaagcagactaaagctcctggtgaagtggtaacttcattaagatcatacatacattttatagccagtgcaagtattctcgatggaataaaaacttgatactagactgttcatggccaaagaacaaaagtattacttaatttgttcaaacttttggattgacagtacctttcatgttcaggatttaccacgatttagccattaaatctgaattttattttatccaacagatccctacctgcaatgggaggcactgtggagatacttggccgggtccagctgacaagaagaagcccctcttgtggactgaaaactggactgctcagtaagttactacttactactacttgagtaaaatccaattcatcttgttctgtaagatcattgtcaatgttgtcagtgagagaaaaaaatatatactacttatgcagacttcttagtgattaacatgttctattcctttctggggggtggttcttgatctctacaggtacagagttttcggtgatccaccgtcccaacgttctgcggaggacattgccttctccgtggcgcgcttcttctccgttggcggcacaatggcaaactactacatggtagtactgaacagcaacagtaacctgttcttgacaaagaagagagatgaaatttctgacagaactgacactggtggctttacttgtgtgaataatcaacagtaccatggaggaaccaactttggaaggaacggcgccgcgttcgtgatgccgagatactacgacgaggcccccctcgacgaattcggtatgcaaccctgaacaatccatccacagtacccaagaaatgtgtgtaagatgaagcaccatgagttgtgaagaattcagtttctaacacgcaatgagcaggcctgtacaaggagcctaaatggggccatctcagggacctgcaccacgctctccgtcactgcaagaaggccctcctctggggcaacccctccgttcagcccctcggcaaactctacgaggtaatgccatggcaatggcagtgacggcaagaggaagaagacgtaggacgccattgttgatgatgatgatgatgatgatgatgtgtttccatggtgcaatgcaatgcaggctcgggtgttcgagatgaaggagaagaacgtgtgcgtggcgttcctgtcgaaccacaccaccaaggaggacgggacggtgacgttcagggggcagaagtacttcgtggcgcggcggtcgatcagcatcctcgccgactgcaagacggtggtgttcagcacgcagcacgtcaactcgcagcacaaccagcgcaccttccacttcgccgaccagacggtgcaggacaacgtgtgggagatgtacagtgaggagaagatcccccgctacagcaagacctccatccgcacacagaggccactcgagcagtacaaccagaccaaggacaagaccgactacctctggtacaccaccaggtacgtaggtagtagtcgttgtctttctggatggctctgataccatattgagatttataatacggtcgtctgtttgtctcagcttccggctggagacggacgacctgccgtaccggaaggaggtcaagccggtgctggaggtgagcagccatggacacgccatcgtggcgtttgtcaatgacgctttcgtaggtaactaacttggatgctttcttccatcttcctcttgttgttccattgttgttgttgttgttgctgctgcttgattccatccaccgtgtgcgtttggatgaattgaaatattgcagggtgcgggcacgggacgaagatcaacaaggcgttcacgatggagaaggcgatggatctcaaagtgggcgtcaaccacgtcgccatcctctcctccacgctgggtctcatggtaataaagctttcatccacccaccattttgatgattgttgttcttcttaggatggagcttggtggtgatatgatcagggttttaaatcttccgctatatctgtttgataagagttccagctatttgctctcatgtacaatttagccactatagccctatttagcccaatatagttatcgctatagttgtctgagaaactaatcgctaaatgttttaacccgctatttaaaacattggatatgatgggcaacaacaaccatggtggttgttttttttttgttatttcaggacagtgggtcatacctggagcaccggatggccggggtgtacacggtgacgatccgggggctgaacacggggacgctggacctgacgacgaacgggtgggggcacgtggtggggctcgacggcgagcggcggcgggtgcactcggagcaagggatgggcgcggtggcgtggaagcccgggaaggacaaccagccgctgacgtggtaccggcggcggttcgacccgccgtcggggaccgacccggtggtgatcgacctcacccccatggggaagggcttcctcttcgtcaacggcgagggcctcggccgctactgggtctcctaccaccacgccctcggcaagccgtcgcagtacctctaccacgtcccgaggtcgctgctccgccccaagggcaacacgctcatgttcttcgaggaggaagggggcaagcccgacgccatcatgatcctgacggtgaagcgggacaacatctgcaccttcatgacggagaagaacccggcgcacgtccggtggtcgtgggagagcaaggacagccaacccaaggcggtggccggcgccggcgccggcgccggcggcctcaagccgacggcggtgctgtcgtgcccgaccaagaagaccatccagtccgtggtgttcgccagctacggcaacccgctcggcatctgcggcaactacaccgtcggcagctgccacgcgccgcgcaccaaggaggtggtcgagaaggcctgcatcggccggaagacctgctccctcgtcgtctccagcgaggtctacggcggcgacgtccactgccccggcaccaccggcacgctcgccgtccaggccaagtgctccaagaggcctcctcgttccgccgccaccgcgcaataagctagccagccgccacatctctcttcttgtctctcatcagattctcagatagttaaagctttgacctgctgctgctgccgccgctgctattgtactttgattggttccatccatcatcgatctcactcacttcactggggaattatttaggcaaacaatcaattcatgctcagctccttgtatgcaccatcgtccatggttttatatgtaggtaactgtagattgattaattgttgatgcaaataaatactagtccattccatttggtgaataacaacatataatcatcacaacatcatcctaagtcctatcctatagtgtgcaccatttgctctcacctctagttgctttgcaattaatataccatcattttgatccctgatggaaggtaaaacattccaaatttcagtatgctgtcctcggacagaaacccatacacatcttgcatgacaaatcttacaacaagctctccttggactctttacctatacacatctcacatgaatgacatatcttatgctgcatcagagaatcttacatgtgcttgccatcaccaatggccaatgcacataacctgcttgttgagaccattgcccatcgtattcctcacctcacccattcacaagttacaggttgcaacctcattcattcacatcaatggaccaaccacaccgcgaggtaaatcagagtgcaagataattgccattgaactgtcccaatagcttaaggcactttttcttttcggtttaaaattattataatctagattattgagttattataatctgtagtaaaataagtggttagttgtttctttactagattattagagcctagattattgggtttgcaagtctaaagagggagtggggtagcatggtgggtaatttttcacccaataatctagaaaaagctcacctaaatgagcttatcagattataataagctacttcaataagttgtctgtttttttcagcttactcccaataatctggattataataatcccaagctaaaagaaagagggcctaaatactttaattagtattattacggcacagagggcaataatcttgagaacaccaaaccatcaagtcataaaaaaaaaaggcgataaggatacaatcttaaaacaacaagggctggcccaaggtagaagtagagctagtttacgagcttcaacattgtgatttgtgcatatcaagatgatttcgcttcagcagatttctgctcaacaagcttgtcgatgagtgcagcggcatcttcaaccgttgcaattgactgcgcacttgactcttcgacgctgatgtggaactcctcctcgagacccatcacaatctcaacctgcaccaatccaacaattgagttttactacttgcaattgaacatgtaatcctttactcaaacaaaagaagatacaggcttctaccaacttataactgaattagactaaacatccaaacaaagcacatgtgcctgaacttcatagattaaacatcttgtttgatcattttcacacctgatgcaacagttatcacacttcatgtggcaacttgggaattccaatgcatctgatattctagtcttaaaagtactgaagagatttggaaaacaagacctacatgaagagcgagcctcaccaataatcactatggctgtaaagccattccacatctctaaaaggacatagatgccacttgtaaaacgagagatgctaccaaagcatccctcagatattattttgtgagccaaattgattacaaggatacaactattcaggcccccaaaatatatagaaaatttaggtaaggtgctgcttagttcaaaacaaccatatgcatgacatcactcaaaaaattatgggggagttaccgtgtccagtgaatcagcaccaagatctgagaacttggatgcaccagaaacttcagtgccctcaggaacagcgagttgcttcttaacaatgtcacaaaccttctccactgtctccttttttgcctattgagcggaaattaagaaggggttaggagacactctttagattgtagcaggaaaacacacgacaacacaaaatgcaaaagggaaatagcgcagtcaacagtgccatacatttaaaaacggagtatagggccgttttggattagtgccaaaacggtgccctaccaatattttggtagtttgaacagtgtatatggtggttttggtttgaagccaaaccattggcattgccaatgtctagtttgatattttctatactctactcaaggcttgttctaaattggtctccaaccaaatacaactttaccctaccaaaaaatcaatgatacaagaaacaaaaaggtccttctagaatggaaaggtgaattccaaacagctaaagcattaaaccctccctggtcataaaggaaagggttttggccccaggtgaaaattttcattcatccagaaataacacaactgctagcggatatctcatctctagcatagcaaagcagcgattgatggggaaaaaaaatcatgcatgacaagaaagtatggaactcacggcacagcaaacagcaaatctcataggcactggctgcaggcggagaaatgcatttcccttccttgcgctggtgaaagatatcgaattagtcttgactgcctgcaattcatggaacaagtttatttagacaacagaagtaatgcagaaaaaggaatagcatactatccacaggggaaaagaacatagcatagaaaacagtgttattgtcataattctactgttctagtatcacattagctgtatgtcttgaatttgtctcagtagccagtatggggtgttgaaatgagtaaagatgatttcgatgagaaataatctccaatgcatagttgcaaactcatcagagtttttttttctttactttctgtaagagattttattacaatttccctatataccatgaacataagaattttgcgaagccgtatgacaaaaatccaggctagtaagccgga

SEQ ID NO: 48595 - DNA, 4578 bp, Oryza sativa
acaaggcggaaatttcatacggatacaagtatattgcagccttttcaacctacacaaaaggcagatctgctcggatctgctatacaaaatggatcagtaaacgcacacaaaagcacttgtgccacccacccgaaagcgaaaagggtaaaaaaaaaaagaaagaaaacttttcgccgttctcccatctgaatcgctccaccaaagggcacgaagctaaacccacagatcggccaaagaaacaggcccgagatcaagccgaaagctcaaaaaaaaaaaaagaacccccagcacccagaaaccagtcaggcacacggatcgatgaatcgatggatcgatgtacggcagaacaaggtggcgggtggggggatctgaccttgacgggggtggcgaaggagagggcggatccggcgagggaggaagccatggcggggggtagcacgaaggtggaaggcggcgagcacgaagcgcgtgacagcgactgggaggaggagagaggatggccggctcggcgaggccgcggggtatttatacagctggcgacgccgccgcatcgagtgtatcgacggtggggcccacgtggcggccagctgtccggcgcgggccgacctcgcggatgggccgttttgcttccggcccgaggtgttggtgggctgagtagtaacttgtcagtacgacggtccatttctcttctcttttccggagtgtaagatacgacggtccatttgtcttctccggcccatgctgatttaagggacacagaggaattccctcttcgaaaagaaaataataagataacctgatacgttcatccttcatcgtccttgttataaaagttaatcgatatagcggaacgataactagcattctcgatcgttttatccatcaatcacccaaaacgtgtcagatgataactataatgtagcgtaaatactcagagagataatagagacgaggccatggactcgtagcggttaaatgttagtatgttgattagggaggagcacctataatcagagctccgaagatgtaggctttcactaaacttcattataaatatcgtgtgtttctatatatcatcatcatctgacatgttttaagtaagcaatgattgaacccgatcaagaaaattagtcgtttcgttatatcggctactttgtataacaatcttagtattgtttttcactagtgtgcaatgcttttttttccattttgtttgtgatttttttttttgcgagctaagactgaagaggcatggatgatgttgatagatgtggctcatattgtcggacataccgttttcgtgaggcaggccaagaaaacatgcatgcactttcctgcaagtaatcaactgaagattctattacgcaacatccttcaagcttgctcaaaaagtaaggagctgtttggttgggctgttttcggcccgtatcagataccagcgtgaattgattcccttacatctgtttgttttagatggaccgtaatcggttagcccgcaaacgaatcccagcccaatacaaagttgattacgctccagatcgggcgttacgcgttaccgatacggaggcggagcggagcgaacatgacctagccttgagcgccgccaccttgcagcgcaccgtcgccggcgccgctccccctgcccggcgtgcgtcgtcgacaccgctgccccctgccccgacgccgctgcccctcccctcgcacgctccatgaccgcccggagattgcccgcctcgacaaggccgacaacccactgctctgctaccttcagtccctcctccatctccctcgagttccacatccctgacgactggatctgcgagaaggacaaggctgttgagcatcaagaaggcatggcaaagatcttgaggcacacgaagaaggcaccagccaccaaggaggttcttctgtcgtttccgccgtcgccggtgagaaccctcccctcactgataccaccactctttatgatgatatacttgtgatgctgatgattgatgatctttttcttttcattaacaaatcatgaagtagtttatactagtgaatcatttgtattcttgattggttgcatgtattcctgcctcagttctgtttgctttataagtttacatgagttttgtagaatctgtttttcccgattgcaggaaaaatctggaatagtagttgatggttctttcatatttgttttcgagtgtaggtaagttccgaaattttgtcggaccaactcattttactctctagattttgagaattttgattttcattactgccaggtgatatattattttgcagagtgtgagattggaaaaaaaaggtttgtcgtgcattgccttttcgacagaattgtcatcttgcacatatataatcaatttacttatgtttcgcagcatggactgttccaaaccaatctactcgctgaatctgagtctactaatctagtagtttcactcatgtcaattgttcatccatatatttcctcagtactttatttagacagatcacaatgtatcctcttgtggtttagtacattgaacttctgaagatctcactcccagcatgggtcttatatttactcttgagtattcggaagctacatctacaagatcttgttcagagatcttccaggatgatgctaggctgatattagatacaaattcaagaaactagctgctttcaaatatttgcatgtcaaaatggatccgatatttactcttgagtattccgaaccaaacaccaccctagcttgagatcgttggatcgagattgaactgttggagttccactgctctcatcgtgatccttccacaaggattcaagtgccaattattgcttacctcatgactgctgcgaaaattagtctcgcggtgcagctatttacttgttggttaactgcctatatatctggtatgtgcataactgtcccatgggcaatttatttctttacttgttatattccaaaaactttgttagcaaatattttttttgcagctgctgttgacattgttcaacaaatatttgctctactttctgattagcatttaattttctcttgtccaggaagttgacttcagatggccctgctttccattttcttttaaaattcactttgcagaagcaaatggagggtaaatttgcaggtgagctaacttatatttcatgaaaagtgtatgattggaaaccatagaaactattccacttgttaccaattgcataagtggaacacatatttttgggtttcgtgctctcctttaaactcacagtggcatcttttatttcttttaatgtagaagtaacattataaattggattccttgcatctttgtttgagcatgagaacatatttacatgcatgtgtgcttcttaactttggagtcaatgccctttttagaatgaagcgaggacctgcccgattattcactttcagtagtttctggatgcatgttgtccaattatatcacttgaattctaaagccacatgaacttttcttgaattattcctatacatgccctagctagagtgctatcaggtattaaaaaatacacatttcccttcttttctttattttgggccaggaagcatgtcacaaaatttaggagtttgccctatatgagagctactattgcatatcttaatcactgcatttttagattgttgttggatcacttttgaagactgtttgtgctagactcctttaaggtgtttttagacttttttttaaattattgcatataactgttcggtcactaatttctgaattatttcattattaccacagatgaagcaatgaagaataaccgatgtattagctcagtcacaatatttggagcttgttcattgttatatgaccactatccataatttatacttgagattattaaactgatgttcacattttcaagactgtatacacttcccaatgtgtgatagtatcaaacagttgcatgttataaaattgtgaatatttttacatagctttgatgtgctacacgtgtttgagaacactgctgctatgtagcttgtaatgtgccttagctttgagctgcgtcacgttctaagcgctccctgcttcggaagcagccgttacctgttaccatgttccatccaaacaatgtaatgcaaacatgagacgttacagcggccaaccaaacaaaacctgtaaagtgatacattttcttcccttaccgctgtagctgatcccatttacgtttgcatttcctgacctcaaccaaacaccacctaagatgtgactggtaagcaggcggcaggcggccaacaaacttcgaagaaattagggtgtgtttagtttcacgtcaaaattaaaagtttgactaaaattgaaagtttgaaggaaaaaagttgaaagtttatgtgtagaaaatttatgatgtgattaaaaaattgaaagtttgaagaaaaagtttgaaactaaataaaggcttaaggacaatacgggacactaatttcagctcagatctgtagcatatactcctaggcctggtttagttgccaaccttttctttaaactttcgacttttctatcacattaaaaattttctacatatacaaacttttaactt

SEQ ID NO: 48596 - DNA, 43009 bp, Oryza sativa
ctaatacttacattaaaaaaactacctagcattataaatctaaacattggatcagtgctagatttttatattttaaaacaaagattattaatgttgacgagtgatactcgtagaccggatgattagggtattggggtacgttggaacgatgatctacgtaattcgacatcaagcaaacaaaaggcagtgattatactggttcaggccaccatatcaggtaatagccatagttcagtttatataagattgatatggaagaaccacagattacaagggaagtagacgaaactgacgataccgacaagatcatagtcgatgtacccgacgagatctcccggctacttggctctgcatactccgggtttgtaaactatggtgggtgtgttggcgatgagattcgatgccttgcacccctccctgggggtcccttttataccgtggatcatcttgatatccaagtaagactcagagacatcagatattatacgatataacggaaactctatccccaccgagcaggactttcgaaatcacttgactcgtggagatattttccataatttgtaacagattccaacagcgttcacgggaggtatgccatatccgtatattccataaatcgtagaataggaggtataccatacccgtatattccataagtcgtatgatatgaggtataccttatccgtaacgctgacaattaattattaattattccaaatgaccatcacatcgacgatcgattaggtaccaagaatccaaaatgcacatcggagtaagcgagataaactggttaagattcttatcgtgtaaatctgctcacctagattgaaatcttagactttgatatgggtgttcgcatttgcatctagttattttttcaatgataggtgacatattcgtcgatagcgacgcactcgtgttaactttgtcggtcttaagatatatcagcacaattttccaaagatgctcatatgggtaatgtatatataagtatgtgagtttatagggaagagtataagcatgttgtaagcgtccgcatttataatgtgttttaaaaaaaatccaagatgcaaagacaatcatagaaagatatgtttttaaggtgatggtaaattaaggttgtttttgttcctacaacaaaaagaggaaaaaaaaccttgttttcgcacgtacgttgttcaaaccgctatacagtgtgtgttttttagaaaaagttctatagaaagttgtttttaaaaaatatagtaattcaaaatttaagtatgaactaattattacttaatcaatcatggttaatagctcaactcattgtacatatcttctcaatttctactttctacctctctcaaacagacaccctaaacttccatcgaggaagatcggaatctgatctgttagttacgcctaagtgcacttgcgcggctttgttgatatctttccaaatatttgtagtttttttttgttaaaataaacgagtaattaaagtttggaaaagagcactaccaaattcagctattaaaaaacgcgagtctcaaataggctccagattcttcagttggcaacgggagaagctgatatggcgtggaatctttgatgtggaaaactgagctgtcgcattgtgaaagccattactactcctatcccaaaattttgacacattaacccttaaaaaaaatgaaccttagcaaaagttaacactccctccattccgtattataagtcattttctcctaataaaaattcttttatttgatcaagtttgtagaaaaatttaacaacatttacaacaccaaattagttttattaaattatatatatatatattttgtaaatttgatcaaacttaaaaatatttgactatagaaatcaaaaccgcttattatatgaatatttaatcttaatgccaaccccaataacattgatgttcatcatcttaattagcgtgagtaaggccatctacaatgggtaacccctaggtcgtcccctcaccgacgggcgttcgcttttccgtccgcgtctgctccctacgatggagcgcgtcccctggctgatggacgcgtctcttgccgctttttagccaagcaacgtagccaagagacgcattggggggagggggggcgggggcgatgggctcctgtggacatcggttccccagctcgtattcctattccaccccttggcagaggtagagtctctgccggacgtcgacgatgaagagggagagaggagcttcgtcgcgaccaccgggaccgggacggcgccgaggcggacccacaagagagagagagcggcgagcggcggcgtcgatggatccgcggcggaggcgacggatccgcagtggagtaggcggctctccttgtcgccctcaccgacgaagctccggcagcggcggcggtcctcctcgtcgcgcgacccgcgcgacgctcgctgtccgctgcctcgaccgccgcgacatgcgcgccctcgccgtccgctttgctgagagagagagagagagagagagggatagagcagagagcaagttgagggagtgagagagcagagagaaaggcgacaagaaagagggaggagtgagagccgcgttgccgacaggggtaggagaggaaattaatatatgtggctttttggttgggatacccactgtgggatagagtgttttcattcagttgcttcgagtttggaagaacccacttagctgtggcctccattgtgagctgagttcccttacaagtatcctcagttagtaagaacactttagaagtagctcatattgtaaatgccctaagatagctgccacctaatcggattgttcgagttggctagctagccaacgtggtgggcgcacgctagctaaccacccgtcacccgatatcaacgctaggccttttggtgccgttgaaatatatggcccttaagcaccatgtcagtcctgttggcgttgagatctatgatcgaacgtgatatgaatctagtattagatgtaacacgaatctaaatatatctacccttcagatttatagtacaagcatatattttttccgctattagattgctttacaatgattagattgctttccaatgggacggggagtaccatataaaggaccacacgacctagcttgtgattgctatgttccaaagcagcttgcatgtggtagctagctagtgtgaaacaggccaattcaaagtcacgcgagcaacgcgcggccaatacaaagcgagagagagcccaacttgctatctgccatttttgccaacttgctacctgccacttccagcgagcatggagcgagcggctggtactggtagcggcggcgacgatgacgagctcgtgctgccgccggcgtcgtttcaggacgggcttccgtcgtcccgctcctacccctcctgcatcggcggcggtagcgcagcggcggcgtcggcgtcgctggagcgggagctgctgtaccgcgcggagctgcaccagcaacagctgggcggcggcggcggcgtagagcggcggaagaggcgcgcgatgaagaaccgcgagtcggcggagcggtcgcgcgcgcggaagcaggcgtacctgcaggagctcgagcaggaggtccgcctcctccgcgccgagaacgccgccctgcgccaccagtgccaccaggtacgtactaccctatcgtctccttccttccttcgtcgtcagactctgtgtgctcatagatcgacgtgttgatgagatgtgcagctgaaggccgccgcggcggaggcggaggcggaggcggcggcagcggcggcggcggcgaagaagccgacgtcgtcggcgacgttctgatcggtgtcagcatgcaagtttgttgggggttgtcggccgggctatggagtgaaatttactccactcgtagattaatctgcaagaatattagaactcgtaggtaggtttagctagctagctagctacctcagcatggagaatatgagagcaaggactagaactactagtccattttaaagccaatatatatactctctctagtttttttatatgacgttggctagttcagatttatactagccaacgtcagacatatatgtacggaggtagtaatagattagttataatgttggctttaatttttcttctccactctctctcacttatgcatttaatatatttgttttgaattaatttttcttctcatctctctctcacttatgcatttaatatatatatttgttttgaaggacgtataaagctagctcttatataaaaaccaacaccctgcttttttttttctctctctccttccgtaagtttatattaagcttacttgctattatccttgcgcggaggggagtgtgcctgcctgcctgaaaaaaaggcctcccacaagcacatcatattttgggtaaggaactaattaaaactgctgttgtagttcccagttttatttatgtgcgtagagaacaattaattttaattgttatgaaaaccgttagtaaatttttagataatggaatatatttttagcctttactaaacgagttacagccaattagtattatacaaattcgcttattagcatttacacataaagagtcaaaaaaacacactatcttaaaataaaaacaaacaacctaacaagcaccaacacaattaatgaatcctattaaaactgtcatacatctacgattacggtagtaaaagtgttccattaagggcatgttcaatgcgtacccctagcccgtgtccctgctcacgccgtcggggtttgccatcgaagccatctcccagcagagggccgcgacccctctgcaagggacgtggctctacgagctcctcggctgggggaccaagcaagaagccgcactgggtcggccgtggctaggggaggagcctgtggacaccgctctctccccctgttttcccccttaccctcgccggctgccagagagagagagagagaggcgacgacgagagaaagagagagaggccattgctgcccgagtacctacgtctccgcagccggcgtcgcgcccgtcactgccaccatctcctcctcaatgcggcgcgaccggcgccgctcaaaccggatctggccgtgtgggggccagatccgcccaggacgatgctgaatctgtcgcctccggccggtggcggtgcaaggcggaggagccgccgccgccgcccgagtaagacgacacctcgccgccgctgccctcgccttgcgctcgccgccgagggagaggaagagagagagagagagagagaggaggggcgagcagcgacggcgacgaacgacgggcgaagggagaggggtggagtcgacggcaacgaacgacaggcgaaaggagagaggcggagtcgacggtggtgcgacagccctcctcatcgccctcgccgacaaagctctggtagcggcggcggcggtggctggggaggacgaggagggaggcgacgacggtggctggggagggcgaggagggaggcggtggcggtgattggggagggcgaggagggaggcggcggtggtggcttgggagggcgaggagatcggcgacgcgcgagagatagggagagattggcgacacgtcggtgagctaggggtggaggagggtagtataggaaaatacccaccgtgggctttttggttggaacatccattgtgggtttaagtatcttgacccaattacctcatattttgaagagttcacctagtgtagctttcattgggagatgagtgccccaaaaagtatccttaattagtgaaggtactctagaaatggctttgtttgtacatgccttaacgtgacagggggttatatactccctccttcccattttatttgacgccgcaagtcaaaaaaaaattagtgtcacaatgtttgacgccgtaagccaaatcaattgaagcattccgtctttgcccctgtcctccaacaccgtgggagatcgagcatggagctgggatgcgcttccctacggctgcatccacaactccctcatgccgtcccctccggctactgcttgctatcgaagaggtgatgatgtcgctgctcgccgacgatggcctcgtcctctgcctcggtgccgtaagtcgtcgccgccgccggcggcggcatggcggacgtcgaggccggtgcccgacgacgaacaccatatggtgcttgtgtagaatacgatatgcacgagagaggtaagcaactcagattgagtgttaattctattgatgaatttgtgtttgaggaatcaaaagaatcgatttctgagccgtaattggaattcaatccttggttgcagttgtggatttcgatttctgagccgtaattggaatacagtcattggttgtagttgtgggttttttatctctaccctgccaatggtttatggttcacattttcatgtgaggaccgacttttttcaagattaggagaagctgatttctgaatatttcagaccagcacccagcagcatcaagttcagatcagaacgcagcaacagcagcacgagcaccatttcggatcagcaacaacagcaatgctatgggttcctgctcttgtgtggcggcgacggcgtggggagacgacatgaaagacaaaatcgagacgacgagctggaggcctcgtgcggcatcaaggcggcgaggcagacggccgcctcgtcgccgagccggcggagcagcagtatgtactccctccattccaaaatatttgacgccgttgactttttaaaaaatgtttgaccgttcgtcttattcaaaaaatttaaataattattaatttttttcctatcatttaatttattattaaatatacttttaaatatacttttatgtatacatatagttttacacatttcacaaaaatttttgaataagacgaatggtcaaacatgttttaaaaagggaatactagatatgaacaaagaagggcaaaatcgtaacttcattgcttccttaatcctgttgaactggtcggaaacgtccaataaaacgggaaggagggagtatattgttcgtgccgtgaacgtcatcaaaactcgatccatccgtgaacgtgaaagctctagacaatggagatcgatcataacagagagttttggccagctttattcatgttcactgagaacgttttcagatcacttttgctgagattcgttgtttgttttctcgcaacttgcaatctatcctgtatatactggacgagcacttcagcacatctcacatctgcacatgcatcatgcatgtattctgttccatcgaacgtgacgacatcaacctgattttttctttttctttcttaggccgtgtttagttctcccaaattcccaattttctatcacatcacatcacattgaaaactttcctacacatataaactatctttttttctccaaactaccatttttcttctaacttcctaactttttcaccatctaaacacaggttgcgtttagtttctgaaaaaagttagaaatttgaagaaagttaggagtttgaaaaaaaaagttaaaagtttatgtgtgtaggaaaatttttgatttgatatgatatgatggaaagtcgggaataagggagaaaactaaacacggccttacttataccttgaattgttgcagaaaactccgtactgcaaatggccagagctagatcgatcatctgaggatgtgtttagtttttggatgtaaagtttttgaagtatacggacatacatttgaaacgtagactaataacaaaataaattatagattctgcctgtaaactgcgagacgaatttactaagcctaattaatttgtcattagcaaatagttactatagcatcacattgtcaaatcatggcgtaattaggctcaaaagatttgtctcgcaatttacatgcaaactatacaattggtttttttctcgcatttaatgccccatacatatgtccaaacatttgatgtgatgtttttggccaaaattttttggatctaaataaggcctgaattaaaaatattaccctacgatccatcgctttttctcgaaaaagggtccagcttagctatagtcaagccaaaacaaccaaaccgcgctacctgacaatgttcgcaatgttatgcattgtaccatccaatataggagaaaagaggaccaaagaaaaaaaagagagagacagcaatgatacgtgcatttgctgagagcgggaatgccatccaacaccaaaaagttaatttgacaatgtttgatataaaacagtttggtagagccgtagaggtatatgtagtgtaggcatatatgctgtttgattttatatcttactaccgaattttttgtacggagtgatcatgtattcatgtgaaaaagattagtactatgtgattgagatggtataatgtttgaaactttggatcgctatggttgaaggtaacaacaagctagccagacatgcccagagagttgtcagcatcatcagggttagatcggagcggtccaatcaaaattcagtggcttgtttggtttgttaggggtgtttgggagagaggggaacacccccttaccataccaaaatattgacaatgccaaatcataggtaaattttggtagtaccaaatactttgacaacttatgtgtcttattggtatattttggtagcaaattaaacactagccaaactactattcaaaatgccaataatttggtagggcacgttttggcatcaaaccaaaatggccttcagtggcttaaatcatactagtagtactcatgtgtgcgaaacagtccctacccaatatacgtgtgcttaccagagtaattaagaccgccatatactactccatcatgtagtatatatatatacttaaagacagtcgttaccgtgcgcttctacagtacggcatcgcatctacacccgatcgagcgagagtagctagagtgcaaggtgaaatctaataaatagcgtatagcaggttagtaggtattattgtggacctaagttccaataacgaaattaagaaaaataaccataaatttatattgtatatcaatattagcatcaagtttcacttaaaaattaaaatgtaaactgcatgcttaattacttctacatttaataacataaatattatgaaatagcatataaatatataagaaaaagaaggcacacagtgctaaattattttatccatatgtgaataacactgtttagcattatatatagtgattcaacaaagttaataatgggttgctattaaggtcgtgaagcgctatagcagacactaagtttcaatacgctagataaagtccactaccttgtagcggtagcagtagaggttcgttaccgctatagcagccgctacgaatgctatttatcaccttgctagagtcataataatagtcgtggttaaaatggtaatgagtactagatttatggagagtggaggttttgtgctcccgtaaaaattttagacttgttagatcataaatgtaatccattgttcagatattaataaagcttctctctccttagactaaaaataataataataacagtcgtggttaattaagtctcaagtcacgcatagcttaacaatggcgtgtggctgttggtggtacgctcgtgcatgcatttgtgccccagcactgtcttcgaaggatcgatcattctagaaggatcatatgaatcgaattttaatttattagacatttagtcaaaggaactagcgtcaaatcacatcgagacaacatgcgggctttctgacagtggcctatctccatggggccgggccgtgccgacgtgtgagcacaagtagtgttgggccatgacaggcctctccggcccattatcgagagcgcagcccggcccggcccgaagccgaggagccacatttcgtccgcagaagatccccaccgtcccgcgatcctcgacttgcgagtttgcgacggccatcctccgcgcgcgtgacaccaacgccacccacccacgcgtccgcctcccgttggcccaccaacgctcgcaggccgacatgtgggctccacgtcacgggcgtccgggcccacgcgtcagcgaggcgtggcaccgtgcggcccaagtcggtttcctcgcgggtccgcctcgaaggcgctatataaacctcggccttggctaatccggagatatttttgcaaatcaaccccgcagctctactgttttccgcttccatcttcttcctttcttcccaacaccaaccgcatcatcatccatcacccatacgcgcggcggagagatcgttccatcgatcgatcgatcagctcgcggctggatcgaggcgaagacgcatcagatattgatcagatggaggtggaggagatgaagccggccggcgccggtgggacggcggtgggcgacggcttgcttcacggaggccgatgctggcggcggcggaccagctcgtgcagctcagcgtcagcggcggcgggtgcgaggacgatggctacgactcctcctcgtccaccacgctgcagtcggtgaacaacgccgaggcgtcggcggcgatggacgacgacgacgacatggggctggataggagggtcaggaagaggtaccgccacctgtcggagctctacgccgccacgctgccggtgaaggagaaccacggcggcggcaagcggaagaagagagaggaggacatggggaagaagaagcagccgcagccgcagccgcagccgcagccgcgctagaggaatcgggaacgcacggatggatggacggacctatctgtaaatattttcttctcgtagggtgtttgctttcactttttttggttaatttagttttctccttttgccacctgcgcgtggaatggaccgagaaaaagaagaatttgtacaaagtttgagttttggttttcaaacaatcgatgacacgcagcgatcggtcggcttgcaagaggttttttgtacacgctgcctgtgaaatgtatcgaatttttgtttattttttcgaattgaatgctttggttgcttgcttctggaagattccagaggtggctaggctatagctagcctaacgggtgacgccatcgtttcggcagcctgcaaccaagcatggcaaagcttggtcggcgcgcaaaaacatacgctgttattcgcaccaaattaagacacgtatatgtgtagagatcgctcgatcatatcgtgtcccggtaacaaaatttaattagctttcaaaatctcatataaaatagtatagcaactttatttactttaatttatttatcgatcacaactaattactattatcatgtcttatttaatttcacttttagccaatcagaaatatttctcaattagctttaccctctttagttatgttcggattttgggacagaagggttacatgtttcagatcgattacttaatgaccaatcaagcttcatgtacgtaactaactgatttagctagctgcgttgatcggtcaaacgcacgcatacagctaaaataaaatgtactctgaccgacaaaaaggagaacaaacgccatcgtcgctacagatgtaagaactaaccacagttacataataatactcaggttgaacaagactagatcgtcagcctccgttctagttcggttctctgtgtacaccattggttggatcgatcgaaaaaagtttgatccgaactgtctaattcacagtagagataaaagaacaagcctgcaaaactttcaatatatctataattatatttggatcatggaaaagaaagtaaatcacaaaactaaaaaaatactctagtcaaactattgaaattattacaacagatttaagacgatgtatcattcaccaaaactatcccaaaatttaagtttggatattaaaatcttagcactattgttctgatagagttgtaaatatgtagttctgcaattgtctgcttaaatacataattttatgctaaagtttatactatatttgtagttctagaatatatagttaaatatgtagcttttcaataatatctttggaacataatgggctgtaatgctgctttgcagccggctgcagcagtagatgggttgtatatatagtaaagcaatattagctgccgcgatcgtatagccacatcaatctctccccaacactccaaataatcttgagagatggggctgggtgaatgtcatcatgtctaagctaaggtagagggtggatgattgagaatacatgagaccgtgatatactcttttcgttcgaaaatagatgttattttagaatttaaaatttgtttcaaaatgcttgttactttggaattgtgccttttttccatcccacccctaaatacataatttgataaagaacgctataatagttcttctaaatattagtttttaacggtaattatattaggacagagatatacaaactggcttgtgtactgatccatccaatcacctacatatatatgatacatacaacacgcagctacgcacgcattagctgcctgaaattaaaggtctgaaattaaaggtcgcgagaggccaacacagtacaggaacactacacgcgtaccgaccatgtacagactttaatttacatttctctcgacttgttgtgatttaatttagccgtgtgattattaacataacacaccccctacctggatggctggatactacggagtataaagcaaagctaagctggtacgtgcatgcagtctagctaagccctgcaactttgacttttctatgaattaaccggcggcaactaggagccacgtgaggtgcgccgtgatgacgtgtctcatgcccaccttttaactctttctcctcctccgtcaaattactctaatctcccccgcacaaaaccgaaattacacacaactccttcactccgttaacctagtactcctagccattttctcacatacccccctgagaggaaaaatcgagtccagcgcaggcagactcatcacggccacgcaatttcccatcagcttttgttcccaaccaagaatcacatttttcacaaaaccccccgtactttttctgttttacacgcctaggcgaagtcggtttccgccgagtcacgccgcacgcagcaaccacatgaccgattaactcccttcttcttccatcttaacccacacccacacacaaaaataaaaaataatactaataaaccaaccaaaaaaaatcgaggaagaaattagagagagagagagagagcacacgaaattaaccggcggccaacccatccacgccccgccgcctcgatccaatcagccatggagggatccctagcccggcgccggaagctaccgccgccggcggcggaggcggaggcggaggcggacggggagagcctggtgatgtctctgtcgtcgtcgccgaagcagcagcagcggttcacggcgctggagctggcggcggcggagcagctgatccacctgagcgagagcagctcgtccccgcggtcgtcgtccttctccttcacctccgcctccgcctccgcctcgtcgccgcgctccgtgagcaacgcgccgcggcgtgggggtggcctgggcgaggcggacgacgaggacgacgagcaggaggtgggcgggaggccgcggaggaaccggaggctccgcccgatcgccgagatctacgccgccacggcgccgatcggcggcggaaggaaggccaaggccaaggccgccggcgtagagtagtagtagccggccggggagggacttgtttgtaaatataagttatttgcagggactagcttgttgagtaagtaatatttaagggcgtgattagattaattgctagcgtagcttagttgtaaattatgttactactactagaggttttgagtttaatcaatcaatcgtcctactataaatattatcatgtttgttttctttacaagaggaatgaaaaacctatatataataacttttttgttcatcatcgatcttatcctatatatgtaatttgtataggacaaataaattaatcgatcaatgatctaacacgttgatcaatgcgatcccctggacgataacatcatgcaagggtttgcatctatccattctgatgatagctagctagcttttaataatcaaaccgcacgcatataattaagcacgtactgtgtgcaaatctttgaaagactttaattcggtcggcatggagggcaaatgtgaaacagcgattgatcgatccatatttgagttcattgcttaattttgttgatccaaattaagtgatcgatggatggggtcaggctgggaaacaaaaggaaaggaaaatatataatggatgaatgcatcgatatgatcgagaccgagatctagctacacaccgcgcgatatgatctatctatcgacgcccctgggagcttcagcttcttcggtggtgtttatcgtacgtgatttttttgtgaacgtacgtgaggacgattatagagtgtactgtagctagcagctagctaattccgatgcatatataattgcatatatagatcgaaatacgtagtatgcgcgtgatctcgctgtgtcgcctggatcggcgctttaatttggctagctaattacaaggtgttaattagtactcctacatgcatacacattcatatactgtcggaatgtaattaattaataaatcatgagtatataaatatactcctatatatatatactagcttagctatatatacatgttaaatcctatagatactgtcatgtatcgtgtccagtccaatgacgacccacgcatgcatccatgcagtgaccgcacaatatataaaactgtagggagtatatatacacagaactatggaggaggagactacaaggaaggaggagatcatcattaattagttattagcgaccagaaaaactttacagcaagctaggtatctgcagaattattattattttttgactaagtatctgcagaatttgaagccaacaacatgttgtgatcgatcgactgaggtcgggaattatctagctatcgatctctacggtgcagaggctggctgggtggggaagaattaataatacttctacgcagcaatagaaagaaaaagtccaaccacactggcgttcgatcgtattctagccacttctagatgcttctccatacttcctcgtctccaattccggccatctgctagcttgtatcgatcccaatatacgcgagcttaccaccacctttgggtgaggcggtgagctattctccccggcccataaataaactcgcgccgccacctgctccagtgtaacggagagagtacttctttgcataaaccctttttttttttggaacgtatctttgataaccatgcatggattcagctaaacagaacacagtaattaacatctgcttgagtgacctgctcaaccattcattacagccacggcaattcacagatttgggcaacacaaaatattctactccatcatgacttctccttaatatagcttttaggtttcaactaaaattaacgttcttgggtcacttcctggaagaaaaaccaagagacgcgcacgatcaaacatgacaaaattactactaccactactacataagtacaggatgcataaagcgcacgcgcacacatgaaccacaatacatgaatgaagcagccgaatttcgcatggtacaaaagaaattctcgaatccatgatacaaggtgaaggtaaaagtaagttatccaactagacacatttggagtcataaatttctcatcgacataaatttccggcagatgaagcaaagggtttttgcatgactcaaatatcatttgtgagtggcatgtataggtgtgttacggtctctcagatcaaccaactcaacattgcaatttggcagcccaaagtgccaaagaagtggccagccagtctaaaaatcatcgtcatcttcctcagccatgtgttttgccagctcctcctcctgttggagcctctcacggcgcttctccgcactttccttttccttgtgagagttcggggggaaccgcattgctttcacagcttcattgtgcatgttgaggcaaaatgcaatccgagagttgaatgcaatctgtggttcatttgtcgagtagacatcgccagtttctttcgacaccatccagccgttggcatgatctatggtggcatcaattgcgccatcccttattgccttggctacaatgctctccgcatcagcaacaggattatcagagtcgagccttagcttcttggcaatatcagcaagggagatccgtgagtatgaaatgctaatattgcgcagtccggttcgaataacattgtggcgcaatctcacaatcaaattgcgagtcctgtcagcactaaaagtgctcacaaatttgtcggcgacagccctaaacaattcaagatcaccgatcctgacagcctagagaccacaaataagtcagtctgagttttccacctatgcaacacagtatttcaggaaagtctagttacttacatttgtaagctcgaagtagggtgtcagtgcttccttcattcccttctgcatgaacacagtcctctctggaatctctccgagaagtagtctcactataatagcccatttgttgcactgaatacgaaagccacgagctgtaatgggtgccttccgagcagcttgcagaaggctttccttagcatcagtgtactccaactgaattgtcctgattttacccaagtagaacaggtatcgacagaactgcaataaaaggcacttattagcatatgcccaagagtctgtcctgtgaattcagttggctgaaggatgatctcatacttcaataatcataaagcattaactaaaatgaaggtgtcttaacaacaacatgtagaaacaaatttaagtggagtatgaaacttcgcatgagcaacatccaaaacacaataaattcacaagctgtagagtaataaatggtgcaagcagatatatacttgttgattggagtgggcttcaaaacgaggagcttttgacctaagtttctctgcttgatcatacaaattataatggaggtaattgcgaagaagcaggttgagcaaagtttcctgcaatcaagaaaacaggtatatttacacagattacaagaattagatgacttaaaggttaataaatcaatgaggatatagaaaccaaaactacctggccaagttcatcgcggtgaagagttgccattctgtgtaaggctagcagattcctgaaaagagagtaaatgcaggaaaagtcgataaacatggtagtaagacactgaatagtgagcaactaagcattaaataagaccttgacgtacccacggatttcagcaaggctgttggtgagttcatgcacatatgagtaatagaagtacagtctagatgccagaacatcaacagttctcctgttcaagtttttcagacgagcaatgcttgcatttgcacatgctttagcctagagacaggtgagaactttaaattagaatgtctcactgagagcagaagataaaatcagtagtcttagacgtacatcgtcgtatttcttctggtcaataagaaaaatcaggacaagcaaatagcaatatatttcaatctcagggaggccatgcttgatcgaaatctgagttgctggagctgccatgtcaatgtccatctcagtgtcatcttcctaaaaagcaacaaataaggacatcagacaccgtgcatatgataacagtatgttttaccttactctccttattatatcattgtatacacaatgaaacaacaaagttaggcttccaggtcctgagccctaaattacaaaacaagtagcaaaaacagaaactacgccgaccatagtgcaacagcatattatgttcttcatataacagagtcatcacaaatgaaaaaaaaaaaaacaagtagagtgcagtatctcatactggtaatcaatttcttgggtatcatagagatactgctaaataaggcttaacgttacagctctagacttctaggaatagctttctaatatgttctaaaaatagatttcagcataaacatgcagaaataacataacgataatgaacaacgttgcaaatatacgatacatgaaaatatgatctttttgaaagtcgaagtgcgcagtgaaggagctcacttaacctctatttgcaagtgcttcctatcaagagatgaaagaaaatgacccatgctatatgttcagcgatttaggttgctaatcatggaatgacagacacaggcgatccaaaacagccatgagaaagtcaaacaccacagtgataaatcaaataacaagcatctatgaattacatcagtagtaccaatggaataattccagttttgataacaacaaaaataagaccacacccacccaaaattcctgtttaccagttaatttaaaattttaaccatatgattagcttatttaaagaaagaattccaaaataactacagagcggttgataatgcagtgatgataaatcaaatatccacagttagcatcacaggtaccaaggtttggaaattccagttttgccatagaaaacccagatccacacagaattactgatcactatgttaaattaaaccaactcaatgcaaatatctcagtgctggaaattttgtcagaggtacctacttaccaacgggaaactttccagaatcacacacatcatgcaagcatgtctagtaagtttatccatgccaacaactatatctaaacactgatagtttagttgcatcacatggaatattaagttgctcttacgctgagttatactagtaacagaagaagaacgcatgagaagtaattcaccttggggacgagggaggtgaggcgggtgtaggcctcggaggaaggcgggagcgcgaaggcgaggaaggcggagacgtcgcgggcggcgaggcggcggcggagggcgacggtgaggcggacggcgcgggagatccggcgcacctccttggacagcgagccggcctcgatcaccgaggcgatctccttcagatctgggacgaacagcgcgcaaccacatcagaaacaaatctgaggaattccacccgagggtttctgggggatgggggaggaccgcttacggtggagggcggaggccgccggcgccgcgggaggcgccgcctgcggctcggagtcgctcatctgcacgtccgtcatcgcggcggcggcgctggttggttcgtgacttctgcctcaagaaggtcgctccccttcccttccgagcttgggctacctctcctctgcttttcgttgtgtttcctgtattttctttgttttatattttgctgggctgagctgggccgtctgtgtgagggccgtgttggttttaaactgggcttgttcatcctagacggcttaggattcaggcccatcgcttcctccatacagcatcgctcgttgccaaaatttaaaatcttttatttaaagtttatttttcagtattggcatctaaatcactaagaacgtataaataaaaatcttacctataaatattattattttgctattatccgtacttggctaaacgataggggcctcagtttgctctcctacctcttcatgcaagtgtcattttgtcttatttcatcaaaatccaatggaaaaaaaaatggtcttatagcacggaaatatctttacttattttagttttatttatatagtagcaccaaaagccaattctgtcaaaaaaaattttccgtgagtaagtcactggagaacgaatgttgcttgcgttacatcatacacatccattgcccaagttccattgccattgacaaacagaatctgagaccaaactgccaaaacacagaaccacaatatcaacgcaactgcatttctttttacccactccgtttaatattataattcgttttaacttttttaaagtcaatttttaaatgtttgaccattatttttaaaaaaacagtaacacttataacattatttgttttatgttgaaaatattgttatgtttttctataaacttgatttagaaaaaaattgtatgaaatggagatactagtatataatatcatgctttattcatgatatttatctattctacacgcgcacgaatctccaatcaaatccaaacaaacaacaaggtgcacatacactgcataattgcatcgtggattgacattctcggatacacaaaaccacgacatatcaacacatctgcattttcttattgcaatccatgctacgcgcacgaatctcaaaccaaatccgacaacaggatgtacatgtacttgcattgtgcaggtacattacaaattcttacgccatggatggatgatgaagctcgctgtcgcttaactagatggggtcgtcgacggcgagcttggccgtgccaccccagtgctggatcctggcgtgcgcctcgctggcctccttgttccagttggtgcgcgccgtgatcgccaccaggatcgccgtctgcagcccgacgccagtgagcatcccgccccacatcccctgcacgccgcggcggagcgggaacgcgatggcgtagccgacggggatgccgacgcagtagtagcagcccaggttgatgtacgccaccagccactgccacccggcgccgacggccacgccggagagcaccggctggacgctgttgaggaggagcgagaaggcgaacaccacgcccaggctcgccaccgcgcgcaccacctccgggctgcccgtgaacggcgcgccgtacacgtcgcggagcagcagcaccgccgcgaagaaggcgacgccgatggcgaccgaggacacgagcaccaccgcgatcgcgagcctcgccgcccgcggccgccccgcgcccagctcgttcgacaccctcacgctgatcgccgcgttgaacccgaagaacaccatgatctgccacccaaacaggttcgtgctgcaaaatgcaaacagatcgagatcgacatcagctacgatccgagcataaaacagtgaagacgatgagtgattactgattagtgtgggtttttgtccctaaggggttattctctcattttgtgcatgccgttcaaaaaattatcaaaaaattatttaaaaattatcaagatagatcaatatatgatatatctttcacaaacatgcgagttaaaattcgacttatacaattcgaaacaaaaataataaatttaactgtgaattacacgttcactttatagtcaaatttgttatttttgtttctacttgtataaattgaatttgaatttgcatatttgtgaattgatatatcacatgttgatatatcctactatttttttcaatttttttatgactttttagtgacacaaaaataaagagatatccctctaagggatgatttgagttttcactaaccagatggagacggcggcgacggcgacctgggcattggggaggttaccgacaatgacgatgaggaacatgtagaaccagaactcgaggcagatcatgatggcggagccgagggagaggcgggcgaagctgaggaggtcggtgaacgcgagccagtcgaacccgttccaagctccagggcagtagcccatgacgatgtaggcgagctggccgagcacgacgagccaccacgacacgttgagcgcgacggcgaggccgacgaggcccatccggagcggcacgaggagaagccacgtgagcgcgacgtggaacagcagcaccgccgcggagacggccgccatggccatgaccttgctctgggcctggaggaacttctggatggggaagttgagggcgtaggcgaagagctgggggatcatgtagagggagaagcggctggcgaggacggcgatctcgtcgtcctggtggaagaagcggaggatcggggtggcgaagaggtagatggggaggaggatgacgctcatggcggtgaggatcacccatgagcgctgcaagtagatgcccagcatgtgatgctgcttcgcgccaaaagcttgcccgcatagcgtctccagcgcgctccccatcccgtactgcaccgcacacattcatacacacacaacacatttttaggagtaagctaaaacaaacagatagattattatgatagattattacaatttataaaccatattactatagtctgataatccattcgaaaggtgcttttttagattatttggtggctaacaactaacaaacagctaacaatttagagaaataaacatctaacaacttattctatatcggcttattataatccgacttataataatctggctcttagagaacgggtaacacgtgttgcgggaatcttcaagtggaggtcagaaattcaagcaagatttcccaaaaaaaatcttctaacatacttttgaaattttagttaaaactaatttaaatatgtccaaaattaaagttacatagccttccattcgttcttaagttgaattcgatcctcctaatctgggtagtaggcacatgatttataaataaaaaagacatactactagaagggtcaaaagtgatacataaacatatataaatcatgtgcgagtgtgtgcatatggtgttgtgtgtacagtagtgtgtgcatacgcgtccatgtaataaaaaaatgttgcgcaggtgatggagaaaacaaggaattaataaaaaagacatgtgcacttaactctctactgcaactatcgctgtgttcgtattaggggtgaaaacagtacggaattttccggattccggtcatgttttcggaaaccgaatcggccagtcggaattttttcggaatttctcggaatcggaatcgaaaacggaaatattttctcggaaacggaatcgaatatgataatagcagtttccgtcggaacccggaaacgatcggaaacattccagaaaaattgtcggaatttccgaagttaaaaagcccatagattcaatagtccataattcatccctagcttcccagcccaacccaaatcgcggcggcatctaccctaaccggctaaccctataggagagagaccgtcagactcagaactcagacgcgactcgcgagttggaggcggagcggcggctgcggcgtccagatcgcggcatcgcggcgccagcgtgccctcacgcccaccgcccgtggcgccggccccccaccgccctatgctggtcgcctggccggctggcccccgccgtcctcgcccccaccatctcgcgccgcccttgctcttcgtcgtttcgccgccggccgccgccaccatctcgcacggcgccggcgcgccctcgcgcctaccgctggtcgcctggctggctggcccccgccgtcctcgcgccgcccttgctcttcgttgtttcgccgccggccgccgccaccatctcgcacctccgccggcctgctcggtccccgccatctcaaggcgccgtcccaccgcgtctcgccgtttcaccatcgccaccaccgccgccgacgacggaacaaccaccacaccgacgaggcgacgacgacaccaccactgcagtctcttcctcaccgccaccaacgccgacggctcctcgcctcgcagcagccagcagcccagcggcagcatctgagcaaccagcagcagcaggtgtatatagtgattgactttgcacttttactaatgctctatcattttttttgaaggctaatggaacggaacaagagacagagacagtagaagcggaatgttctaatgaggatggcattgcgccaatggatgtttgaagaaaatgttggtcaatttaattttcaagttacatctaatttcaagtttccatttcaaattagtgtactcctgctgcacaagtggatgagatatgtttgaaccatgtactgatgtgttttgtgattgaactatgttttgtgatgaactatgtatttatagggtgatgtgttttgtgattgaactaagtactgaaacactgatggactgatgtgcgttgctgttctgtgatgattgatgaactattgctgttctgtgatgattgatgaactattgctgttctgtgatgattgatgaactaagtgttgatggactgatgttctgttgttgttctcaaacccatttcctggagtgataggctgatagcagtatagcacctgaattgtgtataccttatagacttataccattctgttttgctgtattcttttagaatatttgttatgcaaattatatgaagttatagaagaatatatttttgctgttgagactaaacaattagacttgatataattgtgttttatgatgaattgttgactgttgagacttgcgaattggacttgacaaaagtttgaagctcagtttgaggggttattgtattccgataaatttttgttaccgtatccgcgctggttcgttttcgctccgttttcggtttcgatactattcgtttccgtttttgtttccgattccgattccgaaaaaaatatgaaaacgaaaacgataaagtttgtttccgtccgtttccgtaccgttttcacccctaagttcgtatgttgaagtttgggatccaatctctcgcgcacataaatggagtgattcattagcgtgtaattaattaaatatatgctatttttttaaatgggttaatatgattttttaaaaataactttcgtataaaaaatatttgcagtgattgttaatttggatgaagaaaattaaaatttgtcttaagaaaacaagttttaactaattacaaggaagttagactaagatttaataaaactttggatccaaataactgacataagcgcaaaaatgtacaactcaatcctgtgattaagataaagtttagacataatgaagaaaaaattgggaagctaatcaagcaaaattaactactgtacttccaaggtctctcgaaaagtgtactgtagtcaagttgatagttaaaaagacagtaaatttttacacaaattaaaaaaaggacagtacttttgagatggagatagtaatacacacgatcgatcggtgaacgagggtaattatattatactcccctcacttcgctctatctaaaaaattaatcaatattaaatttggtacatcttagtactataaatttaatatatatatatatatatatataaaagtattagaatgtatcatatttaatatttttttttgacggaggtggtaggtaagtaggaatagatgaatggaagtaactggagtaactattaaggaagtagccagccagctactccctactccctccgttttaaaatataaggcataaccgctcttaacccaaagaccaagaaataattattattatctcctagtttgaatcactctaataaatataatgcatgtatccaatagaattagagatattgaggatggagaatttaaaaaaataatagtttaatggagaagaggttctaattaattgtatgcatgcatgcataccttatattatgtaacatataaaaaatatagttgtgtcttatattatgaaacggagggagtactagctagtgagtgactaaccatgatcccgaaggcgaggccggcgatgaccatgttctcggtggagacggcgtcgagctcgagcgtggtgaggtgtccggcgaacacctgcgtgacggcgccgagcgagtactgcgccagcgacgtgaagatggccggaccggccaggtaccacagccgccggttctcctccgccgccagccgcatcagctcccccacgctccggatctcctccaggtcatcctgcttcttcacagcaatccccttaatctccctcgactccggcgacgacccgccgtcacccagcagcagcgcctccctcaactccggcgacccgccgcctccattgttgctgtgatcccatgcagatccactcgtactgctcattctctctctctctctcacgctgatctcgatctctctctgaatcgaccgatggagaggtttgacgcgacgatcgatatgagttggctcctactatatagcaactgggtctagaagacactggtgcaataactctcaaacttaatacatacaatggaccattgcatcttgcccgattcatttttcataattattttttttaaataatgcaaattaatctacatttctttttcattagaagatcgatgtatatgaccacttcatacacatactagttatattgcacacgtgtaaggcaaagttattagttatgactaatatgaattaatatattattttggatagagattcattagctaggaggattgctgaactgtgaccaatatggatttatatttgtcttctctttaccctttgttagctacgtactccactttcttttgttattggtcatgatgagcgacaattttgtaacgagtagttgtagcttttgttgaagccaatgtcagattttatccattaattatctaaaaataacttaataagaaaaaaaaacatgtttatcacctcacgatttggtggttaccgtgaaaaatatgcgattattatgaggtataccataattttaaaaccgagaaggttatcgtaaatataactacgtgataattatatggttctataaactctggtcgcatcacaatagtgtgatcgttaatagtgcgtatctagcacacggtcaatatataagtgggttgccacttgccagttgccacggtcgtcgcgatctcttatcaatattgcgttgatcgatttaatttgtgaataattcgatcgaggagtaatcgttaattatatagttgcgactgtcattgtcagatatcacgtttgctatgtacgtactgttcgattaccaaacgagagtattatatacaacacgtcaagtacaacttcacctacttgaaattaaaaccagctggagcgctgttgatgactgaatttaaaatcgaattttgaaaagaacaatatcggcgcaggctgattaattaattagagaagtagctagatatagcaaggactgtcagtatttattgtttaatcacgacatggttctcgtgtggcagctactacgacactaccacaaaaatttgacgacgaacgacgacggcgacgtgaccacctcggtggaccgatgcacgcagcagctggtacgtacatttggtgatttggagatcctctaatgtttacaaaaccaccgagaccgtctgtaaaaatcaatgggagtagcttgttcttttaggggatttttagatggtatttatacggataaaaagttattggtttttacttggttttccttaaacttgtgaggagcgttttcacttataagatatatggggaaatcttcacctttggaggtttagggcttgttcagattgatgtcatttcaaaccataccatttttttttgttagagttgtcaaatatatacatccatttagtttaattacatcagaatatccgaaatcctatcaaaattttgacaatattaccaaattgccaagcccttaatgtctttatttccatgcatatgtttcatgtgaggaagagataacagtatcacaattaatcctaattttattgaaattaaatctgatgtttacccggattatattaaaaacgaaatgataatattagattactatatttaaaacaaaaggagccaggagtcattagacaacgttaacagtgaagagaagggacagactggcggaaggttggatgagtgatgactgatgagtgtcagcgtcacatcacgtgcttcatgcagcattgactgtgcgtccccaagccaaacagtagcagcagtcgatcatgactgcgttctcacacgatcaaccgaccgaccaaccaaccaactgcgacatgcaaatgacatttctcttgaaagttattttagtacagcttgtggttagaagcattccatcatggtggtgatatcaatcaagagctatagctgctagctgatcatctatcactacagccgatctctcccagtttttttttttcttttggagtcggatggattttaatctctgctcttgtgagcaagaaattaagctaaaagaaatctcagcccatgtacataaatgggatggaattgaggcccatcaattagcccaaccaagtcaattaagccagaaagaagaagcccccagagaagcctgcggatcatatggtacacggcccaccacccggcgatgtgagtgggcctaacgctgaaatcaattgatgggctttcaactatggccctttatgtaggtgacctcataggaatcaggaaaccggtatcctcttgaggaggagggctttcgaacttaaaccgttcgccgtttgggttgagcacatatcacctctgtagctctagttggtaggattgtagttagtgcttctcagattcaataatgaactcaacaacaaacctttgaattatgctatttttatagaggcagacgaaagcgatcactagtttgtgaagcagtgtgcgcattaaaatagacttacagatgttattattgtgacaacgccgcagctccctatcgatattcttttttttctattgttagatttcattaggaagtatattttcctagttcagttaagcttttcttttgaaaaaaagtggttcaatactttcagctactaagattattcttctaaactctgtcttcttacaataagtactctagtaaattgagattttgtgattgagacttgtctttaaaaaagtactccagcgagcaaaccacaacacatatctcgcagaagaactcttaaaaatcctttgagttcaatgaagttcacaccaaaatctgtaactcaacaataaacctttgaactacgatatttccatgtaggcagtgtacatcaaaataggctcatggacgcggtcgtcgtgttttaagtatagagattaccctgtctatatgcctcttttctgctgttaggtttatttccttaggcatcgttcgtttaggggtgataggggagattggctctcgttttccgcgcgcacgcttttcaaactactaaacggtgcgttttttgcaaaaaatttcaataggaaagttgctttaaaaaatcatattaatccatttttggaatttaaaatagttaatactcaattaattatgagctaatggctcacctcgttttgcgtatcttcccaatctcctcaatccccttctcctcaaacactcccttagttcccttagcctttcatttggaaaaggatggttcagtgcttccagttactctgtttagcattgcactaaggattattattcttctgaactgtcttcaatgatcgattatgacttgtcttaaaacaaatagcaaaccacaatatgcatcttgcataagaacaagcgtgtgtttagattggtgtcattttaactatatcattgttttggtaaagttgacaaatatatggttgcatttaattttaccaaatatttgtaaagaaaattttggcacaacatatttgttccatcctatcaaaaattggcaattctataaatttataaaaaattcagcattgccaaattttggaggttgattttggtagtaatctgaataggcccaaaattagtgatgaaattaataactaagatagagacaaaatctggatctctctattatgttaatcacaaggtctccatgtacaagtatataaatctacaatacatacaagtgtgtgtgtatatactagtataatgcaagtatccgctacacatatgtactacgccaaaacgaatcaaggtatcaaaagaaggtgaggtagtaggtacacacacgcacgtcagtcgtgatcctcacgccgtcgccggcggcgtgccgtgcactgcacgcccttctcactaatcttctagcttaagcctaattaaccacgaacgagccaaccagatgcgagctcgcgccagctcagccgacgacgacgtcgtcgacggcgacggcggcggcgaccaccgtgcgccggcacagggggcacgacgcgtgcctgagcagccagctgtcgatgcagcggaggtggaacgtgtggccgcactccggcagcctccgcgcccgctcgccgtcctccaagtcctggaggcacacggagcagccggcgcggtcgtcgccgccggcggcggcggcgaacgtggtgaccgggagcgcggcgatggcgtccgccggcatgcccgtggcggcggcggcgacgccggggatgccggtgtcgaacatctccgccagcgtcggcgcgctctccctgaagggcgcgtcggcggcgttcatctggctgtccaccgcgttctgcaccgccggatccaccttctcccgcaccagccgccccgtcaggaggctccagatcacgtcaagctgaacacacaaacacaaccaaacttaattagctcccaaatttggtagagcaagcaagcaaaaagcttaattagcttgcaaattggtactatcaattagtagaacaaggaaagcttaatcatatctttttttagtacagcaaataaacttaattggattgctaattggtacgataagttggattagtaataagaatgaatgcaaattcatcgtctcagctgcgagatggaactgtaattgcagtaggggatgcagattttggcaggagattagtaaacgtacgacgtagagaacgctccagatcccggagtcgtgggagcaccacatggcgacggaggagtcgacgacctccatggcgaccaccgcgccggagatggccccgatcccggtgccccgcaccatgccgctctccgtcgccagcccgatcagcccgccggtgatcgcccccaggatcgtgcccactgtcaaccaatcgatcaattactcaagttaattacttccatgaaacagatcgagctcgaattaatcgaggcaaacaaaaagaagcaagaaaccaccaccacctacctgtggcgaagacgaaggtgacgatgccgcgagctacggcgccggcgacgcgagccggcaggcgggacatgctcctgctgctgctgctgctgccggcgtcgtcgcggccgccggcgaccaccggaggggagtaggacgagaagctggcgtgcactgctacggcctccatggatattgttggtttgtgctggatttggataaggggaaatatcactgatcgatcgatcgagcttgctctagcagagtgcagagaagaggaggatctagctagctagctttgtggatgttgggtacgtctctaaaaaaaatcttgttagcatataaatatgcttgcttggtgaatggtgattagtagtacacgacacatatgaattaatgaatcaagcgcgtgtataattcacaaggattagccgagggaaagggtacgcatgagatgatatgatatgaagcatatgcacttggcttgccagctcagccatgcaccgcttgcctgacaggctgccacgcaagcttaaagccttaaacactgatcttactacttttcttaaaaatgttaagaatttttttaatgaaaaaaccgtacgggcacttctttttccttgcatattagtatcacagactgacagacagtctccccaatattctaaacagtacggtttctacaaaagttctctgcataaatttgttagaatggttttttttaaaaaaataaataactttcaacttcgtaacagttaattcattcgtttacactctcaaatatactatcataaaatcagataatctatcatctcttcagcatttagggctcctttgatttgtaggaaaaatataggatttttggaggatttcaatcctatagaaaaaaaaatcctatgaaggcctttgaaacaaaggattgaatcatatccaatcctttaaaattcgttcctttaaaattcgtatggaatgggtaatcctatgcacattttggaggaaagttagcaagaggtctaacctcttggaacatttcctctgagtctatctctttcatctgattcctgcttttttcctgtggtccaatcaaaacggccattcctgtatttttcctgtgttttgcaattctctgttttacaattgtattcctatcagaatcctgtatttttcttatttctctgtttttttttcattcctacgattcaaatgggcccttaacccgtaagccaaaaggcactttgaagggcctactttcttcaccttaaaataaacgaatctaatacgggatgtgctcttgtccagatacttaatatatcacgccatgtactacgtttgcttaatggagagggagtactaacacagtccctctatcggggtggcgcaccaggtggttggaggaacgagtccatccacagccaccggcacccccgtgagcttaaagccataaggtcagacgtgccgctgcagaaacgggtgaccacgcgggagcgttgatggcaacgcgcggccagagtggttggggctagctacgtacgcctccagcatttctcctctcctttctctcttccttaattctttccttgcctcgctctctctcttaacggctaagcttcttctacatccctcttcttcctgtgtctctgtctgatgctctcagctacacacaagcacaagtgcagaaatagagagagagagagcagctcatgacatgagggccgagtttagttccaaactattcctttaaacttccaacttttccattacatcaaaactttactacacacacaaactttcaacttttccatcacatcgttccaatttcaaccaaacttccaattttagcgtaaactaaacacacccgaggcaagtgaaagcgaagtcagaaacttctcctatgctgcctgctgggaatctgtaatttgttttttgttttattattatactatgtttaatacttcaaatgtgtgtccgtatatccgatgcgacaaacaaacatagaaattttccccagctaaacaagaccaaacacaagtgcagaaatggagagagagcccctcatgacatgaggcgagtgaaagcgaattcagaaacttctcctatgatgcccgggcgacgggtgcagcgggacgtgtagggaggagtcaatttctgctagctgcagcgagcaattgtttcaacggaacattgattaggcgattaccaccaacaggggaggtgtgccacaggtttttctacggcgattgcgagctgcgtctcgatcgcaatttgtctgaccttttctttcttcagcatgagcaacatatgcaggtgaaggattcacggtgaaggcatctctactctaatatatggtgtcaatgttccacgcaagacctgaatgggcaaatggttttcgggtggttgggtgaatgacaccatgacagagacgtgtgcaagggagaaacacaatggtatggaactgtggatgccttgtatcggcaaaaacagaagttggcttcaacaggattgacaatgccgccgggcgccggttaatgctaaccgcgtgataatcccaccaaatttaaacaattttaaacagttttgaatttcttgattatttctttttccggtttttcatagcttgtgacagtcaccgtggttattgcgcttaccgtcgggataccataagctagctcggctgtaaggaagagttgtttaatctttcaagaaggaaaggaaggggggagcttacatagcttttgctacagacaggatggaattttcccaaccttttttctcagaaagaacataaattttccgattttatatgaataacatattgttctatatcttcagtaaagctgagctaaaatcttgacatgagagtcgcacattttctcttgccatcaaatttacaccattggacaacgattgcaacagataaacaacactggcagaaaataatactgccaactatgttgctcttttgatgtgaggccgtctatcgacggctgactcaattcaccgattgtttctccaaccgctgccgtaatctaagttattctctcctcccaatcttagctatagcaaggtgtcaaactagataaatactcagtttaacatatatcaagttgatatgcaaattatcaagttgtcccaaggtttatctagtttggtaccttgctatagctgggattaggaggaaaatttttgtgcattggttggtgagggagacgttttataaaatgtaacgaggagatccgggacgcacattttagatccaatggttcacaatatagtcctcagaaagagtcaatactcaataccatgtggaatcagtcaataggctacatgagttgaattcagaaaacatggagcctataaactgtgcatataatttgcaaccattcacaaatgaaaataatttacttcatttctaaacactagaacattacttaatgttataaattttgagaattatacagtataacgcagacactcaactcacgcacactcactcctatgagcattttcgaagactcgaccggccaatctatcctggagattgacgaagtcaccacaggatccatcctggagattgaaatcaccacatgcgcctcgctatcaacgggtacgtcgcttaccactgaaagcacaaagctgttaaatcctgaaaaaatcgcttccatggaaagtcaaacctagaacctaaggtgctacttaggctcgtgtaaccactaagccacatgccatttcgccataatgttgtaaatttggtccaaatgcccgtaccatgctagtccttccggtgacacttaatttactaaaaatgtgttccacacccaatactttatctcgatttaacctagtactacctctgtcccaaaataagcgcagttttgaccgttcgtcttatttgaaaattttttatgattactatttttattgttattagatgataaaacatgaatagtactttatgtgtgactaattttttttaaaattttcataaatttttcaaataagacggacggtcaaacgttggacacggatttcaacgactgcacttattttgggacggaggtagtacaatgcagcgtgctatatgaacttttgtgatgagtatttatatgctgctctagataaagaacccctaaaaacataacagtgctccgtacaaaatggttaacggcctactactaatatggagatcctattataaaggtttcagcatgggtaggcctggtaggctggtacaagcctgggaagccgtggtacaaaggcatgtacgtttatcatgtttgtctgctactagtaccatgccaggcatctactgctaccttgtagtacaaccatcgtttatcctgtttgtctgctattatgccaaaatatttttagcttttcctatttgttctaaaatatatttatttttagaataatcattatatcaaagtttgtgaaagtaggaaataattgtatttggaatagataaattgattaataattgcattaggatttaataaagtagagtcgttgtagttttcttagttttgtattggtatgtgtgggacaggaaaaaataaacttattttgggatgagatagtattatgcaaggcttctgctgctagcttggtacataaaagcatttataggttgtttaaaaaaaggtcagccacaagaggaaattaaaaccccttaaagtactttaattaagaagaagcactcgaaaccggggcaagagaaaagtcacaaatccccccccccccaccaacaacaatattcctcgttaaatgtgagatggttggaagtggaaagatagttaaatgtaagatgagaagaaacttgaatgtaattttttatatttatggacaaattttaaacccttgtaacgtttatatttatggatagagggagtatactttgggtgtgtttagttcacgccaaaattagaagtttgattgaaattggaacgatatgatgaaaaagttaaaagtttatgtgtatacgaaagttttgatgtgatggaaaaattgaaagtttgaagaaaaaattgggaactaaatcaggcctctattggcctctattggaaggtttcaaacctaccactagcaggtatgggtaacctggtagcctggtacaaaggcaccctcggtgcccatcatcatcccatttgtctgctgctgctagaggcttgtgctggactgctgctagtctctgattttatacttgccttctgtgacaaaacatgtgaatttacgcaccagagcaccttgcatctcctttggttaaaggggcaacggatgaataaagcgatgttagctaataggggagtacatctgatacgatctatcctcccgttcagttggcagcataataatgtttgtacctaggtagtgtccaagaagtagctttttattattttacctttgctctttaaaatcacaacgtgctggaaatagatatcgcagcaagggttggaataactaaagaacatcatcactgttcaaatctccatattttatttgctttaccttttgcttttttccctcccctttgttctctttaccttttccttttctttaattccattttatttcttactacatcatgtcacggtgtcacaacttttttctaggttctcactttaagcatcttctctttgcttctcgttggaggcagataagcttacttatattaaaaaattgtagggtggagttaccatacttacttgcatgccatatcattcaatcttcaaccagcaaacctgagctcttgctgtcatggcagggcttagcaccggagcaggtgctccagttgtgaagttataccatgagaaatccatgatcatgcctgatgtgtccagagtgcttgcatgcctgtatgagaaaaacatcgagtttgagactgtcaaggattcttacaaggacatcctcaggctccaggtactttgctgccacatttatgtgttactttccgttttcggcaacacccagaatgtacaacaatagaagcagtttcttgggtttatatatttatatctcatttcgagtttttattttgttctgtgactgtaggcatcgaggagtgttccagttccattctacgatggacccacatttctacaaggtaacaatgtttgttgcacaatctagcctgtcttaatttggcaaggtgtgtgatgtatccatggtttaggtaagcttgcatggctaaaggaacatagctttttttttggttaatcacaaatcctagaatgagatgcttgttacctgtatcagcatgcgtgccttgtagatgagacatttttgaaccgaatcaaataagttgaattcaatttatgtcttgtgcatccaccctgcaaatgattggtgcaggaattttaaacctgtagatgaaatgaaattgacatgtcaatcaatagccatgtgatctcagaagattgacattattcattatttcaggatgaaaataattaatataacagtagacttaaaatgaaacaaagaaagaatgattctcagcattctggttttcagaaacttaggtgctacaccatatcatgtcccctttcatttcaaaattccatttaaagtggaaatagttggcagaccctgttcatcaaaatgtagtgccattgtgcaaccactgtgtaccatgtcgtgcattcatcattagcggcaatttgtttcatgattacggtttgaacatgaaatgaaatgctgaatgtatgtctaaaaactggttcgaaaataaaaacctcatgaagcactcaagtggaaagagaggtacatttcacattctagcaagtatatcatggttgtactagcaggattcatggtgccaaaataaacaaatgcttcttagcatgtattaatcatgtgaattggcaactgaaatcacactatctaaaactatctcaattttctcaactgaggttatgtaggacatacactgtccacagaaaccagaaatatagtaatggtgcatcttcagtcttcaatcagaatatggtactgacccttcttacctgcagaatcaagagcaatttgccgctacatagcagaaacctatgaacagcgtgggtatcctttcctgctgggaaaggatgttctggagagggcttccattgaacaatggctccgtcatgaggagcatgcgtttgatcctccgagccgggcattgttttgccacctggcctttcctgtgcaggatgacgacgatgatgatatcaacacagagaaaagaaaactggaagaagtccttgaagtctatgaacaaaggcttggtgagagtgagttccttgctgggaacaagttcacccttgctgaccttgttcacttgccaaacacccaccaccttgtgacatctgaatttgcctacctgtatgactcaaggaagaatgtgcagaggtggtgggatacaatctccaaccgccaatcttggaagcaggtgctgaaggatatgaacagagtggaggaggaataccaaatggaactagagcagcaggaggagcagtggcagacagagcttccccaaacatctgttggccacaccattcgcttagaccctcggcagacgactagcactgagtcacggacagtactagtcccacctcccagtgctggtatgatctcaacctcattttcatcacaaagagagcaacctctgccctctgaaacaatccgccaagataaaccctcacctagaaaagaaagcaacttctttactaccacagagaaaactccatcaaccccaaggtctagagctcctacaactcagaaacagcctagcagtaccttcttcaccccatctaccacccccaaaattcctcagagaacagatactgatatatccagctccaaagatgccccataccaaaccaaacctagtgaaacaacatcgaaagaagctcatgataaatcccatctctctggcttttttaaggctaggagccataccgatgaaacagcaactcctacaaaacatagtccacaagaagactcgaaaacttctaccaagatacccaaaacacgtgatatcagtgaggcagtcggtcctaatagtccaatatcaaccaaagctccccatgaaattgatgaacgtgccagtgttgatccccgctttgacaagccagctccatataccaagcctaccacaaacataccacaaacttcttctggaaggccttctgcacagagagatctaggcacttctcctggcactgaggcagacaaaacatcttctgatctgggaggtggtgttcagtctccttatgcacagggacgtgctgagcaagtgaagaaaacctcatctgatcagagaggttctgaaactgcacaaccagctcaaccccgtggcatccagcaattcaccaaggatgctagacaggctgatcaaaacaggatagctgcatcaccacgtcaacaaccatcaggtgagcaaaatgtccataagcaatttatagcaccaccaattctgaaaatacctgacttgtcaacaatgcaaccagagtctcaagaagacactcataacatcatgagtgaagatgaaagattctctaccaagaggctccggaagatgatggaggaaagtgaaaaggaagcacaagaagttaaatcacagcctacagattttcgaccttcaaaggaggaaacaccatctatctataagaatccctcagatgtgcaagacagaaccattttggatgatagaaaaagtggtagatctccgtcagctggcacacgagctcctgactatccaacaagtgctgctgaaagaagagttgcttcacaaccaaaagaaggaatgccatatgatgatcgtggtgccactaaaccacaaaaatcaccatccatcaatgagcaagaaaaaattccagtagtgccaagccaagcgccaccagccagttcagggaaagcttccgaatcattaaaggaagtttcccctgatgatggcttggctcaagtatccaccatcaatcaatggagacaaacctctgcacctcctccaaccaaactagcagctcctgatgctcctagaaatgttgggttggccaaaacagaaggtgttgacaagaggacacagccaagcacaacaaaggaaaccccaaggaatgatagaaatgttttagcaacagggcaaggagctgatcgtggagttggtaatgaacaatatgacaagaattccatcgatgaaagagcaccacaaatgacaccaaggcaagcagcaccttctgtcactcagcgtgcttcagcatcaatccaagaaagaattagtggtgcccgtggcgctagtgatgatatgtttggaaaaacatcaagtgctgatcaaagcaacactccagccataccaaagcaaacaacagttcaaggagcaacccctgatgttcgtggtactagttatgctgacagagagatgaaacttcctgctgatgaaaaggcaacagcaaacaagcagaagccagtttcaagttcccaacagacaattgaaccaattagaggaggaactcctacctcatatggcagtactgatgatgacttggccaagacatcaagagctaatgaaagacaaacgccaccttcaaaggcgcaagcaccagcatccaacagacagagtgcttctacagctctccaaggaggcacacctgatgctcgtggggaaaatacagcagtcaaaccatcagtcacttctccaacaggtatgcctacttcatcaagaagacaagaaccaactccatcagtcacttctccaacaggcgtgcctacttcaccaagaagacaagaaccaactcctgacactcaacgtcgtcgcgcagcaggtaaagtaacccccactaaaagaaaatttgctcaattcaatcaagtagagttccatgtatatgcatgctcagcagcaggtcaaggaatacggtggaacgactaaacatcaccacaaaacaggcagcaataccttctgcaaaaagatagtagtttccaaatttctagatgagtttgaaaatcccaaaatcttatagcaaaatgctgcatttatattggcactccagcattttcaacactgaaaaaatcatttctcatatttgcattttgttggaatgcttagctcaatgtcgatttggatatttggttcatcctctaaatttagtcacaatgtgctattgcctattaggattatgagtccctgtcctaaggaaagaaaatcctatatattcttttgaactgtatgtttaatgtgtgggttgatcatggcttattgatttgatgacataacacagatcaaatgccatcccaagctccacttccgtcttccttcagtacaaggaacaaggagaatggtatttctgaagctggtcaaaccaacacagtagcacctgatgggctgccaggtccgggagttcccaaagatgctggaccacaggttgcaggaccttcagtcgtgaaatcacagaagaacatgaatgaagcatacaacgatggaccatccacacagcagttgccaaatgatcagtataggtctcagccaagagaagccaaggaagagcaaggagctgatgcagcactaatcaatgaaattggcaaggcccaaaaggatgatttgttggcaaatccaaatcaaagtagcactggaagagttcaaccaacatcaactgaagaaacatccaagcagcaactgcaatccgggctgaacaagcctatatcatctaaagatggcaaagaaacagtaagctatggcagctcagcaacgtccagagaaatgctaccttctattcctgataagagcatgagagtgcagcaaccgcaaggtgacaagtccagctactccagtatatcacaagaagacaatgtgaagcaagggtctcaagctgcactgcagggatctggaaatgagcagcctaagaaaagggacctccttgcaaatgctgatgagaaaatcagaggaactacaggagaagccttacaaaagtctgatgaagggcggatctcctctaatactgagcaaatgaaaagcaacagaaataacagcaaaccagatggctcaactgaacccacttcatttgatggcaatgaaggtaatcttcctgagtcacagaggcgtggctcatcaagcaacccgtaaaatgcttcatcagctcattttctttcaccatctctgccgtactgctatctacttccctattttcacataataaggtcacctatacaccagcggaccagccataccagtccatgttgtctactctgcatgtttattattccttcccagtggtgcagtattgttcattacttgaacaatgacttgttcagatgtcaaagttcttaatttaatcttgttttgaataatgtgaatgcaatatagcattctccatatgaaccctatctctttgtaagttatccatgcgcattcaccttaattatctattatatggtattaattgttctggaatcacatccatgcattaccaatgtgtcattaacccattaccagttaggatatctcttaaccaaaaaaaacttggaaagattgcctccattccctagtaagtggcaagctacatagatgctcagccagaggtaaatatttaaatcaaacagaaaggtagggggaaatgaattcttcattgtatatatcgtcacatcacagatgcacacatgttagagtagcttaatttagtacttatgtcatagttaaagcttaagtgtggatattttgccaccttcctaacaacattaatttaactatctggaatacattgcagcatcctaggccttgctcgtggaaatatgattaactcctcaacagattgaccttagactgctaatataacaactgtacaataagctcaacaaacagcatagtggccactgttatgggcacaactcagcccatctcatgcattcagttagtttgttaggctttgttagatagggttgttaggagcctgctctatataaggagaggcatggcagtaaattggaatcaatcaagaaagaaagttaaacctatctctggtctcccccttctctgtttgtctcaccaggctccagggcggcgaggctgcaggcctcaccctcctgtccaagcaccagcgtatccacacccacaacagaccccaaattggatgttgtaggaatagtgttactcccgcctgtagactcatctgtgtgaatctgaaccaaaaattctccctaaggccttgttcggttacacaaggattcaatctgggctgggaatgacaagtatagtaagaaatttatgatagatacaacgagagaccgggatttattccgagccgggaaccaatttactcatgatagggacaataagagaccgggaat

SEQ ID NO: 48597 - DNA, 14601 bp, Oryza sativa
  unsure (1)..(14601): unsure at all n locations
ccagtagcattaataacaagttaacaacacatggaacaatgttactctatcagatgttggcttcactaattcttgatgactaacagcatagcaaaaccagcagcatagacaagtttgtcatcagccaactgaacttcagaaaattttaagttggataacatctccatgtgaagggaagaataatacatgcaaagcaaactacagttgaaaaatgataatccaacttaacataagggaggaatatgctaggtacttattgagttattgatttttttttcttgtttcatgaaaaaacacagcataaagaacttgttggacatacttgacatagagtgtgaaaaatcaccccaagtcttactcttttttattaacaaaagaacatatattaacaaacatgtgatgtgagacatgatgtacaaatcacttcttacatgttgtgagacaaatcatggaaaaatagcactgttgcaaagtttggaacaaataaaaatagtgaaatgaacaaaaaattattgaataataccgcacaaatcattctcaagtaatggatcaattcaagtagaatctgtgggatttatctataacttagtggacaacctacagaactcgagtcatgactaagcaatcagctgagaaaaatgcaccaaagtgacttactctaagaaacaaaaggatcattccattcctgaactcagcttttagcccaagattagagtcaatctaaagtccacaaaaatcatgagcccgagaataatggatttttaggaaaatacattcgctcctcatagggtcaaactgttttcgaactatattagccgaagccgacaattcatagcaaagtatgataaaaatctcaatcacaccatcatagtaaagtccacaaaaatcatgagccccagaataatggatttttaggaaaattcattcgctcctcatagggtcaaactgttttctaactatattagccgaagccgacaattcatagcaaagtatgataaaaatctcaatcacaccatcatagttgagaactcccattgcctaaatatgacatgtaaaatcagaatgaaatttgtgcgatggatcgactgggactcgatggggctcagattcagtaaactactccctggctggcattgctagcacacaagtcatagatcgaggaatctctctctcctagctccgagtaagacctatgacccccggactggttggatgaaagagggtgtgagccctgggaacgcgaatgaggaagggaggggggatggaggagggggacacgtacttacacccgcgaggcaacgggttcccctcatctgcatccgccagggccacggcgagcgagcatcgtcgccggtgcggcggagcagaccccaacttccgcgactccgacggccgcacggcgatgcacaattgcacatcgccgcctgcgaggggcatgccgcagccgcagccgccgccgccgctagacggctagacgcccacctccccgccacgcccgccgccgccaccggccactgcccgccacgcccgcgagccgacggcgtccttgagaggagaggtctcgggagagagggagaggtgggagagagcatgacggatgggcccacgtcaggggtattttggtcgggaaaaaaataaaattgagcaaaaactttctattcacaaaaaagaactaaaatggcattttggtaaacacatctcaatttagtgtgacattacaatgaatcagtttgaagcgatggcaatccagcgaaaccactcttttacgatggtataatcctaaatttctcgccaggagaatcggagaagagctccgcgccctcgtccatgctacggtgccgccgcggtgggcgatgagtagtatccccaattccccattggtaatcttgtctcaaagaggatgaatggatgtgcctatgtctcgcggttcatcatcttctccttaatttacgcttggctgggaagtggatttttgtccctcgaggggacatcctctcattttgtgcctgtcattaaaaagctatcaaaaaattttaaaaatttatcaagatagattaatatataatatatcttattgcaaacatgcgagttaaaattcgacttatacaattggaaaaaaataaatttgaccgtgaattacgcgttctattcatagtcaaatttattgttttttttctacttgtataagttgaatttgaatttacatgtttgtgaaagcaacatatctcatattgatctatcttactaaatttttttaaaaaaatttgatgattttttaagtggcatgtaaaaatgaggggataaccttgagggatgaatggagttttcaccttggtcactagctcactgctcagcccaactccaagaagatggctcattgcaatgcaacagacaacagtcgcgcgcggatggagccaggcggagcatgatgcgaaagccacctgcctattccggggcgaggcatcgtctccccggccaccgccaccacgagactcatggccgtccctccaatttctaccttttgcatgatgcatctatcgtgcatgcatgaacacgcggccggcgcagctagctagctagcacgtaaacacactgcacacacctgcaggaggccggaactaagtttgccgagcgatcaaacggcgagccggcgatcgccgtagccttcttcctcggcggcggtgcggccggctgccgatcggccggggcatatatgcaagcaagatggcaagatcctactacatttgctcccatatcgaccccctcgctctctcccccatccccggcatcgccctcgacacgctcttcctcgtcgccatccaggccctcgccgtcatcctcgtctccaagttcttccacctcttcctccgccgctacaaccagcccagcgtcatctcccagatcctcgtacgtaatactctctcggctcattgatcctcctagtacatttcttgaattcataatcgatcggatcgtgtgtgtccaggccggcgttgtggtcggcggcatggggctccgcagcgccatcgtgcacgtcgacgtggacaacgtggaggacatgtacggtggctacatctccgcggcgcgcatcctgtacatgttcctcgtcggcctcgacatggacatcgccgcgctgcgtcacgccacgcaccgctgcgtcgccttcacctacgccaccgtcgccgccagcctgctcctcgccgccgtcgtctccagcggcatgtacggcagcatgatgcactccccggtcaagacgcccgagctgctcgccgccaccctcatgctggcgctcaccaacacctcctccatagccgtcgcgcggatcgccgccgagctcaagctcaccgtcaccgagaacggccgcctcgtcgtcgccgccgggatcgccaccaacctcatctgcatcctcggcgacggcgtcctgtcgtccaccacccgcgccaagggcaagatcgagggcgtcgcccgcggcgagcaccagatcaggaaaggcttcctggcgctcgccgtggccgccggcgcggtgtggatggtgcgccccgccgtgacgcggatcaacaagcgcaacgtcggccagcaccacgtcggcgtccgcgacctggcggtcatgctcctggccatctggttcgtcggcaacatcccgcagttcctcggcttcgacggcatgccgacgagcttcgcgctggggctggcgttcccgcgggaaggcgccgcggcgaggtccgtcgccgacgcgctcgcgccgccggtgaagggcatcatgctgcccttctacttcgcgacgatcggcatgaggatgaacttcaactccatgtcgggcgccatcatcgtgcccggcgtgctcattacgctgctcggccttttcggcaaggccattggcgccgccgccgtcgcctcctacctcagcatgccgctctccgacgcgctccgcttcagcgtcctcctcaacatcaagggccacgtcgacaccatgaacatgaagttcgccaaatcagaaggggtaggtaaccggtcgaacacttgatgcgccatgacaacgtcggcaatggagcaactcatcggaattccggattatttgtttgcgcggcgcaggtgtgggcggagcaagcgctgtacgcgatgatcatcggcaacttgatcagcaccctcgtcgccggtccggtggtggcggtggtgcggcggaaggaggaggaggcgtacaggacgaggcaccaggccatggagtcgttgggcgcggagcaggagctccacatgctcgcctgcgtgcacagcgcgcacgccgcgccgggcatgctcagcttggtggagctcctggtgagcgagccgcaggagcagcccgccgtccatgtcctccacctgttcgacgtcggcgaagagcgcgtcgtccggatcccgtaccaccagcgaatccgtgacgacgacgacggcggaggacgagacgaacgcggcggcggccgcgacgccgtcacgcggatgaacacgatcgtcgacctcttctcccgcgccacgggcatctggttccgccagatcgacgtggtgtgccgcggcggcgcggccctggacgacgccggcgccgtctgccgcgcggcggagggcgtccacgcccgcctcctcctcgccccctgccacaaggagcagcgctacgacggcaagatgtggtgccgcctcggcgggcggcgggagctgaaccacggcgtgctgtcgcgggcgccgtgcaccgtggggctcctcgtcgaccgcccctaccggaacagcggcaccagcttcaacgtgcccagcagcgtggcggcggaggcggcggccacgagcggcggcggcaggacgctcctccacccgtgcagcgacagggcggtgacgcacgtcgtcgccgccgtgttcttcggcggcgccgacgaccgcgaggccgtgtcgctcgcctcccgcctcgccgagcacccgtccatcggcctcacggtgttccgcttcgtgaagcgcagcacgtacgacagcgtcacctccgccaaggtcgacgagctggacatggcgttccaggagggggacgtcgacgagcgcttcctgtggaggttctacgagaggtacgcggcgagggccggtctggctgaggacgtcgtgtaacaaaaactctattcttttagtatattgacgtacaatcattttgtgtgttcgtgaaaaaaggtacgcggcgacggagatggccatgtacgtggagaaggtcgtggagaggcccgccgacgtggaggagacgctggccgggatggccgggatgttctcgctggtcatcgtcggccggggagggaggcagccgccggagctcttggccgggctggaacggtgggcggacgccggcggcgagatgggccccgcggcggagatcctcgcgtccaacgactcgctggagatgggctcggtgctcgtcatgcagcagcacacggtagtgatcaagcaatgacacgcagacgtcataagaattattgttgtaagattattaataggttattacacacatgacacaacagcttgtgtatatttagatttctgcgactagaatttcttagagctaactttttttttcttaccatatgtggacatctccaagattttttaagtccaaatttgatctagtgctaaatttgactatcaacaaatgttaacatcttggctgagttctttccccaactttcctaactcacatccctcgttttccgtgcacatattttttaaactgttaaacgatgcgctttttgcaaaacaattctatgcgaaagttgctctaaaaaattatattgatccttttttaaaaaaataataaatactttattaattacatactaatagactattgcgtttttcgtgcaaaagatatttgttcccaacacaccaaacgaacacagacttagtattgtttcatatagggaaagtccattcatctctcaaggagatgttctatcgtgtttacatgtcgcttaaaatatcatttttttaatagaaaagtaagatagattaacatgtgatatactgatatgtcactccataaacataggtgttcatccctccataaacatgtcactcccgaaacaattatactcatttggctaaagacttttaaaacacgacataagctaaaccttactgacaaataaccataaatagggaaggtatattaaaagctgcgtgttttagtctggaaaagcaaagatcttaacacaacacaactccattattattccactgcatggaaatttagcctgatcctcttttctaatcacaatgctgtgattatttttacatgctccatctgtacacccgcagtaccttggaaaaacattgcacaaaaaaactgtgctccaaaggtacatttgggaaaaaagatggaaaaaaagaggaagaacaagctgaatatccctggagctcttcttcagacttcagatgctgtgtgattcttcagacttcagatgctgcatacagcaaaatgctggtgctgcgccatcctgcttgggtggtggctgcagggcatcacaatggaactgaggagagccttctcaacctcctccgaggcctctctcccgagcaaacacatgacatactccatcaccgcggcgtcgcacggcagtgtgatcctaccatcgctgctgaacccaaactcctcctgtgacatcctcaggagctccacgaacaccggcgtgcggaggtacgccagcgggatctcgaaccgcctcccgtcgcacgagtagacgacgcagttgcccttcccggcgacggatgagctgcaggatgagtggtggatgatctccttctccgatgccgtcaccctcttcctcccgatggcacccattccctgccacttcttggaaagctgaactagcttcttggagctgatcatgattgcttaattttgctttgctttccaaggaagtgatcagggaaaaaaagagaggaaatgtcaggttgtttttggtgaattggtgatggtttgtgtcaatggcaatgtatttacaggggagatatgtgatagggagatatgcaacttagtttcagatttttcagtagtaccaaacacgaagtagctagctggcaagggacaaggccatgaactcccatggtgagatgttgcaatccgtgttacaggatttcaatgcccacgatcattgtttctcccatggtggagccatatttcatttgccagatctgacatacattgaacccaactactggcttattatctcagatagtattagagtggttctaaaagaaatagtgtagttcctcgcaaaaaaaaaagtgtagttttatgaagattataggtttcatggcttattttttgggaatgtgtatcattattgcattgagatcaaagaggttcacacataaaaaacaacacaaaggaaaagaacatgtacatgtttcacaacacaaaggaaaagaagtacatctttcatggtttccgacgctaaatcctaccactaactcactaagagaaatttgacaaatggaagacatttaaaacctccttgaacgtagttagcgtataagttcaaattctgctaaacattatgatcatgatatgctgctttttgttaacagtgaaatttggtaagcccggagtagtcatcggcttcgaagtcttgagattagctgatgagagttgtcaagtcgtcagttgtcggattcttgctatattcggttaaggaaattgatatactaaaggaagcttatccagaagagaccgagttcaaagagaatgcggcatggcaagttatctattaattaggaatagtttgttagtttccttttatctttaggaaagtgtgtttagtgtcctataaagactttatcttttccttttatctttatgaaagtttctttttggtccaacaaggacttgtatcaacccatgggtataaatatgtacacccggggtctatgtaatctatcttcacaatcaatacaattcggcgcatcgccaccttttaccttttctactttatttttatcgtccggcgggacttggcacctgacgcggggctgcatcggtgttcgatctctggctaaggggtaagtccaatgttccactggcctaggtagttgtatcgtttatgtcggcgtcgttcaaggctgcatcagtacattcaacctcttggattgctctggtttagatgatatatttgcctacctatttatcatgtctctgttaatctagtcttagcatatcaatttagctctatcggctgcttctcgttttagggtttctgtcggtatcggctaatcgcgttgctagattagattagcttagacatctaccaccctgaaaactcagtcaacggcttgattgtctagatattatgttttttttcatacttagtgttgcatcagttaagtttgatctactaagtcgtgcttagaaccataatctctagcctgcttcttgattgccaataagggtttcatcggggtttcagccggtgagttatctggacgttgcatcggctcataaggattgcatatacatataagttggatttagccgatgacaacaaatgtttcgctgtttaatctaatcttgtggatttcatgacatcggacctccagccgatgtgtgcttcaaccttcggatcgatgcttatttatcatatcattatttgccgattggtttatactggactatattgttattttattacatcatcatcagccgattgcctttatatcatcatctacattggacatatagccgattgcttaaaccctatcgctatcagctagtatcggcatcggctattattggatatcggctggaactactccatcggcttgtcagccgatcggctgttttgatctactatttgtaacgctccgcttttcatgagtcgttaaaaactaactcggcaaaatcctaattgcgaaaattttcgttctttgtgtgcgagtctaagtcgtgccaagatctcatttcaaatcccgttgttccccctcatcgaaatcaaaaatcctccacctcaagatttcctatccaaaattcaagtctccgaaatcaaattccgaaagtcaatcccttcctttgaatccttgccgaatattcgctccgactaaaaaaaaatatccaagttttcgttttgaatctctttcttgacttctcctcgagtctcccttgattccaacctaaaccatcgagttcgaatgtcaaatttgaattcaaatccaaaacctcaattcgaatccactccaaatcagtcttctctgcaaaagtctattttacctccctcgggtattgtgggccgttttccccttagcccacctccctccctcagccgtttcacctccctcttggtcgttgggccgtttttcccttttccggcccatcttctcctctcggccgctcctcctcctccccacacgtgcgctgcacgcgccgagcgagagaagcagcgcctctcttgtctccttcctctctctctctctctctctcgtcgaactcctctcctcggcgccgattcccgccgccgccgtttgaattcgccggtcgcccttcccgcgcgcgcgctcgccgcccggtcgccgccgccatcagcccttgcaccgccgacgccacgcgctgccgccttgcccccgctccatgccaaaccgaccaccaccgtcattgccgacgtcatccatggcccccgccactccacgccacatcgtccaagaatgggagaagcagctgcttcccctctcctcaatatggcaaaggaccaacctcctttcccccccttctttttccttttccccgaccaccgccggcgtcaccacctctgtgtcgcttgaccgctcgcgccacccgcctcatctccttgaccgccccaaggtcggttctctcaaaccgacatcgccacctacaaaacccacaccccctcccatacctcccgcttcctctcctccatcacaccactgccgtctcgccgttcgtcgtcgttctcgccctcctctgccgtcgtgcgtgtcggggagctagcgagcacgaggagtcgacaaggagctccgcgccgccccatccttgcacctctccatctcttcttccccggccgcgccctctcggtgccgcgccaccccgccgacgcgaccgcctcgccgcgactccatccgcgccgtcgacaccgtttctctcgtcggtgagctccccactgaaccccttttcccttgtcgcacgccgcgccgcgcccgccaccgttcgtcacatctcgccgcgcgcccttgctctgtcctggtcgtcgctcgccgtcgccggcctctctcggcgtcgcccgtgccctctcgaccggtggaatgagctcgcgacctcgcgtagatgcccaacttcaacgaatcgaacccccgttgccccggtgaagttttccccctttgctcgccgccgacgatcgccgtcgaaatccgccgccgtcggctcccctcttgtcaatccctcttgccaccacgctctcggggatccccttgatctccccctgttgcctcatggccgccggcctcccctctcgctctcgcgccgtgccgccccttccgccaccgcttagcgccgccgcctgtgcgtcgccggtgaccttcgggtcccgcgtcaccgtgtgcgcgtcgcaaccccttttccacgacagctgaccctgagaccgcgcgcccttcgctctttccacgcgcggccacatcggcgtgtcggcgagattggccaccgccgtcggccgccgtcgttcttcccccggctaatccgctccgttgaatcgattccccttggcctcctctctcttccggtgctaaccccccaatccacctcgccgccgttcgccggttcgcgtcgctcatcgctagccatcggatcagcctgcccggcctcctctgcctccccatccgacgtggcttccacgtggacgccacctcaaccccgggccagcttgaccgagtcaagccggcgcccagtcagcccccctcctccctctccccgctcgtgggcttggcccgtcaaccatccccccttctcggcctaggggaaaatgaaaagtctacttttactccctctgtccaagcccagtgcccacacacatgaacaaaagtccacttaatccccccccatgtacagtacacccttggccccgcacgtcagtgactgtcaataatattcttgagaatattatttccataaatttcgacaaaacatttccttgtccagaaaatccatttagacctccaaaattcatatccctcgatccgtagctccgatcgcctccgttccacttccagtaattccgtaaaattgagatctatttaatggcactactaattagtctaaataggatctttattttggtcctttgtttaggttttcgattgtttgcgtatagttgcggttatcggattttcgtcgatcgcgggttttctcgaagattcgtgaagcttcgtgaagaccttgagcaaggcaagtcaccctttgatcaattgcccctataattgaaaagtcattattattttgtttgcaacttgcattattagaatcacacacttaacttgcttggcctcggtttgcgtgccaaaccgacggacctacccagtagtcgcactaatttccgtaggtcatactaccctgattccttgtcgctccacccttgtggtacctcggtaatcgtgccctctgagcgcgtataccaaatatcccacatacaccgttgtttgtcgaaaacttgggaaataggtttgtgaagccttcaaaacccgacatgtggtgtcggtgtgtttgaaaataaaatgaattgtgaaaactcgcgatgcgggggttgtgcctgtgtggcactgtcccgtattcgcatataaggaccgattcctgtgggaaactcatcgaacataatcaaagtgcaaccacaaggtggaatgggacaccctggctaagtaactagtcggttcagggaaacctcgcatgccaatagttgggaacgccggggcggggtcggacaaaccgggttcctggtaatgcaagaacgagaagcttgctgaattaccgatcgaggtggttggagtttgatttgtgaacgcctaaaatggcctatatttatgtgaggatttgatccttctatgtggcatgaggtatccctgggtcggcttgggaaaggctttgttgcgaacctccgataccgacgggtgttcggaataagttcgtatcttgtgggtaaagtgtacccctctgcagaggattaactaactgttcgaacagccgtgcccatggtcatgggcggatgtgaggtggttctcgttgcgtagatttgtttgcatgtgctttgtgaaaagttgttgtggtgtgggaatcgtaaccagaatcagcctatgtggcagatggatgacctgagtggtcaagaaacgaatctgtgtgattcgggatgtctatgggcatcatagtctaggcttcccgagtggaagcggattgttgtgctgctgggcagctggactctgggagtccgagaaaatgaaaaaggctctgggagccgattaatcaagtggaatggctctgggagccgagaagtaatgatctgacccgggaggtcggtacattaccaaatgagctgttgaaaaacatctctgaaagtcgaatcgagacgcaagtctcttttcggcccaaacttagaaagaaataaatcacttagtgatttcaaaatgtcttcaaataaaagatttgcaaaacaacattgcctctcttccaagcttgcattaaacacctaaattcccgtgacttgctgagtacgaaagtactcacccttgctctatataaatatatatagttcctccgccctgaagttgaagatgaggtgaagtgaagattagggtttcgtcctggttcccagccgtcgcctgtggtgttgggtgttagaccgttggttccgctgctgctgttgttgttggtgttcgcctcgtccgtgtcgtcggttgtattctcgggctgtctgagctgcaacctaagttaaggtaaataagtcctctatttattttaaggatttgcaatgattcatatttgtcaccgtgggtaccagcactatgtcctgggactggtaccgagatcgcggtttcgtaggaagcggtttgcgccgtttttcctacgacatgccccctatcaggtgccgttgtgcggcggtgccggattggggtgtgacactatttgcatatcttttcaattgcaggatcaaactgactggcacgcccgcatctcattaatctttagacctgcacaggagttaagcagatctcccaggccggtgtattcgatttttttcgtcaacactgttcattcaaaaagagagagagagctttatttctacgtacggactgaagctgcctccaagtcaagtcgttgcatgtgttccttggatctgatttggatcatggccatctttaaaagaaaatatatcaacttttcactttccagaggatatccattagtgctttgaatagatgagcaacaaattggtccatgacatgcacgcactcatcaatgacactagttggtgcgagcagcagggtcatgaatctggtagtgcaatgttggctacaatggaggcaacagttggtgcattggggtcctcttgtggagaccatagtactgaactggtttcagatgattgggtacgtacagcagcagtggttcagtgtaggatagaagcatatgcagaggcatttacttcaagctccagcatctgtcaacacaagaaacacaccgaaacatcagatggagagccacatcaagtgagatttcttaggatgcttcgtgtgtccttccttatctgatcattaggggttggttgaggaagacttgactagcattacaagcaacttgcatatggtatgtgctccatatttctacgatgatgtgatatcatcagatgtggcatccatatgttctccattttacatgcctttctgaactcttgcgcatttctggtttctgaactcgcaatgtgctgcaggttgcacttctgtaaagagttgttccaagaactacactgaagagttctttgctatacctcgctgtgttttcttgtcaattacaattgcaaagcaatccataaaaaaagaccaatcctgcaagggaaaggagtgaggttgtgagctgtttgatcaatgatcatgcaagtgatgcaactgtatactggtccgtaccgtactgtggataataaagagatcgacacgaggacagcatgtagcttcctagcttgcttgttaacttcaatggcgtaggaagagatcgatgggtgataggctagccgcagatcttttcgcccacatcaaatttgattagggttaggaaggtgttggttggttggcttcgatttgaacaacttcctcgacaaattcttatcgccaatgtaccttgtggtccaatccatctgcactgcagcatctcacatgcatcctccagaaaatggcgttcctctgtaaatctcacggagaagcagttcgatccgacacgcatggcggcggaggggatgggaggggagggcgtcgaggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 48598 - DNA, 753 bp, Oryza sativa
tcatcaatcattttcatccatcccttatcaaaatcatctctgtttaatgaatcatacaccacattagacaatgtagagctaataacttcatattctaagtacccaccaagtttttcaggaatcttcttcatgatatgccacaaacaccatctgtgtcgagcttcaggaaatacttccataatagcattttgcattgctctgcactgatcggtaattatggcgtttggtgctttatttgacatacatgataaccatgatctgaataaccaaacaaaagtctcagtttcttcatttgatagcagagcacatcctaatagaactgattccccgtgatgatttacaccgacaaaaggagcaaatggcatatggtacttgttagtcaagtacgtagtgtcaaatgtcacaacatctgaaaaagattcataggtagccctacttcttgcatccacccataaaacattttttagtcgagagtcctcatccacgtccatgacatagaaaaagtttggatctttggacgtcatacgcaggaaatactgataaactgcatgtgcatctccagcaccaagcttaagctttcgtacatcttgcaaataatttctgcactccttttcaccaaattgaagattctcatagcctccagcttgcataactagagaactaaaattcttgtttatacgaattcttgcttggtcattcaactctagccttctcttagcttgcaaatcaagtttcttgtgacatctgagatgt

SEQ ID NO: 48599 - DNA, 3501 bp, Oryza sativa
attcctgcagccctactgtgccttaccttgtctgctacaagcaagtgtgaaatatctcaccttgccatcctcagttttcttagatcctctttttatcacaccgaatcctaactttcgagcataacttaatgtaaaagcaagtggcactatcctcactatcaaatagcatacctttggttggctccaacagtttggttttatctgctaccagagcatttgaatcactctcaacctcctcaattgcaaagccatcttcatctgatatgatatgatcttcttgctcatcatcagaacatagattggtgtccattaccttaatttggcaaggaaaattaaatcgattttaaaagcaaatcaaatatggtcatgtatgtgtttgcaagcatggaaaaacaagagatgttgaaaaacgaattgagaaaattaatagaattgctcatcgggcctagaaaaccagagcctaaaatgtcaggcaaaaataaatcaacaactttctcatacctttctgttagcttcaacgtggatactctgttgtggttgccgcaaaaaaattttccgattaatcttaactgattgttatggataggagacaaaggggattagaatgagggtttacggtgagaaagaaaatgcagaagatgaaaagtcacgactgtgtatagagtaatatcgagaagaggaatcgacgccggaatacggagcttcggctggagttgggcttttaaaaggcccaacaatcacagcccactaagtaaacagctcacgctcacagatgacgctgtcgactagtcgtacgatagtcgcacaaattcgtcgtgtgtatagcattttcgattttcaatagcacatatttgcacggattatatgggaattacaagaacgacctcgcgatacttcggaaacgtatagtccggctgtgagaaaagcttcagtcgtcgcagattttgttttgaagtgaactttaaccacaattattagaacccgctaattaacctgttgggcctggccaaaatcaccacctcctaatgggcccatatatatctggcccattcacatgcataggccttcggtgtgatcagtttgtgcccggcccactaaattcacgtgaatgtatttcttcactccgcctcgttttaatgagtcgagataatggcccattcatattttaagggcctatattttagtggaccggggactaattagagtgaggcattgaggacagaaggcgagagaggacatagactcaaaagtcaaaaccgtctcgagggtaagtggatcctcttacctgtgtagtcactgaacatatgcacctcacttcattatggcttacatatcagtggtgcaactataaactgcacaaattcagaggagcatcgtccatctcgaggaggagaagcgagcgagcagccaaacttgtctatttcgtgagctgggcacatctagagagatgcgtcgagaaccatcggatcgtaaaagataaaaattacaccttctaggtgcgacaaaaataaagacatatggctatatagagaggatgatgagctcatgcaggcgcttcacctcacaaacatccacgtactagattcttctttgttttttccaaaaggatcgatcgttaaattctccttctgttcaaaggctctctaatttctttctttaattttcatattttccaaatgactagggatctgatcaacagcgctaactgccgatcagcggctgaaactaaggcagttcaaaacagttgcagccggtagctctttacaaccaccatagctacaacagttgtggcagtaagaccaatcgaacatacacatagaaggacaatggcatgtacaggcgaatccagcgtggatgctagggagacttaccgattgaatcccccctaccccgctagatctctattgatagaaggagagggaaagggggagaagaggtagaggaggaagataatgaatggttgaaggagaaaggagatgagtgtccctctaatcttattcaggattcgtccctaagtgcatgtgcgaagtcctttctccttggttacgcattgacaagtagagagcatctcccaccactcatatagacaatcaagctcttcattggatggggcaagttgctaataggtggtccagtttgtcactagcccctggattgttagagtatctgtgagtgaaatgaatgttctattaccacatagtggctagtgaataatgtaaattcttttagaatttttttaggagaacgacggtaggagatctgccggaatttaaattagggaaaaggccgaaacccagcaaagagtttacagagtttacatggactataacaaagaggaaatacagcttaagaagaaaataaaatcagggggggcttaaaagctattttgcacaaatccatatcttgtttgataaggtatgctacttcatttactgagaggcaagaattttgaaaaattcttctgtttctttctagccaaatattccaccaaagtagttagtagtgtgcctctgataccctgcatttgaactttgcttcccacatggttggttccattccaccaagtttcaacatcatggggatggggtgtagttataggggttagattttggaaatggcagattagactccaagtttgtctggtaaaaatacattcaaattcttttagataatagtgatgaataatgtaattgaacagtctgtccaattactttgttacagtttcatggcggtggtgttccaatattattgtcgatgcgatagacacgaacaccacaacacggggccggctaaggccttgtttagttggggaaaaaatttaggttagttgtcacatcggatatacggacacacatttgaagtattaaacataatctgataacaaaacaaattacagattccgccagaaaaccgcgagattaatttattaagcatgattaacctgtcattagcaaatatttactgtagcaccacattgtcaaatcatggcgtaattaggcttaaaagattcatctcgcaatttcccggcaactgcgtaattggttttttatctatatttaatacttcatatatgtgtttaaatattcgatgtgacaatatgaaaaaatttgtttgggaactaaataggccctaagccaaattggccagatgtgatcgatcgttcaaatgggcaattatgtttgctaggcaaaccatgtggccggaggccatgcatgtagctatagagaagactctggacgaaagacttgtggagttaacggcacgtacggtgccgcacagggttatccttgacacttctgctttctatcactgctgctgctgatgatgataatgatatatatatacacaaacactccaacatatggacaatcttgcaatacagacttgagtacaccaccgagtcatttggcgcacgatcgatgataataattaatttaataggaggacttgaagacttgctctcatccctgcagctagcgagcgtgattacatatatagaga

SEQ ID NO: 48600 - DNA, 19769 bp, Oryza sativa
atgtacaaatacaaaacattctcacatgacctcgagcaagagaattgaacactatctgccatctatagcagataatgtgataccgttaacactagatgccgcaataacagttgacgcctcttcgttcgtcagcctcatgttgaaaaatgcagggtgcttaggctcaggtagggtcatagtctcgttgcttagcattgcaacaacctctgacgtggtgggccgatcggccgcattctcttgcacacaaagcaaagcaatgttaatacatctcattatctctattgtatgagaatcggtgggtaacaatgggtctacgagttgaagccatgtttcatctttccacatctgccatgcctgcaaggtgtatgatcgcaaaaaacatgaaaacaatctacatgacattagtatttcttctatcgaagaagtacgaaaaaagactttaattttatatactactgaaatcttttcgctttgcattttaggaagattagaaactcaagtcattattatatgatgaaaacttacatggccaagaagattaataaattcaccatatcgatgaaaacttgatgtctttttcccactgacaatctcaagaattagcacaccgaaactgaatacgtcggatttgattgaaaaaaggccctcagaagcatactcaggagccatataaccactgaaaagatgcacatacaaaacattgaagtgaggtaacagtattggcagttttgtgtacagctaatgaattttataataaaatcttactatgttccaacgatcctttttgtattcccttcattatcattcacgctaaatatttttgcaagcccaaaatctgcaattttagggttcatttcacggtccaagagaatattgcctgctttgagatctctgtgtatgacacgcaaccgagaatgcttatgcaaatacagaagtccttgtgctatcccatctattatcgctaggcgtttatgccaatctatcaaagctcttcttgtttcatctgcaaatcaattcaacatagatataacaaagaatatacatttcgcagttagagttagtgaaccaaatcttttatttgcggtacggtacagcaagaagtaataccaaaaatgaagaaatccaagcttttatttggcaaatattcatatattagtattttctcctgtccctggtaacagcatcccaagagcctaacaagatttgtgtgctggagcttagctatgagttggatttcatttttgaactctgtcaagccttgccctgaatgagaagcaagtctcttaactgctatctccaccccatcaggaaatcggccctagagacaagtgcaaaagagatggatgagtgacacgagttaatttgcagtttcaattgacttttgacacttgacaaatattatgatcaagatataatcggccaaagcagagagtgaattgcataatactccatgtaaattaacgaataatatatgtgtataacttttgtcagatttttcgtcttatgtaccttgtatacaggaccaaagcctccttgcccaagtttattttcttctgagaaattatctgtggcctctaatacttgcgaaaagtcataaatagtgaattctgaacttcttccttgtagcccccaaattagtgcttcatcttcatccgcgttcgtcttacctgataaatgtagaattggtttgataatatcagttgatttagctctttatgcattcatgcatgtatgtaactttttttatgtagatatatatctgaccttttatgtgccttctcaatatgatggaagcgatgatacagagaaacaatgcaagtagtggagctaccaaagcagggaccaaaacttttgctacgggctctatagattcagagcaaatggttagtttgttttgttggaagcttggtaaggagataatgaaagtaatttttatctttaattactactactctcaaatatagcaaaattagaactgaatgtgacacaacctagtactacaacgattatgaatctggataaagggattgtccagattcaatgtaagtaataggatatatgtgtgtgtctcctatctaatactaaattgttatattttgtgatggaggtgcttaagtaaagatagtctctacgcaaagatgtcaaagaagggcgtgttttgcttactcttttgttttggccatgttggcagtaatggggcgggctgtggcgctggacttggaactagtgcattcgacgacgacccggagctccacgtcggctcaccggcgaagaacttatccgtgtcatacctcagattacaccggagagcaagaatacgtcccccttgccgaccggcgaagttggccgtcgccagatcgctgaaattctgaagacagttgtagcagatatcttcaaccaaatctggagcacactgtgccaagcagaagagcctccttggaagggtaacggtgttgcttgcatcggcatcatccatgtccacgcggattgcagcgtagtgcttcgtcgtggagagagcttgtgctactatgtaattcatcgtcttgatgaagaattgggtgaagttttttgtcccctggatgttggtgttccagccggataacatgggctccgacgtgatgttcatcaggacgagcggcgcgacgccaactgcggccgaggtgttgacacggccgaaggcgtccatgttgaggatgtcctcgtcggagaagcggagggcgcactcgtcgtagaagacggcggcgtccttgctgagcgggcagagccgcgccgtcgcggccgcgtacgcggcgtcgacgcagccgctgcaggcagaggcgttcgcgtcgccgcggcagagcgcgacggcgtagacggggtccggggcggcgccgcgggagcccttggcgaatagggcccccgctgctgaagtcgccgcttacgacaaggaatgatgaggagagaaggctgtcgaggttggattggtagatgctgttcgccgtgtatttgctgctgccgcagatcatccagggctgggcggcgaccataggcatcggcaagaagaagaagcagcagccaaggatgagcaggacggtgagaatcatggctagctatgctgcctcacgcgtaagcgtaaggtttctctgaatctcttgcattccaaagacagggtcgcatgttaagcagatcgaggcagcgacgacctgtgtggacaagtcactgctatcactttcatggagcgggtgcaatgtatagtacaaggccagactgaacgtaaatgcatgggcccacacgttgaaattaatttagaaggtggttgacatgttaaatcatgctttctaatgtcccattctgaacatgatatattttaataccataaatctaaatataattatttgaattcgtaatattagaatgtttcgtattcaatactatatatactacttttacgagatgacgaaggaagcaagtatataactccgtctccaccatcatggctgtgaccatagatagtttcaccataaccgtggaaccccgtgtgttttggtttcattttgcttttcttactccgaaagcctatacaatatgtgtccttttctggataaggtgttggattttttttccgctgttgttagtactcttttcaaaatattaaaacggtgtgtttcgtgtaaaaaaactttaaatatataagttgctttaaattatcaagtaaatccaaaattttaaatttagagcaattaaaacttgattagttatgtgctaataacgagctcgttttgtgtgcactaatttttaaccttcatctacagcccacaaggcactgaacatctctacagccttcatctacaaccttcaaacagggccaaggtatgaaaactatgctcccaaatctctacagcccacaaggtactgaacatcgaagtcaaattaaccgcccacaaaacatacaagtcatttattcgtgtgctgcacaaagtaatacactcagtgtttagggtggaaaataacgtctaagatctcgtttgtttagagatacatatatgtgcgggcgtgccagtgtacctaaatacacaatgtaaacaaaacatagagaacatgctctttattaatcttaaaagatcataaatacaaattcccaatgtaatatatatgtatgcgcgctccataatctgtcattggacagatctgacttgtgcgatgtggtctcctggttcctggggcctcgaaaagctcccagttaattacctccgcaagtctaggcctgcaagagaacctccgattaagctgcttgtggtcgtctcgtcgtcttcgcttcgcgttctccatgcatggttgggatgatgatgtagatgtgtgtgtgcgagcgccggcagcgatccacagcctcgtcggtccgtgcgccggtgttggtagcgtggccttcgtatcgacttcgcccgccctccgtcgtctagcctcgtcggtcttgaacaacatgcatggagttgcgtagctcgaacgacttgacgtcacagcagttgcgtcgagattagattaggaaagggagaaattattaaagatggttgatgtagacggtaaccggatttaatcaaagctcggcatctcatttgggacgaataagaaaaaccaataggacttcttcagcccacgcattggtttgtgcatggcactgtagcagtgatgacatgtcgtcctccgattggttggccacgttgccacaataattaacttaatcaacatgcattagctagcttgttgccatccaacagcactggctcgccgtcctcccgtcgtccttccttcgtactgcagccatacttgtctccatcgtcatccgctggtttcgacgccatgcgtgatacttgacctccggcatgggaatggatagaaatcttggcagtcggtggcagctccggcgatcctcggcgcgctccggcagggcggcttcccgatgacctcctccatggttagcccgctccagtgcggtgaagcttgcaaatcaaggacgtccggcatctcggcgaggtcgcagcttcgggtagatgcatcaccagcagcttgaattagcagcgtcgagtccagggacaagtagcacagcgtcagctcgaacagacgccggcatcgatgaggcttctgtgacgcgtagatgaatcggccaccgcgacttccccggcgacgacgatacgtgcagatggatccctatgcatggatgtgtgcgtgctgtagatgaaagaaaacgaaacaatcttgctagcttttaccttgactagccatcaagctcctctcctgcgcttgctaatgatcggatcaccgcgcgcgccctctcctgccagacgtcgggactccggccgaagtcgctcgccgccgccggtgcgtgtcttcgatggatggatcgccgatgagagttgatggatggatgtgttgatgctggatgggcagatgcgttgatgatgggtggcttgtggatactggatgcgttggtggatcaatttgtggataagttcgtcaatgccccaggctgccgaggggtcgacgccttatataggggcctaaggtcggtgctcgccgcgtccgcgcgccgtttcgtccgcgtcaagttcgttgcagataaggctcgatcgatcagtttgttatttgttcatatccttcttttattttatctcttagcctctcccggtgtcaaatatctgagctctgttaacttctggagcatcggggagatggaggcccagccgcccgcgcgtgcgcagctgggtggcgattccttcatcattatttctgtagataagaaacaatcaatagagataaacttgatttgtaatttgctttgtttctctgctgctgggccacagtccggtgataagcgcctcgccagcgctcgcgcgaagtaactaactcgatcaagtttgttacaaagatagaatcaattggtttgttggttatctcttaattcatctggttttatctcttccgcacgcgtgagcagaagttgttcagataaattgaaaccccagcttatctctctaatttgatcgataagtaaactcatctagccgataaatcaaaactgtggatatgtataatacgccgtgattgtgtcattcattgatatgggctaagcccaggggcaggcgcattaaatttcttaattaagcccattaatcacctcacccttaatcaagcaccatatatttgtgtactgccatgcatgcatgcatgcatgcatgtacgtagttgcttcaccggccgactgacatagctagcttgctcttgattcagtatacacacgcatatatatactaattaacaagtatagattgggcacagtgtgtatttctatatttgcatggcgcatgcacacatgaaatggagagctagctggcctcacatatacctaatgatcatggctatcaggttcatcgttctagccgctgcaaaaatgccatcaaacactcagtccggtctaagaggattaacaaagacaattaattagagtattggaactactgtttgatacacgtgccttctaagcacaaacttttatatataaaagatgaatgattttagaacaaaattttccagataaaagttttgtaatgaaaatttcagaaaaaaaatgcactggggacacactaaatatagcgatctctagaggctactactgacgtgcagtgtcactagtattttttgttcttcctaaacccaaacataatatgtgggttcctggtgatgacatcactgcaatgcagactctgttcacgcccatcaacagtactatgggccttaatgggccagctgttgggcctagcctccctaagcccataatagcttttggtcacctattgttcgaatagttctcgagatattgttgtattttttgtttcctgtgttctttcatctcatacataacaatatagcagatattttgtaaactatatatgcgtacttcctagttaaatgaatgagcagtgtcctgcttaatgtctaaagtctaaactcgaatacatggtgccacacggccgaaagtgatcccacgacctactcttcatcgttttctaaaaaatgattcaatatttcaaactgatcctcaaaagacaaatgaaagtatgataaattggtcttataaaacacgttaactacaaaatgacgtacccatatgcatgcatataaatttattagttcaaatggacctaatttaaatacaagaataaacacatattagtttaaatgaagcatctctcctttaaccgtggcaaccatactgtgctagcatcattgtagttgttgcgtctgtagatcatctatgcacctttgcgtatcatgtcgacgctgatcgacttgagcctctcaatcccatacctatgagccgcgacgagcagattctgagccatgaacgccgtgtctcccttgtcgatcttaggcagggtatcggtgtagatgaactgaagcatggcccgaaacaccctcaaatccatatcatcaatccgaataacgccattgccagttgccgcagcagcagccttcgcctccttctgatctttcccgccattattgccgaagagctccgccatgaacaccggcgaccgtgccgcgagcacgttcttgtgcgccgcgaacagcttgccgccgaccctgatgcgcacgtcggcccccaccccgctgccgaggagggcggcgaggtgccggtgcaggtccggcggtggcaccgccaccgccgtggtggccgcctcacagcggataatatccatggtgatattacatctgatatagaaactttgaccgtctagatgtagacacgaccacaatcgactgtccatcttcttcctcttgatgaatcttgtatgcccccaacttggccagtagccattggcgaaggagaatttcttggccgtgcagatcttctcttcgaccaccgcaccgtacgtcccgctgagtagactgagcgtgaatttcgcttcgacgacgtcgtcggccgcggcgccggcagctggccgggcgaggcagaggtagacggagacccagtcggagtactcctcgcggtcgccgtcggggtagtaggctatgtaccaggtgtggcctccggcgtggaacttgctggagttgatgctgttgccgacgccgatccccttggtttgagagtagccggcgatcctcatggtcatcgacccggttgctgtctcgctcacgacggccgccgccgctgccgccgccgaggtggttttgggtttgggcttaccgtcgccggcagacttggaagtggtttgacccatgggtacaacaagctgtacctgccacggaacctagacaaacagatcggaggaggacgacgacgatgagttatcgatatgatgcgtctcatccacggatagattaattttgtagattgatgggaattagaacgagttcgatacggaaggaatcactgaaatatagaacgtctcgatcggaaacgtatgcaggtaggaaactttggattttttttttcaatatagatccgcctctgtttcatctctcactggattttatgcacattcgctcttggtccgtttcaatatcgaagcgaatccgtattcaattccgcaaaacttgagataaaaacggacggggtagctcatcgccgggccatcattggcgacagttaaacagaaattaatttggtgaatttaagccaaattaaaaagaaaaatcatggggaaatgataagtgaggggtgaggaatcgatttttacaattgaaagaggaaacatatgaggagacagattgatgtggcggcggctctagaattatgtcaagagagaagaacaagcggcgaatcgagacgcgcgcggtgaaaaaggctaggatgagcgatggctgggccgagcccaaacacagccaggccgagggatggaggggggagcaagccaaggcggggaggaaaaggagatgactttcggccggaggaggaaagtccaagagaaagagagatgaaggcccaagagggagagaaaaagggagtgtgagaaaaaggccgaatgggctggctcagagacgatgacggacgaaaaaataagttgtggaagccttacgtattttttaactagacatataggtatagatgtatagaaaaatgacgtgtgttgcaacagataaagatgtttttcagtgatataatagctactatgagctaagtaataaattgaaacattgggatatcattatcattatacattataattgaaaaagtttatgaaaatgcttccttggattcgggccaaaagcccattaattgctttcttttcagccctagctcagaccgtaggttttgaccataattagatcaacgcatctcatccacaaatcgattaatttgtagatgtgaattagatcgagttcgagacgaaaggaatcattgaaaaacagaaagactcggaaatttttttttaataatggattaaatcggtctctacacccaaagaatatacacagcataagactcggaaacttatgcaggtaggagtcttacttttattgaatgcttaggatttttccaaatagtcacaccaggatttcgtccgtagctaaccttcgtgcttcttgcgtttcaatgtaaatttctttccttttgactagtgctatattgccatgcccgtgtgtttcaacgggatctgaagattcaatgacgaaatacaaaatttctttccttttgactagagtgccatactgccatgcgttaaaactgaatttgaagatttaacttcaggagttgagtctagagtagagttgtggagctgtctaaagccagcgtcacaactctagtttattttgtgagagagctccacccaactacacttccagtttgggtgaaactgaaactgtttggctgagctccagctccaggagaggtggagctggagctagagttgtaccaaacaggcccttaatgacaaaatatggacaaacggttttatgacagtttttcctacgtggtttttcagctggtgggtcgtgaatgaaaacattagtaattttttaaggggtaatttggaaccatgccattataattttgcaaagtttgagatatgccatcggtatctcaatgacatgtaggacccacatgagtcaatgacatgtgggttaggatggcatggttccaattttgcaaaattataatggcatggttccaattttctctttttttaagtgggtcttgcaaacacgtactatttcttgcatgaggtgttttttttttggtagtgattatttcacttttcacttttcttttcgtgaaaacacttgcttttttcatgggccgtgaaagcactagttttcatttggcttgtgaaaacatgtacatatgcttggatagacagtttttagacggttttttcttagaaaggtacgatgctcatggaggaggacaactctattttcagagtagaccagtagagagagatgagtcctatcaaactctgcagatctgttttgatgagtcagatcaaagtctatgattcacatgttcgcttccggctccctaacaaccgccaacctgtaccccaacgtcgaggccggccgccggcgacagcaacttactcccttcgtcctataaaaaagaatctaggaccggatatgatatttcatattcctataaatctggatgatgtgtatccggtactaggttggtttttttatgggatggaggaagtagctctcattgaccacgccggagcaagaggcagtggtggggatttgggtgcacgctaaatactactccgtagaagagaaggagcagagaagacagctgaaataatggtgaaagcagaggaaatctttcccgggctccgggtctgattggcattgatagatgacaagggtctatagaaggagaaacaagagagcgggagtgtaaaatgataaaggatcggaagcattctcccctctactttcttttactctagtattttttttatatcagaatttaaactatcatagatctgatttaaaattcatctatagtgttatattcattttgattaaattaataattcaacacccatattgatccctacatttttagtaggcaaaactttactttatatcgtcttctatccttttcatgcatcttgtaccatataagccaataacaatttggtcagaatctctaaacattgtgtacgttattaaccattagagatacctatgatatcaattactaacagtaaattcctaccagaaaagatattggcccccgtgtctttctgcttggggcaacaatggtggtgattcaggctgccacaacaccacccgcctccttgcctcctcctccctctctaccgcctgagcgggccattggaaatcgtgtggttgcaaggatggtagcggcagggtcttctccctctcttgttgggcaaccgacaagcagcgagctgcgggagccgacccggttgcgttggcttccccagtggtggcgaaggcagaggcagctgcgcaggagcccaggatggtggcggtgacagaggcgatgaggtgtggtggtggtgggacgccggttgcgctggcttccccagtggtggcgaaggcagaggcggctgcgcgggagcccaggatggtggcggtgacagaggcgatgaggtgtagtggtggtgggacgccaggcatagtggaaaaaaccggaccggtggtgggacccctgtcgccaggtcgcagccggatctaggcctccgcacctagccatgagatggtgtctgcaagaggccagacggtttggtgaccgcgagggcgtccacgacggtggtggaggcggctgcatcaaagtgtgacggtggtggaacaacatcggttgtgttacggacggatatgggcttccatgcatagatttgtccatgcatcggcggttgtttcgatgggagagcgagcatcgacgggacgcgatagttggggcgtgaccatctaggggccctgcaccttgatccccgttggggactacacaggccccatcctcggcaaggtaaatggtgcgatgtgagggagacgaggccaacgcacggtggacgcatgctgacaacaaccgtggccaagggcgagttcgcgtgcatggaatttggggatgtctgagagcagttgctggcgactactctccactctactcatgctcatccatcgatgatgggatgtggagggcagcttggcaatgggatggggcagtgtaatgatggccagctgcagcggtgtggacagtttttcccctacttgtgccttctggtgatgggatgggagcgggcatggcaactgttttgtcaaaggggcacatcaagaacataacaccgcccgttttcttgtcctatccatgtcaattgaccaccacctccttgacctcctctcccaccccacaacgccacctcggacccgccaacatgtgccacattgtctctgcagctcttagctagtacttcttgtttcataataatagtttacaaacataggaaaataatacttttatcaaactgtatttcaagatcattttcaaacatagaaaaataatactcatatcattttcaaatatcgatacccaatacataaacataacatgtaaccaaagtttgaaatgaattatcgacttaaggcaactccataaattccatttatttgtgacttggtagtacaaggattcttcattattgacatacatacccatgaaatataccatttacagtatggggagatctatagacgactcgatatgtgactttggctccatataataacatctagaaagtcttttattcagttttctcttatagaccaacaaagaatacatatgggagcaaacaactcgacatctcaacacacaccttggactccaacttcagaaagcttaaatcaagcaaaagcagctattgtatatattcttgaaaatatggacctgtgtaattaatccgccgctatataagaacgtcatatgagacattcgacactagatcagttttaagcatgttcagggccagacttgatagtaggattctatttggagccatcatgtttttcttcacctcctttcttccagaagaaaagaataacaacaaagcccaacacaggtaagagaagcaggatggcatccttgaatgtgcaccaattccgagtactgcctgccgcgtaggctcccaggagggcaagcatgtccagcaacatggctgtgtgcattggccaaagaggcaatttatgttcatcgcccttggtcatccttcgaagcagcaaaacaatgacagtgatggatgccatgaaggaagtggagttgctatagaaaaaagcattgtaccgacgcttgtcgatgtcgtagaggaccgggttgccagcagagtgcccattaccttcatccctccacaggccaccaggtggttttaggcccgtgaggtaggccacactcgcagccaatattcctgctagcattaagtacttggccatcatgtcggctttctttttcatgtcagcttcctgttgatcttgtgtttgtcttggtgtgtccatcatgccatcttccttgttggtttgttgattttgtgtttgttttgactgatgttgatttatgtttgcacgttgtccacgaccgatgattgccacatagactacagctgcaaaaactaccgtaaccaatattaagacaacgatggaggttcgcagatgcatcgaacttccagcagcataggcatcgatgaggccgaacatgcccgctaccatgcagacaaagagcgcatagcactttatgcccggcccgtacagatttcggttgagaaggagaatgatgagagccacggatgccatgaagcttgctgcattgcaataaaaaaatgccttgtaacggatagggaacttgtctagtaggacagggaagcctgcacggtgcccaaactcatcattttcccagaagccacccggtggggtcaagccggcttggtaagtgagtgttgcagccaagatttcaacaagcagcaacaactcacgcttcttctccaactgatgctcctttatcttgtcttcctcaccctgcttgtccgacttcttttctagtgtggagaagagaatgtgaatcaccacatagataaggacaccaccagccaaggcaactgtgtaaatggaagtgcttgtgtccctgcaacttccgacagcgtacgcgcctatgaggcaaaacaaatcaagtatcatggctgcctccagtacatggcttctaactagaaattcattctgcaacatcaccatgatgactagggatgccacaaaagccaccgagttaaaatagaagaagaccttgtaccgcctagggtgtgttgtcaggagtattgggtctccactgtggctagccccattgtctgcccagacgcctccaggtggatctattcctgcttggtaagcaacgatcgccgcaagaatggcaaggagctgaattaattcacaaggcttgtctagatcattgttgtattgtttacttcccctgtacaattaaatagatagttcaattgcagtctagaataattcttttggtactcgaaattgatgatgtggaattaagaatttctagcactcaaaaaatgtgtacaaaaatgcaagaaattctcaccgaatcaatcccccccccggtcccccatgtcatcatgattgaaatgatagttaacaatgtgaaacaaattaatttttgttcggttagcccaatatgtggccttaaatggctccaatcagtaatcactacatctccctaggtcttgattgaggggcacgaaggtcttttccttcctcttaattgatatgtactcaaactattagaaatgctacagcccccctagtactggtcctttctatgcccatgccagcggcatggatgatcgtagagctatcttcatggaagtagaaagcatgaatagaaatattttttttcaatgatgataagcagcgatggagcaagctagaatttcctcatgcccgggtcgaggctaaaaacaagggaataaaattggcaggcgactgatagcattttaatgatgtggagcacaagtagttgggcattatgaacacatcaaggtgtgaagagcttgagctgatgagcagtccggattggaagcaaggtcattgggtgcagtggcatggactagcaggaaaaaaattataagattatagccctaagagactatgatcaggaaaaagaaaaaaaagcactccgctgcaagttggcgactccaacccatagactcgaggacaagactaacgctatgcgtgctcggttgctatcagcctttcgaagggagaacaaacatgtcgcctagatcaatggttctcgatgagcatgtgctttgtggatctatgatcatgttcaagcaaaactggtacaataaagtatagatgttaatagtgaaatagttctagtgataggctcattttgtaaggctcatgtctacatacttttgggagcaagacaccattgagtccatggaccttttttttcttttaccgtaccagtttctttacctatcaatggttctcagtgagcatgtgctcgtttattatagttttacagttttcaaatatttctaagtaaaatcatttcctacaatacacaatataaatctatgatcgttttccatatatctttacataaggaaaaagttcaaatacccccctaaactttggatggaaatccgtcaagcaccttgaactttaaaatcaaacacccattctcctaaactttgtaataccatgtatattactctctaaggtggttttggatggtgtttttgcatatttgaaggcttaaacgagtggttttgaataactaatatacatatttaaatatgattagttagtaggacatcaatttatattatatagtggtgccatattattattatgttgatactcattttgtaagtgagattgaataaagggtacaaattaaagaagggatatttaagtgaagatcttagcatgtatatctaatgtatatgtcacgtgatcaaactcattcaacttatatacaaattagattaaaaacatcttatcgggttatataaatagtactataaagttcagagagttgtatgtccgttttcgaagtttagggtgctagatagacttttactactagagaactcatcttttatccaatgccccaaacatacaaatacctcggatggattaagaagcgttactaaatctctttagtaccggttctaaaagcccaagtccctagaaacatttttagtaccggttggtgttatcaaccggtattaaaaatacatctgtagtaccggtgttagcaccaatcgagattaatgctgatggatctttagtcccgttgatattatcaaccggtactaaagatgtatttttagtactagtaggtaacaccaacccatattcaagatatttttactaaagatgcctcctgagttagttcaaaaggaaatcatctctattcaagtcaaatgtgtaaggtaggtgggatcgtaacacgcgtgagggctgaagtgagatatcttgagtttgattcccacatcccacatattttttttttgacttggtttgcatcgttagtaccggttctttagtcttgatttttttttgtcacggttgctaactggaattaatgggtatacatctttagtaccggttcagatcgagatctttagtctcgattttttgtcacggttgctataatcgggattaatggcggttttcaactgatattaaaggtgatttctctcctggtgtttcaatcaaagtttagggtgatatttggactctctcctgcatataaatgtactacatgaagcaaggaaaaatgtagggtatgtatgtttttgacctaatgtggttttatatatcctacactttgaccattgtattttatattatattgctcatgatcttgaaattgacatcattggaaaatgtttcgaaatatgaatctaatcataccataatgatttttattaaggacaaagaagttttgctttcagacttttgttaaattatttgaatgcaattcaggtttggagcgcgcggttgtgacttttttttaaaaaagtaacaagaaaagataaaaaaaattaaaaaaaggctaggcatggcattagaaatgcatgatgaagatgaatactgcgtacctggtaccaaaagggagactgatggcattagatcctacaagaaaccactggagaaagatgcagacaagaaccgggacaatcaggccaagaacatagccggtgtgcctgctgtccctgcagctcccggcggcgtaggcgccgccgagtcccaagatcgccgtgacggtgagcccgtacagcgggaacttgatgcgcttgaggtcaagcttctcgtagtacacgttgaacgtgatggcgagcagggacgcgatgaaggagatggcgttggagaagaagaagaacttgtaccggattggatggaggcccggcagcaccgggtcgccggcggcctcggtgctccgccagaagccgccgggtgggttgagcccagctacataggcgtcggtcgccacgaagatggcgatcaacatcaggatcccgacggcggcggcggtgtcgttttcgccgtgagggttgggacgatgaagacgatgacataggcggcggtggcggagacgagcgcggcggcgccgatggtggtgaacttgtcatggctggtcccggcggcgtaggcgcccatgagggcgagcaggtcgaccaccatcaccgcccgggtgagcgtgagcagcttggtcccctggtgctggtggtggccggcccttgtgcaggaggaggaagaggaggctgaccaccaccagcgacgccgcgaaggagatggcgttgaaccagtagaagacgatgtagcgccagtagttggtgtcctgtaggatggcgtcgccggccagctgccaccggccgccgccgccgccgtcctccagccacgagccacccggcgggttcagccccgccgcgtaggtcaccgtcgccaccagggtggccagcagcaccaggtacttcttcagctggcactccattggcgacgacgacgacggctgcttgtcgtcgctgctgccgctggaagaagtgaggttttgctggctacttccaccggccaccgccggagccgccattgatctgctactgttgatcgggtgatcgatcgaggtgaatctttgagcaataatacacacgatggcatggctctatgcatgcatttatatagagggctgatcgatcgatcgagcgtgtgtcacaatcatggcatatatgtattacttgatcgtctagtcatattttaggctttattcccttgtcatttttatgccctttgcatttcattcggtagtgtcatgcaagtgacattcattcgtgcacagtgacccttgcacgcacgccaggtttctattccttatgtgtgtcgcgcacatgctttgttttgagctgctgattaaggccgtgatctctcggcacacaaaacgaagcacgtattattgcatgattaattaagtattaactattttttaaaaaaatgattaatatttttttaaaacaactttcgtatagaattttttttaaaaaatatacaccgtttaccagtttgaaaagcgtgtgtgtggaaaacgaaagaggtgagttgggaaaactaggggaagaacacggtctaattatggacgtttttacacgaattatgcaccagttcattgcacaaatcgtgtgtttttccctttcttatgagtacaacgtaaataaagagcgtgtaattttgtatacactagttatagggctagcctaatgggcgggtgatcgccttgggcgatcagcacccccatccctcccctaacacgcacacgtctccccttttatcctcttcctaccacactatgaaatttcaaaccatttaaaaaatataaaagaaatctaatacacttgaaaacatattcatgtgaataaactttacacttataaattataaatatatagactttatgtatagaaatattctatataaaaatatatttgaatccaaattcaaattcgaatttgaagcgagtatataaacttttaccctataaactttgggtatatatgtgtaaactgggctgatagccgcgcgtgatcgatcacgcgttagctttctagctagttatgtcccctgcgttgcaacggttttttatccagtttagtagaaaaaattggaccgagtagaccatcggtttttataaagtgaccgggctttttttaattagaaattggttttttaggatggatgtttttttatgagaggtaagatatgtttaagtagaaatggaggatggattgatagaagaagacaactccctctttaagtagttgtgagatataggtttttattcggttaagagggcaactccctctttaagtagttggagtattttttttttataaaactagagtacttgaaattaaactatcaatgtagatatgttatgacgttttagtcaaattatataaatttatctaaagtaacaactttcataatttattgttatgtaataatgatacaatttaaaatgaactttcagtttcattggtatgtaattcatcaagggaacatttttttatggaacactaatactgtatgatttaaacataacacaatgtatgccaaactaagggccttcaaagttcaaaccaacctttccaccggaaatgcatttaatgtagtggacgaattccggcccatacgtatagatgggctgaggggtagtaggaccacgtgaagaaggaaaaagtccacttagactcccttaattgttcacc

SEQ ID NO: 48601 - DNA, 13822 bp, Oryza sativa
ggggggagggggggagccgacggcctcccgtggggcaggagtttttgcgtatttggttgttctcatgttggtgtgctggtgctccttggtgtcaaattctactgcctccttgggttgccttggcgtcatgcagtagattcgtttgccgaagatatggtcggtaggtatgagatggagttgtgggattggtgcatacaaggagggtttttggatatgcttgctttgggggataatgtggtttgagtggggccggcagtattgatccgttacgccacgccaaggacttatgtttctggctgttcattagcttgtttggtcaaattgggtgttgagagtgatgagcattatgtagtttattatggaaaagagggtttggctgatcgacgaaagcaggaaagtaatgagtctttttgttggcccttttttttaattactctgaatgttttcctgtcaaataaccatctgcactcagaatcagaaaattttaacatataaatagttaccgtcacacttcgctttctctgaaactaattgaataggcacgtgcaacttttggtatgttctataaatgtacatctatatttcctaattatacaaccatttaatgtaaccatcaaagttgcttgataaatgaaaggtatttcttcgtttgattgctcatattgtgcatttattgggagcatgtcgcaattcttccatgtttacctattttttccttccgccaagaactatatatatttattgtgtctctgtgtaatgtgaatgtccagggcgatacgcattcacgtgaagacggattatcaaaaccaagagataaagatagagaaagagaaaaagacaaggacagggaacgccacagggaccgtgacagagatcgaggaagagaccgagatcgggacaaggacaaggaaaaagacagagacaaagaaagggacagggatagggacagggacaaggatcgggatcgccaccataggcatcaccgtgaaagaagagaacacagagatcgctctgatgatcatgatcgccacagaagccgtgattctgaaaggtattctttgttaagggagttctgttttatatgcaccttatttcttacaaaccatgcatccttgcaatgaatgcattttatcaaatgtgttaaatgcttttagatttagagctattcaactgtcttatacatgcctacatgattagtcaaatgcccacaccaatcttgtggtttatatttaatacaggagaagagaccatgaacgggatgggcgtcgcaggcatcggtctcgctcacgctctcgttctaggggcagggatcgcagatctaggtctcgctctcgttcaaaaaggtatgtaaaggaagctccttgcatagtcttccatttgcatcttctttagctgccgtgcacatactatgttttccgtcatggttagttaaattgtttattccatatagtagcaattttggacatactttatatatgctttctctgcatggattattttcctgatattttctttgtgtattatcaaattcagacatgtacaattcgtatttgaatatgtatggcagtatggtttactggcttagtcttcttaatctggttctcattgatgaccggtttataacttgttaaatatgctaattttatgtgttattcagctttactttttaagttttattttatcactaaccactaatatctactaaactatttttctaaagcagcaagcgagttagtggatttgatatggcgcctccagctcaagctgtggttccacaatttcctgctattccaaccccaagtatgctctcatcaactaagttaaacggctcaatttcatttttcttttcctcgtcaatttgtggcactttttctgaataataattttagtgggacatttgaacaatggagttaagaaaaataattttgctgggctggatgattgatgtacatgagtattttttttagaatgaattatatcttcggccgctataattcttcatccttatcactgtataatgccacactatcttattgccgttgccataaactaccggtgaattactagtccattaaggtcgattattgccgtagcaggatgatgcttggtgttatacctagtaaattggtggatatgtctggatgttatacctagtagaactccaatacagttaatatttgcttagtatgatcggccttgagcattctacacataatagtaagaggacaggagaacaagcaaattgttattttatagtagtctacatgatgcatttggagagacattggtgctttaattaaaggataaaaaagaataccaaccagtgggctccgtaagcacccctcaggcacctatctgctgcagatgcacttcatgtgatagttactaatatgaataagtgaataacttgtaagtttccattttattattacttggtaactggaaactgagcaaaacttttttgcttgtgttcttttgttgtttgtctgttttgtgtatgtgtatggtaagaaggcaatcttgggttacttgcccccactgctgccaatggaatgagctgcctactgtagctttaatgtacaaggaggaatcagtgctctggtttgataccatcttattcgtcttcaactagcaagtattactggttgctagcattatgtctattatatttgtccttgcacatattttgttcattcttaggcttggatactgaacagctagatctattttagacccagactgatggtgagaactagtcagttctaatggtggaatttttttccttgctaattgtttatgctctgtactagaaatttattgataaattgcaggtcagtttccgggcactgctattcctggaatgtttccaaacatgctcccgatgggtgttggacaggtaacctgtcagtattttaatgtattataagtgccaaaagaatcatttttttatttatgtttgtaaataatttttatttgcctgtaataataaattttgtttgaagcagttcaatccccttgttatccagccgcaagcaatgacgcaacaggtatgagttgttgtgacatctactgcatctattattgataaggatgtcaacaaaataatgtgttaacacctttttctctcaggctactcgacacgcgagacgtgtttatgttggtggacttcctccaactgctaatgaacaggtctgtgtatttaatcactcattctttcttactgcccatttcccatacccaaaccaaaagccgtatgggagtgcacgagtgtgtacccgcatgcaacatattactgtggaattgttacattagtttcctttactgcagtcagttgcaatatactttaatcaagtcatggctgctattggaggaaatactgctggtccaggtgacgctgttcttaatgtctacataaaccatgacaagaaatttgcttttgtggaaatgaggtctgtggaggaagcaagcaatgcaatggcactggatggcattttgtttgaaggggctccagtgaaggttaggagaccaacagactataacccttctctggcagctgccttgggccccagccagccaagccccaatctgaatcttgctgcagttggcttaacacctggttcagctggagggctagaaggcccagatcgtattttcgtgggtggccttccatattacttcactgaggctcaagtccgggagttgcttgaatcctttgggcctcttcgaggatttgaccttgtgaaggatagggaaactggtaactcaaagggctatgcattctgtgtctaccaagatctcaatgtcactgacatagcctgtgctgctctgaatggcatcaagatgggagacaaaaccctaactgttagaagggcaaaccagggagcggctcagcctagaccagaacaggaaagtatcctgttgcaggcacagcaacaagtgcaattacaggtataggtctcaactatttttcatccagtatcagataattttactttcttatgccaactattttgtagctgtattgtgattcttgcattttgactctgtgcttcttaacagaaacttgtatatcaagttggagcactccctacaaaggttgtgtgcctgacccaggtggtttcggctgatgaattaaaagatgacgaggagtatgaagacattatggaggacatgagattggaagcaggcaaatatggtaatttccaacttctcacccgcaatttcctcccttgcctctaaactccggtttagtttgatcatctgctgggctaaaaccccatatgtatcttcttgcgttgagagtttatgcatgttttcggattccttttgcctcgattgatactttttgtttatttagttggtcttcctaggtgttttctcccttttgtttactcacaagtatcttccttaggtaatctgattaaggttgtcatccctcgccctgatcctagtggattaccagttgctggagttggaaaggtaagtcttgtgtattgcatcgcacaaacattgaagagcgtctgtaatctttctaatgtacgacctttccatccaggttttcttggagtatgcagatgtggacggcgccaccaaagcaaagacggcaatgcatggaaggaagttcggtggaaatccagttgttgcagtgttctaccctgagaacaagttttctagtgcggaatatgacgcgtagattatcccgctatgtaaaacactagtcttttgtttttcttttgcgccagtttgctaaattgtaacaacaatttctctttaagttgaaccttccaatagcttggatttatgcagagcgaccgattaattaatattaaaagatgtgatggatttcctaaagttaactgaagggcttggagtatgatctgattcttgtccgtttatcctgatagacctggattatttgttaactctgttaggcggtagctcttgtcaccggagacgaaggagaatggtgggggcgaggacacctcatcagtctgtccctctggcgtagacgcgagcgaagaacgcaagtggaaggaaattaaaggatgcgggcgaagaacgataggaagaggattatggaggtttggatgtgatctgagcagttggattgtgatctaatggtctaaaatttgcaagatttggacgcaggttttctggcaaattacatgtaggtaggcccctatgatctagtaattcttattcaaacgcgtgatagttcatgatagtagtagtaaattaacaggagaaatgagggcaatggcatggatgattcatctgcacacccgtgcggtacatgctagacgtgcaaaactatttgcaccaatggttttaaaacaacaacaataataaatacaggtacagatggaacttgaaacagaatgatagcttacaattacatgcagtggatgctatgtttagctaatctggacgtcgccacaaatgctgtgccgtatgcagtatatcaagatgattaatcaacggattatttgctgatcgatatgcttaatccttcgccaatttggatgtccaggggtcagacaggtgtccgcaagagaagggtggcaaccagagattacaatgctcttgagcgattggggaagcttgggcagtgtcatcatgttgggacactcctggacgatcaattccctgagtgttttcaggcggcacaatttgacaggcaaatagttccagctgcagtctgtaactgacagtgtatgcaggcaggtgaagaattcaccaatctttgggggatcactcgatcccttgcaactccagaacataagattctgcaatgccgggcgatcttgttcctgttccttgtcgcaaccgtctcctgtcaaccagcttgggtatatcacaccaccgtaatccctgatgcaaagtactgtaatccccgacggtggacggagcccctcaagaacctcctcctgaagttctggaggttgatgttgcttgatctctgttacaggtggaaagaacagcttcttgtatgactccaacgctttcttcgagcagcgttcgtcagtgccaccccaccgtagcgtcagctcagtgagatataccttgtcagatagcctggctcgaacagcttcctccttgctctgaacattctcgatgcagtcgatgaacagcttgccacgaaggttgttcaggtgctccagctgctgtatctcgtatcctttctccttcctcacgtagaagtgatacagagctcggagagatgtcagcttcccaacatcaggaatgttcaggccataccatgtcagcatgtacctcaggttgatcaggttggcgatcttcagctgggatggacaatgcaagcgagtgttaggattgacagagagctcctgaagatggtaaagcttggaaaattcagccggcagaatcaggctgtggggaggaggtgacatgatgccaagataacgaagatgtttcagtccaccgatgcatggtggcaccctgctcaaatgtctcaaatccaagtgcaccaccctcaactttgttagcttcttcagcacacgctcaaaatcatcttggttcattccctctactgaatagcacatgataagagttctcaagtttttaagctccaaaatcttctctgggaacaatatttcactgtgactcgatgcaaagatgtcgaacgtgtttagtgttagcagtaatcttgtgtgccacggttagttagttgattagttatctgcatgtttacgtttttttctgaataaacgcatgagctcacgtgttgtgtgatagccatcgtgtggagtctgttatgagggtatccgagtttagctcgttgcccgcgtcttgtgctgggagctcggatcacgtcgtgtggttgtggggatggacgcagctagagcatggcgtgagaagtggtcttggtggttagttgtttccgttgtattcgttcctttatatatggaagtaaacagaaaagcagctgagttaagcgctgcacaaaatttgctctgtttcctctgttctgcgaatttgcaggtttagccacagtacgcgtgcgttgtgttcgtctggtttcctgctagcgatcgctggggaaattcctaacaattggtatcagagcacggtttaggaagtggactcgtgaccgcgcattggaaggcgtcttcttgccgcgtcgtcgctcgtcgtcaccgatcgtgcacactcctcatgactccggcggccgcgccacgggcagcggcgggggtgaccgcgggctggtgatccaccgcgtggtgaaagaaggaggcggctcggtgaactacccgctgctgaccaagaccaactacaacgactgggcgctactgatgaagatcaagctgcaggctcgctgcctgtgggcggcgatcgagcccgacggcgtggacgtccctctgcatgaggaccggatggctcttgacgctatctgcagtgccgtgccgccggagatgattggcaccctggcgaccaaagcgtcggcccgggaagcctgggaatgcatcaagacaatgcgagtcggcaacgaccggattcgcaaggcgagtgcacagaaagtgcgcgctgagtatgaatcgcttgcgttccgcggtgatgagaccgtggaagatttcgctctacggctcacaaccatcgtcaaccagcttgcaaccctcggtgatcctgaacctgctgataaagtcgtcgaaaagtaccttcgggtagctcgtcccaggttcaatcaactcatcttgtctattgaaactcttctcgatatctctactctgtccatggaggaagttactggcagactgaaagccgctgaggattctgggcaatcctcgtcgcacaccgccggtgggaagctgtacctaactgaggaggagtgggctgaacgtcagaagaagaaggatcaagaggcaaagcggggtgactcgggcggctctggcggccgcggcaagcgccgtggcgggagagggcgcactggtggcggcgggactgcgagccccgagagcacgaactctggttcggcgcgcaagggagacaaatgccgaaattgcggcaaacttgggcactgggcgaaggactgcaggagcaagtccaagcgcgaagaacaggctcacgtcgcccaggaggatgaagaagagcacaccttgatgttgctcaccggcggttgcgttgacacggtcgacgcggcggcgccggagggcgacacgcccacaccgccccaccaagccgtggtggaactcgtggagatgaaagtatttgcagcgctcgacgacgcggctgaccatgatcccgggcgctggattatggattccggcgcgtcaaaccatatgacgggcagcaggatggcgttcgccgacctcgacacgaacatcacttggaacgtgcgactcggcgatggatccgtggtccggatcgcaggacggggcacaattctctttgcctgcaagaatggtgagcaccgcactctgtcgaacacctattttcttccccgtcttgctgccaatattatcagcattgggcaattggatgagaccggcttcaaagtgctggcggaggatggcatcatgcgggtctgggatgagcagcggcgtctgcttgcccggatccctcgcaccccagggcgactgtacatgcttgacatcaacctggcgcgcccggtctgtttggcggcacacgccgacgaagacgcgtggcgctggcatgctcgcctcgggcacataaacttcagggcgctctgcaagatgggcaaggaggagctggtacgtggtctaccatgtttgtcgcaggttgatcaggtctgtgaggcctgtctcgccgggaaacaccggaggtcgccgttcccgcggcaggcactttgccggtctgacgagccgctggcactgctgcatggagatctctgtggaccgatcacgccggcgacacccagtggcaaccgctatttccttctactcgtcgacgactacagccggtacatgtgggtcgccctcctctccaccaaagatgcggcgccggctgccatcaagcgtattcaggcggcggcagaaaggaagagtggacgcaagctccgcgcgttgcggacggatcgcgggggagaattcacgtctacacagttcgccgagtactgcgccgagctgggaatgcggcgcgagctcacggcgccctactctccgcaacagaacggcgttgtcgagcggcgaaaccaatccgtggtgggcacggcgcggagtatgctcaaggcgaaggggctgccaggtatgttttggggagaggcgataaataccgccgtgtatctgctcaacaggtcgtcgtccaagggtatcggcggcaagaccccgtacgcgctgtggaacggcgttccgccggccgtgcaccatctgcgcacgtttgggtgtgtggcacacgtgaagacgaccaccccgaacctgaagaaactggatgacaggagtcgtccaatgatctttgtcggctacgagccggggtccaaggcgtatcgcggctatgatccggctactcggcgtgttcacatctcccgtgacatcgtcttcgatgaagcggcccagtgggactgggatgctgaggcggccgctgatctcgacaccgacttcgtcgttgagtacaccacggtgtaccatcctggctcgctgtcaggaacacgccaagacgctggggagccgcctgctcgatcttcatcatcgccgcgaacgccatcagactcaccgacagccggccgaacaccttcggtgcatggcgatgcgccggcggttgaatttgtgtcgccaccaactggagcagctgctaatcttgatgcagaccacgacgacgcaccactccgtttccgcacgatggacaatgtgctggggctggccatgctgccaggtctcgctaatcgtgaggtccaggagagctgatgatggtgagcggagaagaaccggcaacgttcgctcaagctgaacgcgacgaggattggcgtcgggcaatgctcgatgaaatctcttcgatagaggagaacaagacctggaggctcgtcgatctgccttcgggacatcggccaattgggctgaaatgggtgtataaactgaagaaagatgctcagggcgtcgtcgtcaaacacaaggcgagattggtggcaaagggctacgtgcagagggctggaattgactttgatgaggtattcgctcctgttgctcgtcttgattctgttcgtttgttgctcgctctcgctgcgcaggaaggttggatggtgcatcatatggacgttaaatcagcgttcctcaatggggaactgattgaggaggtgtatgttgttcagccaccggggtttgagatcgatggacaggagaacaaggtttacaggcttgataaggcgctgtatggacttcgccaagcacccagagcttggaacaccaagctagactgcacactgaagaaacttggcttcaagcagagcccgttggagcatgggctgtacgcgcgcggcgatggcagtgggcgactgctcgtcggtgtgtatgtggatgatctggtaattgtcgggggtgacagtggcatgatcaagggattcaaagagcagatgaaggctgaatttaagatgagtgatcttggtcctttgagtttttatcttgggatcgaggtacatcaagaagctggaatcatcactttaaagcaagcagcgtatgcgtcgcgtattgtggagaaggctgggctcaccggctgcaacccctgtgcaacaccgatggaaccacgtctaaagctgagcaaggaaagtgcaggatcgctagttgatgcgacagaatacagaagtctagtgggaagcttgcgctatctggtgaacacccgaccagaccttgcatattcggttggttatgtcagtcgtttcatggagaaacccacggacgaacacttggcggcagtgaagcgcatcataaggtatgttgctggtaccattcatcttgggtgccgctatgtgaaggaaggtgaaggaggactgcagggttacagtgacagtgatatggctggagacattgacactcgcaagagcaccacaggagtaattttctttctcggcaaaaatcctgttagctggcagtctcaaaaacagagagttgtagcactctcctcctgtgaatctgagtatattgcagctgcaacagctgcatgccagggcatttggcttgcccggctcctcggtgacctcaggaatgcagcaactgaagtcgtcgatctcagggtggacaaccaatccgctctggccctgatgaagaaccctgtttttcacgatcgaagtaagcacattcaaacaaaattacatttcattcgtgaagccgtggagaatggggaaatcacaccgagttacatcggcacagaagggcaacttgcagatatcctgacgaagccgctttctcgaatcaagtttcaggagctgtgggaacaaattggtatgtttcctgtataatcggcacatcaagcttagggagagttttgttagcagtaatcttgtgtgccacggttagttagttgattagttatctgcatgtttacgtttttttctgaataaacgcatgagctcacgtgttgtgtgatagccatcgtgtggagtctgttatgagggtatccgagtttagctcgttgcccgcgtcttgtgctgggagctcggatcacgtcgtgtggttgtggggatggacgcagctagagcatggcgtgagaagtggtcttggtggttagttgtttccgttgtattcgttcctttatatatggaagtaaacagaaaagcagctgagttaagcgctgcacaaaatttgctctgtttcctctgttctgcgaatttgcaggtttagccacagtacgcgtgtgttgtgttcgtctggtttcctgctagtgatcgctggggaaattcctaacatttaggaagatgttccgtgatgcttttctcgatcttgacgcagtcgcttcccgcgatcgtcttcgctaattcatggaacatgtcatgaactgtgaagtactcaccggtgctaatgtcagagggactgaccaacatcttctacgtcctcattgtttccatcattgtccttcacaaattcttgcgctatccacatacgaacaagattgtcacgttcaagctcataccttctggggaagatgctacagtactggaagcatctcctgacatccacaacaagttgattatagctccaccaaagagctcccttggtcttattcagcacatcgaggttcgcggttgtttgccaaaatctgatatctgggtttctccagagctgacctgccactgtcactgctgcaataggtgatctgttcagcttcttagcgattttcctcccaatcggtatgtattctcgatcatcgaaaattgtactgtcaagtgcataatgcatgaacattgagaagtattgctcctcttccagatcagatattggaataagcctattagagcctagagctgcctctttactctgggctgtcaccaggattctgcttcctgacttcccaacattgagtggagaaagcagcttctcatgattctcatcattgacccacagatcatccagtaccaacaagaaccgtttgcctctcaaattctccaccaattttgcttccaaacctctgcagtcactaatttcagaatgccggctttgcgtgatctcctcgagcatatcacgaaatatatcttccagtctgtaagtcttagaaacataaattagcatgactgtgtcaaagtatctatctttatcctccttttcatactcacaaacatactgtgccagtgtagtctttccagaccctggaatgccatatatgcaaattacagaataacatttcctgctactggagcttggtaaagaatcatcctcacgaagcatacttcttatcatatcacgctcccggtctctaccgaataccttgcgtgtactactcgatgtaatgcttctcctgttcatgttgacaatatcattccaggcaccactgcttgtctgtgttaaatagggagagttctccacgtttgtgacagtgttttctagtttctctattcttttcctcaatttccatctagcaatagcaggcatgaaagaatatactgctgtaccatcctccagctggaagaataaagaacaaaaaaaatgattagaatggaatggtggaggaatgtgcatactttccaagctcctaaatggtgcattttttgcgaacactttctatatacgaatttattaggaaactcttttaaatccatttccactttatagtatcaattcaattcgtatgtacacttgaataattatctttaatcattgagctattcaaccaatttagccattcagcacaaaagaacaggaccatgtgagctacatactgaacttccttaaaaaatatatatatactgaactagttctactctctgacgactgttgtcccctgattaataatagatgttgttttcttctaaattagtgcttctgtttagaacatggaaattttttcttgttacttcaaaaattgaactattagatgtagtaacattagtggtgtctcaaacactaagaccctttaacacattccagcaactattgatttccgaataaaattgaggagcgcgacataaattttaccaagatcatagcccgtgcattgtaactccttttgcatagtgtattagtgttgatgcaaaataggaacattcccctagattgagagaagatgcattgctagattggggtggggtgtgtgtgtgttagggggcagagaagtggtaaccaacctggtaacctgtggctgtgatgccagttgcatcataaaaccaatctcgataagagcgagcaacctcaaaccagttgactga

SEQ ID NO: 48602 - DNA, 6225 bp, Oryza sativa
tttattaaatgctcctatgatgatcagcttgacacgccaattgttaggcgttttgatacgttgtgcaagcgttttaatgaagtggcagagaatggttcagtttcagatgcattgtgcaatttagtgatggatggcctaaatgaattgcaaataaagattgatgcacaccatggcagcaaggaaattcaggaatatcagcaaaatgggaagaataaagatatggtgctgaaacaaggaaaaatggtgctaagcccaatatcagttcgtagaagaggtcgtcctccttcactgagaaaacaatcaaaattggatcaagtggtaaggagattgagaatgaagaagcaacaagaatctacaattgaagtacaaagtcgaagaaggagaaagacaaggaccaaaaatgttatatcaaaagataaacagcttatcaatattcagaactctagacaaatggaggtaatatatttattaaaatgtgtacagcatattctattcagtagtattaagtacttgaaatatttcatctctctatcgtttctgaatatatgcacttcattattaggtaaattttgatcattgctatggtggagcatatgaggcaggcagtgcagagtttgctgcaaatgagtttcaggtaatttgtgtgactgatttgccatacataattttgcattgctgtaattgatttgacaatattgttgtacagggactccaatcaaatcacccggcaccaccatctcacattagttcttacatggatcttcttcaggtgctaattttcattgttgccttctagtatatatcagtgcatagtactttcccctaacttgttgctctgttccttttacttttgcagggaaatggtgatttgacggagcttctatcccagcatatgaatggatgaaagagagaatgattttttgcttgcattacttgtgatctcaatcgacgaactaaacaacatttgctagtttattattattcaatgttagacagtatgcttgtgattttggatgtcactctacctgtattttgaatgtcactctacctgtattctgtttaatgaactgattttggccatgaatatggaaattgaagccgtggtgcgttgcttttcacaggtctggtcaatcattttttacttgtatgttatggctttttttagaggacttgcatgttatggctgtgagaatatattggtttcacatcctaaaggtctaaactaatctaacatctggagtgaatcattttaatagcaacctaagctgatacatgttctcagccagactggccccagtgtacagaaagcccagtacgcaagcaaacaacaacgaggcccagcgacccgtagtcatatctgacgccgtcattgctcgtttttccactgtttcagtcgtacaagcgtcggacacatgcgtcggacgtatagcaaagttgattgaaaatctaatgggtctcacaacttccaagtctgccaccggcgacggcggcaaaaccacgtcgtcgtcggccatcgacagcaagagagcaatggaaaccgggtcagtcaccatccaggtcgccggctacagtagaaccaaagggatcggcgtcggcaagagcatcaactcctgtaagttccacgacggaggggtgacacctggacacctggtatatatatacgtcgcctactacccgacggcgatcgccgggagttcgccgactgggtatctgtcttcctctacctcgaccggccgacgccgccgacgtcgtcaccgcagaatacgtgttcagtatacccgacgggagcggccacatggtccgcatgaaaattcccccatcgtcgccggtgacctttctcctttaattgtccatggctacaaataacgttagggctatggtatcaggtgtgacatcgccgtggttactgagtgccctccaccgccgtcgcgaggcggcgtcatcgtcgtccgtggtggtgccaccaccggacttgcaccggcatctccgcgacctcctcgccagcggacgtgctcgccgcacgatcgtcgatttttatggcggagctcttcggtggccgtgaggaggaggatacttacattcagattgatgactcgagggaccatcagtgtactgtgaaggggcaatgaatggctggggagcaccaatgtatgaagaggatattgttgaatagttcaaaattagttatggaagggtaaggaatttaatatatgagtgtaagagcatctcaactaatggaatcgtttttgggcaggaaagagtctttacaatctaaaaaagttcataacaggagggtagaatgcagattcttgattgctcacagcagtatttgacttgcagactcaaatgagttgtagtcaatgggggaaaaaacatacttgttcatataacggtacagtctcgatgatcagttttataaggacagagttgtcccaacttgaagtgccatcgccaactcgaattctttagcaaaccaattgtcaaacatcaatttacaattggcatgttgccttgtgaatgggaagttgcaatttttaaatgttcatgtcactagtagtcatttatttttctgtccagatgtttagtatctcagcaccttgagacaaaacgttgtccagttccatgctaagctacttgagaaatccggcgtcaaagttgacagctttcgcgtagtatatcagcaaaagtatccactaatacaaagcagaaaacaatcaagagctagtagctcatcatcgtccgtaattccaccgtgatcaacttggttttggaatctccctcggacactgaactactgaaggccaaggtgccgacctgccagaacaaattaaccgcagctgattatcgctggaatatattcgccgtcatgacgtcatcttcaagaagaaacttgcgagaagtatcaatcgttgcggaaaacagaaggctaatgggctcgatggctcatgtcttcctatgagatgcataaacctattaattaattaacttaataaagtaatagaaaaaaaagtctccactgtagctctcaaggtctataaattctcatattaattgaaataaaataaaataaaaaatatgagaatttgaagtagataaggactctttctttttctttttagaaaaaaaatcacgttatatacatgtaacatccgattggacacctgcataggcgaatcttttgcaagaaaaagaattacacacagtagccatgtaaaacacgatttcacttacgtaacgctttgacctattctatcccgctgagtcatcctgtgaggcccacatgtcattctctctcttcctcttatctctctttctttacttctccatcggccccacctacaatggctccctttcatcacctgacaggcccctccgctggtcccacttttgctactgatgttctattaggtacatatcaaacaaacactgttcaatatgtatgttcgatagggattggtatggtgaaaaaatattaaaagtacaatgcatgcgcatagaccagtaaatggcctgttgttgcatgtgggtgtgcaggacctatcgacagacattggtcgataggacctgcatgcaaatgcatgtatgcacttcgaattattttatctaataaacaacccaatcgaactctacggttgtttgacacgctatcgaactccaaagttcgataccctctatgcatgcacacacttttctttttttatctggtcatctaacttaattaatataaattaattaacgattgtttttcgctctattgtattcaattctttctctcgctcaatcaatcttatccactttcaacacgttatgagcactttcgctctcgcgaagtacatcgcgaagtgaaagaaggaaacccatcgcttttgatctaaaggaaaagcgaacagaaaaacaacagaaggtacgatgcctacctttcattggatcatggatgccgttctcggcctccctcgccatcagcgtgcacgccggcttcgccatcttcttcgccgatcgatcttcttccttctccgaatcagatgcaaaattccgttaacaattacgtaagttaatgaggtttatgataaattaaatttaaatagtaaatagaatgatgattcaaatgtaaaagtaaggtgatatgactttatgaaagaagaaaagtattgagatagtttggaccatagattaatcatctaaagggtaaagataattgaggtaatatggactaatgagagaagaaaatgagagagataatttggaccatagattaatcatttaagcactaaaaacaattgatgtgatatggcttaatgaaacaagagaaaaaaatattaactacgtgaggatgaactatgtaggtactgccagtgttatggataaggcaaacccaatagccttaggttgagcttagcggggcccaccatataccaagttttatatggaatcatgcctcatatatggaaaatattccttatacagaaggagaagcagagttctacatggaaactacaaggactactcggatcgtatccatttttgtcttcctatttctatttggacaagggacatctgtggtataaatacaagccccctaggaggagaggggggagatcaagccaagcctaaccataataaacacgctcagtgagaatagataccaatacacatcaccagacatagacatcggagacaagcctagacagactcaaatgccatctcttatgtcatcgagtttgtattcgagcaggaagactattccgtcgtcgactacgtgtggtgttccatgccgtcaagtcaatgatgactagatatgttatcccaaatattgtacttgtttgattctgatgaagaagagcaatactggcttcgaccaatatgagtaggtctattacctgtcagttaaggggcccaaacctgtataaacatccttgtctctgtatctttacccccaatctcgcgtatatcgtagcaacaacgatctccatattctgcaaataacctagttgtgatctactctgtcaacaggtacatagcatattataaaaaaataatgaaaatctacattgaaatattatgtgaattatatgaaatgatgatcacatgttaaatataagtttatagataatatagcatgtttgcatgatgtttaaatttaatggttgttagtggatgataatgatatagcatcttgttagtgtatgatgatgtagtattttttgcatgttaagctttaaaagttagtgagttataactttatagtaagagaggatacaacctcactttgaaaaatatattggcatattatatatgtgtagcgcccattccgtcgtggcgcattgcgggaaaattaaattctaaaaaccctaattgcgaaaattgtttcttcgcttgcagtcagtccggatctcaaatccccgttctatcgtcaaattcaaatcccgaatctcgatccgtcccaaatcaaatccctccgcaaaagtctgttttgcctccctcaggttcgatgggccgaattcctctcggcccatctctcttcatctctctctctctctctctctccctctctccccgctctgcccgtgagccgcgccgagcgcctccccctcgctctccctctccccgcctccatccccgcgagctccccgcccgcgaaatcgcggcgccgcccgttgcttcccgcgcgcgcgcgccatggtggccgaccggccagacgccgccgccgtcagcgcctgccgcgcctgagcccgcgcctgccgcccgtgtcgccgctccgttccaaaccgcccccgccgtcatcgccgtcgtcatcgactcggccccgcctctccccgcgcgtgcttccaaggaaaggaggcagggctcctcctcatcgccctctctccctcattcttttcccaaagaggcaaggggcaagccccctttctcccttcctttttccctctctccctctctccctcttccccgtcggcgtcatccgcctctgtcgccgttttggccgcgagcgccgagcgccagctcgcgccttgaccgcccaaggtcggtttccaaaccgacattgccgccctataaacccaggcgccctcccttccctttttccctcccaatcttccccgtttttcgcccgcgccattgccgtccctctgtctctctcgccgaccgccgccgtcgcgtgtgccggaggagccggtgcgcgctaggacgcggaaggggactccgggtgctcgtcttcttcctcttccc

SEQ ID NO: 48603 - DNA, 2903 bp, Oryza sativa
cctccccttagactcgctgtgtgctcgccgccgctcgctgtgtgctcgccgccgtcgccgcctatgctccgtagcgccgctcgtcgccggcctcgctcggcgtagctccgcccaatccgacgctagcaacggattcccggagtcgcgtagatgctctagcttgcccgaattggtctcccgtcgcgccgtcgccgtttccccccttctctcgccgccggttgccgccgccgcaatccaccgcagtcgagcaacccccggcgaatccgagtcattggctcgtctcccctcgtcccgtgcaacctcccggtgtgctcgcttttgcctgtatcgccgtggttcgctccgccgctcgctgccgccgtccgccgtccgttccggccgacgtcgtcatctacctcccgccggcccgcgtggcagccacgtaggcgccacgtcggcgccacctcggccgcgaccgggtcaagctgaccccggtccgccgcttccctccgccccgctcgcgcgcgcggtccaccgcgagccgtgaggctgcgcgtgggcccgctgcatccgcacccccgcgagccacgcgcatgcaccgcgccccgctccacaccctagcgccgcgccgcgtactccctccacatggtaagccgagccgctgacaagcgggtcctacccgggaccacgcaaggtggacccggcccaccggctctctctctctcctccccgcccgcgcgcgcgccttgggccgccttcttggaccggccagcccattaagcttggccaagccgcccctttctctcgggccgcgccctagccgcccgagggaagtctatttcccctccctctttcttttcttttcttttcttctctcaaaaaggatttaaataaatccttttcctttagaccaaaaatcgaataaacttagaaattcaaaatcttcccaaccgtaagtccgtttgactccgttcaacttccaaaactcctcaaatctcgagatctatctaatgacacgcctagaggtcaataatatggctttattttcgccgtttgttgagttgtcccatttcgcgtgtagtttcggagcccgaagacccgcagtgcgaggatttcgaagatcaagttcaagatctcgagcaaggcaagtcacctttgatcatcttgcacctataatttaaatctaagtatttcttttctgcaaatattgcatgaataggatttacacaagtaattcggccgcggcttgcgagacggcctgccggccccaatcctaattgctgcaattaccctccttgaattattgaacacttaaacctccttgttaacgggccttcgggtacgcgcatcggaacaccccccctcaaaatataaaatatccaaccatgggtaaaacttgggttttacaaaagacttggaaaacccgacacctgggtcggtgcttgcgaactaaatgaatttccaaaaaatcggggaccggggaacgtaccgggtgtacggtttcccgctcttgcacttaaggaccgtttccttggaatttcatccgaacataagacaagtgcgaccacatggttggaatgggacacccctggctgagtaactagctaatcgggggagccatgatgccaagagacatgtggattcaacggggtggtgtcggggagaacccccgggtttcctggcacagtatggtctgggacctaatctggtgttggtctgggacccctcttgttggcatatggtgaacctgtgtcggctttcgaaatgccttgtcatgaaagccttaaggtctctagtcgtggccgttctgcacgggctggatgatccaggttagtaatgtcgtgtgggtaaagtgtaccccctctgcagaggttattaaactgttcgaatagccgtgcccatggtcatgggcgaatgtgaggtgattcctagtgtagttttgtttgactactgctttgtgaaatttgctgaggtggtttgggttcgatgtttggaaaatttgcggctaatgggatcagccaggcccgggtggccgtttgaaagctgttggccggatgccaaccttgatcaattcataaaaaactgataccttgcacatactccgaccggacgagacgcactgtctcatccgtgtcgtttgagaagcactcacttagttgtttcagaaaagagtttaaataaaatcaattgcaaaaacaacagcctttccttgaagcctgcattaaacacttaatccccatggcttgctgagtactcccgtactcacccttgctctatataaataatcctccctagttgctgaagaagatgaagcggatcccgctgacgaggagttcttctaggagcaagtcggctacgatgagttttagggtttcggcctagttcccaagtcgcgcctgtgatgtttggtccaagtcttggcttctgcttcccttttgtaatgcagttgtgagctcgggatctgtccgcagcccaacatgactatactcctactctataataaagagacatctgttgctgtgatattctgtcttcctgtgataccagcactgtttcctgggactggtatcgattaacaggttaatttggagcgtcacgggctagttccgctcggggctagttcggggcgtgacaatatgtgtctgcatagtctccaatattatactttgtctaagttttaaacaaactttataatttgatcattattttttataatatattatcaatagtgtgaaatatcatatgaattgtccaattagattttgtatctattgaatttgtgttgtatccgctttacgcgatgtgttacttacgtgtgtgggaatggaggccatcgctcggtcgcacttacaaataaaaaataattgatgtgacgaacggaaagttgcaaattttttaattaactagttaagaagttggattca

SEQ ID NO: 48604 - DNA, 1717 bp, Oryza sativa
tacgttttgccccttaattaatagaactgaggtacaaacgagggtcagtgtgcaaggtcggaaatgatcctcgcgtgacttcgtcaagtcttcagttcctaattataacatcgggcaaaagttaagagatcgattaggacagtgtgacatcacggcccaatttgaattagaaatgtgtggtacatgcatgtaagctgtgtatgtatgtttcataccacattgctagtttagtaaaagtggaatcaacttataagagcttgtcccttcaactatattaacccttttgtacgaaacgagaatgaaaataaaaatgaaattgtaagtggagttgttatgtgtaagtgggtccgaccgtcagatggtctggacaaggcaggggggatggttggataaagtgtataattatcgatgacctagctagctacctagcagcagctggtagggctatcatccttcgtgcaactgctgcctatatattaaccagtacaccaacacctaggcctagatagcatatttacgtatatatggcactcgtcgatatggttcacgggctcaacagcccaaagttgcgattgatccgcatcgaggttctcgtgttcctgggcgtcgtcgggctgtttgtgctcctcatcctcggctcctaccgccggcggtccagctgtgaagctgtcaaaatgaccatctgggtggcgtacgctgcttccatccccatggtgagctacaccctggggctgatgcagtcgtccccttacaagaacagcctcttctccgtctgggccatcatcctcttcatcttcctcggcagcgccgattctttctctgcttatagcctactagacaacgacgactggaagaggttctacttgaagcagctcatcgagtctttctgggtgggttggctggtggtttcctctggtggctcggatttccagtacattctatgggtcatatactgcatagtcatattgaaatccggcacacgggtcgcgtcgttcaagctagccagtagaagctccatgctctccaagagtaccaaatgggtggcagactacatgagctacgagcacctgcgacctgccggcgacggggtccaacgacgagacgccgtcgacatgcaagggtaccactatgtggttgcaggagaggacgagcagaatcctagggtggagcctcccgagtaccatcttaggtacaacgacgatgaccgggcaaagctcgttaccgttcaagatatctggaactgcaatgggagtctgctctccggtggcaatggcggcaggctcaaggacgtgtgcctctccatggccttgtccaagatgctgaaccgcaggtttgccggctttcaggtgctcgccgaatcaaatctccacaagacccgcgacttcctcttcggtggcctgctccatggcgacaggtgcgtcgaacgaaccttcagggtcatcgaggtagaattagcctttgtgcacgactacttctacaccaagtacttccttatctatagcagtcaccatctgttcgtcacgttgtcttttgccatggtcccgacctgcggttggcttgcctacaagctgttccagcatttcctccgggtacccgatgaagatgagctcaaattcctcgtcaatgctaaccacaggaactacgacgctctcttcacctccgtgacagcgatcgcaatcgctctgcttgagggtttacaggtgtacatatacctggc

SEQ ID NO: 48605 - DNA, 4758 bp, Oryza sativa
tggtcatgcaccacactcccaactacaacacatatcataatggcttggcacatcgccactactctttgcgaggtggaagacgaagatcaacatggaatagacagtactactactactactaatcagcacgtagcttgtagcttgtcaaggtactgtgcctacctagtagcctttgctccggaattgttaccggatcatagcttcgtctccgaatccatatttgacgccctggtcgaggaagcccgcgaattgctgaagggtaagaaaacaatgcagcagcggaaggaagcgctaagaagccaggaccatggcgacaaccgtctcctcgttgtgggcggtcggctcgcaaacaatctcatcgagatcgaacacccgggggacagatggaaggtgctgtgtgatttctgggcagagatgatgctgtacattgcaccttcgaatgatgccaaagcgcacctggaaaccctgccaaggggaggagagttcatcacacatctctgggctttgcttgcacatggtggcatcttggagcgacccactggtccagctcaaaacgtatgagcaccaatagcctttactacgtacatccggtgccaagctttatgctctatagttctctattgtgttaaagtgcagtgtatcttctatgtatgtgttaaagtgcttgtaacttttactccctccgtttcaaaatatttcacaccgttgactttttagcacatgtttgaccgttcgtcttatttaaaaaaaatttgttaaatatgtaaaactatatgtgtacataaaagtatatttaacaatgaatcaaataatatgaaaagaataaataattacttaatttttttaataagacgaatggtcaaacacgtactgaaaaattaacggtgtcaaacattttgaaacggagagagtaatacagctaacttttagacatacgtttgatcaatcatgttattcagaaatttagtataaatacaatatattttattatgacttattttatctttaaaggttctttaagcacaacttctacttttttatatttgtattataaattttaattaggatgaatggttaaaagtacatagactcaactagtgcgtatatttaaaaacggggcaatactgtgtgtgtagagtgcggtaacacccatgcatcttagtctatctattataaagtctatcaaactttctcaaaacaatctcaagccatcacttggcactctaataaattaaagaaaaacatatatagaaactctgagaaaaaaacaaaacatatacccctcgattttcacttaaatttatgggtctaatattataaactatattagattagatttctcaaaaaaaaccgaaccaaactccttccttacatagtctcatctttccttctgttaagtaggaacgaatgtacaaatattgacctaccttttttttcacgtaatttttaataaaattatttgttcatcgattttcacttaaatatgtattagaccattagatctatcttttctaaaaatacaaagcctagaaattctaaaaattttgacaaaaaaagtacatatccctggatttttcagtaaatcaatagatgaccattggattagaatttaaaaaatcctactaatcactcctcatggtcatcccggctaatcacaccctcctatctctaacacgtaagtacgtaattcgcatatgtacgtattgcatgtcaaaaaaaggtataaccggcaaatcctctaattggattagattaaaaaagccaaatcatatcccacctaatctctaatttttacgtactgttacgtgtctctatctctatctccatctctatttctatctctactgttataaaaattaaaaatatttttgccggtactttaataagtcattcgtgtatgagtcggtttttaagttcgatcgtttttagaaatacatatccgtatttaagtcggtttttaagttcgttcgcttttgaaaatatagaaagagtcatataagaattctttttaaaaagacttgcatgctaagacgatcggacttctaattgcagcttatgattttctaaaaaaatatatatctaagtgaatttcatcttaactagaccgtataacaacaatacaaataaaataatcttcacctgttgttaaatatgcacggacattttttctagtaaaaaaaagtacatgtgttggatcgccaccaaaccccctaccggcgcctaccgcatgctcttggcctgttttacttccaattatgaaatcttaggtgatctcatccaagacatagatgggattggcacccggtgaaataggcatattgcggccggttgccaaagcctctcgctcctacaaccaacagagaagggtgaaaaatgcctcatgacgtcatactgcaacaaccacaaaaagcaccgcaggaaattaacattgaatcccaactaatgaaacttaaaaagaattcataaggaacatattatatgtattcaaatacttaaatttattggaaaatttaattgtaggaaatatcacaaaatgcttactataaaacacctagaacatcacatgcaacaactgcaaacgtcctagtgaaacatcaggaagtacgtatcgaaatatataaagaatatgatgtgcaacataaaaaacagaacctttgctaaaaatataaaataatatttttatcagaaaatagtcatgcgagatattgttataaaaatttacttgcgataaatacaatggttgaattagatctttagattggatgaatagtttaaaataacaatcattttgaatgttattgcatgcgactaaaaagacacatatgcttcctcagttcaaaaaaaccagcctaatattagatgagatattttctagtgcaacgaatctggacaggaacaagtccagatttgtttagctcctgtccaaattcattgtagtagaaaatattaaatccaataatagattggttctctataggacgaagggagtatacggtttgcatgcgtgtcagataaaaaaaaagtagtgctcagccatcccagggaatggaatgcgtacaagtggacagttgacagggagtgaagtgcaggtttactagctagagatgggcgcccggttttttagaaaaaaaaagaatagggtgcatgatccgtagtctcgtcgtgatcttactaattttctattactacttttttttttaatttttataactttttagactacttgagtaaatccctctagggagaccggagacatgaatccatcaccgttgattgacttgatctaaagtcttctgtccagagtctttgcagggcccacgtgcttagtaggcaaaattgtcaatttggaacaatgacatctccagcattttggcttagctgtgggcggctggttttcttagcgcatccggtgtttcaatgattaattggttatgttcagagaaaacacccatgcgtgtttcattgtttggtagtgtgaaatatataccagtatgttactatacattggaaatatagttacgattcggtatattttaatcaaaaaaacataataagcaaaacatgtatataataggatgattcagttgtatgtaaacatgaacgtgctaataacagtaatagcatcatctagcaacatgtttaatactaaggtgaatagagtgatatacccagagagtgtatgttctggtactggatgaggcatggttggtgttgttgccttcattgccgttgtcattgtcattctcgcctccacctccgttgctgccattcaggttacgggcgacatgttgatgtagtggaaggagatgcagtgccgagagcagccgtgtgaagaacgtgctcctcaaaaacttgatcgctcgtctaacctgtgtacgtactcaagcgaatggagttctggaagcctgctcgtcccaaatacttgtgcgcgcaagtgcttagaaccgagagaggtttatgtctttcccaatggggaagataaccttgtcctgaacactcgtgtgctcaaagtgcttagaatcaagagaggtttttgtacatgctagtaggggagataacgttgcgtgcgcattgaggtctcgtccaatacttgaagtaatgtcacccgtcggagataacgttgtgtgcgcattaagttatcgtccaatacttcaagtaatgtcacccgtcggttatgcctttgttcatcaaaacaaaaggtagcattagggaggcaggcaagtccccatacgcccgctggtcacgcctcaccctcgctcatggactagcccagcgcgtgtgtggaagtctcaccaccacctcaatcgctcaacaagtgctctcatatagcagcatatttaagttgaggttctttctcgttggttttcaagatggtattaatcttgttaacattaattgtaggtctataaaatttattaggattaaattgggtctagctcatttgattctaacatattacgtgcctgtttactcaaggctgacaggccaaaaaaaatgacaaccaaaatatagttagggggttaaacattatatctatattattgttgatttaaaagtaaatgctccaagaagtgtgtaaaattacgcacatgtatatgtgcatataggttttccattgcaatgaaaaaaatataaacgacccttgaagttgtttatagtatattggataacattggcctaacttttaaatttccagtattctaataatttatgaaatgcttagtccaaaagaaaagaaatgttttactacacgttata

SEQ ID NO: 48606 - DNA, 1298 bp, Oryza sativa
atttataagtaaatacataatccaagatccatattacccatattttgctatatagaagttagatagtgcggtcattctgacaacaaatatttgagcataatagcacttcgaaagcgatgaaatatgtgagtctaaaatccatgttcaatcaccaccaaggagcttggaaccatgatgcatgccttgggcttgaaactgatggagagatggacaccgacgacagtgacatcaatgacttccacgagttcctaggtctaacagcgtactagatgattaggtgaagggcaaggactgagaggagaggcagagggagacgttccacgtctttgacaaagactagaaaatggttccatctctaccgccgagccttgccacatcatgtccaatacatcaagagaggctcactaatgagaaggccgacaagatgatccgcgaggccgatggtgacagctggattactacaaggagtttgtaattaaattcagaaaaaaattaaaacaagcaatttgattaaaaacgcattaaaaataaaataaaaattaaaactaaaaaacataacaagatactatgtagaatataaaatatcaagagtctatataaaagtataagttataaatatcttaaatttggaataataaaataagtattaaaattagaagagtccaaatacaacacgttacgagattaagtacaatttcaaattcctaaaaatacaatttagaataaaacaataatttgatttgaatataaattcgaaattagaatcactcaatcactaaattcaaaatacaataaatattttttaaagaacttttctatctttattggttcacatgcataacgaatttgcatatatgtgaagcaattaaagatataattagtagggtggtaaaaaatacatttcttaccaacaaaaacaataaaagtttgtcgagatttattcaaggaaaaaagatataatgaacactcaattaaaaaaatcaaaaataccttaccttaaataatttgttttgttagaactattttcgaaacaaactaatacgcatgtccaccacgaatgcgcgggctatttttttagtgtgcataaatattagacacacatggacatgctttcaaaaattatggtgatgacggcaaacatgaaccgtctatgtgagcatgggttagaaacgaacatacgggaattcagggaatatgtacgcgtgtgttatggaatacttacgcacccacaactccacacgcttcagttatgatcgattttacggtcctctatcgaagatctaataccaacgataaaa

SEQ ID NO: 48607 - DNA, 3031 bp, Oryza sativa
aagaaatatctatcgaccatttgaacgcatccggtgtgcttccataatttcatgtaattaaatatgttagggagaaaacacgcatgtgttcttggtaatgtgaaaatattgtacgtttcgtacgcgtttttactgcacatatttttaagtcacatgtaaagagaaaatatactccctccgtattttaatatattacgccgttatctttttaaccaacgtttgatcattcattttattcaattttttttgcaaacatgaaaatatttatgtcatgcttaaagaacatttgatgatgaatcaaatcacaataaaataaatgataattacataaattttttgaataagacgaatggtcaaacgttggataaaaagtcaacggtgttatatattaaaatatggaggtagtaattatcaatctgacgggagacgctcctgtacttaagcaagcacttagacaaacacttgaacaaaatgttttgtgctaccagaactgtgcagcttttcttagtttttcttctcttatttaacagcaagcaagaacaggaaatctgtggaaatgcaacatgatcctccgcgacgcgggccatgcatcccacgcatgaggaacaccacaaacacaaagggcgctgcaccgacaagcccggccatgcgcttgaccaacacaaggaataataagagaaacatgaaacaggtaaatgaatgaataaacacagaatgtacggtattatactgaaattagcaagaaataatccaaagatcacaaattcacaatctggccatgccagttttattttggcttactgatctcagccaccatgcttaacgtcctcttctctggctgtgttccaaatgccgtgcattggcgtgcatgtgcacaccatgatccgcccccagcatttagtatatttgacaggcttaattacttcctgatcaacaaaacagaatcaacatgagtaacagtataatcaccgtagagcataacttttcaaataaaaaaaaaagaaatggaggagcacacatggactttacattgaacatgtatggatgcttataaatgcttgtttggaatgtgcttgatcttttgccagttttcataaccaattgtttggcacgaactcgtgagcacgtcgctgcagcgataaagtcgaaacgtcttaagagacaggggtagcactggaagcagcaagatttgagggcaaagaaatagctctagtttctcgagtgacttgagacgctccatgttatctggtaaggagtcccagctgcaacaccaaatcacgagcgaacgaagatcagtgaacagctcgctttgttgaggaatagatcccaatgggctgcatctgttgagtttcagttggttcaggagcttggggccattgttcaggttcagcagctgacccacaagcctcccatctgtaatcttttgtgcttgtacatcagtacattaaaaaaacatagattaagcttaggttcatgctgtcacaagtgcggaaaaaaaaagacaaaccatgtgacttcaagctcccgctcaagtgctcatcatttcatcaagtgatgtatatatatagcatatatgaagcactctaggaaaaaaaaggagatttggagggagaggtgtccctccatgcatttttaaagaagaaattccatgtgacttcatgctcctgctcaagtgctcatggtttcatcaagtggtgggtcctgtcaagattcaatcaactactattagatatgtggtatccataaccctgatatatatatatatatacatatatacatatatatacatatatacatatatatatatatatatatatatatatatatttatagacacggtcgcgctacacggcacgacacataggcgctgtgcgccaggaaaactccatggtgcgacacacagcgacaaaccccccaccaccgaggcatccaaaccacccgtgtagttaaaatataacttagatagagttgagtggtggggggcgatgacatcgttgaggagttaatattatgcattaattcagttggtttgagttaaaatttaacttaaacacagttgggtggtgcgatacgatgacatggttttggagttaaaaatttagttgttgttgaattttgaacgatatgtgattgaacctggtcactgctgagttaaaaattaactcgtgacaccccatgaccgagacaaccaacccgtctcgcggagttaaaatttaaccgagatacagttgtgtggtagggtgcgatgatatcgttgtagagttgacatttttctttaattcagaggattgttcgcattgttttgtaatttgttgttatcaaaaaatacatcccaacacgtataagttttcacgtattcattacaaaaccgtattttacacgggatgcagctgaataaggttaaaaacattggagggcgggctaagtaaaaaattaacttggtatccttactaagtaaaaaattaacttggtatgacaataaaagttttactcaacatatacatcctcacaatttatgagcaaaagttaaaattttgtttacacttgctccggacatcgacggcggcgtgtcgtggaggtggcaccactggtcttgcctatccatcggagtccgagctcgccaccacggaggtcgccgccgtgcgcatggaggcggcgtggaggccggatccatcaccgcctcgcctcccgccccagtcgcccgtcacagccgcgccggctatgccccaccgcggctggatccgcgcgcgtggggtgtggagcagcggccagatgcgccgcatcctcgcctcccgctcgccgtcgcccatcacagcctcgcccgcagccatgccgcgccggatctgctgacaccgcgccagccgcagctcggtggtggaggtggagccgccgcgtctccccgtgcaggatcagtgccggatccgccgtcgcaccgcatcctcgcctcccgctcatcgttgcccgtcaccgcctcgcccgcagccgtgccgtgccggatccgccgacgctacgctagcctcccagtgccaga

SEQ ID NO: 48608 - DNA, 1959 bp, Oryza sativa
tcatgacaattaaggaccggttcacgagtttcggttgtgaaacattaaccgtgccaaccacaagccaccatgggcaacggctttaccttttgtatagcatggttcattgcggagcaccagactgagaagtggcggagataagcccacgggggtcgctggggagtccatgccttgtttataagggggtgattatgatccaggaacggtgcgttgtggtggattgtgttgtgcgaggggtactgtcacagctcctttccgaggtaccgtggtggtattgaggcacatggtgacatgtcgtggggctgtgtcttgtgggtacagtggtacacctttggccagagtaaaactattcgaatagccgtgcccgcggttatgggcgggtcaaacaatgtctttcgtgattagtcccacactattcattaataataatgtggtaattgatgctaattaatttagctcctggtttggaatggtatattcttggtttggagatagatctgtgcagccgggtatggttgttcaggatggttgggcctgtgcagcatgggtatgttgtacagtgttgattaatattgatgattaattgctctactgttttacaattctcaaatgtttgctaaatgctgcttttgcaaataagccctatactatgccattctttagtatccttgtgcacttgcatatttgctgtgtggcttgctgagtatgtcatatgctcaccttgcaataatcaatcaaacctcagttgaagacaagttgcgaaggagaagatatttggcttataccccagttgagctgcctgtgggagtggagccggagcttcgctagaccgtaattccgctacagttttcttttcttttgtaagtatgtaacgttattattttgatggatttgtatattaaattgtcagtttgtgtacctcggctgattcctggacgagggttttatgcacaaattagttcagaaattactagtgaatttctgggcgtgacaccaccccactcccctcccgactccacccactttgattcacgagttaaatttttactactatatagcgcaccatatatattcatgtttagtcagttaaattttaactatgtgtgattcatcaactataataaacgtgacctagcatattgagttatttactatgataaacgtttagtattttcttgttattattatttttcttctgtttcattatgtttttgaaaaattaaatgtctatgattttttaatttttttgtaaatcaaatgttcttttttcgactgacattgaacaagttagttaatttttaactatatgtgatgtgaaaaatatttgaccattaactgatcaaaagtgatgtgaaaaatattttactcgagagtgatttttttactccctttacaaattagggcagagatagaagtaatttctttactcattgtttagagatgaatgctcagagtcgcgctatttgcttcctggcgccactgtatagaggaagagacgtacctccaaatagtttttaagaagaaattgtgagtgtgttagggattgaacacagaaccttacggttaaaaccacacatctcttgccactgcactatcaagtgcatctctatgaagcactctagaggaaaatgttacattcaagcatgcacatgattaatctactgaaataatcgtgatgttaacaagttaaaatactatagctagatggaaggcacgggacaaggtactgacctcctctttcactggtggagaaatcgtttgtagtcccggttcgtaaccccctttagtcccggttgtccaaccgaaactacgaatccgggactaaagatagcgatctttagtcccgggtgaaataaccgggattaaagatcgatcagccacgtggccggctgatccatctttagtcccggttggtgttaccaacctgaactaaagatctatgtaccatttttttatttg

SEQ ID NO: 48609 - DNA, 23159 bp, Oryza sativa
atatgtatatactgcagctgcttagcctgacagcggttaccgagttcaaacttgtatgccacttccaccttcgggattggtgcgcctccaaccaactgagccatggttagaccggtgtccgaaatgaaatccgttatgccaaagtgttcgccggtcaccaacggctcgaacacttggtgtggttgttctccaagctgaggaactggtttggacttcttgtaataggctttcctaagtgttcggtcataatccgatagctttaaggcctccttgtttgtggtggacattcccttgaagaaattcttcacactcgggtcaatagctatcttcttttcaggactccgaggcttgagttgcctcttcacttctcctgccacataagcgtcaagctcctcttgactgcaaccgtatggcggctccttgtttttggtggtgtcaactttggccttcttcgttgcccttgtgctggcaggaggtggagcttggcgagaccttgtcttgggaggtgcaggcggacacggtggaggtggaggaggcagaggagccggaggagatggtgcaggaggaggtggcggaggagccggaggagatggtgcaggaggacgtggcggaggaaccggaggagatggtgcaggaggagacggcagagccggaggagatggtgcacgagacgccgcttgtcgcctagggaggatgatgtaccgcttgcgccatagtataatggcgtggcttgtgtctcgtagatgcgtctcaccgtctcctcctgggtagtccaactcgaggtcctcgtacacggcttccaccagctcaacttcgaccatcgagtatcctgctggaatcggcctacagtggtaagtccctgaaatgtctgttgggatggccattcctgacaccaccttcacatgacgagaggttatctattagtaatcaacctaagcagcaacttgcggaacgtacgagtcaaaaatcatatattacatcgagcataccttgattgataagttcttgaagggaatatgcagctcacatggtgtccgttgcgtgatctcatcaacggggcaggtggtttcgtcctgggtttgcatggcgtccatgctatgtgatcctacctgccctgttgaggcgcagctgctacgattgcctgatgggctgaccattggaggaggtatgtacggctggggatcgtgtgaccgatgtgctgccatgcgttcatccaccttccgggccacctcctcttgcatgctgagctcttagctcgataccctgtactcaagatctgcaatcttcgcctcggtatctctcttgctcctcatccgactcctgtacgtgtggatgtcctccttgaatcccatcttccagggaatcacgcctttccctcgtgttcgtcttggatgctcgggagtctgtagggcgagtgacagctcgtccttctctctgtcgggtcggaatgtgccctgagaagaggcttccactgcgtccgttagtcgattcgcagcctcgcgtatctgatcgctaaagaccaaggagccatcaattgggttgagcgttccaccatgagcatagtaccagaacttcgatcgatcaggccatttagcggtggccggtttgatacccctctcaagcaagcttgcctccatctcctcccacttcggcatcgcgacgctatagccgcctgacctcaagtggtgatggtacttcttcttggcggtattttctttgtttcttttcatcatcgcctgcccttgttgacctgtcttgtaagcaatgtactcatcccagtgatcccttagcttcgggaatacgtcgaagttcggtgtctgccccttcaggatgtatttctggtacagatctcccttgaaggtctggaactcttctgccattttcttaagagtccactgtttcactatgttctccgtacccgcagggagcgtgaacgtctcgagcattgtggtccatagcatctctttctctgattccgggacaaagctgtcattatccccgcgtgcccttgttctgcgccagtacaccttgctgacaggcacgttatccctcacaacccaaccgatgtggcgtacaaaattcttcgctgcttttgccggggcactaggtcggccgtctgcgtccacctcagttatgatgtgctgaccctctatcttcttcgcggcaccttgttgtccgcgtgccctcttctgtccagcggagggatgacttccactagcgtcctcgtcgttcccctccgcatccctctccacgttcccctcctcgttcccctcttcatccctctccatgttctcctcctcattcaagtactagtttggatcctcgttcccctttttttcgttccagtactggctgcttccctctacgattgtttcgtacagtatctgttcctcatcgcgatcagctatctgttcatagaagaaatatttgctaagcgtaatattaacactctactaatcttgtattaaaactcaaataatcatatatgctatgtctaagtgtcgtgtatttgtacatctctaataatcttatatcaaatttctaacaatcaaatatgtttcgaatattacatctctaataatcttatattaaatctctaacactcacatatgctaagtctaattaagttttgtatattaaacctctaataatcttatattaaatctctaactatctctaacactcaaatattctaagtctaataatctaataatctctaatactcacatatgctaactctaataatctaataatcttatattagaaatctaacaatcttatattatatatttaacaatcacatctttacatcacttgtctgcgtgaattcctttgagggctagctaccacttcggcttgagggacgacgacgacgacgtcttctctgcaacatgcaaaaaaatgtattagtctaaacgcaaaggaacatataatgtatttcacgttttcaagtatatataatcatatatatatgctaagttcaacaatagtttaatttatctcgttcgtacatgtttcgctcgcgttcgttctcacacttttagttcaagtgcattcacgttcgttcacatttcaatcatgttcgttcacgtttcattcacgttcgttcgcgttcgttcactaacactctcgttcgttcacgtttcagccacgttcgttcgcgttcattcgcgttcgttcacgtttcgttcgcgttcgttcacgtttcgttcatgttcgttcgcgttcgttcacgtttcaatcacgttcgttcgcgttcgttcacgtcgttcacgtcgttcgcgttcgttcacgtttcgttcgcattcgttcgccacggctgccacggccacatcctccacgtgagcgcatcctccacggtcacatcctcgtacacgttcgggcagccgtggcgacagcgtgtcgcggtggcggtggggcgtcgcggcggcgtggtggcggcggggcgtcgcggcggcgtcgcgcggtgtggtggcacggtggcgtggcgagctcgaggcgggggcggcggcgtggacgcggcgtggcggcgcggcggcgtggcgagctcgaggcgggggcgtcggtgctgtggctatggcagccgcgtggacgcggcggcgtcgtcggtggcggctgcgtggaagtcggggttggcatcggcggcaggcggaggaggggtcggcatcggcgcgtctacgtcggcggcggcgtcggcaacgagctaggcggtggcggtttggagagagagagagatcgagatcgagatcaaaagagagggaggcagcggcggctctcacccgagagatgcggcggcggcggcgtcggcggcggaggcggcgaggaccgcgagacgatggcgagagacgacggcggtgtcggtacggggatgcctaggcagtggcggcgaaggagctagaagccgatcggaggaaaaacgtctaagtgttggtagagaagacgagggcgcactgggaatatatatacccccagatctttactcccggttggtgagagttatctttactcccggttcgtaacaacaaccgggagtaaagatcttatctttaacaacaaccgggagtaaagatgatctttactcccagttgttgttacgaaccgggagtaaagatatctttactcccggttgttctcaccaaccgggagtaaagatattttcccgctatttccaaattctttttaaacccggttagggttaagaaccggactaaagataatagcactgaatattgaatttcattgcatatgtgtttctaaaatagtaaataatgcattaaaattatttaaagtcgaaaaattaatgacaaaaccttcgaaaaattattgttgtctgtagtaaattaagtggataatatataataagcacgtgaatgatttaaaattgttaaaaattctaataatcatatataattagcatatgcatattaaattgttaaaaattctaattaacctatgtaaataccacatgcatgatttaaaattaataaaaattctaataagcatatattattagcatatgcatgatattaaattgttaaaaattctaattaacatatgtaaatcccacatgcatgatttaaaacttttaaaaattctaataatcatatttatttagcatatgcatgatattaaattgttaaaaattctaattaacatatgtaaatcccacatgcatgatttaaaacttttaaaaattctaataattatatatacctagcatatgcatgatttaaatttgttaatcatcatatataactagcatattcaatacatccaaaatagtttacaacaattacggcaatacatcggcggtgacgattgtccgcacgtactttctcctcactattgttccttccttgtgatcgctacgtgagtaaggggtgtcttcatttgataggaggatgctagggtcaatcgtcaccgtgaaagggggttgcccatcaaactgatcgtaatcctcgtcagtcttgtcctctactccgacaatttttcttttgcctgggagaaccacgtggcgcttcggctcgtcaggccctttgcccttctttcctttgctagacatgtccttcacgtaaaaaacttgcgttacatcattggcaaggacaaaaggttcgtccgagtatccaaccttgttaaggtcaaccgttgtcatcccactgtcatcaatcgttacgcctccaccagtcaacctaacccattggcaccggaacagagggaccttgagaggtccatagtcaagttcccatatctcctcgatggcaccgtaatatgtgccagttgtaccatcgtgtcccatggcatcgatacgaacatcactgttctggttcgtgctctttatgtcttgggctcgtgtgtagaatgtgtacccattgatctcatatccctggaatgtcgcgatcgagccagatggacccctcgccaggaaggccagttgctggttaatcgtctcgttacccatgagatgttgtcgcagccatgcgggaaagtatcaatgtgatgtcgtgtaatccatgcatcggacttaccgatgtttctggcgcgaactagagccaagtgctcctcgatgtaaggagccaccaatgaagattgttgtaaaacagtgaaatgggctttacggaataaattgttgtctaccgtcattattgctttccttccgagagtcccctttctccatagtctcccttcatggtgtgattcaggtaccctgattgggcgaaggtcttcaataaattctacgcagaattcaatgacctcctctgttccataccccttggcgatgcttgcctctggacgagtacggttacgaacatacttcttcagaacgcccatgtacctctcgaaaggaaacatgttgtgtaggaacacaggcccgagaataccgatctctttcactaggtgacaaagcagatgcatcattatattgaaaaatgaaggtggaaatatcaactcatagctgacaagacattgcaccacatcattctgaagggcttctaacctatccggatcgatgaccttctgcgaaattgcgttcatgaaagaacatagctttgttattgttgcccggacattgtctgggaggataccccttattataattggtagaagctgtgtcatcaacacgtgacagtcatgagactttaggtttgtgaacttcttctccttcgtgcttattattcgctttatattcgtggagtatccagatggtaccttgatgctctccaagcattgaaacatactttccttctctgccttgctaagagtgtagctggctggacttaagtaatggctgcctttctcctttggttccgggtgaaggtcgctgcgctgttccatatgcttcagatcattacgtgcttccagtgtatctttcgactttccatatatacctaggaagccaagaaggtttacgcaaaggttcttagtgaggtgcatcacgtcgatcgcgtggcggacgtccaagaattcccaatagggtaactcccaaaatatggagttttttttccacatcgccgcgtgaccatcttcgcagtctataggctggctgccaggcccctttccaaacactactttaagatctttcaccatagcaaacactgttttcccgctgtgatgtttaggcttcgtacggtggtccgccttatgttcaaagtgcttgcctttcttccgtactaggtggtttgcagcaagaaatcgacgatgacccgtgtacacaaccttcctacagtgcttaagatacgtactttctgtttcatccatacagtcagtgcaagccttgtaacccttgtttgactgcccggataggttgctaagtgcaggccaatcgttgatggttacgaacagcagcgctcataggttaaacccctcttgtttgtcctcgtcccacacggggacaccttccttcttccacaacagtttaagatcttcgaccagtggtcttaggaacacatcgatgtcgttaccaggttgcttggggccttgaataataatcggcatcattatgtacttcctcttcatgcatagccaaagggggaggttgtagatacacatcgtaacgggccaagtgctatggccactggtcatctctccaaaaggattcatgccatccgtacttaaaccaaaccatatgtttcgtgcgtgctttccaagtctttaaattttctgtcgatgtttcgccactacgaaccatctgcggggtgtctcagcatcccgtcctattgacgttcttcagcgtgccaacgcatcattctagcattccccttgttcctaaacaaacgccttagccgtggtattatagggaaataccacatcaccttagcaggaattctcttcttcgttagctgcccgtcaacctcacctagatcatctcgtctaatcttgtattatagtgctttacaaacagggcatgcttctaggttctcgtactcctcaccgcgatataggatacaatcattaggacatgcgtgaatcttctgaacttctagtcctagagggcagactatcttcttagcctcgtacgttgtctcgggcaatttgtttccctccggaagaatgttcttgacgagtttcaataaatcgccaaatgccttgtcactaacaccattttttgccttccattgcaagaactccagagtggtatccaactttttgtgcccctactcgcaacctgagtacaacgatgttctgtggtcctctaacatcttgtccaatttatgggccctcttttcactttcgcagtcctccttggtatcctgcaacatctgaccaagatcatccgcaatgtcgttataatcagcatctctatcctcctcgcccgtttgatttccttcaaatccagcgtactgagcaaagtctggaatattgtcgtcttccacttcatcttcttccatttcaaccccttgctctccgtgggatgtccaacaattatagcttggcatgaaccccgactcaaacaagtggaaatgaatagtcctggatgcagaatactccttctgattcttacacttattgcatggacaacaaataaaacccttctgcttgttagcttcggccactctcaaaaaataatgcacgccatcaataaactctttggaccgccggtcagcgtacatccattgccgatccatctacatgaaatgaaaaaaaaatcgtacacaaatattcattcgtacaataatgacagtcatacaataatgataaaataatcacaaactctttcaacagtcatacaataatgacatatcattattcatacaaaaattataaaatattccaccaaataattcttatttattattttttaagttttaaattcttttaattttcaatttagtttgttttcttttatttaggattaactttcactatattttcctactcaactattttataaaaccttttttagcaaataaacaaaatttctatatattctttcttttcccacacaaattttctctctcatcaacttacaacaaaattttggagacaaaaaaagtgtgcaaaacatagctccaaatgtaatatgaccaaaaaaaattggaggatgaagttgctaaccttttaggcacctccgatttgtatataatcaccaaagtaaattcactataaattttggcatgacctcccctcttttttgaagaaattttgaagcttgctctcgggctggaggaggaagaaggcatatataaagaggggggatctttagtccctgttggtgttaccaaccgggactaaagttacgatctttagtcccgattggtaacaccaaccggaaactaaagatcccggggggacctgacaagccctgacagcatttgaaccgggactaaagaggttggtgttaccaaccaggactaaagatcaaatatgcccgttaccctttttaaccgggactaaagatcatctttagtcccggtttttgttgcaaccgggactattgtggaattcggccgatcgacaaaagatggtttctccaccagtgtttcactcgctcaagacattgacagaagataagtacttgcctttttcagagaagaacagtctctattaatatgcctgtgctaacgctacggtggcaattgttattcaaaataaaacatgtaagagacattggtacaatacatgttttagcaatcgaatatgggagtgtattataatcccaccagggatgtcctctcacgtactttttttctttcaaattcgatataaatagttgtgaaaaattctgaaaaggttaacaatgtagagtatagtgatatctattggtccaccaaaaatcaagttcaaatttgacctacacattgagataaaaatacaaatttagaagtgaacacatacgctgaatttgtctttttcatatctcgacatatgagttgattttggacttaagattttgtggagttgtataagtatgttccatgagtgttgacaatttttttagaatttttcataaccatttagatgatttttaatcaaacaaggggacattccttgagggatcaaaatagtttaccaatcgaatatagaatgatagttataaggttagaataaccactaaaatttatccacaaaattcttttctgcattatatcttggttgagcccaacattttgcattgcacactcaatatatattgtaacatactcaaaatttcatgaaaattttttgcgaaatgttttaagtcatgctcttctcaattcttacgttgagcaaccttgctttcttttaatatcttttaatttggatccaaattttatttgcaaagttaaatgctctcttctaaattttataaaatccttattttattccttattttgtttatttcaaattttacaaaacccttccatttattttaatctataactttggctctagattatatttccttcgaatccattcccgaacatctccacatctacaaataccctttcgattcccactcaactatcttcaaagtacatgaaataataatttccaaccatccctagagtacataaaacaataattttcaatttcctcagagttaatactttccctttgatctctacccaaatatctctagagtacataaaatatcaactttcaatctccctctgagtcaacatagttttagagcttattatactaccaccaaatccgttcctataaaaattcctataattccccacctacatttatctccaaatccaaatttatcctccaacaaatactctccctttggaatcctccatatctaaattacctattcaaaatttccaagtctacaaattagtttgggccaatgtttctctaatcggcccaactttctgttatatcccattaaccctttttatccttagggctaaaccagtataatttcctttttgctggaatttattgtggatcaaacccttgatctatacctatctttagaaatccttatgtttctccttcatacaacaccttccacaaactcctctagatgttccactatccaaattcttatataaatcaaaccgccaatttgattcccaaggtttgattctcctcggcagaagaataatattaatacaaatattaaatgattgctcttgtgttaagaacactatttccaatcgcttccttagaaagtccaatttcctttagcccacaaatgtttcactcagaaatccgtaccacataatcttgggctaaagtccaatttattcccttccttttatttttgccaccatcccaaaaattcatccaaagtcagaaattaaatcatttgtgaactatttcaattttaaattataaaatattagagaaaatcttttgtgacaagttttatatttggttcttattgaattctataaacttggagcatctttattttatcctttcaaatttataccttaaaataaatatctttagttttattttaaaaagatttcaaactccttttgtattctaaaaatttctatatttaaatttttgtcaaaattctaaaagtcctcaaacttctcccttagtttctatttcctagaaatcctattcaaattcgttgtcaaagttcaaaaagtctccaaacaaatactcttcattttcattcccttcaaaattatacttaaattctttgttcaaagtttaaaaagtccacatccatccatcctttagttttttatcttcattgaattccaatcaaaaccctccacacaaaattatttaaacttcctattcaatttgagataaaaccctctcatttggcccattcctttttctttttccttctacttccttctccccctcgggctgtcggcctagccaaagccaagccagcccaactgagccgcctccgctctctctcactgtgggcgtgccgccgccatcaccacgccaccgcgggcgccactgtcacgcccagaaattcacgaaccagaatttccaagttgaaagtgcattaaacccctgtctaggaccagccagggtacacaaacgacaattgctgacatacagatccacgtcttacaaaaatataaaagattacaaatgcagcggaaaaggaaaaagcgagctaaacttggaagcttgacttcagcagcggggcgactccactccacaggcaatccttgacggcagcgacgaaaccaacttcaataagacatcaccaactaggaagatcttcagctctggtgtgggggaaaagagagcaagactgagtactacccactgtactcagcaagtcataccggaagagaaggtatgatgcaggatataaccaaaagaggctaaaggttcttttgcataaagctagcatttaaaaacagtagttgaaaacagtaaaacaattgcagtagattaagcaatattacccaatcactgtccaacgctacaccacgttgcaataggcccaacccaccacctgaactacaccagttcattaagctaaactaggggtgagactaatcacggtgaatctggttgatcacccataaccacgggcacggctattcgaatagttttactctggccagaggtgcacaactgtacccacaagacacgattccacacatgtcaccatgccccgagtaccaccatagcactgcaaaggaggaaatcgtgacaagacccttcgcataacccgcccctaaccatccacaccacgctaaggtttcacccccacccctcaaaaggcagtgggtagtcccctcgtgcgccgcggtgaatccggcagctggacaaccggacacctcgaccgacccaactccatcactcccaccctcgccaccggtgcctaggaaagggtcgagctatacttcagatcaagcagttacccactcccgcttgtggcaagcacggtaagtctcccagggtttcccgtgaaccggtccttaattgccatgggtgcgaccagcaaaaccatgcacccacagcccaccatttagtgtattttaattaactaacaccattgcggtggcaccaatccaaagctatgctcatagtcaaagtctatgtaataatgtgatccccatttgtgtactagttgaactaggcatggctaagcattttcctaaaccaacatctagtcattttgatacccaagttatcaatggcataaggtaaacaataaatggctgagtaataggacccatcccacatgacattgtaaaagaatgcaacatttaatagaaatacgggatatttgtaaattgggtacaatatgatcaattgtaatgcatgacttgccttgctcttgcactgatgagacctcagcaacgtcttcgaggaaccgcagatcgacgaaacggccgaaatctacgcgacaaacaaagcacacaagcaaaacatgctataagactactgaaacagaaaacaaaaccatttttaatggattcattgcatttttcttgatttactgagacttgaatggacttaaacggagctcggatgaattagttatgatttttagaagattctctgtgtttttactataaaaagaaatgccttaattatttattgtgcaatatattctcagggctgacgtcatcaggggggcaccgacaggtgggccccatgggtcagcgactcaagggagagggaggcgctggctggtgggccccacttggcagcggcacaaggcggccggtctaccgtggaccgggaccacgcgggtggtccaccgccggtccacgggaccgacggtccagattgcccgggtgtccgatcggacggcgcgggcggggctaggcatggctcggctcggcataaagccggccggccggccatggggagcggcggcggcgtgcgaccgccggcgacggcaagcggcggcggatggcgcataggctggcggcggcggccgaaggcgatggcgagcgcagagagcggcggcacgtgcgggacagagggaaggagggaggagaggagctcctcactggcgagcacggcggccggaacggaaggcaaaggcggcgacgatgaccctgtgagcggaggggcggatgggcggcggcgatacctaaaggaggggaggagaggagctacgagtagggaaaatgaccacagcggatgccattgacgaccggaggcggaggggagggacaaactcaccagcgtgcgaggagaaggggactccagtgggtttttgcggcaatcgagtggcggctgaagtgcgggcggactcggtgagcacgacggcggcgatggcgcggcgcggcggtggctctagcggcggcggcgcgcggcaggaggtgggcggcgggcggcggagctcgggtgcacggcgcggcggtggtaggaggcacgggagagcgcggcgagagcgaaaaacgagagagggggacgcggggagcgatttataggtgaagggggaggcggacgtggccaaggaggtggccgaaatcaccggtgacgtgggggcggagagagagagaatggggggtgggattcgaaatcgaatcccgcccattctcgggtgcgcgtgagtgcgggaggagcgggggaggggcggcgacgtgggagcggcgcggagtcggggcgcgaggtggagcagagaaggcaggcagcgtggggaggtgggggcgccggcggttggagctcagctccaaccggctggaggtaggggaaggactgacaggtggaccccacctgtcagcgcctgagagtgagagggtggccgggttgacttcgagaggggaagaggaaatgggccggcccggtaaggagggagagggcgcgggaagaaaaagagagaaaggaggaaaaagaaaagaagaaaaaggaaaaagaggaaattgatttccttggatttaaaatattgcactttcatgattttaattggttaaaattatttatagggctttgaaaattccactaaaaatgctgttaatgtattgtgacatgtggaacccaaggaaaatcccaccatgccatttacaattattgaatgcatttattaattagggaattagctcatggttatttaaacaatttctttgggcaatttattcaacaaatttttaaagcaagaaaaagggggaaacttcagggcgtgacagccaccatcgcctcgccccaaaccacacgccgcccaactgctaccacatcgccctgccgcgccgctcctttcaccagccgttgccacgccgctacgcgccgccgccactgccaaacctaggggcaccccgtgccaccccaacagccgccaccgccgccatggccatcctgtggccgccgcggctatgccgccaccgctgctgtattgctgctgttgcccattgctctgccgctgccacccattgttcaagccatcgccaaccactgagctatgccacgcgccgctgtgagccaacgccgaccactgagccgccattgccgcccatttgaaaatcgacacgcgccgccgcctctctcccaaagccgcgccgtgctgtcatcggcttctctccctccgccgccttcgccgcctataaaagccggtgagagccccttattttccccatcaaaaatcttgagagatctgtttagctctagtgcaggaacaaatcttgcttctgggtgaaagggcatgctagttggtttgatcctgcaaccaacaagaaacaaacacagaaacaaagttaaatccataaacgatagccgatcggccgcatgccgatgacgtatcatttgtaagctagccgatgtaacgtgaattagatcggcaatgatatataaagcaagaaaaagggtaaatctagtcgatcggctgtagatattagcagtttataatctatagatcgaaatatgtttaaaccaagtgattggaatagatcgtatagctttccgagacagtataaatcacttatgtctaaaagtacttcaatataaagattatacgtgcttatagcatagccgatgtcgtagatctaacatatatcggctaatactccgataccactttatactaagatatcaatatagattaaataattaaataggaattaatcaagtgttaaagtaaattaacagattaataacaagcttaatatattttcttttaatatattaataacaagcttcttttcttcaagggcctcggctatgtgctgccaattcgaagtagggccacaactggatccacaaaagagatacttttctagccacactaacagataggctgtgtgctctcgggggttaacagatccctggcccatattagcagaaatgaaccctgaccatcctcctatactcttagtcttgaaatcaaatttgttcttggagttcaggttcatgtggttagccgatgaggtaatgtccaagccagttatcattgtgatgtcaagcagagtaggggtcatcggcccttggttgaacataaaagcattaagggtgttggaccagaaataggctgcagaagctatcaagggttcatctttagccgaatttgctatggttagggctaaagcctggccgattcccagctcatcccagtggctctgcttgctagccgatatgcgcttgtaccatgcgggccagcttttctctagagaaggccaagacttgaaggtgtttttccagtggcctaggctaggattggctatcctgtaggggatcctattgatttcagcactaataaactctgcccggtgagagttaccaatcggaccgagaaagtactgatgctcgcgggacaagctagggatcacaatcagatttgcaagatgctacaaaagaagagcaaagggaagagaaggcaaactgagaccaagagaaaccgatctattgcataaaagaagggatttagccgataagggcttacctctgcgtactcagccgatggagcggtggatggaccggcggaagacgacattgccgcgggtggaagttgaccggagagggagtcgccttgagatcgtctttttgcgccgaggggattgccggagagaaagaagacagaaatcgcttgagcggttgagggcaaagtaacggtgtgaattttctcggggaggtcggttagtatttaaagccgtgtggtaacggttggaaaaatggcaatgtgcgattttcttggagatatgatatggcaaatccgaaacattaccaaatattccggacttggggggcatgtgttaacgaccaaatttggtaatccaagtatctgagataaggataaatcgaagcagaactaagagataaactgtttcgaaaacagagtaagaatcggctgaagtctgaatcggctgcggtcaagattggcagagttcgagtcgaacaaggttagccgattgagccgaattttggcaatacgactcggtatacatcattgggttgaatcaaagtgcttcatatggattgctgcacacgatttgagtcctggaaaggcaattgtatctattagttaggatattttatgtaatttccttatgatttgagtcggtaagagtccgccttagggacttgttcgtatcctaagttgtaatagggctcgaagtcgtgtccgatagggacatatcatgtatctcaggtataaaagtaagcccgaacccttgtaaacaattaacgcttagttcaatcaaattcggcgcatcgccaccctttcgttttgttctattttcgacgagttcttgctttcgagttgggctgcatcggcttcgatctctgacaagaggtaaaacttgttatggcggcttgtgttctcgggattagtgcttccatatttatgacactctaatattgtttgttgagttatcatatatcctatatagtttctggcaatattgttatttaaccttcaatcggctaacatctatgactggaaggcagccgatcaagttaaatatcaactttgacttagattatatagggtatctaccactctatgaatcaaccaacagcttgactttctagatattgtgattctcctcatacttatagctgcatcagttaagtttgaccttataagtcgtgattagaattttaatctctagcctgctttcggttgccgattagggtttcatcgggggtttcagccgatcttatctgatttagttgttttgtttacttcatgtttacttaacatgctaaatctgccctttatatcaagatctcactgttattaaatatattaggcttattattaatctgttaatctactttaacacttgattaattcttgttcaatatatttggtctataatgatatcttagtataaagttgtattggagtattagccgacacgtgttaggtctacaacatcggctatgctatgagcacgtataatctttatattaaagtacttttagacataagtgattcatgttgtctcagcacttggtccgatccatactagtcacttggtttaaatgtatctcgatctatagattatatattgctaatatctacagccgatcgactagatctaactttccttttgctttatttatcattgccgatataattcacgttatattggctaacctacaaatgatacgtcatcggcatgtggctgatcggctattgtggatttaactttgtatctgtgtttgtttcttgttggttgcaggatcaaaccaactggcacgccctgaacccgaaagagagattttaggtcctgcactgaagttaagcagatcttccaggccagtgtgtgtttttcgcatcaacacgcttttggcacgcccggtgggacacgagtgtgacaatctttcatcatggtggacgtcaagcctactgatgatgatggcaagaggactgaagttgattccacaaacaagattccgataaccatcgacatgctgacaccagagcaaaggggttaatatgatgcatggttgagcaagctacagaacacatactttgattcttttgctctgactcgacaaggaacagtgatccagaagcataaggtagaaatcccacccccttcaaacagtgaagcttctggttctggtacttctggacgcaacaaggaagaaggcaaagaaggacttaaacaagaagatgccaacctcgagttcaagaatttccaagacagtgttgactatgcggttaatcatgctctcatcaatcagtcaggaatcttagctaatgtgatgagcaatgtgatggagaagatgatggattgcaagtttgaagaaaggggagccagaggtccagcgttcttccctggtgacaagtttcctaattacaggaccttggttacagatggactgcctgtttctgggattacttcaggatagccgattgcatcaacatcggcttaacctaatccaataggggaaacttcggctctgctgaacccgttgggaccaaatcaacctcagattaacttgacggggacaaattcggctcaacctaacccgatggtgccagcatcggctcagccgaattcaactgtgatttcatcagctcacaaacaaccagagttcagacctcgtatcctgatgagaccacaacctcagcacgttggtcacaacattcctcaagttaatcaagagcaaatatcgtctatgttcgatgtcactcagccaattcagcagcagattcaacagcctgttcaacagccgatttagaacataccgatcaggccttagactccaattcagcaaactcagttgatcggtgctcagttcatgtctgattgtcacgcccagaaattcactagtaatttccgaactcatttgtgcataaaatcctcgtccaggaatcagccgaggtacacaaactgacaatttaatatacagattcatcaataactaaagcgaataaatacttacataagaggcacttagtcctcaccatgaagaaagctgcagcggaaaaataaaacctaacgagcttcagctccactcccacaggcagctcaactggggtataagccaaacgtcttcttcttctgaatcctttttcttcaactgaggtttgatgattattgcaaggtgagcatatgacatactcagcaagccacacagcaaatatgcaagtgcacaaggataccaaagaatggcataatatagggcttatttgcaaaagcagcatttagcaaacatttgagaattgtaaaacagtagagcaattaatcatcaatattaatcaacactatacaacatacccatgccgcacaggcccaaccatcctgaacaaccatacccgtctgtacagatctatctccaaaccaggaatgtaccattccaaaccaggagctaatcaaattattaccagttatatcatctttcattatggtgagaagtgtgagactaatcacgaaagacattgttagacccgcccataaccgcgggcacggctattcgaatagttttactctggccagaggtgtaccactgtacccacaagacacagccccacaacatgtcaccatgcgcctcgatatcaccacggtacctcggaaaggagctgtgacagtacccctcgcacaacacaatccaccacagtgcaccgttcctggatcataatcacccccttataaacaaggcatggactccccagcgacccccgtgggcttatctctgccacttctcagtctggtgctccgcaatgaaccatgctatacaaaaggtaaagccgttgcccatgctggcttgtggttggcacggttaatgtttcacaaccgaaactcgtgaaccggtccttaattgtcatgagcacgaccatcaaaaccatgtgctcacaacccacctttatcaagttttagttgacatattaattaattaaccaatcacgattaaccatcgtgagcttccattaaatatccataagtgatagtgaagtatgatttatcccattagtgagctattttttctaagcatggctaagaatctattataagcatctagctgaaccaaaccaatatataagcttctagctaatcaaattctaacccataggtaaataaagtcatcttcggccataattaaatgggaaaggctcaccacccggtgacattcgaaaataaatgcacaattgaaataaatagagaatttaaatgtaggatcaacatgctcaaaggaattgtgtttgggatttgtgtgacttgccttgcaaacaagcatcttcaattcgtcttcaggaacttctccaacgaacgaacgatcctccaaaacaacggaaaactaaacctagaacgcaaaacaaagtaaaacactaataaaaaacaaatgaatagtacaattaaagttcataaataggtagagcttgaatttagatgaatcatgagacttgaacgacctcattctgagttcgtatgaattagatatgaattttacaagatttaattctaattaaacctattaaagaaaagactattccaaattgattaaacaatttacaaatgatttatagctgagacagaagattaaaacattttccggaaaaatattagatcatatttggtagatgacatatattaaaaaggaataatatgtcattgaaatgagatgacaaatttatattaattttggatggccaagatggcgctgatgccagcgatgacatggctgccacgcaggatcgacgaccgcaagcacgggaacggcagttaccagcgaaccacggtacaatgatgcaaacggagggcaccgggagagagaggagatcaaggcgacccttaccaccacttacgcaacgacagacgacgagggacatggcaggcgacgaactccaaaaggcggcgaccttgggttgacgatggcaacggctttccggcaacgagaggcagcaaccgaggggcggacggtcttcacctcgctcctgcgatcccgagggtggcgacggtgaacgaaggcggcgatggacggcgacgaacggcgcggctgaagatggaacagattggcttcacagtgacgacggtgctccgatggcttgcgtcttcgcggaggtggctgccgggcttgctgttgtcgctgcaatgccaacggaggagacggcggggttcggcgaccacggagtcgacggcaaagcttcgccgaagatcaaaccgaggcagcgaactcggccttcacggtgacagcggcttccggcgggatttggcgcaaaggaacgggtggccgaggtggatctcttcactgcgaagccgagggaagcgacggcgcagatcggggacgaccggggaggcagcacagcgcggctggagcggcggccggcaaaggagagagaagccgaacgtggggaggcggctagggctatggaaaaactcgggaaaaagagggaaacggaagaggaggtcttgggactgctatttatagccggaagagggagagatcggctcaggaacggatggaattggcgacggattagttagggttcgccggaaaataggaactcaaaaccacgtcgaatccacgcgatataccacgggattcaaggggatttcttggggataagatagaggagatcgaggggaatccgtttttgcaaccaattttggaaacggagcacgggatgcaccggatcgaacggagaaggcggcgctgcaacacacgtcacgggaggagcggccggctggaggaggaaggcgagtccgacaggtgggcccggctcggaagagagaaaggaggaggagggtgctaatgcagacttcggccaagggagaggcacgggctgcggaagggagaagggagagagaggagtgggccggattcagcccagactgaggaagaggatttaattaactttttaatttaaataattgctgaaatgatctttcagttattaaaaatacttccaatgctcaaataattctgggaaaaatccagaaaatacttgggcatacaaagtatttaataaaattttatctagctcaagtttaagttcaaatttttcatagattttattcacacactttctttagttattaaatgatttctaaaaattcctttttcacaacgatttataatttagcgattttcagggtgtgacactgatccaattcaacaaccccacatggtgcatcagactccaccaccttatgatgggggtaacatgtttcaaccatactcacctcaaggacagtatcggctagcaccttcaccacagccgtagtttgtgcctcaattcaatcagtatgatctagcacagcagcagttccagggtgcacctgagcagcaacagcagaagccctgggccgatatgatagcctatattatgagggagtagtttggtttcaagcctaaagattctggtaatttgtatcggaaaccatatcttgagtagtttgataggattccattaccacactgatacaaggtgctagatttttccaaattttctacttatgaacatatcagccgatttctagctcagctgggagaggcatcggctaatgatgcttttagatttaggatgttccctttgtctttgtctagatcggcctttacttggttctctaatcttccatacaattctatcagtaattgagccgatttggaaaagcaattccatagctacttttacagtggcgttcatgagatgaagctgacagatctgattccagtcaagtagaagcatgatgaatctattcaagactatattcagagattcagagatatgaggaacagatgctatagtttgtccttttcagattctcaattagccgatctggctttccagggtttattgcatccgatcagagaaaatttttcggctcaggacttcgaaagcttggctcatctggcccagaaagttggagtgcatgaacaacggttttaggaag

SEQ ID NO: 48610 - DNA, 2294 bp, Oryza sativa
attcaattgcctgcaaatcatgttattccatcggctgaggaactaggcaaaaggaaatactgcaaatggcataatactggatctcatactactaatgagtgcaagctgttctgacaacagatctagttggctatacaagatggtaagatcaagtttgataactccaagaggctgatgaaaattgagcgtaatccttttcaagtaaacatggttcatacaactgggaagacagccgataagaaggattatcggtccaagcaactcaattctgcaaggattatcaacaaatatcagaagagacatgatcggcatgaagagaaattttatgaagatgatgatagctttgacccccactggagttgtgaattcttcaggttttgctggaatgaggggatgaggctaccatctatcgaagattgccctagttgtagtaatcataaaagggggcatgttgcaagctcaagccgatcacgtcccagggagaatcggctacctcagaagaaacttcctgttcaccagatattgggccctattcatgaagactactttcaggatgaatcggctcaggaacgggagcaagttgagaacaagcaatggtgtccttcaggccctttcaccaagaaccagaagaggagagttcagagtgaggaatagggagcagtttgaggaggtgagcaagaaatcaaccatcagctgaataagaggagacgtgttagccgatgaagcaaagaggttagctaaaggaaaatctgttgtttcttcgtcggttaacatggcttttgtgttgcctgccaagttcggtgttgatcatgccgatatggaggaagaagatgtggtagaggaatcctcggctaagttggttctgtcacctgagcaagctatctttgagaagccagatggagcagaaaatcggcacctcaggccattgtacgtcaaaggatttgtcaatggtaagccgatttccaagatgttggttgatggtggagctgcggttaatttgatgccatatgctactttcaagaagttggggaagactgcagaagatctgatcacgaccaacatggttcttaaagattttggtggtaatccttcggaaaccaagggtgttcttaacgtggaattgacaatcggcagcaagactgtacctacaactttctttgtcatcgatgggaagggttcttacaacttgttgcttggtagggattggattcatgccaattgttgcatcccttcgaccatgcaccaaagcttgatccaatggcaaggcgataaggttgaagttgtgccagccgacaagtcagtcaatgttgctaatgccgatttgactatttgggagatggatggaattgattgcttgtctggcaaagtttgggaaggagattttctaaaggtgtccgattttgacatatagccaattggagatggagagccccaattgctcctttgagggcgttgtggagggttcaagcttctacaccaaggatattgtagatgatctcgatggcaaactaggacaaggtttcatgtcggccgatgacttagaagaagttgacattggtccgggagacaagccgaggccgacatttatcagtaagaatttgtcatctgaatttagaaccaagttaatagagctattgaaagaatatagagattgctttgcttgggaatatttcgagatgccaggacttagccgattgattgttcaacatcggctaccaatcaaaccaggatatcggctgtataaacaacctcctagaagatgtaaggccgatatgtttgaggctattaaggccgaaattaaacgtttgtatgatgctggttttattcagccatgccgatatgctgagtgggtttctaatatagtgtcacgtcccaaaacgactctaaaatacatcctctaaattatgcctagaataattaaaatccgtgtgaaagcctccaaaaaaattaaaatgtgcaaagttaaaagtcaaataaggcttggaggatttttgtatatttcctaaaagcctaaaatgcgtaaataaattttagtggaattttcagagcacaaataataattattaagaataaacaaagttaaaatggttttataaaaagaaaaaccctaaaggtcccctttccctccctccccctcttgggccggctcggcccatctccctccccctctctctcctctccccgcggcccactcggcctctccccgcgcgcgcgccgctgacgggcgggcccgcccgccaccctcgctgatgggtggggcccacccgtcatccccttcctcccgccgcttccgc

SEQ ID NO: 48611 - DNA, 43091 bp, Oryza sativa
tcctccgctccggccgcctttttcgtcgtcgccgtcgacctagggtgagctgtggaccaccgcctcttttcccccttcccttcccctctctcggccgccgctccgccgtgcctatggccgccgccggcgaccatagaggcgcgggcgccgcctcctgccggctgcgccggcttggccgccctcgggcgcgccgagtggctgccgcgtggggcccggccgtcagccgcccgcgccctcgggtgcggctgacgcgtgggacccacggcgccggccggtgtgagcccgggtgcacccggtccaccgtggaccgtgaggctgccgcgtgggccccactcccgtggacccggtccgcgcgtcccctcccctcggctgacgcaataaacccttttaaaattaaaatttaaatgaagaaattcgcaaatattcatttaaagaggatataacttcaaatgaccatagcttggccatttgaactcggaattggaccgttcaagtctctaatttttccttaagaagtcaagaacccatttttgagctttgttcctgcttgttatatggagtttatcagagtaaaagccttttcttttccgttggtcatgtagacgctgcagcttcggaagatccgctcttcgtggaggttgaagccgacgtttgggaaagcgagcaaggcaagtcacatcatccttgaacatattgaatcccagtttataaaattattttgatttaaattattgcattaccgctttatttaaattcccgcgttatcactgttttatctagccatgcctatttacctttgttatgaccttattattgttattgttattatttcctgttcaccctagaataaacaaaaccccaactagtggacactctactcatggtaccactagtatgattttaggtagatgcttcgctgattaattaggcaacattaggtggttttataactctagactttgggaatattctcaccacctggacactatggaatagttggattattgtggaattggattcacacgtccccctctattcaaaaccctcaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggacgaagttgggggtcgatggacatctctaggacaaatgaaggctacacgagctgcggcccggtagtcgagatgtcatggcacagggccggtgtcctgctgctaggggctcagtcctgcctacctgtcccgggggttccggccgtaggtggggttgggtcggtactcttgtctatggctaggatgggttggaaactatgtcacgtcttccgtccgtataccgtggtggtatgtggcacgtgattacacgtgaggaagatgtgtcttgtgggtaaagatgtacacctctgatcagagtataatctattcgaatagccgcgccctcggttatgggcaagccgagcaatgtacccaagttagtgttttaaattcttaaaacctgcttaacaactaaaatgtggaatggttagcttgggttggcttgggacgagctgggacccagggtcgggttgccagttcggtctgaatcatcgtaggccttgggttaaggcaggttcgtgtgggttcacggccttgattaataatattgtatagctctagaatcgtgtttacaaaatagctttgagcaactaagtgtcttttaatgctgtttactgcaaaccctaaccctttatattataacccccttgtactcccttgtatttatcctgcacttgtgggtgtgtcttgttgagtacggtggttgtactcagttttgctcaatttttcccaaacccagaagtggagttcctggaagatgaaggctttggtgtctagctcgtggatgccgtcaagcgcctgtgatcgtcgccctagtcttccgctgtttcccgtttgtctttgtgtgtgctgggccttcgccgcccatgtaataaattaactatttacgcttccgcttgataaactctgaaatgtatcaacttttggtgtaccttgcctcctgggacaaggaataatacacgcacgtaaggaacgcccgttgggttaattccggtcgtgacatccaatgacttgattttctaggtattgttcttctttttatacttataactgcatcagttaattttgatcttataagtcgtgattaaaatatcaatctctagcctgtttattggttgccgattagggtttcatcggggtttcaaccgatcttacctgatttgattattttgtttactttatgtttacttaatatgctaaatctgccctttatgttaagatctcactgtaactaaatatattaaacttgttattaatacgttaatctaccttaacacttgattaatccttatttaatatatttggtctatattgatatcttaatataaagtagtatcagggtattagccgatacatgttatatctacaacatcggctatgctatgaacatatataatctttatattgaagtacttttatacataagtgatttatactgtctcggcaagctgtccgatctatcccaatcacttagtttaaacatatttcgatgtatagattatatattgttaatatctacagccgatcgactagatctaactttctttatgttttatataccattgccgatctaattcacgttatatcggctagtctacaaacgatacgtcatcggcaagtggtcgatcggctatcgtttatgcatttaactatgtttccttgtttgtttcttgttagttgcaggatcaaaccaactggcacgccctttgacccaaaagcaagattcggacctacactagactcaagcaaatctcttaggccagtgtgtgtttttcgcatcaacatggagccaccgtcctcctctaccgtgcctttctccctcccctatctgtgtcacaagaaagaagaagagaagaagaagaaatagaggaggaagaaggagcatctgatagtgggtcccacataaacagtatcttttatttgattttatttcaatttcaaactttagacacccatatctcttcaaccacaaacccaatcccagaaattctttgatctaaattcatctaattccaaactctttattttgataccaaattacctattttaaacattttatttaaatttctttatttatttaaataccttttatttatttacattctgaatttaaaattgttttaaataaccttgttaaattattatattttattcaaatacctttttaatttattttatttatcttaaatacctttaaatttaaatctcttgttttatttaaaaaccccttttaaattaaattttcctataatttatttaaatacattttcgtcatttaaatatctttatgatttaaaataccatttcaaaattctttattaccctttttgaatattcaaatttctttaattaaaaacctttttgaattcaaattcctttgatttatttaaataccctttttatttctaaaccatacctataccatcccatagccactaaacagccgccgtgagaactttacgctttccatggagacattcacgtggtctcaaaccccgatgtcaaaccgttggtcgtaaaacccggcataagctaatcccaaggtcaaagtattgctcctcgcaccccacgccttaacgcgtacagtggttggagcctcactactccatcaacctccatagcacgccgcacactagctttcgggctctgtgcgaacctagcagctttgctacaactcacagctgtaaagtaacactattccgccccacaaaccggcacaaacttcccaactctctagccgttgtgttgtttgactgtagcatcaactagacgagccaatatttagccgtgatgctccccaaccttagcatcggctaaccaactccaaatatctagccgttgtgctgccctactctagcaccgactagaaaccaaatccaccaaataaaccccacctatccaaattaccttttcttcaattttatttgattcccaacctatagaaaccatcacctctcttttgttttcaaattaaaatatattttgaaccattcctttttccttcgccttgctccaattttatttatttctcggtttatcgtttctttgtagcatttttcttataggctttatttgctatctttttggtattcatacgttagactgtacagcaagatctatcgacatccaaggagctgacgtggactcagatagctacgttgaagccgcaggaaacctcggggcacaaggcaagacataactaaaattttgatcatatagaaaactaattataatcttcatatttaatttgatgcataataccttactcttttaacatctcatgggtagatgttaaacgatttcaagcattattgcatgaggttatagaaagatgcattggttatcattttatgtggtttactatttcaaacatctttaaaaacataagaatccggttataatgggcatttatgagttgaggtcgtgaatgttgaggattgtgaatgttgaatgtttatgaatgatgaagtttgttggtatggaagtttggatgttgagataattttggtggtttaaccggattataattacccccttataccatggaaattacatagtttgtgtccatccacacgatcaagtaattggacttagcctagtatattgtcccactatatgaaagactgttggttggctcactaggagcaggttttggggtgaacgtgcgtaaggagtttgggctgcatgcttcacaacagtgggtcccatgaaagtatgatgataaagtaaccttgcttaggcctagcaagagttcaactactatgatgggccaaaaccccactgtgcactaactagtagtaagtgggaccttcgaacggctctgttattctcagcctctagctagctgtgggcatcgtgtgggtaaagctagatagtatctacagaggtgaaattaaatcattcgaatgcgctgtactcccgattttggagttgtgtcataagggtgattcatactcctgaagtataagtagttttaaaactaaaattttgagcacaaaaatgatatatgattttattactactcttttactttctcattgttttatttattcatatctctctacatttaattatttataatatgccttgttgagtacataagtactcattcttgcataatttaacatatagaggaattgtgctaacaagaagatcagaagatagtgaggtctaaagcaacaacgagtttttctaggcttgtctacactcgagcttttgcctatggagtttattagttgtaaattagtagtttaggaggttagtagttgggtagtttggattcttccttgtattttcaaataaggatgtgttagtttggaacttttaaacctttaacagttgtataattagcttgtatgatcaaatttgtataattaatcaaaagttgttatgtatattaatctgtgcgtaatcgaaatcctggacgatcacgagtggattttcggggcaccaggcctaatttaggtgtccccacatatatgcatacaaaaaaagtcaatttccattttagataaaaatcaagcttcattttagttttccattgaagttgaaaatgaaaaataaacagagtacaataatgcacatggaatccatgttggcaagaaatgaatcattgcaacggagaagaaaccaagcctcatttttatttccatacaaaataacattttgggaaaaatcagaaattaactgcgtagaaccatagctatatctttacattagatgaataatatattcagattgttcctaatgaaaatacatcaatatatattgtggtaaaatctagtaggttcactaaattaattaacttatgatcttgtaacatgtgtcactaatatttaacataaaaatagaacaagtaccatgcagtttgtctattgctcccattatggcaatttgaaaaggatgcttctcttcttccaccagttcattgtgccctttggagtagattgttttaatcaatttattctcaaatgatttgaaaaaagaagaagcatatagcagtaccaagctagcaccaacatgaccttgcatgacacgcttccgatgttcatggaagtttaggcaaatatatcaatcctctgtagccccgattgctgcagtacagcacccgcacgatctccagctacacatccatctgcgcacccttacgttggtatactccaccagctcagatcgccggcattgcacctgatcagaagccaagcctccataactgcaggaatcaagcagcaataaaatccggcttaaaacacaagaatccaaaatttgaagccccatcactgcataggaacagtgatcgatactctgcaaacagagctactctcgttctccaaaccgggcgaaatgcttcaggcacctaacaatttggccaagttaagcaccgcgaagacttgggtgacccgagttggagacttggagtcaacaaagcaaaattatcttttctttagcaaaaagaggataagaaaagaatataaacatgataccggtttccttaataaatctggaaattacctttggaatatccctgaagagtgagggaacgagcggtagcactaacctgctagaaaaatccatgtagctattgccggagattatggagggaatcgcctgtattcctccgccccgcccacccattcttctccggcgacggcggcgggggtcgcactcgcagcggtttccccacccgtccagactatggtgggcccaaacctaattttatcttggaataagttcactttgtgaccctgaaaaagtgatcgaaatctaatccgtgaccctaaaccacgaaaccggatatctcgacccccaactctcaaaaccggttttggagggcggtttcactgacgtgcgcctacgtggcagtattgactcggtctcctttccacgtggcgttgacgtggcgcttaggtggtattagaaataaaaaatactagaggatgccccgcacgttgctgcaggacttggttaacatcaatttgttagataggaggtacaatctcaagaagaaacggacaaaataaatgactttcttggagaaattctttttagcagccctatccaaattttgtagataatttagatagcacattcaaagcgtaagctataaagaagcaaaatggtctaacataagttaacaaattgtaatgtcaactaaaggggtgttcggccataaagctctttttatacggattgacgggccggatacatgtagatgtgaatgaagatgagccaatgtgttcatgtgggctacattttggcactgaggaggtgaagagactcacccggtacctgatgggttgggctctatgccgcgttccatccaacggctaagaagcgatctaatgcattcatccaatgattcacaactgatgatgatgtggaagcatgaggtttgaacttttggcattaactttatagaaagaagggatgtgtgggacctatttgtcattcaccaaaaaatatgtgtgggacctactgacatacgaggccgacgtaaatcatcctcctcatcctccccctctctttctcttccgttcgctgtccgtgcgctggcaggcgggccccgctcgctaggagcttcttctacctctgtccgtcgtctgttcatctctcccgtgaaactcaagcactgccgccttcgttgatctccctgccctatcgtttctcctccaaattaattgcaaaaatcggttccttgtgtagtgggcatcaatttccccaacaaatcccacttaatcccgcactaaatcgccctcaatcgtcaagcactgccgcacgtagggacgacgccgcggaggcggccgggagggagcagcggggcacgcgtcgatgtggcggccgaggaggagaaggacgctggccaccgcgccgcggcgggatccggcggggagggcgtttcttggccatggtcgtcgatgccggcggcggagcagaaggataatgagacggcatcagtagcgacgacgatggagctagagggacatggtcgtggtcacaagcggcggcgactcagcggccaagctacgacgcagctggtcgaagaagttgataagcagcaggaggaggaggcgccggcgccgacctgcagcatttgtctgcaaccctggacctgcaacggcgaccatcgcatctggtactatacgttcctgcatgcatgacacgtctcaattgatgagctactcgatcgattgttaattagtactaatttgataactaatcaattatatatatagtactatagtagtcctccttaatttatatatgttaattgcatgcatttcctctttcagttgcattccctgtggacatgtttacggcagatcgtgcctggagaagtggctgctacatgctgttcttcaacgcggcactggacaagcaaaggtaattactactccactaattaattagttgtgcgttgcttgattaatcagctagtgactatactgagcagtgtcctcaatgcggtgaaagttcgagccacagcgcattttttagcgaacgcgcaaaagaattgctcgtcaatatattagcatgaaaagagtttttgttacacaaagcaatcagccagactggcttatgcctaaagagggggaacaaagtaaaaagaaaacttgaagcgagaaactactacgacggttaaaaacacaactccaaacagcgggagggggtagaggcacgctacactccaagaaatccccaaaaaaagcaatgtcggctaaagaccacagctggccctccgagtggatggactccaaaacgactgcaaccgaagcgagcgcagagtcgaaaaccctggagtttcgttccttgcacagctgccaggagactaggagtaccaaggagtcgaagccgctgcggaggtgctcaggtaaacaggccctggaggatgaccaccaatcctggagccagctgccacgagggggagagagggcagcccagccaggaggggacatcacacggagccagacctgccgagcgaacacgcaatcgatgaggatgtggttcgccgtctcaaactcctgagtgcaaaaggggcaagcagagtggctatcgataccacgcttttggagaagatcggcagtccagcagcgctgctgaaatgcaaaccaaaggaagaacttgcatttagcagagcccttcgcgtgccagagtaggtcggcacaggcaaaagagtgctggccaaggaagaacgcccgatacgccgatcacaccgagtagcactggtcacccgtccaactccagacgaggtgatcctcaacacccggcgagagctgggtaggaagcaccgcgtcccagactaacaggaactgagagatgaccgggacagtgagggcgccacgtatgtcaccaacccaggagtagttcgctaacccagtagcaaccgtgcgcgatccccggaagcgtggaggcacggcgtggaggaggtcaggagctatagaagctatcgagcgaccatcgatccaccggtcaatccagaagagcttggattgaccatctcccaggatagagaaggtgtatgctacaaacatgtcggagacgctccgcttaataggggccttcagatcagaccagtagggatgccccgagcgctgaagccagagctagcgaacactcaaggcaaagccagccatcctgagatccggaatgcccggtccaccgagatccctaggacggcaaaccctcatccaggacacccggcactgtcccccattggccgagtccgtacccgtccacaagaaggcgcgacacttcttgtcaatggctttgataacccagcttggcaagccgatcgccacagaaacatagaccggaatggaagagagaaccaactggactagaaccgagtgacccgccagagtggtgagacggcccttccaggggggagccgatgggagactttatccacaagcggtttcagggccgcttttggcagcttgcgaactgacagtggaatgccgaggtaggtgtagggaaactccgagatcgagcaaggaaaagaggattgaactagctccaggtcaagaaccgagcagcggatcagcggatcggagtaatcgagcacttggtgaagttggtccgaagcccggaagcggcaccgaagacagagaggatgccttggatgaactcaaggtcctgccgaacgggggaaaggaagagaactagatcatcggcgtagagggatgcacgatgtcgaatagcacgataattgaggggaagaaaaccacccgagtcagaggctttgcggagcaatgcattgagcacatccatgactagaatgaaaagcatgggggaaagaggatctccttgacgaagacctctccgatgggggaaccgtggacctggcaccccattaaccagcactcgggaagaggaggcactgagaatgagggagatccaatcacgccaacgttgactgaagccaagctgggctagcacctcaagcaagaaaggccagctgaccgtgtcaaaggccttcgcaatatccaccttgagaagaagtcggggaacgcgtttggcgtggagcgcccttgccacaagctggacaaagcggaagttgtcatgaagagagcggcccttgatgaaagcgctctggttaggcgccacaagctcgtccaggcgaggggagagacaagaggctaagatcttggagaacagcttcccaaagctgtggataaggctaatcggcctgaaatccttaacgtcaacagcctcgtccttcttcggcaagagggagatcagggcgtcgttgagggaagtgaaaccttggccgttggtcaggaacaaggagttaagggccaccagaattttgaccttgatcaccgggcagcaagtcttgtagaaacagcctgtaaaactgtcaggaccgggcgccttattagagggcaaggacttaatcaccgcccagacctcatcctctgtgaagggacagtccagcccctcaagctgcacagggcagaggccaagagagtggaggtctagggcgagttcacgctcgacgctcgtccccaaggtggcgcaaaagtgagaggaggcaagctcttgcagcgcatcatgggagatggcaagctggtcaccatcacgaaggtgcgtgatgaagttcttccgcctacgagctctggcgtgcaggtgaaagaacttggtattagtgtcaccctccttaagctagaccaaacgcgaacgctgacgcgtgatggtacgctcaagtgaggcaagaccaagacacttcaactttaaatctcgccgcagccaggtctccaagggggaaagagaccgactctcctgcgcaacatgaggccggaagacaagttccttcgccatctgaagctgtagacgaacactgccaatgtgacggtcactccagctctgtaagcgcttagccgtggtagagaagcaccaggcaagagcagcaagagggggtaggttggcagggggatgccaggcgtcctgcacgacttgaagaaaagccgtcgaacttgggccaaaaggccttaaaacgaaaacgatgcgcttttggggaggtgacgcaggtatgaaggagaagagcacagtgaactgaggcgacagaagaggccgcttggaggaggcaagaggggaaaagctcctcccaatccgcagagaagaggacgcggtcgagcttaacaagcgtgggcgactcgcgctcattgctccaagtgaagcaacgtccgtgaagcggcagctcctggagttccaactcgtcgatgagccgacgaaaacgacccatcatatgacgattgagattaaggttgtttttatcccgagcttcgagaatgaggttgaaatcgcctacgatggcccacggccccgtgcgagaggagcgtagtgaacgaagctcatctaagaaacgaagcttgtcaggctcctcctgtgtcccatagatgatggagagccaccagggggcaacatcagaaaggtgccgaaccaacgcggtaagagagaaatccgcaaggtgaacatctgagatagaccagacggtcgtccgccaggcaagcaacacccccccactccggctgaccgcaggcaagaaagaataatcaaactcgaggcctagcgcattaccaacctctacgcgccaggaatcaatatatgggacggttgctgcaaaaaccatgcgaatgttagttagttaattaattagtactttattatacattgtcatgcatgcatgatcaattaaattcttgtgcacaggaggtaggagagtattacaaccgtgcgtacgaggggctgaaaacacaaatggagtcgacgatcgccgaagaaggcgcttcggaattcatctcatcctttataatataatggtactttttcttctttgttcagcaataacttaatcttggaataaaacactcgtgaaggatctggaagaattggatgggcttgtgaaatcggtcggcaggcagtttgagagccttgaatcatctgtcaagacattcctgctatcaatgacggagcggatgaagaagatggtttcacagcggcctgccatggatctcgttcaatatatcgagaaggatgcccatgaaatcgtatccgcgctctcccagaaacctccataatcatcatcatccaatcgatcctgcgtgctagctcatatgtgctagcttcttgtggtggggttcgtttaatttgtagagagcggtgatataagaaaattacttcttgcaactgaattctcgtttggctctagaattggctaatagctatatatagcctgggtgattttcggctacgacctcgatgctggcacggtcaccttcgccaccgcagactgtgcggggagcagccggctggcggagcagacaagcggcgagcaggcgcgctgcgggagaggaagatggcactgacagggagcgggatggggagagcgaggacgccgccgccatcgtcgtccacggccgcagatctcgcgcccgcgccgtcagcggcgtcggcggtgggaatgtgtgagcgcggggcagcggcgagccgagcaggcggtggcgggcggagcgggcacgacgccgaagacaacttcttcccgcgccggcgccgccgggcgcctctcccatctcaagcgtcgcagccgtcgccgccttccttcttccgtgtcgccgccgccgcctcccgggcctgtcaaatggtccgaccccgaggtcgcatgcgccgccgccgtcgccgccggcggtggccgccggacctcctccccacccgccagccgccctgtagagaggaaagaagtcagagaaagagatgaggaaggaagagaagaggggagagataacctgacattctgacatgtgggacccgcgtgggttgcacgctgactcagccgccacgtcagataaaaccgggagcaaaaccaccggaggatgtaaactaacgattttattagttgaggtacacccggtatctggttttgcggttaggggaccattttgtaactcgatgacaagttgagggaccttcggtgtactttttccattagatttcgattagttttgaggttcaaagtgaacttattccttttatctttcgggccaaatattcatgggcctttatggatccaaattcttttgggctattcctactcagtattctacttatttgatgggccaaaaggccgcaaattcgccgccgtgaagctctggatgctgtttctctctctccttcctcggcgcacccggccgccggccatccaccgccgtcgcatccaccggccgccgccacgcctcctcctcgccaccacttcctcctcctgccgcgtaaccactaccgcctccacgcaacaatgccctccatctactctcgccctcctcgccgaccacccgcacccggccgtcgcggagttcccgcgcgccggcttctcccgcctcggcgaccaccccctcctcgcccgcgccatccacggcctcgccgtccgcctcgcactcccgctcagcgccttccaccgcaacaccctcctcgccttctacttccgccaacgggatgcctccgccgccgccgccgcgctccacctgttcgacgaaatggccgaccggaccccatccacctggtacaccgccgtctccggctgcgtccgctgcggacgcgacgggacggccttcgagatgctccgcggtatgcgggagcgtggcgtcccgctcagcgggttcgcgctcgccagcctcgtcaccgcgtgcgagcgccggggccgggacgagggcatcgcgtgcggcgccgccatccacgcgctcacccacagggccgggctcatgggcaacgtctacatcggcacggcgctcctgcacttgtatggctcccgtgggatcgtgtccgatgcgcagaggttgttctgggagatgcccgagaggaatgtcgtgtcgtggacagcactgatggtggcattgtcatccaatggttacctggaagaggcattgagagcttaccgtcagatgaggagggatggggtcccatgcaatgcaaatgcgttcgcgacagtggtcagcttgtgtggatcgctcgagaatgaggtgcctgggcttcaggttgcttcccaggtcattgtctctggactccaaaaccaggtctctgtggcgaattcgttgattaccatgtttggcaacttgggaagggtgcatgatgctgagaagctctttgatcgaatggaggaacatgatactatttcatggaacgcgatgatatcgatgtactcacatcaaggaatctgcagcaaatgttttctggtgttttcagatatgcgtcatcatggattaaggcctgatgcaacaaccctgtgcagcttgatgtctgtctgtgcctcctcagatcatttcagccatggaagtggaattcattccctgtgtctcaggagcagtctggattcatcagtaacagtaattaatgctctggttaatatgtactctgctgctggaaaattgagtgatgctgagtttctgttctggaacatgagtagaagggacctaatatcatggaacactatgatttcatcctatgtgcagaactgtaatagcaccgacgcgttgaagacactaggtcagttatttcatacaaatgaaagcccaaatcacctgacattttccagtgctctaggagcatgttcaagtccaggagccttgatagatggcaaaatggttcatgccatcgtattgcagttgagtcttcagagaaatctactggttggtaattctctcatcacgatgtatgggaaatgcaattctatggaagatgctgagaaagtttttcagtccatgccgactcatgatattgtcagctacaatgtacttattggtggctacgcagtacttgaggatggtacaaaggcaatgcaagtattttcttggatgagaagtgcagggataaagccaaattacattacaatgataaatatccatggttctttcgcatcttcaaatgatctgcataattatggaaggcccttacatgcatacataatacgcactggatttttgtcagatgagtatgttgctaactctctaatcacaatgtatgcaaaatgtggcaatttagagtcaagcactaatatattcaatagtatcaccaacaaaaacattgtttcatggaatgccataatagcagcgaatgtccaacttggccatggagaggaagctctaaagctcttcattgatatgcagcatgctggaaacaaacttgatcgtgtttgcctagctgaatgtctgtcatcctgtgcaagcctcgcatcattagaagaaggcatgcagctacatggtcttggtatgaaatctgggctggattcagactcatacgttgttaatgctgcaatggatatgtatgggaaatgtggaaagatggatgaaatgttgcaagtggttcctgaccaagccattcgacctcaacaatgctggaatacgctgatatctggttatgcaaaatatgggtatttcaaggaagctgaggaaacatttaagcaaatggttgcaacgggtagaaagccagactatgtaacgtttgttgctctactctcagcttgtagtcatgctggtctagtagacaagggtatagattactataactctatggcttcttcctttggtgtttcccctggaataaaacattgtgtatgcatagtggatcttctcggacgcttaggtcggtttgcagaggcagagaaatttattgaagaaatgccagtcttaccaaatgatctgatatggcggagtttgttgtcctctagtagaacccacaaaaatcttgaaattgggaggaaaaccgccaaaaagcttcttgaattggatccattcgatgattcagcttatgttcttctgtcaaacttatatgctacaaatgcaagatgggcggatgttgacaaattacgaagtcacatgaaaaccatcaatataaacaaaagaccagcttgcagttggcttaagcttaagaatgaagtaagcacctttggtattggtgaccggggtcataagcatgcagagaagatctacgcaaagttagatgaaatgttgctgaaactcagggaagtaggttatattgctgacacatcatctgcactgcatgatacagatgaagagcagaaggagcagaacctttggaaccatagtgagaaacttgcgttggcatatggccttatcgttgtcccagaaggatctacagtaagaatattcaagaatctcagagtctgttcagactgtcatctggtatttaagctggttagcatggtttttaatagggaaattgtgttgagagacccatataggtttcaccacttcaaagtaggatcatgttcttgttcagatttttggtgagatagtcgtccacaaatgggctattggttcaatgtttaagtttgagcatgcctacagaagatccttccacaccccaaaggacacagaacaaaaaatgataaagatgagaaattaactcctatctccctttgcatgggaacagtgattgtcattactgcgcatatgtgagtgcctttagttctgtttccactttccagtacattgatttttatgttccatacttggtgcattgacaagtagtgtcagatgggagaaattgatcagctgattgcatggttcttttccacaattggtgtctttgtcagatttcatagtagagtcggtgcaatgacaacaatgggataatgttgaccacatcttttgcttttggacaatgttgtcacactgattcatggtatcatactggtcttcttttcatgttgtggttggtgtctctcaattctctacagcctcaaaaagtatttctgagactaatctgttctttttttttcgtctgcagcaaggatcagcagttaacacctctagtagcattgatgcttgtttggaaccttcgatggtacttggctgcacgaatccttttaggatttacaaaaattatatcctggggaagtgttaactgacacatagatcaagattatgctaatttgatttcggaccctagctctgaggtgagacgcaactggatgaaaccactggatgagtgacagctctgatatatagtataatcatctctttggtgatctctgtaagtatgtctcagccaccttttgttgcttatgtaatgaccatcagttgttaatataatcaagtaaacatcttaacacaactaattcaatttttttagagctcacattcacatatgtcttcatttagttgttgggttgttggaagtcatcctatctatacagtggcatggacagtgattctgtagcaggctgtgtctgcagtattggcaggctgtatctgcagtatagttgtactgttggtcgaatccgccgtatatatgcttgatgggatttacatacagtgaataagaggacatggacacctaaattaatgcgtgcaatcaaattgcttgagaaactgtgtggcctgattttgaaatttgtcctcacaagaatgtcacagttcgaaccaccttattctcatctactgttgatggcttgctgcggctgcaacttgcatactactccacggatacactaaaatgaaggaactgatcaataattgacatgaaccatgccattcctatccagatctcaactacatttccttgcaacttaattgagtctgtcctgggagcagttgcccagggaattcaacagaatgcttgttgtccatgattaaatcattgtgtcttagctagccttgttccttgcatcccacacatcttgtttaatttctgctctcttctacatttgcgtctggcacttgggatatgaaattcaaatcctccaggctatcatgatcccttggcaatctgacgggtggcttgaacaaagaactcgattgtttttatgacttctccatgtttttttcctcctattctctccttgagaaaattaatgcaattatatgcaaagtcttccatgtgttcctagaaaaatgattaaatctgttactactacaccaaagagctgatcttgtggatgctcttcctggctatgttatggatatctgaaactaaaaatctgaacttaattagtgttaagtctgcagttaaagtttccacggtacaactcaccgtaattactgattcagtacaaaacattttgctttttcatgcagggtcgcagcagaagcgcggcagttcaattatcctggacgagcgccgtggtggtcctggcagttcaatcaccgaaaggagacagtacgagcaagaaacaactggtttcatcaaaggtttgctactcagatttggtctgtccattacactagactacaagttttggagatctgattctaccagttcagtgtgggcacgcaagctgagcacacatgtatagtacataagtacatttggggatcgaaggagctcgtgctgcaacagtaataacatggtactgaacataactgttcccctggttcagaattcgatcagggcctctcttgtgggggtccgttcctgtgctgaacctttattctgttggtaggtagcatgtgatccaatcctgatcaccagctttttttttcagatcatgaggagatcagacggcgaccaagatgtagacgaattaaacatgacatcacatttttgttctctcccctcgtaagtgcgtacaactcggcggtgcattaatacagtactactagtacgtaactaccactttgttcatagatcatggtccatgattatagattcatggcccatgatgatagattgctttgcagcgtatgggctaatggagatgtgatggctggtgctgaaatgctcacctcaactactgaactttgaatgcacagcactactactacaagtcaagtagactcctgttcgttgtactacgtggtcaccggaattagcaggggcaggcagagtccaccatgatcaggaagctcaagcatcgtaggctgatgaactctgagccgacatgaacgcaaccaagcaaagcagatcagtgtgcattgcaggtcgacgatcgacgtcgaatgcatgggtcgatggccgctgttttcattggggtcgttgtttgcttgagatagagtgtgatacatttacttcctttccctctgagataggcgtcaatctatgcatgaatgtcatgacagtgagaggttcttgattaattagttttatgctagaaaatgattgtgcaacgatccttatgaagttatgatccattaatcgcttccaccgtctttttgttaggcaccatagataattgcctgacaatgattagtagtgtcacacgttgtgcttagctttgaacattaataaatttgattaataactgacaaatagcgtttgtagtccaacggttagcataattgccttccaagcaatagacccgggttcgactcccggcaaacgcaattatttgcatggttcttcctttttcacttgcctgaaaccttttctgattccttttaaagttcatcctgtccattttaaatacttgaataaaatacataatggtcttttcatgtctttaatttagacactttttcacttgcctgaagccttttcagcttttctgattccttttaatgttcatcctggctatttaaaatacttgaataaaatacataatggtcttttcatgtctttaatttagaccgtatagaagatcatgaaagccttttctgattcctttttaagttcatgatggccattttaaatacttgaataaaatacataatggcattttcatgtcttcaatttagacagtacagaagattatgatcctttcaaaattaagagcgacagtttattatgttttgtgctggtttacatattctagtataaatgttttattaaatgagatagtggcatgtggattgcattgttgcttctctattatgtcatcttcatggaatggacccatgatagattgcatatttcttccaacagacaggagtaatgttcaaacttccaaaaattttatctttcagctaggatatgccagtcttcataatgaacaataaatagttgataaatggtactcctagatcactttccattatatgtttacccaaaatttgtggtactacaagtccaagatgctccattttctccttttgggattttcttcagagagacagcaagtctatgattcccatattcactttcatttaataggatgtcagagtatgtacaataattaatagcaggttctttgagtaggtaacaaggtaagtttgctgatatacttactctgtcccacattaagtttatttttagagtaatcaatgcatcggaatttgtaaatgtagaaaataattgtatttagaggtggataaaatgatgaatggttacattaggatttgataaagtaggtgtattctagtccttttcttttgtattgatatgtgtgtaatggataaaaaaataaacttattttagaacataggtagtagaaaaaagaggaggaaggagagagagagaaacatactaagagtaggtacaatagcggactataagccaaaactataaacatatttcgaggagataaatgaggagagaggtgagcagcagactacagatttatagccagctgtagcactaacttcaagatggcaatgtttgtatgacaggtgggaccaggtattaataatatagtatatatattcataggtaactattgtatgaattaactattaaattgactatagatgatttggagctagtagctggctatactattaaacttgctctaagcttaacaatgacttaacatcaattcttagcatttataaaaagaaactttgcttggggaagagaaaagaaagataataaaaacttatcttagttcactaattattatagcctttgttatctcaatggttataaaatcatagtctacaaataaactaaaagactatatcagactctatctttgaatatgccctaagaaaatatacatagattttttttaaaacaagcaaattgcaacaatggtcgagcatacctaacaaattaaatgcactaattaattcacacacgtagtagtactttctctacaagctccttgatggtgccagcttcttgttgtttctatacaatcattaatttgattaaaacacacagaagaaatcaacctgatgaacacaccagccaaactgaagcaagaatgaaatacagtataaacacacaccaaattaaactacccagcaacataaaaaaataattaaaaagataaaagaacaaccgaaatctatctagaacttttttgagaacttttttggctaatctaattcataattattgcatcttcttcttccccggagcagagtggttgtcttgggtggtgttgacgacgccatcgttgccggcgagcatgaggtacttgtccttcctggtgagcatggtgcagcggtagccgagcgcgtcgcccatcctcctctgcacgaggttggccacgtcggtggacggcgccctccgctccctcgccggcgacgtgtccaccctctccaggaactgcacggcgtagcacgtcctcgggttggcgatgtagtagagcgggtccaggcacttgagcccgccggccgtcgtcgcgtagaacatcgccgtgtcgacggcgatcccgacggggaccacgtcgtcgctcagctccgcgaacagcgggctgaaccggagcaggcacggctcccggcacgtcgtcccctcggggcagacgacgacgaggtcgccgccgtcgaggagccgcgccatggcgcgcccgtcgctgtcgcggtcccgcgtcagccgcaccgtccgcccgatcggcgagatcagctccgacagccggctcaggctgtacgacacggcgcgcacggggcggtccagcgccaccgacacgtacaccgggtcgatcagcgtccggtggttgcacacgaacagctgcccgcgccggcgcgcgccgtcgccggcgccggcgagcggcgtgggggcctcgcccttgaggcgccacgacaagcccgtggcggccaggatcggcgtcgagtacctgtacggcacggcgagcgcgacggcgaggcgggcgacggcgagggcggcgccgaaggggagccaggtgaacatggcgagcgtgtcgccggcggctggccggaacgcgaggcggccgtcgtggaacaccatcggcttcgggtacttgtcgcgcggcagcgccgaccacctcgccttctcctcacgtgtcaccaggtacacctcctgtgttgtgtgagtgagtaattaataattaacttgtcaaattaaatacagattttttgcgaatacgtaaaaggattgtacgtcaatatattagtaagaaatagaggttttgatacacaacgcaatcggctagacatacgtatgctggaagagagtaaaaaaaaaatcactgcaacaaccaattgcgaaaagaaaaggactactgcgaaaaaaaaaactactccaacaaacaagagggagggggtggcaccacactatgctgctagcaaatctcaaaagtggttggggaaataaaatgaaatggaatggaatggaatgcatacagtaattcacatgagggaaattaatttgaaaatagtggtattggttgtatctcaaattgttctcaaatttaattaacgtggggaatggaactgttgtgtgattaaatggtcaatttaattacagatttgacaagatggaatgcatacagcaatgcacatgaggggaattaattttgaaaatagtagtattagttgtatcaaattgttctgatcaaatttaattaacgtgggaacacgaaactgttgtataattaaatggtcgaattaattacagatttgacaagatgaaatgcatacacagtaattcagatctcaaattttataacgtgggaacgaaactgttgcatgtgtgattaaatggtcagattaattagagatttgacgaaatgttgtgtatgcactatacagtactacttcacatgaggaaaattctctatttctatcaaaatattctctatttttttggaggactatcaaaatattcttaaatttaattgacacgggaaagtgctggggagtttgggaaaaggggtaaaacctgtgacttgatggtaaaggtcacattctttctgggaaaattaatgagtggccgtctaacagtaacagatattatgcttttgttggtctcacatgatgagatacaaaaagaatacataaaaagaggaaaaaaagtatgtatatatgatcaatgattgcacgatcagcatgagaccggccgttgaaaagacgtcgtgcacgtaattaactattacatctaattttactttcaggtgtaaatatgcagatattatatacgttgtttcaatccaatcacgcgtattacatgcatgtctaatacctgaactagctaaatcacacaaaccaaaaaggggagtttatacatgtaaaactagctaccttagctaggtgatctaaactcacatgcaagttaagtcaaatatatatatatatatatatatatatatatatatatatatatatatatatatatatatatatatatatatatatatatatatataacaaagtataagaattaacacaaacatgcaaattttacatgttgaattaattacttatgacatattataccttgcaacaatgtgagagatgatgttggaggaactccaaggaggtagagaagcccacaacatcaaccaacattttcttctcctcaagcaacacctcctcttgatcaccaccttcttcctcctccatgatgccagtgaagaacccccaaatcaccttcatctccctacctgaaacaacctcaacctccaagtactccttcaagaacccttcaaccatgatcctaggcatctttgtcacacacaccctcctcatggcactcctcatcacatcaaacccttcctccccaacatcctcaaggaaccacttgggaagcacggctcgcccggcccgaaaccggcttgcccgtaaaccgcagaaggacaccattgccatgaccttcaaggccatgtcacttcccatgacacatagcaatgggtagaggaggaggagcacaaggcccctcaagaaccctcctgcctctagtgccacaagcatgaagtaggggaacaaggaggatgatctaagcaaaccgccttcgacgtcgagtactagggttttcgcggcgagcttctccatgggagggaagcttgaggaggacttgtgcagcaaggaagggtgtggcaatgtggtgttggtgttggatgatgatctagagataggcttcccatgaaggagtagggataccaaggcagagaacagcctatgtgacagcttcttcttgggcatggtgtactgttgttggtggcaagctaggtatagtatggtagaggaagaaatggattgaattgtggagaggtagatcaatggtcccttcttttataggacaagacaacacttggatttcctgcctgatcatgcatgaaagagctagatagatagataggtgaaagttccatacttattactagtacttaattttcagggaccatatgcatggcatgcatgcctacatggctgtccttctcctttagtaacaaactctgaaataaataatgcacagtttactttcttattcaggatagcatgttagatatttggtcatagatcgcacactagatgtcttgatctcattgagaaccgtccagcatgagctagtagccatagtacatgtatattcatggcagggaagaaagggactgtagaactacagtaggtgtgatcggcttcaatttttgttcaatctgacggttacattgtcgccacatgtgcaagcagtcggtataccagcttctcacatgtacaagcacttgtacattagtactagctacctggcctgcaggttcagtctgaactctgaaccatgaatggcctctttgttcttcagttgatggatgaatgctattgattaggccagcacatacaggtcaaaataccgttaagatgttaagttctatctaggcagtaggcacaatcaacagctgccgaattgtgagaaatcgcagcaggtttggtctctgattggtacatgtgaaacaacagagcaggtactgcttgaactttttcctctgaataacttaacctgaacttgtataccacgtgtcatctggaattatgtgggtgtttctacactccatataactaaataatcattatacacggtggtggccaatgatttgtgcgtgatttgcgtgccaaagttggcatttttgggttgagaacttgagatagatgcagcatgcagccaaaggagtttgttagcgtgcttggaagaaaaatgtatgagtaccacaagaaagagatggagactgcatacatgcaacaagcatgaatctatcgctgacgaggtgcaaccatatcatttcagatataatcacaaacactcacgataagtcgagctgactaatgatagtagaatttttaatttccttgcagatctaagaagatcaagcagtaaagaagttcatttgcttaattgtttgtaatgaaaaacaactaggggatttttctgcgtaattttgcgtgagattgtaagattggacttgttatacgtctatttagatgtgtctatttacaacatatattaaaactaactttaaatttaatatacaattctaattctatatatacataattatattttgtatacaactattattatcgatttacactgttataatttggtttcatcaaaatctgtctaacggtttacaatatatttttctccagctttctccacggtccacagagaaaaaaaattgaatgactgatgctgagtaattttagacctacaaagcgaatatgttttcgatctattcgtatagatagaaaagaattatgttttcagtctccacgcttgccctaggtgcagtttatccgctttaatttgtggctcatccgatatgtgtggtgaaaaaaaattaaatgtactcagtttgcttttgtacttactttgctttggctcgtcgcaggaaattaattaaatgttgaacttgctttgttaactgacaccaaacttcttaattttcataatggagtactacacagtgacagtgcctgtaagattcaagaaacagcggtgctaattgaaacagtactgtttatactctaagaaatgcaaacagtacgttgcgtatgcgtcagtgatttaacccccctcgtgttggtaggtggctgttggacataattaagtaccctacagtctctcgtaaacactctctgtcttttgcaatgcatcacggtaggagtatctcctgctgtgtttcctgtaaaaaagaataattaagtactctctgttttatattataaatcatttgattttttttcttattcaaatttttagatttgattaaatttattaaaaaatttaataatatttacagcaccaaattagttttattaagttaatgttgaatattttaataatatactttttattaaaattattagtatatttttctataaacttatagcttgactaagaaaaaaaatcaaacgacttctaatataaaaattagaaaaggaagaagtatgataataatgcagtaaaacatgccatgtaagtattgatttaatctctgctcagcaaatttcatttgatatatgtttcggacgaagaattattgttccatttctccttcatattaaagccaaatattaagccatcaattaactacatgatcagccacaactctttgtagcacgcctagtacatcagtaaaatgttggtcggacatataactgtccaataattaggaatgcatgcaaattaatgagatccaagttcagtcgaccaccctcaatacgtccccatcattttagaatttaattcaaagttttcttttcactcgcaggtttggctttagaacagctaagaatatgtaaatataaaatcctcaacggtgataattttgtggtaccctaaaattatttttatcaattcaattataatatgttgttgacttataagctatcgtgaggaattctttttcatcagtttattatatgtactcgacttataagctacagttacgaaaaaatagaatatgatgaaaaaaaggaaactaaaatcaaatttatattaattaaatttcaaaatttgagtactccatctaattcagattacttgcattctaggttaatttgttctgaatcaaatatttcaatctttgaccattaatttctatgcactcatatggtctaatattacaaaattttatacttttagcttcatcgtaaagaaataccttcataataatacataaatcatatgttgttaaattatacatacattcctaagaattaatgatctgatcagacaaatctaaaatatgataataattaatttgaaaccgaaacgagtataagctatgacaataagttaacaaagcagacgatgagaagtatgacgtgctttgtacgtgcacacttacttactagtggtagtttaattaggggttataagttttcatatcccacaagcaatttgacacatctgcaaccaaatttacataagcaactatattgtcggagcagcacggcaccaacatggccggccaaggtggcgccacaacggctgcctaacatgccggttaattcggcagagaagcaactttgcacgtacgccacgtcatcgaccaacatatatatgcacacatttcaaagccggagcactgttaaatttcctcccagtgattgggaccgtcttgtccctgagcacaacctaattttgtccgaacctaatactccttccatttccaaacatttaatacgcactgttagttcaattttgagctaaccaacatcacaacatcaaacaaaaggagtatattactaccatattttccaatacacacttttttaatatatataatacagttaacttttatagtttgtttgaccattcgtttttcttaaaaatattgaagaaaacaaacaagcatacacgttttaaattagcatgacaatgtgataatatttttttacttcacgttactaaataatttaacaaaatatttctgatcaaagtttcaaaaaataattgtgttatataatattaaaatctaagctatgcatctcaatctgtggtcaagtcaatggtggtatgcttggataatgacttcgtgtactgtgtgtcaattcaacaccaaatagtttgacagaaacctgcgaatcttctgcaaaatattatggtccttttcagctgcaggggttttggtttctttcgttgctatagctgataactgtaccgtggttttgcacgtacgtcactgttaggttgttgctgcctttcacgacgactcaaaagagttgttactaactttttcaaatgttaagataaattaatatgagatatataattgcacaaacatattaagattaaatttaacttcgatgggttgtaataaaaggaacaaatagaggctgtgttcggcagcccgtggctgcggctgcaacgcagcactgccgctgcatcatagcgatctgaacaacgtgtgtactgttgcagcgactgcagccaccgaacaggcccagagttagtatgggcattcaaatttatatttattattatttgttataatctgtaaagttaaatttgtacttgtttatcgagtggtatgtcacatattaatttaaatgttgttattttttctaaaaaaatcgtagtatataaaataaaaaagcgagggtacattccctcagaaaaagaaaactttcccattgtcaaaatgataggattgtgaattgtgataaaacgataaggtccatattaagatgtgtcgccttgacatgcaggcaggcaagcacgagctttgcagttttcttcctctgaagcgacgcatcagtcagtgcacgattagcgcctcgatgacatgagtatctgctgatattcttgcaagtggaaagctaggttttttacatgaggttgattggacaatcaggcagtaattaagtgctatgtgctgtggcagagttgaatcaggatttctccagcctgctcaaaaaaaatcaacggatatgataggtaatctggaagcaactagctagctagctaaaagtgtgtttgactcatgattcatcaagctacttgatggatgatgtgaagtgaaggacaaaaaaaaattgcaaagaccagaacatatatatcaggttccttgaggggattaaagacgaattttgcttgaaattcaggcatttcagttcatatacccttcgtttgtcaggttggtcaatggtcaggctgctggttgctacagcaggtctgaaattgctgcaagaagatagctagcttgtgttgatcttttgatttgtcggtattatgcaggctttgcttatgggatacaaacactacttatcagatcgaggattgaattcagataatatttgaagatctgaactgaagggacgatgccatgctcctgttatagattgacattttcggagaaaaacatgttgcatatgcatacaaaatgtgattcatatgcagtccttatctcggggtttatgatgaaattaaagaggttatcaccgttgtttgtttgaaaatgtaagatcagtcaaactcatgtttccctctttgcttaggcaaggggagatgttccaagagaatttaattgtgcagacatggtatatggtgtttttgtttccttagaatgggttggatttttttttgtccttgttttggtgggatatttgttccaatcacgcttcgtttattttcccatccgtgtgcgagcctcccgccgtcaccgggccaaatcttagcaccgctgccacgtcaatatgtcccgctgccacatcaatatgtctttccgtgtgttttctcctccaattaattgcaaaagtggattagtttttcctcattatttttttcacgatttctcttttcaattcagctttaatttattagatttaatcttcatcgttgatgatggccgactggccgtttatccttagttttaattataatgtatagtggccctaatgttttaatttattgctcaactactcatatatgttgtatcattgaagaaacgtctttacccgttgcaacgcacggccattttttctagtcaacacccattgcaacgcacgggtatttttcctagtcaactttataagagaattccgccgtggcaactaacagattagatgtttttacatcactgacttgaaaagagaatttcgctgtggtaaataacatatcagatgttactacatgaataatataagtggagaacaatgcaatagtgaggtttagagtacgagatgcatattttgttttcctcgaatctcccaagagtattacatactgatagcaaacataaaattctctcaccaacatgttctatatataatacactagctagtagagcaagattgttgtgtaagagaagctagtagagcaagattgttgtgtaagaggtttcgatttagacatcaaattaagtagcatctctccatcatgcaattctgtcacggtaagttttgcgccttgagaacaagtttcctaacattgtaatcgtgtgtttgtgtatcacgcgagctggtcgcaaaggttgatttgcatgcgtattcagaaaagattcaaaataagaaaagaaaacagtgcaaaacagggatgatatagctgaaatcacattcaggatctgcatcgattttgtctcttccatttactctgaacagaactgcaacgaatatcaaaattttcttctcttcctcttttattacttccttcggagagaacacaaaaaaaagggttaattaaatggagaattggtttgcaaatctcgtttcgacccaatgcaactcataatgagccgtacgactacaggcccaaccagatcagccggactttcatgcggcctctgtgtcccactgaacgtcggcccaagtaagattttagggcccagcgcccgcaagcgttcactattgcaccattccggcccaactaaatttggaaaccgaggcggaccgtgttctcttgggaaaaagaaaatgagagagattgagtttgccgctgtatttgatcgctgcctctgcaaaggaaaccgtccattttacctttctcacctatagccccagtttaaatcacatttctcaaccctaaaatcagatagggagactccttccgctatcgaaactcccccgatagattgaatggtaattttgtcctttgtgaccagaaaacctgtgctaacgtgtcatcgacgtaagttccggttaattcaagagctactagatcaattgcatggttgggcagtcgtccttatgcacctagatgcttcagtacacttttgctaagaggtaatacgagaacaagagtgatgcaccctccaccgagatcaccgcctgacctggccagagtgatcggcgatgatgagggatcggagctgctatgccttctggcacatgcatgaccagctggcaatgacacaacgggagagagcaaggagggcaccttagcttagtgctggccagcctagccctagaggtggctagtcctgctccatcatcggctcgtgcgatgacaacggtggtcatccaccatcgtccccatcattgtcgccgcgtcctcccctgcgttggctaaggctcgagctcttaccgtctcgagctcggcacagaggacagtttcagcgatgcggtcagtaggctagtggtgcgataatggggaagcaacatcccacggcggtgctcaagtgatcgattaccctctgccgctggcctactaggttctacaatattatttttatttaagctaatcataacatgtgggttctgttgagttcttttatttatttttctaatcatattctctcatagacatatagcacgatgaacaatgtcacatagacgccaaatttatagtgaggtaggcagttaaattaatagctacgtggctctcaacggaaagtaagtacggcagacagaaggtgccacatagacgccaaatttatagtgaggtaggcacttaaattaatatctacgtgactctccacggaaagtatgatagacagcaggtgtgacaaccatgtccatcatcccttctatccccacgtttacttacatagatctcttggtagaccagggatgaactggacaccaattgatagatttttatttagtttaagcttagttaattaattcataggaatcccctctagtttaagcctaccatttgtatggtagaatcatgtttgtagatatacacatctattattcgatatccttgaaatactgttaggtggagtgttgcagcggtattcatacacttggatttattggtaactgtaacaaataccaataataaccaactacaaaacccagacatgggtatcctaatatgtttcactctaatatttcacctcaaaacaatattactcagacacatgtttaatttttttttgcggggcagacacatgtttaattaaaaccaatttacactattttggtgtcatgtagagctttctatgattatatacttacgtatttatatggagagatataatatgctagctaagctaatatctatcgataaaggtcaaaagaagaacgatctgcttctttaggagtagtgtatcggccatcaggtcaggatgcaaccaatcccattctagcctaacatgtgtagaactgcatatcaatcaaccaacgcttcgatgttaagagggagccttcaacactgtgttatcacttttccggcccaactaaatttggatgttaggaggcagcagagcttaatttgcagaggcagcaagcacatccatgggcgttgccgtcactgatgctggtgatcatgcatgcatgattagatcatgggatcatgcattcggctacaaaattgtgtgatcatgcatacatgcatttacagtgatgttccgatcccttgcagcccaatacttagagaactactagaagtgtaacaagacctgtcagcgcttctcagcccaactaaattttggcgcccacatatgtgtcatgacaccattctagcccaagtaaaatgtgtgcatgtagttgatttcatattcaaattaagtgctttgtaacacaaataagtataattaataattgtggtacacaaacataagaccagatgaagatggtaactgacatggcatcattgatcatatcttctatagaattaaataaattttctagtgttaaatgtgatagatccatcaggaatagaatacatgcgagtgtatggataattatttctaaaagatattgattatttcacaacaattatgtttgttctaagttataagtatgatcaaatcaataattaaggatagacatggccatttaattttgttctaccccaatatctcactcccgaccgcacacgtgactgcttgggttagtccttatttaataatcttacatataaggtaattgtgacatacaatagctactctacattccttaacgtatttatactgagattttgggagaagcatgcattcttcccttcatcccatttgtgtgttaggagtgaaccggttatttaatcaagcatgtatagatcatcatatcatgcattctgctacaaaattgtgtgatcgtgctgtcacacccaatctgataccgctgtacaacggtacctgacaggagcgtgtcgtaggaaaaacagtgcgaaccgcttcctacgaaaccatgatctcagtaccagtcccaggacatagcgctggtacccacggtgacaattatgattcatcgcaatccttaaaataaatagaggacttatttaccttaacttaggttgcagctcagaacagcccaagaatacaaccgacgacgcggcaacagggcatgggcggcgtcagggctgacgcggcggcgaccaggcggcatggcgcgcgtgcaaggagcggctggcgcggccaaaaattgaatggcgacgggcgggggatttggtgccggagtgacgaaggcggtggaggttcggatggcggtggcgggaaatcggcgccggtgagagaggagagagaacgagcgagacagaggggaaagagaagacggcgctctctcgctcgctccgagcacgtccggtgcacgcgcaggagagagctgggccgagaggaggggatgggccgggagagaggaacagcccattgacaagggaggcgaaatagactttgacaaagattgaatttggagagtattggagtttaggtttgaatttcaaatttgatatttggacttcgggatttgggatttggatgagagggaggagttgacgaaggaattccaaacggggatttggtattctcagaaccaagagaaatattggcaaggagttcaaggacgggattgaatttcggtgtttgacattgggagttgaatcagaattgacattttgaggagggggattttgatggcgatgagagggaacaacgggatttgaattgagatccacggcacgacttagactcgcacacaaagaaccaaatttttgaaattatgattttgccgaattagtttctaacgtctggctaaaagcgcgacgttacacgtgcaaacatgctttgacaaccgtattcccttgcggcccaaataatccatagattagaaatagagacatgacaagatcagccagcgtttctcagctcaactaaatttggccgcccacatatttgtgatactgctctggcccaattaaattggtacagctgggtggaataattaagagttaacgtaaataagaaacttcatacggttattttgaatggaaaataatgtctgaggtttaattaagagttaacataatcaagaaacttcatacggttattttgaatggaaaataatgtctgaggttgttcttagattttgcagtgatgcatgaacagatataaatgctatattaaagggaaattaataaaggaattaagttggattgttcttaatgaaactgctttgttttagaatatatatagtgttatattatttaagcttcaattgatgattcatctctaaaattgggtaattaatctatagctgcaggacatgtaaacaatgataaacttttggagttattcggtttggagtaaaaacaaaggatttggattttgaaggattaatctctatgattttttttgtttgtaagagcctaagcctggactaaagattccctcttacatcttataattaagaatcataaaattaggttagtatatatactacatgacttactatgaataaatttgcaaagtgctatataatttattagaacacatataaccccgaataataaatttttataatatttagcaaaagttgaacaagctcatgcgagtcgcttggtgggaaactgtgctggctgaaaacaacatgaagaattagaggttgttgtaacttggaatataattacgagtgccagattctatacttatgttactattttctatcctaagttacctattagcaaattaactgtttatacatgataccttgctagcattgtatagttcctataatttgtttcactccaatctctcgccatatacatataagacgtcacatatctcgcataaaattattaaagtcagagcgtacatttcttaattaacatagcatagttaccttatattcactgatctatttataccgaaacattggggaagcatgcatactcctttcatgggcgagtagtcatgaaccgatcatgcatacataatgcttgcaggcctaacaggacaagccaacgcttgtcggcccaattaaacttttttctgttcaaaattttgcacatctgaagagatctattgtcatatataaatacgtgtatatccaaaacaaaaatgacaacaattaactgtacaaagatataaggggcatttaatgctggaacatttgaaatgacagcaaagaaaccttaggctgtgtttagtttaacacaaagtttggattttggttgaaattaaagataatgtgattgaaaaattgtgtgtgtatgacaggttgatgtgatgaaaaatgactgaagtttggatccaaactttgaatctaaacacagccttacacatggaaaagcaattaattgtacactagagatttctgaaggcataaatgcaagaactcatctaaaaacatgagcaaaggtgcacaacaatgagcgcattgcgaaacagagcaggcgcacatatatatatatacatatatatatatatatacatatatatatatatatatatgtatacatatatgtatatacatacacatatatatacatacatatatatacatacatatatatatacatacatatatatatatatatatatatatatacatacatatatatatatatatatatatacatacttactgtatactgtacaataacagctcgatcggagcctgtttcttcattaatctcctaatggcagctaccaagaggatgtcctactccatcgcggcggttttgatgcttcttctgatcatgtcctccaccttctcctgctacgcaggtaagcattgaacccaacgaaagctatcctacccagaatttttcaaacatttaaactgattgtttaccctaacactgcatgtgcgttttctctgtgcgtgttgtttaatttgagtggttcatgatgcttcaattgcgttgcatttgcagaattgcagctaaagaaacgatggaccaagaaatattacagcactatcgcaaaacaatgtaataaaaaagtgaacaatctggcagttttaagagtaaaaatatgtcaaaattttgtctcttttgttatgactaaaaatgaatttaaatatcagatttcacatatagatgcaatactatttaaagtatatgtccaattttttctaaaatttttagtggcatttgttatttgttagttggtgtgcatgaaaaacttatgtacatagtatatgtttccctctaaatttcttctcacatttgtgtcacttctcatgtctggtgtcctgatcgaatgtcaaaacacttcccaacgggtgcccgatgcggaagaaaacatgggcgcctcgccattatatagggtttgaaatttcggttcgaaatttctgaaatttcagccccccaccagcatgctcaaatctcgcccaaaatttttggttttttgcaatgtttttgaatttggtcaaattttattcaaatacagtcaaattttcaaataattttggctcaaaatttccaaaatttcggtaacccccaagtataatatttaatttcgaaattgaaaaccctgcccttatcccatttccacattaagcgcttggtaatttgcattgccggtcacgagctagtctacaatattaattaatttccattgataagattaagactgatgagggtcgcgtcattgtttatcaaggatgtgccttttagtaattgtcgtatgatcacggcctcacgggcgttcgctcggctccaaacacacaacatatatacatatctatttgttcctgtctacaactccgtattctcatttagcttaagctgatcataccagctctcgatctgcactcaacgcgctaatccaattgagagctagctagggagagtgattaagattgtacggtattctggatcgacctgagccatggcatcgtccagcgctgggaagacgaagatggaggttatgatctgatcgatctatatggctgttctatatctttgattaaattagttgttgttagttgtttttaatttgttgttggccattattctctgtgttgtgcttgctgcaagtaaggagctatatatctatacatgtacattggttggctgatctgcagtatctgtaggttgcaacgaaattaaattggggacttattaaaaaaacttaatttcgggaaaaaattgtaataattctttcaaatcgatcaagagtggattctggttgaatgttcatcgaattgatggcaaatacagtacacagctagataacatatatagctatctaatactgtagtacactacttttcgtcttcccaacgctgatcagattaatgatgagctagctagctagtgcaggcaacgtcgaaggcggctattgaccggcaagaggtgcgagtgagcaccaccccgatccgggcggcgatcgcacgggaccaacggaaggacgacttcgaggtgctggtgacggtggaggcgcccaaggtggtggcgccggagaagcgcgcccccatagacctggtcgcggtgctggacgtcagcgggagcatgaacaaggaggagtttgtccggggaaagcacatgtcgtcgaggctggatcttctcaagatcgccatgaagtacatcatcaagttggttcgcgacgccgaccggctggccatcgtgtccttcaaccacgcggtcgtcagcgagtacgggctgacaagaaattcagcggacagccggaagaagctggaaaatttggtagacaagctcaaggccagcggcaataccgatttcagacctgccttgaagaaggcagtggaggtgcgtgcgtacgcaaaatttaactcttttaattgcttactactccctccgtactctaatataaaggattttgacatttttcttacactgtttgaccagttgtcttattcaaagaaaatttggaattattatttatttttatgacttactttattatctaaagtattttaaacacaacttttcgtttttaatatttgcacaaaatttttgaataagacaagtgaacaaacagtataagcaaaacgttaaaatctcttgtatcatgggacggagggagtatatcctccgatgaggtaagactactcgatccattggattaacctgtagtactaactagacggtgtaaacaagcttagcatatgctcatcgtaaaaaaattcaagcaattaatccaacaacatcacttgctatattttttaaattcgattaacaatatacaaaagaatttctgaacttcgcatatttgtacatataagaaatttaaattaattttatgataaaatcccatagaaaatttgatattaggacatgaacattcagaatataaagaattcaagtgcttataacaactttcaggtattttgaaaccggacagtacttaattttattttaacacccagaatttgatattttaaagtacaaattcgttttgatgcatttcagtttctttccgtactactagtttttgtagaacttttattggtagcgaattcaaataacggactgctacagaacggtatcccgtccggactagatacttgataatgtcgtatcaacaccaatgttaatgtcactatatacgtacagttcggtaccatgcatatgtggtacctattagtaccgaacatgatacctaagtaccatgtctgatatcctagataacacgtcaatgatgccatcactatatacgtccgtggtaccatgtgtaatacctattagtacagaacatgatacctaagtactatgtctgatattctagataacacgtcaatgatgccatcactatatacgtctgtggtaccatgtgtaatacctattggtatcgaacatgatacctgtatactaggtctggtattttataggtaccaagtacgatatatacctctatgtaccagccataatatttcgctactagattgatacctataggtactagattcaagacctatatgtaccaaagtatcatgatacaactaaaatatcattgcaataagaacaacaaatcatatgatcatcaagagagagctaaaaaaaatcaattccaggaaaaagttgctatggatgtagaaacacccatagaacatgtagaacaccccataatcaaactccaaaacaaacaatgcaagagcacagggtcacaagcccagatctggatgtaggatccgcaccttgagaagccttgtccttgatgacggtgaccttatcgacgatggccacctcctatagaaaatggcaagcagctctgtgttccatcatgtgcttgggcacctgccacacaaacaactccacactctcctcctctactccacccacacctccaccatcaccaccagcggcgcctgtgacggtggctccttccacgcccaacacaccaccggcaatggctgcgccggatgaaccacccacacggccagccatcattgttacctccgtgctcatggggatggtagtcagagagagagaggtagagagaatagagtaaatctgtagagcgctagatatttttaattagggtaattttactattcttgagaattatatttagaggtaccacattttctaatataaaatttggtacctcaaggtaccaaaattttttttcaagtcctataaaattcctctttagttatcccgtccagatggttgcccgtcttgtagtatttatgatataaccaaacaaaaatattcgaattcacgagcagttcaaatggccggtataaagtttgcatctttaaccgtaccggagcattaatttcttgtatggatgcatatgcttaaatttagatagggtaattatggaccttggtgatttcctttttgctgtgatcgatttattgatccgaaattaaaaaataatattttttatgggactatctatacaacattcgactaaaaattagtctaaaaatctgtcaaatgtaactgtaacataattacaatgtaattttcataattaaactatatttatactataattacgtatgtaattttcataattacactatatttgcactataattacatatataacttgcatgtaactcgcatgtaattatagtataagtaagatataagttcaaactggatcataaaaatatagtagcccaatggggcagtcacgtcttcatcctatgaggttacaggatcgatccctaaatatgattttgtttttcttcctaaaagcacatatcttgatgcgtattaaactgttaacatgaatctaggacacatccaacggtttagaaagtgaaagatttagccatcaaaaatctgtcaacaaatatttagcaattccgattttttattggtgaaacaaatgaaaattcaattgtttgctcttaccaccctataggtcagaagaccttaattaaaacaattttcatttctacagtatatctttatctttctatacaccagtaacatgcccacacattaattgcaacgggtctatatgattaggatggactatacttgcctatataattgggtatgggttgataagaataggattgaaaataaagatgagggaaggactataccggcctatattactgggtatgggttaagaatagagttggagagcaagatgagggaagaagaatatagatctaaccacttatggccgatgggattaagaagaggaaaaaagacaattccgaatattagcttgatcatatatattattctaaccgtattagaggatattctccctcaaccagttgttttgctggtctttttgtgggaaccctctttctgggctttctgtttctagtttagaatctgtaagacaattatgccgttccattaatggaaaggggggctttgtgccctagttcttaaaaaaaaaccgtattagaggatatgcacaatgataaaaaaaacggagctgctaaaaaaatggctccatattttgtggaaagaatatgtcgattcataatccatacggtatatgttaagattcgtgcaatacataaaacaaaaagaatcagagatccaagagacgagcagaattatactcatgccctgagcattacaaaccaagacgcttaccatgcgagcaactaactcattttgtctaacttacccatcacttccatatgatttacatatgtaattttaggacttacatttttaatacactaaaatacatatgtaattttaggacctacattgttaataagctaaaattacatatgtaatttatatgaatttacaatgtaaatatatggtgactattttttggtaaaaaatatagcgccataaatatagctactactaaaaaaatagagatttcttagagttgttaagagggtaagtttgcttacatggaaaagagagaaagataatggcgacatcgactcatagcaatttataaaaggaaactatttgttgaaggaaacttagcattctccgtagccatattttaatcggctatttctcaatcctttaaagatgagttactcgtgaaggattgtggatgtctgaatctgtagtagcgactactactcatagctagcttgctgagtactgactagtataggcctgtttagttcccacataaaaacttttcatcctgccacattgaatgtttggacacatggagtattaaatataaaaaaaggtgtaaaatacaagacgaatcttttaagcctaattacgccataatttaacaatgtggtgctacagtaaacatttgctaatgatggattaattagtcttaataaattcatctcgca

SEQ ID NO: 48612 - DNA, 5497 bp, Oryza sativa
catctcgcaatttatagacagaatttggaatttgttttgttattagactacgtttaataatttaaatgtgtatgtgtccatatatatgatgtgatatgccaaaacttttcatctctggatgtaaaattgtaaacacagccatatacaatgtgtcgttgcctgcatgcacgcagatcctggatggtcgcggcaaggaggagaagaagaagcgcgtgggattcatcctcctcctgtccgacggagtggatcagttccaatactcgaggatcaattgggagaaggtggcgaagagcaccgacgtcgaccactccgaagttggcgccatgctccgcaagtacgcggtgcacacgttcggcttcagcgcgtcccacgaccccgtgccactgagacagatctccgcgctctcctacggcctctactccttcgtctgcaagaacctcgacaacatcacagaggccttcgcccgctgcctaggaggcctccgcacggtcgtcgccgccgaaatccgcgtcgatctcaagcccaaaagcagtgataagcagcagcagcagcagccggtgctcatcaagagcatcgattctgggggctatgagagtcaagtcatcggcggcggaacctccggcaagatcctcatcccggtactctacgtcgacgaggtgaagaagttcatcgtccacctgaaggtgcccaaggtgtcggccaccaccgtcaataaccagcaggagattctcacagccgacggcgacgccaactcggtggacgggaagacagtccgcattaaggaacacaaactggccatccggaggccgccagaggtcgtcgaccaggccgacctccggccagcaccacaggtcgtggagcaggtggtggtgttcaagctgctggacatggtacccaagacgttccagcagcgtagagaagatgatcacaagggcgtgaagaataccaaggtggccgtgcagctgctgcagcggaacatggacgagataaggcgctccgatgcctggacagacctggatgtgggcacgaggcgacgcatcgacgaacaggtgaaagagattgcggaccacgttgagaaaggagaagggccagcctatgtcaactcgtgggtgtcgagccaggagatgcagcgcgccaacaccatgggctcgcccaacaaggtggtggccggccgagttcgcgacgccggcgatgaagacaatagtggaggaggtgaaaaagccactggaggagaagatcgttgagggtgagcccagcacgcctaccagtaccaagactacaccttcttcagctgatccaaatccagctccggctcatccggctcccactcctatcaaacaatattctccacgtcctgatgaaaaaccagctgattatccgaaatctggtcagaatccacgtccggtggtcctgccttctgaagatctagctccgattcagcctccggtactttcttctaaacaagtcgtaccagctcatgtggtcgtccctccaagctgttcagaggaaattagcttgaggtgcccgcagtgcgtggagttggactttgtcgacgagcacctcgcttactggtccaacgtgaaacgcgacctgctgcgcgtgctagacgacgcggaagccgccgcagggctccgccacggcgtggcatgcttccatgacctgtcgctcggagccatcaaccaagccatgtatcagagcgtgtgccaggtaattcctccgtgtcccacggtacctgtctttctagcattaaaagataccattttcaattcaaatttcttcctatatattctactctcaaccaccatcccatatctaactatacattatttattaagagtactatagttcttttctttgaaccttaatgcatgctaaataatctagaaaaacaagtattctgaaatggatatagcatgtactctctctgtctaaaaaaaccaatctagtattaggatgtgacaatgaatctggacatagattagtatgtccatattcattgtatcgagatgtgtcatgtctaataataggttggctttcattttttaggaccgaggaagtactacgcaatccatagtagtagtatcttgcatatatagcttaacctgactttgtgtgtaggccgtcgagcaagcccggagcctgagcaagtactagcgagctgccatgccagccacatatatgcactcatgctgcaaggaagaatctcagcaaggacgactactaccatcatccatccacattaattatctagcctacttgctcccttccggttgataatatacgttgtggacaaggtctatttgtaaactttcactattaataacgactaaaatatatttgagttagaaatatgtatgtacgtacgtacgtatacagattactcttaaaaatacttcatccgttttacaatgcaagtcattctgtcataaatataaatgtgcattgtaaaacggagggagtactttaataaaattatatatttattggtgtttctataaactgtaaaaatgtttgtgctttgcacgcaaccgataacggtggagaatcataaaaatcgacataagcactaaggctacatccttttctgcgttttcgaaggagctaccttttcgttctctgtgaccatattttccaaactgttaaattgtatgttttgtgtaaaaaaatacatatgtttcttcaaaaagtcaaataaatatgtactttaattaatacttaattaattatatgctaatagtttttctcatttcacataaaattctcgctattctgctagcttgaacggaacctaagaatttggtgttggcgaaactacatgtttacatgtaactacatgtttacatgtttgggatcgtgacatcaccttgtttatgtgtagtatttgggtgtaatggatcttgtagcgttgactcgatcgtatagttagctatcacgtcgcactcactttatttcgcccctcgcctcgccactgctcgagcgaggtgccggcaaagctggaggctcatcaggactacggcggcggggctcgcagctcccacctctccagatctagacgggcggatctcaagttagaggtcgacggcgacacttcggcagtgggcagagaaggccgacgcttgggagcaaggcggcggctcgcggccgggtcacacggccagatccggtgaggggctgcgacgagaggggagaggctgcggctggacggcgggtggcgtcgaggaggacgcatgcgacgggtggccggcggcggcattgacggtgatggcttcatggcggtggtggtggaggacgcggatccgacacagtcgcgccagatctggctccaggtctggccccggcatggaactagtcgatgacggcgcgacagcatcggcgatgacataagcaatgggaggacggtgccgcagggtaggctggagcggtgatggatggcacaggcggcggggaaggggccgtgcaggcggtgtgcggccagtgtccctttggccagatccggtctctctctctctctccctctctctttctctctctctctctgccctggcctagtgtcggcccagcttcgtcattgtccttgagcgcggccgcaccgcgtgtaggagggtgcgaaacaggagggtgaggcagcagccggtggtgtgcgaggtggcggccggcgaagcatgagcgtggctttgaccagagcgacgcatggacatggccagtggtggtctacatgaggaggacgctagcgtgactcgcgcttggtcactcgggtgctagcggtggtggtccaacgatggttgttgtgcatgatggttgtgtggggttttgattgggactcattggtaaaagccttgctaggccatgggccagcatgactacgacgacgccattaggtgtcgtttcccttcttggaggcgtcgttctggcattgacctctcgtagcagcagaaccttccgcgtgcaacgatagcattggtggactcctgcaatgcctctgatcccctacaagcctagggtgtttgacgaggccttcgctgccttggttctgttccttgctctacggcgggtgttcatcattcttatttgtgtactgctgggtagagtcggagctgcttcgttgtaggggtgcgacaaaacttggcaacggtgacacactccaatctttttataggattgttgatgctagctgcgtgcaggaactggttccttggtagcttaggctgatgtccttcatcgatatcgtttatgtttgctccttttggagttggggtagcatcgtagtgaagtcgaaactgctgtgtcgcttgggtggcaagcttggcaacgataacatgtgtgggctattgtgtcacctatatgttaagcttggccagagtcttgtgtcgggctccatcgtggtaccttaggttaggttagctgttggtgtggtgttgtaattgtggttttcgcttagttttcccaaattaactaggcactgtaagatttggtctcatttacttcttaaaatgggacatgcgtcttcttctaaatataaaacgtcggcaatagcttgaccgtttaaaaaatattaatttaaggatcctaaaattaaggaggaagggaaaatactataacaccccttattaaattaaaggtctgttgagagtgggaaggtggttggagtatgattgggtaaaaaaataaataagagatagttggatgggataggtagtgctctaaaatccctgtttttttttataaaatttgaatactcagatttatgggatggaggaaatataagtaaatataagtttatctttcgttagatgaagtagtgctattaagcatatttttaatagaaaatatcaccaaccaatatatcctaaaatatagaaagacatatgtatacagtatataagaaaaagatgttacttaaagttagaaactccaaaaataagatatcctaaatattctaaaaaataaacaaatacaacacaaatgatatatagtttcgtagaaacaactctattagtgcgacactatattttctcatagatttaaaactgcgtgatttcgagtaattttagttcagaaaattatatttagaatagagtaaaaaataattcaataaaaatgcatccacacataaataggtatctgccaatgtgaacgggctaccttttaattttctctctacttgcatcgtgtgattacattgtatctatgtactagctagtatgcactggtggataaggggtttttactcccggttcgtaacccccatgtagtcctggttttccaaccgggactacgaatccgggactaaagatcgttatctttagtcccgggtaaaaaaaccgggagtaaaaatccatttttagtcccggttggtgttaccaaccgggactaaagattatctatcttaccaaccgggactaaaaagactagatccgggtgctctttattattttcttttcttcattgtttttaatatatattgatttcaccccatcccatccccaaaatcccaaat

SEQ ID NO: 48613 - DNA, 19549 bp, Oryza sativa
acaactgtggtttagctgtcctccatctaattgacccccttgtgattttaaaagaaaaaattgataccaaatgtttgcccccgaagcttctatgcccatttgcgggagatttacttcgatccagcaaaaaatatatcgaggtacgatcctcatggtattaaatcgtttccgatccttaaatccagctgggcagaatggcattgttagatccaacaattggaaacaatttggtatcgcgagatatttgtacctcgagatactttttgttggaccggagcaaatctccatttgcttatatgccaaaccatggagatacagacaattcatcactgatctgccagggttgaaaacaaggaattccagttcgatctacggtgtttgtatccctccacatccattcatatacaatagccagtgtcttcgtcgtatacgtggatattgtctgccgtttacgtccgttgccttcttattcaattccatccattttattttctctgaccaattggctcaattggctagccaattggaacatggccttaggtgctatgttaagattgacgagaggacccaaagagttcacgagggtcagtctttcggccagggacaaaacttcttcgttttttatctctgcaataattgttatttaatgttaacttgtttcaattgcaaagagagagggtgacattttcttttaagaggcaaaagctttgtcattttatattgatagataagagtaaagtcataacaagctaagtactacctccttgtacaaatgtttgacgttggctagtacaattttgagctaacaaattaaacgtcaaacgaaaaagaatggatggagtaatatttatagggcgaaatcgaggtaggacactactctccacagggaatggtctctgtaagcctaacagctctcgtcatgatccaggttctcgcctcctccttgattttggccacgatcatggctggcgttgtggctaggcgccgaaaaattctggcattacgctcgcaccagagctcccaagtcacgaggatgatcaccaactttaacgctttccgcatgacgtatggcgtgtttgaaactttgtaccaccaatcttcttcattggcgtaggctttccatttgtttatgcggagatcgatttttgtccaactctgtagtgtgctccagattctctttgaaatcctacggttggcgagaagataaagagccgattctagcgaggcacagcagagtgggaaaaagtggtggttcgtccatcccctcttctacagcctgtctaccgtcgaaactctatttttgattacgagccatgagaagactttgcactttggcggctcccaacatttccttattgattggttgaagattgttcatgctgcccccatgaattgcattctataagccaaattacttgagtagactccattagccataaacttccaagtgatggtatcccgttgcgcgttgagaggagccatgcactggatcattgtccacagttagacaaattggcatagatggactgttgtgcactgatatattcttgcgcttggaggctgcgaagatggccggcgcaatttgtttcgggtcttatcttccaaccaatgtgagtgccgaaatctcgccatattaccgtcccccaaagtgatggtcgttgctgctgcaaagagatctctatcctcttggtcacaggggaccgtggtgccactccatggttgtctggatcggtccactcgtaccacagccatataattctcagagccctagcgaaacgatcgagatcaaacacccctagtccacccaaatctttgggtctacagaccttgtcccagctaactctgcatttttttccccctgaaatttcctcacctcctacccaaaggaatttgcgtctcgtctttcgagggagtgcaggaccccgtccgagttctttattgccgtgaaggagcaaatctacggtccttgaggaggtactatgaggtaccaaaaattcagtataaaatttggtacctcatgataccttatagtacctaggtaccaagaggtaccaaatttacaatagaaaaagtggtacctcctcaagaggtagatggattgcaccgtaaggactaacttggtcagggtcgttctgcctgccgccgacatcagtttgccttgccaaggagctagccgcgtgcgacatttaccaaggagtggttgaacatggaccattttaagcttggagatcgatcgcaagcagtaggctatgttacttcattgggaagctagtgatgtttgcatggaaggcctgtaggatgccctggaggtctctcccattgcaacggatgggcacaatttgtctttttggcacgttggttcggagccctggcacctctccgaaagaatatagtatgcgaaccaggtatcccatgtcgcacatcgtcgggcatgagacatatcctcgtacaaatctgaatagatagtttgtccaaatttatagtataatatattccatactccaattcatcttaaatcctttatatattaggggaggagggagcatgtgtctttatcaatagtttgtatatgatggacctaatttctcttccttgataatatatatactacctatttctgaaaaatccgcgagaaggcgtagggtaaccttttagtaataatatttctcactccgtttctaaatatttgacaccgactttttagcatatatttgaccgttcgtcttattcaaaaacttttgtgaaatatgtaaaactatatgtacacatataagtatatttaacaatgaatcaaatgataggaaaagaattaataattaattaaattttttgaatacgatgaacggttaaacatatttaaaaaagttaacggcgtcaaatatttagaaacggagggagtactttgtgctgaaaaaacatgatttctttcgtctctatccaaaagagtcgtctctctatctcctcttcctaacagagaaatagtgatgatttgtagcctgtacaaacaagactagctaggaatcttttgggagcgctctaaactaagacgtgcctaatgacatgtctttatttatgctgcttaattaattaaggctgctgatagcctggtagaggaaactgaaccaaaacaattagcaattcggcacctatgggccaatcattatgtaatttctcggtatcacgagcctctagatccatgcgacaagttcctaagctagtctatataaagggatgagtcatatacgagctatgagcatcacattcatcctacacacctactgcagaaagctagtgagaacttggtaatctcccttgttcctgctatatacataatggcgccgacgcaggtgatactctcttatcctatcataatatatgggtgatcgagtgattttgttactctctctgttctatacattctggtctaacgttttggtttcaccttccctcctctatattcactgacatatactccctccatcccaaaatatttgacgccgttgactcttttaaacatgtatcaaatgatagaaaaagaattaataattacataaatttatatcatttgaagttacgtatattagtgatgagcatatgtgtgtgatatactaatgtaactatcaactatgcacccatctaaagatgttatgattaatcatcattataaatttaagcttattattactgccagaatctatagacacatttaaaagaaagagagttgtgcaaatgcgcaacttaatatactagtttgtctgatcaagggcggacgtcggattggctcaactccttctggaccagccgaccaacctatggttgtgtggttgtgtttagtcccttcaaacttccaaaaattccatcacatcaaatgtttggacacatgcatggagcattaaatgtagatgaaaaaaatcaattgtacagtttgcatgtaaattgtgagacggatcttttgagcctaattacgccatgatttgacaatgtggtgatagagtaaacatttgctaatgatggattaattaggcttaataaatccgtctcgtagtttacaggtggaatctataatttgttttgttattagtctacgtttaatactttaaatgtgtgttcatatacttaaaaataatttggaggaggaactaaactgtaacgctccgcttttcgtgagtcgttaaaaactaactcggcaaaatcctaattgcgaaaattttcgttcttttgtgagagtctaagttgtgccaaggatttcaatttaatcccgttgttccccctcatcgcaatcaaaatcctccacctcgaaaattcctcttctgattcgagtctctgaaatcaaattctgaaattcaaatccttcctttgaatcctcgccaaatacttctacgaatccagaattattcaaatcccgcctcgaatcctttccttgactccaccctatgttcccgagaacaaatacccaagtattccttttgaatcttttccatgacttctccttgaattccccttgatacatccctaaaccctcgagttcgaatatcaaatttgaactcgaatccaaaccctaaatctctccaatcctatccaaatcagttctctcagaaaaagtctaaatagcgtccctcttggctgtgggccgtttctcccttgctcggcccattctcccctctcggctgctcctcctcctccccgcacgtgcgctgcatgcgccgagagagaggcatcgcctctcttctttctctctcgttttctcgctccctctctgttctctctcgcgccgacaccgcttcccgccgtcgccgcccaaaacctccaccgccttcgcccattcccacgcgcgcctagcgaggtggccgaccggccggtcgccgccaacgccagcgctgccgccatcgccgatttttcccgctgccgccattcgattttcggccgtgccgctcgttcccgcgcacgcgcgctcgctcgaggccagccgctcggtcgccgccgcgtcagccctgacgccgcccgtgaccacgcgtcgcctagccccgcctgtgcgcatgcgtccaagggagggaggcagagccccagtctcgctccctctccctttcctttatcctgaaacagcaaggagcagagctccctttcttctccacctttttccttttgcccgaccaccatcggcgtcaccgcctgccaccaccttgaccacgccagctcgtcgtccttgcacccttgaccgcctatgtcggttccccctcccaaaccgcctcttctccatctataaagcccaggccgagcctccctatctcattctctctcggcatctctcttccaccgccaccgcgcctttgttgccgccttgcagctgccgaccctcccttcgccgtcgcgcgtgctggtgaagccggcgtgtgcgcgaggagccgaagaggactccggccacccttcttcttccccttccctggcccaaggccggagaactcgccccgcgccgtcgaccgcccatcactgcccgcccggttcggtagtgcctcctcccgtttcccttcctcgctctccctcgccccctctagtctgcgtgatagctcggtggcactcccgaacacgcgtagacgccgcccctagacccgccgccgcccggcctggcctcgccgccgttgccgcccgctcccggaagccgccgctcgtcgccagccctccttggtgctcttccgccccatccgacgccggaagtggactccttgaaccccggagatgcttccaccgcctcgaattgaatcctcgtcgcccctccaccgggtttgccctttttctcaccgccggcgagggccgccgcgattcgtcgtcgccggtctccccgccgcgaatccgagccggtggcacactttatctcctccgtctcattattgcggtgtgctccctccctctcgaatcatcgcgacaagcttctgagaactcggccgccgtccgccgtccatctcggcctccccttcttcctcctcccgccggcccgcgtggctgccacgtaggcgccacgtcggagccacatcggccgcgaccgggtcagcacgaccagcctgccgcctccccctccctcgaccggtgcgcgcggtccacggagagccctatggctgcgcgtaggcccgccgcctctcggtccatccggcgcaccgcccgtgcgccatcttcaccaaaccctagcgccgcccccgcgtgaacccattcctccatgaacccagccgccgacaggtgggcccgtcccgggaccccgcatggtggacagcggtccacccggttggtctcctccccctcccacgccccattgggccgccctcctcgcggccgtgccggcccattaggctcgcccgagctgcgcaagtccctcgggccgcgccaatgccacccgagacaagtctgattcacatccctcgtccatttcctttttccaaaggatttaataaatccttttcctttagacagaaaatccaaataatcttaggaaatccatatctcctcaaccgctcgtccgattgaccccgttccacttccagtaattccgtaaaattgagatctatataatggcactactaattagtctaaataggatccttcttttggtcttttgtttaggtttttgattgtttgcgtatagttgcggttaccggattttcgtcgatcgcgggttttcttgaaggttcgtgaagcttcgtgaagaccttgagcaaggcaagtcaccctttgatcaattgcccctataattgaaaagtcattattattttgtttgaaacttgcattattagaatcacacacttaacttgcttggcctcggtttgcgtgccaaaccgacggacctacccagtagtcgcactaatttccgtaggtcgtactaccctgattccttgtcgctccacccttgtggtacctcggtattcgtgctctctgagcgcgtataccaaatatcccacatacaccgttgtttgtcgaaaacttgggaaatgggtttgtgaagccctcaaaacccgacatgtggtgtcggtgtgttggaaaataaaatgaattgtgaaaactcgcgatgcgggggttgcgcctatgtggcactgtcccgtattcgcatgtaaggaccgattcctgtgggaaactcatcgaacataatcaaagtgcaaccacaaggtggaatgggacaccctgtctaagtaactagtcggttcagggaaaccacgcatgccaatattgggaacgccggggcggggtcggttggagccaaaccgggttcctggtaatgcaagaacgagaagcttgctgaattaccgatcgaggtggttggagtttgatttgtgaacgcctaaaatggcctatgtttctgtgaggatttgatccttctatgtggcatgaggtatccctgggtcggcttgggaaaggttttgtcgcgaacctctgacaccggccagtgtctggagtaagttcgtgtcttgtgggtaaagtgtacccctctgcagaggttaactaactgttcgaacagccgtgcccacggtcatgggcggatgtgaggtggttcccgttgcgtagatttgtttgcctgtgctttgtgaaaagttgttttggtgtgggaatcgtaaccagaatcagcctatgtggcagatggatgacctgagtggtcagaaacgaatctgtgtgattcgggatgtctgtgggcatcatagactaggcttcccgagtggaagcggattgctttgctgctgggcagcaggactctaggagtccgagaaaatgaaaaaggctctgggagccgattaatcaagtggaatggctctgggagccgagaagtaatgatctgacccaggaggtcggtacatttccaattgagctgttgaaaagcatctcttaagtcgatttgagacgcaagtctcttttcgacccaaacttaaaagaaataaatcacttagtgatttcaaaatgtcttcaaacaaaagatttgcaaaacaaccttgcctctcttccaagcttggattaaacacctaagttcccgtgacttgctgagtacgaaagtactcacccttgctctatataaatatatatatatatagttcctccgccctgaagagaagataaagtgaagtgaagattagggtttcgtcctatttcccagccgtcgcctgtggtgttgggtgttagaccgttggtttcgctactgctgttgttgttgatgttcgcctcgtccgtgtcgtcggttgtattctcgggctgtctgagctgcaacctaagttaaggtaaataagtcccctatttattttaaggattgctatgattcatatttgtctccgtgggtaccagcactatgtcctaggactggtaccgagatcgcggtttcgtaggaagcggttcgcgccgttttccctacgacacactcctgtcaggtgccgttgtacagcggtatcagattggggtgtgacataaacacggcctatatatactgcagtactacccctactatactagggtagattagctactatggataaacatttttttttgcggggatactatagttaaacttgagatgatgggctttcacattcaggccttaggacatggcccaaagtgaccagtgagacctatcccaccttcagattctgtgtaaattaatatatgtctatgaaattattggttactgcctactataaagacacttaaatttggagcaaatttatagtccttgatgaggtatatcactttttctaatataaatttgatacttcttaatacctgctccctccgtcccaaaaaaaatccaatcctaagtttgaatctggacagtgtcttcatttgtaggattatattgggtttttttagacggagggagtaggtattaggaggtacaaaattttacactaaatttttggtatctcatgttatctcctcaatgactgtaaaattgctctaaatttatattctttttgaaaaaaaaatgaagacactacatatgagaaatttaatttcttttccgtgaaacaacttaaatgcatttggatttattaacggtcaaattgatgcatgcatatgtttcccgcttaaaaaatatgcttgtttactgtctcttctttctgaaatgccatacattgcttacatatatacatattataattaggaaaagaaggaagtatgtttcgttttacatatgaatacgtattcaaatgaacattattaactgtttaataatataatagatgttcaagaaaggcttaaataaatcagcaccctaccgttgtgatgtatatataggctgctgggaaggtgacgctgcgcagcgaaccaaaggagaaggcgatcccgagtaacgaagagcgcaaggaatggcctgtcctggtgcacgtggtggcgccggcgaaaacggagcgtttccccatcgacctggtggcggtgctggacgtgagcggcagcatgacgaaggcgacgtcgatgcacgggtggacgaggctggacctggttaagggcgccatgaagatggtcaccaacaagctcggcgccggtgaccgcctcgccatcgtgccgttcaacggcaaggtcgtcgccgccggcgcgacgcggctgatggagatgaccacgaaaggccgcgcggatgccaatgcgaaggtgaaccagctcaaggccggtggcgacaccaagttcctgccagccctgaagcatgcctcgggcctcctggacagccgtcccgccggcgacaagcagtaccggccaggcttcatcttcctgctctccgacggccaggacaacggcgtccttgacgacaagctgggcggcgtccggtacccagcacacactttcggcatgtgccagagccggtgcaaccccaagtcgatggtgcacattgccaccgccaccaaaagggagctaccaccccatcgacgacaaactctccaacgtcgcgcaagcgcttgccgtcttcctcagcggaatcacgtccgccgtcgccgtcaacgcgcgcgtccaactgcacgtcgccgacaactccggcgtgctcatcaacaagatcgactccggagcctacgacaagacgatcgagagcgggaacgggaaggcgtcgtccaagggcaccatcaacgtcggcgtcttgtccgctgaggaggacaagaagttcatcgtctacctcgatgtgccaaagctggagaacgctcaggcgaagccgccgcagctgctgctaacggtggccggtgagtatagcacaccggctggcggacggaaggtggagaatatggaggagtccagcgtacaagtcgagaggcctgcgcctgcgggcggcgcaacgaaaaccggcgatcatctcgtgacgtggtcggaggcggtcatggtggagatggtgagggtcaaggtggtcagcatcgtgaaggaggtgttgaagaagcacgagcacgacgaggagccggaccagaagcagatggccaaggatctcatggaggaatgggacaagttcatcaaggagaccccagccgggaaggacgcagcggagcgcctcaaggagaagcttcccaagcatcacgtcgaggatatgcgcaggagcctgaccaaggaggagcacgacggcgtgctgtacctctactcgtggctggcgagccaccagacgcagcaggccaccaccatggcgtcgtcgccgccggccggcgtcagcggatggttccaccagcagtacatgaagcaggtggccgtcgacgcggagttcgacgcgtgcggcatccagcccggggtagagacgaccgagatcgacgcgacggcggactgcggctgcgtcgtgggccttcaggacaggatcgaccgccggctggagctctggtccaacctcaagcgcgaggcgccgctcatgttccagccgtccgaggacgccgagtcgcaccacctcaccgccgttttccgcgaggcgtcgctcgatgccatcaaccgtgccatgcaccacgacatgtacctggtacgtacgattacacgtacccaccttactagctactcctccgtctcaaaatatatgaacatatgaccgaacaaggacatttcctagaatctatactcctccgtctcaaaatatataaacctatgactgaacaagacatttcctagaatatgtactccatcatctcaaaatataagaacctataaccgaatatggcattccctataatctagacagatagatggcctatctaaatttgtagtatttggaaatgtttcatctagttatatatatgtttctatagaaaaaatgcccgtgcgttgcaacgggtaaaattatttttgatcgtatacatttactctttttgggccaaaagattatttcttcgttccatttatgttccagcccagcccgctacctctctctacttggcctgagtctctttgacctagctttgacctagcccagaagtgaagctataggccatcctccccatcaaatcgtatcgaacctttctcgatctcccattaaatcgtatcgaatctttatcgatctcccctaattggttaagggtttctgatgcacttgatctactcttttgtttttatcaaaatctaagcgaatctataaaactcaagatataaacgctgacttttaaatagagattagatccgataaactaaagcggaattgaaaggaaaaattatggggaaaataataagggagtagtggggaatcgatttttacgaccaattgaaggaaggaatgcggagaaaaaggaaaaaaaaaagagaacaggaaaaggaggaaaaaacggcgggtgaaaaaaaggaaaaaagaagcgaaggcaaaaaaaaatggaggaacggtaaaaacggaaaaaaaaaggcgaaaataacaaaaaaaaaagtgacggacgaaaaaaaatacaaaaaccttacgtatttttataataggtatagatatagatatagattttccttattttacggaagacggaaactcttttgtcgcaccttttttgggatcgggcagaacaaaatttttgcccttttctcgcgcttgattttttttcatacagtaatttttctttcctttttttcaacggaatttccaagtgagtcggaagttttgtttttaatgggaatcggaccttttttttcgtttttttctcagcgttttatttttcacggacgacggaagcaggttttactttttaagtagtagtagatatcctgagacggaagtagtaagtagcgagttactctcctcatcccaaaataaataacaccgtggaatatttgaactcattttattatatacgtgcaggccgtcgtgcatgcgagcaacctgaggcgatgctactccggcgccgggaagcagcagctgcatggatacggctcgtcggagctgcctgcacatgatgatgaagcgctgccggcgacgcgtgctgttgaaaaacacagcgagtgaatgatcgagccaccgtgcaagctatggcgtaacggtggacgatcgattgaataagccggcgacggcgaggtttatcaattcctccactttgatttcagtattgttatggggagaaaagagtcaagaaaaataataagatagacgaccacctcgtcccccatgggacgagtgccagtctgcttgtgcgcttttccttacgcaagtgtgctcgtgtctttgtgatcaatcaatcaagtcaaatttatttcgtcaatcgcgcatgtattcgtcattctggctaattgcattgtgtgtaacataactcttttcttctaatacagtgacgtgcaatccttttgcgcgttcgcgaaaaaaaaaacgcatgtattcgtcgtcagtttgctcaagtttaatgaacgaatgtttaataattcgaatctttatccgtactgctcaccgtattataatgttatcaatatttgatatttgtattactccctacatccaattttaagcgtagccatgagttttcttatccaactttgatcgttcatcttttttaatctttttatgattagtatttttattgttactagaaaaaatgcccatacgttgcaccggataacaactttttttaaactgagcaatgaattgaaacattatggtcgctatgtattatgattaaaaaagttaataaaaattattctttggttttaggcctaaagcccattctttctttcttggttttcctatgctcgcacggccctccgtcgtcttcaacctctacctagtcccgtgcctgtataccagagctgatcctccccacaagatcccttctttccatttttttctctgatcgaattcgcaaaatttatcaattgaaggagaaaatacatggggagaccgatcgaagtgcaggcagcactagggtttggtccggcgatgatgagataaaaaccggatggaaaaaccgggtttggtccggcgacgatgagataaaaaaccagcgaaaaacaaaccaaataaaaaaaggggggaaaaaccagcgaaaaaacaaaccaaataaaaaaaggggggaaaaaggaaatcggataaaaaaagtagcgaaaaacagaaaataaaaatgaatcataaaataaaaagagagacggagcaaaagattaaccggaagccttgcgtattttttaattaggtatagaattgttttgatgattgggctaccactttagcatacctggagcaagttgaaccgccacatcaaaaaaaatattgttttcaaacactgaaggagtccatttgaattgattgttgaaattgggggagatgttatattcggttgtgcggttaagggatgcgatttgatcaagggcaagagaggagggataataaatatacttacgattttgctatatctcactcgaaagattttttcttatctctcactcgattttctcacttaaatttatagtgcattttcttgtaatctacagtgtaatttatgaaacttacactataacttttgtaagttacactgtaattttttaatcttcacatgtaaattttaaattttgtattggatttggtctttttcttgaggatatggtaatttagtgtccattatggtgtttcttaattgcttttttccttttattatatctatcggattttaatccaaagattaaaaatctgtgtgatacgatcataaaaatctttcgaaagatatataggtactcccatatacttatgaagatttgggacatttctggtccatctttcttttttttttcacatgccagcccacttctcctctcctgggccactcttctttctcctcctcggcccaacatatgtctggcccatcaagctagctcaggttgcctttctccctttctctaactggcgcgtcgggcccgctggcagcgtcatcgtcttcctctagatgggatagaaatcccgttgccgcacagggtcgaagtcgatgcccttctcaaatataatttctccactgcttctccttccaaattggatgcgaaaatggaatcccctcaatctcctctccgttttcgctcaaccaattttggttaagcccaacgaaatcccgcggattttgagtcgtttctatccttcgcacggacaatatcaatataaatccctttttatccttcgcgcagagaacgtcgatatgaatcggattagtgaatccgacgacggacgaaaaacccataccggaagccttacatattttttaagtaggtatagattagataataaaacatgaataatactttctgcgtgacttatatttttaatttttttttaaaaaaaattatcgaataagatggacgattaatggttgctctgaaaataggatggagggagtatttgtttagtacatttttattaaactttactgaaggttataggtaaatttatttcaaaaatttgtgagtataaaataattttatttgattcatattttctaaaagaatattgttgattaaaaatacatataaaatatatcttaatatttaatatattaatttattttatatgtatttttaaccaacaatattcttttaggaagtagtatgaatcaaataaaattaatatattttttgcaaggataaaataattttatttatatgaatgaaataaaattatttccagcctaccatctattgtttctagatacacacgttcttgtaattcgatacccttaaaatagtgtaaggtgaggtatctttatgcttgtggatttatatgtaacaataaccaataccaactatatgatcaactaaaaaatccaggcatgggtaatatttcacctcaaaactcgtgcagatcaatgttgactcaggcacatgtttatctgaaaccaatttacactatttttatgtcatgtaaagctgtctgcctctagattatatacttacatatttatatatttatatggagacatataatatgctagctaagtcaaagataatatatatagagaggttggagaaagctcgctgcttgtttaagagagaaattaacatgcgttggactggatatcaagcccaatcaaccagcgctccgaatcttcgatgctaggagggcgagccgccttcaacacttacgtgatcacttctccagcccaactaaattgggatgttaggagggatcagagagcttaatttgcagaggcagcaagcacatccatgggatgctggtgatcatgcatgcatgagtagatcatatggcatcatgcgttcggctacaaaattgtgtgatcatgcatacaggcatttacaagaccaaccagcacttctcagcccaactaaattttggcgcccacacacttgccatatgggcattgtcgtcgccgaagctggtgatgcgcaatgctagaccgagatcacgatcgagaatcaggagaccaagattaacgagtagggaagtttaacaagatctggtgatttgtctttaattagcaattttttttcgtccggtatatctcatgaatagaactaattatcaaacattttacctttgtcgttaatagtagtcacttttatctaatctatctatatattattaagaaccttgaaatgagacatcacatttatcgtatattagaaattcccatattaataggagaaaaaggaaacaaaaatttaccattaaatcatgttgggcatggattataattggattataatggcatagattaattggtatagttgtatgtaaagtataattcattactattataaaaattgaagatgtttttgccggtactttagtacgtcatccgtatataagtcagtttttaatttcgttcacttttggaaatacatattcatatttgagtcgatttttaaattcgttcacttttggaactacagagggagtcgtacaagaaatctctttaaaaaactagcatgctaacttgagacgattggattcctaattgcagcccatgattttctaaaacacatgtatatttaagcgaattcccgtagtgaatttaatcttaactaaaccatataacaataataagattaaaataactttcacccgttgcaacacatgagcattttttctagtatatctataaatatagaagttttagttgtgtatgaaatctaagagttgtatataaaatttggaccttacaaatatgaaaactaagagttatatatgaaatccaaatatacttctatatataaaggttcctatacaaataactataatttaaacatgaaatcggatgaaatacgtatgagtataattggtaaattaataacagtcgaacaaacatgagtacggacggatgaagattgcagataactcaggaacatcatccaaatcttatcaagtattaaatatatccaaatcttatccaatgttaaatatattttatagggttaaaatgggatgatccattagggatagaattaatgttaaatgattttgctgcagaagataccgattatgttgcagccgcatatctattcctggttagaggtataacaaaattgataggtaaaatcagataaggccatttaaatttgtttcaccccaataactcacttctaaccatacatctgctagcatgatatatggaaagttattttcaatggaaaattatgtctgtgaggttgttctcagattttgcagtgttgggtgaaaagatagaacatcgaaagaaagtaactaatacacacgatcgatccatctcaaaaagaaaacaagaaatttttttaaaaaagcatggaccattcatgtttctatactggtcagacatgcacaatacgtgtgttcctatgcccgtgtaattattttgcattcaaatatcagaaatagagtttgatcattttacagtcttttaactgaacgcccaatactgcaaggcttttaactgaacgctcaatgcaaactatttgattgagctccatttggcaaatgtccttacacggccaacaaggcaacaactgatatgcatacataggcccaacaattcatcttgtccctgattgagttattcatgcatgctaggtaagtcctatgttactttcagtaggaataagttcactttgactcccttaaaagtgacccgaatctaatccgtgaccctcaaccccaaaaccggataggataactccccgaactattaaaaccaatgcaatttgactccctcggcggttttggagagcggtttcgctgacatgtcgtctacgtggcagtgtgttgacgaaaaaatcgaacacaccggcctgggagatctgcttaactcctgtgcaggtccaaagattgatgagatgcgggagtgccagtcagtttgatcctgcaactgacaagatatacaaacagcaaatcaatgagccgatcggctgacaagccgatggagtagttccagccgatgccgataccagccgatagtgatagagtttggagctatcggctatatgtccaatgtagatgatgatataaaggcaatcggctgatgataattaatatgattaaacaatataatccagtagaaaccagtcggctaataatggtatgatagaaaaagcactgatccaaaggttaaagcatacatcggccgtaggtccgatgtcataaaatccacaagattagatcaacagtaaaacctttgttgcgatcggctaaatccaatatgtatgtatatgcaatccttacaagccgatgcaacgtccagataactcatcggctgaaaccccgatgaaacccttattggcagtcaaaaagcagactagagattatggttctaagtacgagttagtagatcaaactcaactaatgcagcactaagtatgaaaagaaacacaatatctagataatcaagccgttgactgagttttcagggtggtagatatctaagctaatctaatctagcaaggcgatttagccgataccggcagaaaccctaaaacaagaagcagccgatagagctaaattgatatgctaagactagattaacagagacatatgataaataggtaggcaagtatatcatccaaaccagagcaatccaagaagtcgaatgtcctgatgcagccttgaacgacgccgacgtagacgatataattgcctgggccgacggaacattggacttaccccttagccggagatcgaacaccgatgcagccccgcgtcaggtgccaagttccgccggaacgtagaaacaaaagtaaaagtaaaaagggtggtgatgcgccgaattgtattgatcgtagagatagattacatagaccccaagtgtacatatttatacccatgggttgatacaagtccttgtcggacaagaaagaaattttcctaaagataaaaggaaaagataaagtccttataggacactaaacacacttttctaaagataaaaggtaactaacaaactattcctaattaatagataaactgccatgccgcatcctctttaaactcggtcacttagggataagcttcctttagtagatttatttccttaaccgaatatagcaggaatccgactattggcgactagataactcccatcggctgattccgagatactgcagccgataatgattctaagccgatgacgtctttgccgattaccactgttaacacagtgttgacccggtctgctgttgacgtggcgcttaggtggcattagaattaaaaatatacatgtgggacccatttgtcattcacacaaaggaaaaatttgtggggcccactgacatgtgggtctatcccttcttcctcctcgctctctctccctcctatctctctttcccccccttccgcagttcggcgagcaggggccagtacagcggcggagtggtgtgctgcgggcgggagggcggcggagtggcgggtggcgggcggcgggcgggagggcagcggcgttggggagacgagtcggacctcgagggagccgtaggcacgcgcggcggcgacctaggacttgcccgttggcccgcttattgtggacttctgcccttggacgatggcgccgccccacgcttgcgggagctgcatccggacgacgacgggaaggagcagacgccagcaagccatgctctaggggctctaggaggcagccgcaagatggagctcggcgagggggctttagggcagcggcgccggcagtgatggggatggctctctgtctctctcgtcttctcc

SEQ ID NO: 48614 - DNA, 4873 bp, Oryza sativa
  unsure (1)..(4873): unsure at all n locations
aatgggtcccagcaaaattttttaattctaatgccacgtagacgccacggtggaatgaataccatgtcaacaccgccacatcagtgccatgtcagcaaaaccacacttgaaaaccactgaggaagtcaaattacacggttttaatagttcagggagtcgttctgtccggttttgcggttgagggtcacggattagattcacgtcacttttaagggagtcaatgtggacttattccttttcagtatatgaaggcatgagactattaatttgaatgcggcccatctggcacattcccttgcatggcccagcaactgatctgcataccggcccaacagttcattcggcccaactatctgatgcattatatatttattcaggaagacaacgcgcatttaatttgcacatctacattccttttagaaaatcctgcacatctgaagaggaaatttattctcatatttgaataggtgtatatccaaaataaaatggcatacaataaattgtaggaaaaaaaaaggcatttaatgctggagatataaaatggaattaataaaccttacacatggaaaagcaataaattatacaaagatttgtgaaggcataaatgcaaggacacatcatcgtaagatttggttgtgcccctatataaacatgagcaaaggggcacaacaatgagcacagtgaaactgaagagggcagatacatacaaacaagagctcagagcttgtttcttcagtgatctctcctaatggcagctaccaagaggatggcttactccatctcggtggttttcatgcttcttttgatcatctcttccaccttctcatcctgctacgcaggcaagcatcgatcccaattcctcacccagaaatttactgtcattcagactaattgctatgtgtgctgtttgatttgagtggttcatgatgatctttcttttcttgaaaaaagaaaacagaattgcgcgaatggtggcttatgatgcttcaattgtgttgcatttgcagctaaagatatgaaggaccgagaagcaataatacagcgccatcgcgaagagtgtaagaaaacatgcagagaacgtcatacttactgcccgcctgagatgccatgctgctgcatgaagaacgccccggcatcatctcccagtagtgtcaagaatgaaagcggcgatgggcttgtaattaattaattaaattgattgatcatctcccatccaaatttgtaacggatcgatttgttagtttgatgctatctcaatgaataaacattcatgattttgttatattatgaaaacgtggttattactccatggttgcaaacaattaaggggcagcagagaagagcatgaaagtctgaataactgtgtgtaccgtactgtacctgacgaaacaagcaacgttttattgccttgttgcatatgcaggaaatcacgtttgtgacatgtcttgtgtctggtgtagtggtgtgctgaatctccagcaattcagcatcggaataaccactcgttctccattaacgtagaaacgaagaaagcaggcgaagacatcaggcagaatgcttgtgtttttgacatagtgtgaatcgaggacacactgaaagtctgaaactctcaataatgtagatgaatttgacaacaaatagacgctatatatacggcagcaattggaatcggaccagattaacgacttgattgatttatttagccaacaggcccaacacacatgatggactagaacatggcggaatggttcccatagcgatggctgatcgacaacttggagtggttttgtaggtttttgtgaaaaccagtgtagtggggctcaaaaagatgcgaatattagagaatgacctagaatgacctaatatcaaataattagaaggggtcaggtttcgaacctaggtcgtctagcccaccaccttgtagagctagccagaatacccctaggcgtttctccagtgttgtggggctcagccgccaccttccctctatatagagatgttttatggtgtttgtaaggtacatagaggtattgagaggtggagcaatatgggccgttgatcaacatacgggtaggtagggaacaaaattattataactgatggcatgggagtaattaactagtaaattagtggtatttttgattttgtgtgaatacctttgtttgattgaatgggtacttttgcatctatttggtgatctggtcatcgcaaggggaaaaatcaagatcgttttttttctcctcgttcaatatttctttacggtttgaaccggagatcgatcgagggagaagatatcggatgccgcggccgcctcagcctcgctaacgatgttgctgtagtgtgctctctgatcggccgcctccggcaacgatcatgacaacgacggcgtattctggcccgccgccgttgcctttacctctttagttctccatgtcactgatgctgcgcctagtctcaaggtagcatatctgctagagctagagatgaagcttttcgatcgtaacttgatctcttgcagaattaactgatattcagataagagggttctatctagttctgctatatgcatttggttcagtcagaaaagatggatcgaaccagatgtcagcacgtgaaaagatatcgaattcaagcgataaattgataaccagtttcatgcgaagatttacatagtataggctcatctacattttcattattttgtcgctactaagaaaaaaaattaaaactggtagagacagccacgggaaaagggcacgacaatatgcaaatataaaaaaatacaatgcaaataatataatggaaaattagaggcgatggagatgacttaccgcatatttggtgatgaactactgatgcggtacctatgtacctacaactaatactatagacaattctaccatttttcatcttctagcaaattatcattttaccctttctacctaagtacctatattaatacttaaatactttttgtatgataccttttattatggagcgttggatttttactatttctggaatgcaaataccgtaaaacttctcctctatacaggagcaacgctctctttacactagcagtctttgtttttttcaattctcttgtttccttgccctcgggctggccgcctgggcggttgcattgcgttgtgtaacaaaaacattgtttttcttcaaatatattgacgtgcaattcttttacatgttcgcgaaaaaagtgaaaaccagagttatagatttttttttaaaaaaagtggaatctagtttgatttaatttttttcaatttggctgtttattgagcggtttgtcaacccaagtaggctcgaaatctcaaaaatttgtgaaaaccaagcggtttgttactcaagctggtttgaaacctcaatatttcgtgaaaaccgaatggtttttgtcagttttatggaaccttgagggcaacaagcatgtatttgtacatatacaaatgttttgcagatttagcacatccaccaaaaatattattgtcgtatacaaatatatgtatagaacgatatgacagcaataaattatacaagatataaagtcatttaatgtttcttaaggaagttatgtcatttaatgttggaacatatatctaaaactacaacaataatatgtaaatggaaaaaacaataaaatgtgtaaagatttgggatgtttaatctatctaaaactacaacaataatatgtaaatggaacaaaaacaataaattgtgcaggagatggcataaatgcaagaaaccatcagtacatctccaagattaagttggttgtgcatatatataaacatgagcagagggccatggcaacgagcacagtgaacttgaagagtggaaaatcataaatacatataggaggagaacttaattatcttcttaataatggcagttgcaaggaggatggtgtcctccatctctgtggttttcttcatgcttcttctgatcgtggcagattccaccttctcatcctgctatgcattaacacgtatgcagcaaagctattaattttactctgcattttttaaaaaatatccaaactacactgaatatgttttctctgtataatttgaggggttcatgatatgcctttttcccccctcttttaatttagtttgcaattagtggctcatgaatcatggatggttgaactgaattgcgtttttgcagctagacaaacgtgcaatgacctaggagatttagcgtgcactgacgagacgtgcaagaagatatacggagacagattagaatactactgcaagccaggcgtcacccctacggtatgctgctgtatgaacgtcacagcatcagttcccagtggtgtcaagaatcaaaacggcgatacgcttcttaattagttataattgatcatgttccatgtaaagttcgtcgatatgtttggagtttggtgccaactcaataaataaacatgcatacataatttgggtttgttaataaacgcggttactgaattggctttgtgctagtattgttgcacaaagtgttcccctccagttaactactccatgattgcgtactagaggcagcagagaagagctttccaatgcaatctgaaacgtacgtgttcttttgccttgttgcttccgacgtacgttacgtgacatgttcaatgtctgaatctccagcaattcagcatgaaacacagcccgttctcgttcatgtagcaacgaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 48615 - DNA, 878 bp, Oryza sativa
agaaggagcactgtagccacagggaggaaaaacagacttctatgtgggctgagaggaagggagagagaaggggaggcaatgggctggattcggcccaagctgatgaggaggacttttatttacttttccaaataaattaaccaatgagatgatctttcaattgttaaaaatacttccaatgctcaaataattccaagaaaaatcttgaacatacttggacactcaaagtatttaatataataatatccagatcatttaatgataaatttattatttaaataattgctaaactgttctttgtattattaaaattaggaattgagctctgaaaaatctgagaaaattccagagagtataactaatcatggagaatttaataaaaattaaatccatccatgctttatatttaggaaattttatttcccacatttaacttcacttgtaaattaatgaacatttaatataaattctattaataatttattaaatgatttataaatccttaaacgaaaatcaggctgccacaggtggtgggcagtgggtgggtctggtcactatgtcaggtgccgtttaatacgtagacgtttaaattttgcaaaaacattatgaaacagaataataataataataataataataatattaataataataataataataataataataataataataataataataataataataataataataataataataacaaaaaaaaattaaggcatgagcaaaaaaaagtttcctttagttaataaataactcaatatgctaagtcatgttcattatagttgctgaatcacacagttaaaatttaactgactcaacgtgaatatataaggttgggttaggtagtagtaaaaatttaa

SEQ ID NO: 48616 - DNA, 7930 bp, Oryza sativa
  unsure (1)..(7930): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagctatagactagctacagtgccggccggccggccggcgtccatcccaactagtacgtgatataataattatatatgttaatcaaacgatatgttagacaggttcttgttcttcagaaaagagaaaaggaaagttggtggtataatagtcactcactatagtcatatgtgcatgcagggccctgtctttttggccttccaaaaggagagaattgaaaccgggcgataaattcgtggcaaaatccaaaagaaggccgtgtatctaggacctttctctactatccaaaagggagatctcacaaagaatgtactagtccagtatatagttgtatatgggttgggttgcagtagtggtggtggccggccggccttgacgacgaacgatgatggccaccgcgtgcacgccgtgctctcggtgcgagctccagcttttttgcttgctagctaagccccttttgtttttcagccgtgctagttgctagctgctgcatcacactgctgcttgctgcttgctgctgctgctgcctttgcttgcttcgatctgatctccatattcttttagcctttctttcatgtgtcgcgcatgtgtacagcctactgatgggctcgccagtgtacgtactactacgtagcagtacgtactgcgtgctgctgctgctgctgctgctgctgctgctgctgttgtgtagagagtataattccttcttcacaagtcacaactggagggcaaatgggcaatgcgatgggagattgggagcaatataatggcatgcagcaagcaagggaataatttttctttcctctcaactcatatcagcatgcagctgatgcctgacaaagcctccaaggtaggttgctgtcgtcctggcctgaacggtcatttcaggcgcgcactagctggtctttgatgtatcccaggattgttggggcgacgggggaatcgcttttgtccagaaattggaacggccaaaatgtgcggtgttagtttttgatcagatgttggagttgcgctgcttaagagagcatgattagtgagattaaaggccctgttttcaacgtggggttcttacaggaattttggagagtttggaacagagagaagacataaatttctgagaagatctatatacgatactaccttcgtttcataacatatggatcaatacaaacagtacattttattagtatgaatgatcagatggtgtagattaactggcctaccaacttaaattaattgtagtataaaattgaaaaggggataattgtctttctaaatgtttgcttgcagacaactgttgtacataaatgcacaatgctagacgtgttcctcacttgatttcattccccagtcccgtagttgtcgtccatcataggccataccgccatagagagacgccacacgcactgcaagttcacgcgcaccacgctattgtgcctgcctgcctgtaaattaattcgaattgcctttctttcgtcttctcaatttccgacccacccaaaaccctagctagttcctctacctggaggaggcagcagcaatgatgcccaactccccactctccaccatgctcacgcgaacttgtacatggaaattcctagtgtatctttgtatatgccaaaaatatatattgctagtgtattgtaccgtagaagtccttcaatttctttaatcaatcccttccaaaattctacttgttctcaacagaattttcataggattctcctagggtctattggctaacaccacaatctgattagccaacccagctcacatccctcctatcttaagggtttattcgattgaaggggtgtgggattaatctccttaatctcatgtgaaattaattgattgcccaataccctccaattgccatgtgaaaaggattaatcgaacaacatgtaaatagggtatatggggaataagtcttgttcatatgtactaatttgatcaagattttagtgacatttcaagatttgcgactcatatcccaaatgccgtagcacatgactacatgagcaataaatcctgatttttttcccttttaaaacaaccttaatttcatatatgaaacacgtctctttagtagaaacaattaattttaccattctagataaaaatgggtaaatggttttgtagttgttttcttacgttaaaaaattagaaatgtaacagtttttacgattgtgtgcaatattaggtctggcatggagtatagaggcacgaagcatatgttcacgcactccattctagagggagtataagagcagggttcgtgtttccaaagggaacgggtcaaaacccatgaaattatgaggtttccacgtaggataaagtatattgtgattgaaaatttgaatggtcttttataaattcaaatttcaaacaatatatatgagcaaaatttcatcaaaatttgacaaaaccattgcaccgccgaggttgggatccaacaatccatcgaaaaaataaaccatgtactagagtaaatgttacaacatttcttaataatctattacataggattttgatttgtacttctaccataggactatcacattgagtaaaaaaaacaaaaggaaaagacataagtcaaacctaaccaaagcaagcaagaggagttcatccaaaagagaaaaaaaaaagaattaggatacaagataatattggatgcttgaaatgtgttttacactagattcttacacatggtaaaagacaaatgctctagctaaatgtccgtcatagttgtgaaagagccacaaccaataaactttttatagattgcgtgtttaatggatttattgtctctattactttagtcctacagaagactatttctctaggtctagatcatgtagcggtggggccaaaaaaaatttagagagtatttgttatgaaaatcttattccctatagtaacagtaacataacgattttataatgtgttcgtcgatgggtcaggtagccgcctagggttatcgagcggtggctccaccactgagatcatgtacgctcgcatagtaactcgcggtatttgaatcgattggacactattgtgtctctctcttccactaactaaaggcgataaattgaatttttaaaacaatggtgataaattgaattgagagtggtggggaaataataaacagtgctcctacttgcagggtgacagtaccggtccacctccaccatccatcccctacactgtcgcgagcgctctctctctctctctctctctgagttcgttagcaaagccaaccaaaaaaaacctaaaagcaaggcgagcctcggcagtgagatcgagatggagaaagcaagcaaagcaaaggcagaggcagcaaaaggcgcccacacccactgccgctgcctgctgctgctgcccccggtaaatttaaagaacccctccaatcagagcgaggcatcatcgatccccctccctctcatcctctccctctccaccctcctctccttctctcatcgatccggccaaaagctactcaaatgttatcgatctcaccaaaagagaagcaaagagaaagagagcatcaaaagcacaaacaccaagccactcaccacacctcgcaatttacatggctcctactaggttgtgtagctgctactagctagctcagctcggctcggctcggctcgccattaaaatccccttgttaccgcgcgttgtttggttgtaccgcgccatatgttgccgcctcctcctcgtcgccgttgcttagatggatacgctgtttaggttggttagcctccaagccgcctccgagcagcagcagcagcagcagcagtcggcgtcctacaactcgaggagcacgacgtcgagcgggtccaggtcgtcgtcgcaccagacgaacgcgtcctacagctactaccaccacagcagcaacagcggcggcggcggcggaggcggcggagggtactactacggcggccagcagccgccgccgtcgcagtactactacctggagccgtaccaagaagaatgcggcaacgccccacaccaccagctttacatggatgaagacttctcctcctcgtcgtcgtcgaggcacttccaccacggcgcgcgggtgcagcagcagcagccgccggcgtcttccacgcccacggggacggcgccgacgccgccgctgtcgacctcgtccaccgcggcgggcgccgggcacggcctgttcgaggcggcggacctgtcgttcccgccggacctcaacctcgacttctcgttcccggcgtcgtcgtccggcggcgggacagcgtcctcgggcgcggttgggggcggcggcggcgggaggtgggctagccagctgctgctggagtgcgcgcggtcggtggccgcccgcgacagccagcgcgtgcagcagctcatgtggatgctcaacgagctcgcgtcgccgtacggcgacgtggagcaaaagctggcttcctacttcttgcaggggctgttcgctcggctcacggcgtccgggccgcgcacgctgagcacgctcgccgcggcgtccgaccggaacacgtcgttcgacttgacgcggcgcacggcgctgcggttccaggagctcagcccctggtcctcgtttgggcacgtcgccgccaatggcgccatcctcgagtccttcctggaggtcgccgccgcggcgtcgtcggagacgcagcggttccacatcctcgacctgagcaacacgttctgcacgcagtggccgacgctgctggaggcgctggccacgcggtccgccgacgagacgccgcacctctcgatcaccaccgtggtgtccgccgcgccgtccgcgcccacggcggcggtgcagcgcgtcatgcgggagatcgggcagcgcatggagaagttcgcgcggctcatgggcgtgcccttccgcttccgcgccgtgcaccactccggggacctcgcggagctcgacctcgacgcgctcgacctccgcgagggcggcgccaccaccgcgctcgccgtcaactgcgtcaactcgctgcgcggcgtggttcccggcagggcccgccggcgcgacgcgttcgcggcgtcgctccgccggctggacccgcgggtcgtcaccgtcgtcgaggaggaggcggacctggtggcgtccgatcccaacgcgtcgtcggcgacggaggaaggcggcgacacggaggcggcgttcctcaaggtgttcggcgagggcttgcgcttcttctcggcgtacatggattcgctcgaggagagcttccccaagacgagcaacgagaggctggcattggagaggggagcagggcgcgccatcgtcgacttggtctcgtgcccggcgtcggagtcgatggagcggcgggagacggcggcgtcgtgggcgcggcgcatgcggtcggccgggttctctccggtggcattcagcgaggacgtcgccgacgacgtgcgatcgctgctgcgccggtacagggaagggtggtcgatgcgcgaggccggcacggacgactcggcggccggagccggcgtcttcctcgcgtggaaggagcagcctctggtgtgggcaagcgcgtggcggccatgatcggatcgtcgtgatcgatggatcaaagctcaccggtgagtggaacagcatggaagaaaagagctccatagctaagcaagcacgcatgcatatccaccatgcatggggtaagctagcaagctctctcgtgtgtgtcacgatcgacattaatggcggctcacacaaaggcatgtagggttttgaaacagcgtaggaagctacagaaatggatcacgtacgtacgtacacattgggttgcagcgatcgaggagggagatgatagttttagttcctagatttgcatccatttttattcatcgatcgccaacaagttcttggcgagaagatgattttgatttgcttgcttccatcttcttgtttatttttccccctttcgtttgtgtttcttcttaatttgtaagggttaacgacatttttcttcactctggagaaattttacgtgcatggtttttatcatgcgtacctgcatcgatctgatcatacctatatatattcatctagctagtagctagcatcttgcaaacattcatgctttcttgcatggttgttgagatgttacttcttgtcatcttgatgggagaaagtttagggcagacatttgcacggcctagtacttctagctagtcatcaaacatgaaagcactaattaaagtttgctactttgctagtgatagaccatagatatgtgcttacattatagtatttctttatgtacatgcattgtggttaaattaattaattaatcatccctttttcatcattctatcccatttgtaatatcactgcgctcaaaccacaccactaggcgtatatatatagtttggtcatagaagattatgcatgcatggcatggcatggatgtttatttaagttgtaaaatgactccccccgttcaaattattatggtttggatccttatttataggatatgtgatacatcaagttgatactaaaatactactactagtagtagaattcaagttctagccgaatatatattaaataacccctgatcctacacaggcgttgatcgatatatacatctgacttatttatatatgccaaattaagtagttggagcaaattgacctgcgggcctgctgtaagcattggttaaacttgacaaatggccggccttatgttgatttggttaagctaaagctagggaccatttattttctccatatatactactctctccgtttcataatataagtcattctagcattttccacattcatatagaggttagtgaatctagacatatatatctatatagattcactaacctccatatgaatatgggaaatgctaaaataacttacattatgaaacggatggagtactaatatctgatatggagtagtgaaaagatctgtcaatagttttgtgttcatgtacgtagttggtccaagaaaccagatcaagttttgttgactattgcaggctaagacctttgctatcttttgaaggaatgaccggcctgtcgttgacagattagtttctctcctcattaactactacttaatcagctaattaaatacttagagctttgatgctgtacagtataggacaacaagagttgttaagagaaactaatcagtggcgcactatgaaaacatatttataacaggttgacgaataacacaagagaaggatgaggaatgccagttctctcagaggattaggtgatggggtgatatcatgagctcagaaaccatttctagaaaaatcataagcttgcacactttctccttgtccttttcatgcagaagctgcagccgtcccactatagcagattacaatcttattttgactgcgtgcttgataatcctgctgcactttactttgtcctcagctttgtgtatatatttattattactctgtatcactaatgtctgacttgcctgttagagcacgcacttgctgtaaaaaaacgaaaggaaatggagtagttcataatcatcgtggaaaataaaacaaaaactttagtaattaaattaaattaaatgctaccagcaggagtatgtcgcaaacggcacgcagacaggatcacaggagctcacatatacctgaagaaaatgctagaaactgtagctctgaccgaatccgattcctgatctaattccttccgctggacacatcacac

SEQ ID NO: 48617 - DNA, 2921 bp, Oryza sativa
gggaggaaggcgaatctcgtggcggggcgcggggtggaatctaacaggagaaggtggtggtggacttggagtggacgggacgggacggacggccggctggttggcgggttggctggatggctagtggagtgcgtgcgtacgtgcgcctgcctcctgcgcgtcgcgtacgtagtacgtgccgggacccccacgatctttttcgcctttccgtccgttttctcccgcggaattattacgccgatcgacccatatgcaccccgcgcccgcgcgcgcgcgcgtcatcgccgcgctccatctcgcgacacggatcgctgtccgccgcgacggcacgtactacgtacgtaccggccggggacagcatcttggccccctctgctgcccggccgctgcgcccagcttagcttgcatgctacttcttctcgtgtacgtacatgcatatgtgtgatctagtactggccggccgatcgatcgagatcgatccaggcttgtctcgtcctatagtatatggatctgttgatcaccagccacaactaagggcatgttctaaacagctaattgaaaattgctactcctcgttttctgttatcatattttttaaactgttaaacggtgttttatgcccaaactttttatataggatatgctttaaaaatcaaataaaatcatttttcaaaatttaaataattgatactcattaatcatatgctaataattgtgtttcttgtttttacatacagccaaaacctgcagccgaaaagaacacgcctaacaacggaggcaatcgagttagtattatctattatatactaaaagtcctttaaacttcctagaaacactcttaagccgtcacttgtcacttctacaaacgtttctaagtcgtcacatggcactatctaatctcaccgttgatttttacactgatggacctgttattttacaccattagattagatttattatttaaaaaataataacttcctcatgtttatatcataccagcgctactactgttgtgccgtacgtacgtactaagttaataccatacaaacgttaatgttgttcttccggtacgtacatccatacacgattgaacgtacctacgtacgtacacaattgaaaacaaaataataaagcttgctaatgtctgccggaagaaaaaaaacatacgcatgtacataaaaaacgacagaaaaaaacatacatccataaaaatcgacagtctcttaaaatttgataatctacaatgtaaagttaaaatatattacttcacaaatataaatatatttagttaaataaatatttataataaatatccaatcaatgttccttaaaccatcttctaaatctatctattatataccaaaagtacattaaactttgtacaaacgctcttacgccgctgcctacgtgtctctctaataaattagataaattctaaaaatctattatatattaaaagtccaataaatatcgtacatatgttcttacgttgtcacatggcgctctaatttattagagaaatcctagaaatcgagagaacaaaaagaaaagcatccgatcttcaaatttcactgaaactggtggacctattattttaaatattagattagatctattaaaaatctcatgatactaatctctataaaaaaaacataatgtgcgtatgtgcgtacttcgtatgatcgccctcctcccgaaaaaaaaaaacaaaacttaaatacctacaccatttacgataaaaaaagataaagcaaaaaaataaaaataaaataaaacacgcacacgtacatagtagaattggaaagaaacactaaccatcagtgccaacactgatgtgttgtcaacggtctttaatctacgattttattaaaatctttattactatacgagacacacttactgattctaagaatgtatttattttattttcacaaactaatttacactaactaattcgcctgattgcacttagtgttgggttcaatagtgtataacatttgtccatcaactatattcggcatataaatttctatcaaccataaaaaataggaaaaagcacgaattacctcctcaccctctgaaccatcgtgttcgaccgaattacccctgaatccgaaaaccagacattacccaccctgaattttcaatactggacgtataactctccttgacccaatccgaagcggttttgttctgcgtggcatacgtgtggtaatccagaggtcgagtcgccgagtgagctcgagacggcggcgaataaatttattaaatcgactaagcttaataaattataataaattagtcggggataccgtaagaacgcgtatcagctatgggacaccgaaaaaactggtatttagttgctggacacccgtgacattattttataatatccaaaggaaatggagagagaaacaaaaacaaaagtatgattgtgccccttgcctaccaagtccggctcgcatacacctccgacactgcaactgcacccgttgccggtgaggtgactgtctagaggggggagggggtttcgagatatggtattttgtagatttttatggtggtacgtctctttagctatatttttttaaggacgtgactacacagctagtggtagctggtttagacaaaccacctaccactccacatatgatagacactatccacctatacttcaaatacaattttctcttaaactactaatccaatttacgatatgattacaccgttgtgttcgtaacaattaaatctttataacaagatctcacatgattatattttgatgaaaaaatataaattacttttataatatatctaaattacttttagatttcactaagttacttcttaggcatataaaagtaattcaataaagcctaaaagtaatttacatatactatagaagtaacttataacaaaaa

SEQ ID NO: 48618 - DNA, 5587 bp, Oryza sativa
caaccatgacatgtttttactatgtttacaaatagatactcccgacgttttgactttggacaaaatcaaactgctttaaatttaaccaaatttgtagaagtaataataatattttcaactcaacacgaatttattatgaaactatattcaattattgatttaatgaaattaatttggtattataaatattattatatttgtgcataaacttagtcaaattcaaagtagtttgactttgacccaagtcaaaatatcttataacctgaaacggaggaagtaatacaaattttgaatgttctacagcaacatattaagatcaattttactactaaattaacactcaaagtttgtgtagcttgctggtgggccgtgtatatggaggatatcaaaaattagtaatttgttcaaggacattttcagcctaaattgaagagagaaatttttgaaaagatgacaatgtccttagagtcaaaagcttctacgaccctagcaatgcacttggttgattgcagatttagagtggcataattctaaattttcacttcaacgtccatgttacgtacaatcctgtggtcttaggggcattctcgtctattgaagaatttctctctttaattggactgaaagtgtcttgtagcaaattactaaatttttaggtgtcgtttagtcatgtaattaacaatctttgatgtcctgtaacaatatgatttttaacattatgtaagtcaccactaaaagcaattaatcacaaggtgaagtttatctggttttgaaggtttagagtgaaaaataattagtttgtgttcagaatgaaaatggacttggatgaaagtttggggtccaaaattggactacccttatttaaaaaacaagtacacgacctcagcaaattaagtactacgttctatatatctaatgaagagttagcaaccaacttattcagcaagtaacaagggatcagttgtctcttggtatccatggtggcatggatgcttattagttttctcttggcaagaacttccatattatcccatgtgcttcactatatgatacactcaaattaatatgttgactaacaagtgatcagcaaatgacacactttcatgttgcattgtacctagtactatagcatatgcaagcaataagtgagggaatattgttttctttaatttgtgaggtttaacttgcagtggcaggagtagtctttcaccttattgttgctgaaccgaagtgtactggacaagcctaagagctagctatgcattggaccaagggaaaattgtaaccatgccattataaggagggtgagtgaggatcaaatagtgggagctccttttagggggtggaggtgaaggtgcgggcatggagagacatggcccttctttttctgcccccggcaataacccctttgcacaggtcctcttttagggcatggggttaatactagtttctccttgcctgtacagtcgcatgtctcttattgttatgatatgcagcaattggtgtttgttctttgcaggttcccctccatatgcaaactccctctctctacatatagagtatatgtacatgtttttttttcccatagcacttgttttatactatttttctcctgtcttgttcttgtataggagtactattttttccctgaaggtgttactgttccaaggagcgcgtggtagaaagacaatcattccaaacttctgcatatatatgttcgcgaggttacctagagaacgatgatgttttgctgcatttttagttcattctccttgggaacaacgttaatcctctatccagtgatgacaggaagcatctcgcgcatgtacatgtacttgtaatccttccctaccaacctcttagcgacagattcgaggaaatggaatgcttcttgaatcttgagcttaattgccactgtcatatggcaaatagtttcagataatgcagcagtacagttccatgatataattgtacccatgcaatgaaccaagctatagctagcaaaaagactgatttttttttgctcgagaaacgatgcaattaggtcgtgtatgagagaaagcaaaaacttttggtccgttcgctctcgcttgctcgatcatgcatggtggccatgacaaattggcaatggccctcagttttaagtggtgatcgccttgaaaaaagcctggagttcttcgcggtgtgcagcatgcgtgtatgcgagccctttttgtcaggcgacttgcacaagcctgaccccagaaagaccgacaaccatccaggcacgaaaattcatgcaatgctccaacattgcatccattggcagctagctcgccggtagcctctctcccctgccactactacacacattttatgcatttgccccatatccatcaccattattctagctaccactacatgcttacctctagtcctagtactagctagccacttcgccaagaaaatgcaatgcaaccgcacattccgtcacataaaaaaataaatctagtagctgatattggtatatcctactactacgaatataaacaaatattatggtctgttttggtttaatgccaagacttgccctaccaaatatttggcaatttaaatagtgttttgtagatgtttggattgatgcgaatatttgccaactcatatagtccaactctactaaaacattggtagtgccaaaacatgtctaagatttggcactaccaatagtttgataaggattaaggaatcaaaccacataaacccatccagattggtggtactataatatatcaacatccgatcctaaattgattttttgtgggacggatgaagtatgcaagtactccctcccatatgtctcgtgatagatttatttttaatggaatggatggagtggtagcttggtatctgctacctcctttgtaaaatgtagttgtttttagcacaataatttgtctcaaaataaagctaattcttgatttattcacatacctccttctctcaaccaatgaaaactattctctttcatatattttttcttctcaaccaatcacacattttctttaatcattctcacctattttcttaatactcgtgccaaccataaaaatgattaaattttgtactgaggaagccgtgaaggtgcagtgatggagacacccatattgccagtgagatactatatatgctagtacttgtgacttgtcctactcctactactactcctcccgtcctccgatccattgcttgcatggatcgatcgatcggtcactggttcacccacacactgttgagagtgcaacatcgtgatgggatcacatccacatctctatggactctatccccaaaggaggagtactttgcgaatggaatcatgcagaggaggaaagcaaccacgcattgttgcagttgcatatatatacatactccatggagaagagaagagggcgattgctgtgcaaaagtagtacgtgcacattgcccgcgctggggcctggttttgcagaatgattccatgcaaaagcggctaaactgctcgcgccattgacatatgcacatgtcctccgtccgccgtgtgcatcggcctttcagatgaaattcagaatttcaactgttgagagtagcagtaatacgcatgcagtcatgcagagtacgtcttgtctgaattggacgttgataccggcggaattaatggctgaagttctctgaaatgtatctgccagatcgatggtggcggatttatctgaaatgaatttatgtaacttacagtgattgcatggtactactactaattgattataagctctatatttgcttattgcagtgtgtacgtagtacggctatatatagttctattgagaatttcagtcgatgaaagaaagagaaaaaaaaaagaactgtgatctatatactgatgcatgatcatcgatggagagcgttggatggcgaaatggcgatgggggaagtggcatcgaaacggagagagtggtttcccccttttttctgcagattctctctggtttttgatgggagaaagataatggcacgtactgtgagcgtaaactgtgtggcagtttgtcgtgcctgcttgaacgtagcggcgaatggccagaacaaaaacatgtccaagatggcagacaacgacgcttgctcgccacgcacgtgccagtgctgcgttgcacagctcgacacattcgcagaaagctacccctttttaatattcatcttcagatacaagtattttgtcctaagatatactgatatagtatgtgtatattcaccggggaggaactataaacttttggtacaagttcaccacacacattcacccgaaaaaaaaaaaagagtttaccacacgcattcaccgtcaactcatccaaataatgacatactccatgcatcatctgcagagatcagtcatcagatgatcagatcaatatgcatcatctgcagcgatcagtcgatcatcagatgatcagtggtcagtcatctgctagctgctaatcaacggatgagccggaggccgtctggccgtgcgtacgaacgtcaccccatgaccccatgacccagctagctcctgctaacgatcgatatgattaggcgtattcacgagctcgaccaaacggaaataaacgcatgcatgcatgcagacgcagtgctttcaaatcgatcagctactagtatatacgtgtagtacgcgtactcctactgatcagcgtctcgatcgggcccaaataattaactggccggctgggctccggctgcagcgtgtgtcacgccccggcccgaccggccgggccagcgagatcgatgcatctagcttggtgtatatcctagtatagtcccgttgctagtccagttgccgagtgccgaccgtttgccaagagtacggaacatgtgtacatgtttgatggctaattgaaacgacgtgagaacagcagaactcatcgtcgtcacagattgatcaactgtctagcgatcgatacgcacatgtgcaaaagctgcagggcctgtgtacaaattaagctagcgctagctgttgttttaattgagagcttatcctcatttggtggatcaacaacaaccagctacttcctccgtcctaaaaataaaacaactaattatcataattcatcttagaaagttgttttttaaacagtggatatatatctagattcattctttaaaattagttttttaggatttatagaggggtatgactaggggtgaaaacgatcgagtaaattcctgatcgatcaagcgttattttcatataaggggtaccgtttccgaccataccgtttttagctatttataatttttgttttttctaatttctttctatattatattaatattgacaccaagtagtttaaatgataaatatggtcaattaccggccgatcgagcgtcattgtcaaagagacattaccatttccgaccgttttcacccctcaggtatatctagagatggtgtactgtagctaactacgtacgcactgataactgattgctgctgcgtaattgattcagcgattcagtggatgattagtagttgtccatatctaccccagcagatgctgaatgtacgttaatctacctccccccc

SEQ ID NO: 48619 - DNA, 38516 bp, Oryza sativa
  unsure (1)..(38516): unsure at all n locations
cccccccccccccctcccctgctcccccggcgctggtcgatcggacgagaattcggccgtggcgctgtgcgctgtgcgcgcgcgacaactgggaggtacgcgtgcgtcgcagcgtgggatcaaaagtgcgtaatgtcgcttgattaatattgtgggctgtcctaccaagtcctgatttgatttgacggggattagctagctcagctgctgcgttagttgctggtgagaaagatagaggattgctgtggtgtgtaacccggatttcctgcgagaatacggtggaacgacagggattgttcgtgcacagcacagggtgcagttgtgtcgggacgatgcaccaacgccacggattggtgcttttccgtggtgttttctcgcgtgatctgcacgcgggtttcggcgcaaactcgcaaggccggcgcgcgcggcccacgaacgcgatttcaactgtggacgctgcttcgactgagcgagcccactatccttcacggggttcggcccaaaaagaccagcagcgctccctttccgacaccgagtccgtttcggtttcaggctttcagcacgcacggtcagtatgtatataaaactacaggtgcaccatgcacgcagctgcggtagtctgcaggtttacttgagagttttgtcgatggagtgttgtgggggaaactgttttaaatactcgggtggacgtccacccgtttcttgcatgtcatctaaatgattatgaaaaaatttcaaaaaaattgacatgataggttaatatgtaatatatcacttcacaaacatgcaaatccaaattcaacttctataagtcgtatcaaaagagataataaatttagctgtgaatatagtatactagttaaagtttgatttgttattttcgtttaccttctgtagaagttgaatttgaaactatatgtttgtgaagtgatatattatatattaacttatcttgtgaatttttttgaaatttttttataattatttaggtggcatgcaagaaacgggtggacgtccacccgagagagattagaatccatcctcagtgttgtggccaacgatccatcgctggcggcggcggcggtggcgaagaccgtctgagcgcgttgccggacgacatcctgctggaaatcatgggcaacctcggcgtccgcgaggctgggaggatggccgtgctgtcgaggcggtggcggcggctgcccggccttctcccgcggctggtcatcgacgcccgggagttcgagcccgccgctctccgcgccggctggcacgcgaggacgaagcgggccatggagcgcgtcgccggcgcggtggagagccttcttcccggagaccgnnnnnnnnnnnnnnnnnnnnnnnnngcgtacctgctcagggacgagtcctacaccgtccgccgcgtcgtcgagcgcctcaacgacgccgtcgacagcggcaaggtcgcggccggcgggctggagctcgtgttcagggccaccggcggaggcggcgcgcccgatcaggatcagccgagcaagcggcaggcgcggcggctggcgcgcctcctggccgcggccgcgtcgccgagcctgctgccctccgtcgccgagctttccctcgtcaacctgcggttcacgtcgccggcgctcgcgtccctcctcggccgctgcaccggcctggaggagctcggaatgtaccagtccgacgcggggttcggcgcggtgttggacgtggggcacgcgcggctgaggcgcctcgccgtgcacgccgtggacgaggccatgtacaagaaactgcgggtgtcgtcggcgccgaggctggagcgcgtcgtcgtcgccaactggttctgccgctacgcccccgtctcgttcggccacgtcccgtgcctcagggagctgcacttgaagaacaaagccgtttactaccaggaaccagtaagactaagcaaaatgttggccagcacaccgcacctcgagtctctgacattggggttctcatcttggagggtaagtatctaatgcaacatcagtcaccctactccttcattaaaagaaggcaatcaactttttttatagtgtaagtttcgtaaaactgcagatactttgcaactacagatttaaaaacttgtttcacaaaactacagatttagtggcttcgtttgtcataaaactatagatactttgtataatatatcacaaaaatacagatttaagaacttgttttataaaactacagattcagtggcttcgtttatcacaaaactacaaatgctttgcacaatatatcacaaaactacagatttaagaatttgtttcataaaactacagatttaatatattcatttattacaaaactataagtttagtgtcttcattatcacaaaactacatattttagtattcttaaaacttgtagttttgggataatggagacactgaatctgtagttttgtgataaatgaagacacaaaatgtgtagttttgtaataaacgaatacactaaatctataattttgtaaaacaagttcttaaatctatagttttgtcatagattgtacaaactacctgtagttttgtgataaacggagacactgaatatgtagttttgtgaaacaaccttttaaatctgtagttttgtgataaattgtgcaaaatacttgtagttttgtgaaatttactcatttttattttttttaccaactgcctctttactctttatgtactttaattttataaaacatcccttctacatattgttaatatcttattttatctctagaatttaagtttatcatgcaaagatatctacaggattaaattgttccaaaagccttacaattattcaattagcttgttccaaacaatatatttttctcattgcccatgcccacgacgagttgtatgcagatttggatcgaacagaggctcccaaacaacttgaaccgatgttcagcaagctgaagtccctcgttctgacaggaattttccgtgggtgcgacctctcgtggacattgttcttcctccaagcagcgccggttttggaggaatttatactcgaggtaactaaacatatgcatgctttgtcaaatctcatctaacggcacagttttttttcgtctgaaaatcactctaatatgcatatatatatatatatatatatatatatgaacttctgcaggtggacaaacctttagatgccaaggcaccgagtgatatttatggcgaaatgccgaagaccgacgatgtgacatggcaggtgcctgagttccagcatcaccatctcaagcatctgtagttcagtggcttcaatgaagaagaaatgcactggaggatagtggagcttgtcaaggagagagctgtgaacctgcagagcattgctctggatgacggatgccaagcctgcgatgttgtggcgaatgaatatgttctctccggtgggatcaaaaacaagaaaccggtgttgttatcagtgtcccagatcacaggatctcctcctattctcacccttgtatagagggtgtatccggtgccttgtgctcgcaggcgagtatagggttgacgccgactcttttaaatatgttcctaaatatttgacatcgttgactttttaaagcatgtttgatcgttcgtcttattaaaaaaattaagtaataattaattcttttcctattatttgattcattgtcaaatatacttttatgtatatatatatatatatatatagttttacatatttcacaaaagtttttaaataaaatgaacggtcaaacatgtttaaaaaaaatcaacagtgtcaaatatttagggacggatggagtaatatagagttactaactgcaaatacaaatcaatgggaggatggactcagcggccgtaaagctaatatgcaaggcatgggcaccttcagaatacaaaaaaattatatggctcctactacaaaataagatttggacggtagacgctgcaaatccgacagtggccaaacaattatttttaccagctctactaaaaaaaccttgaaacagctcagcatcaaatcaaggactgcattttcgtatgccaaatataggagaaaatcatgtaaaacactgagatgtgatgctccaagcatgtacaacagcgatgaaacctagctgaattggtagataaaagggacaccccaaggtgaaaaacacaagacaaagatgataaaagagtggcatgagagatatggtgtgaacagaacaaaagagtggttcataacaaacagactgaaatgccacaactaatgaccaggaatccaggatcatatgcagcgccaaggatatcattagaatttcccaatagatcgacataggcgggactattctgtttgctttctgtttctttttcgttttcaggtctcttcacacttggtgatgttgtaaattatttataccctactttttttaacattaaataatttctatcctacttaatataacaaaagacacaaaccaaaattagggcgaaacaggaaaataaaacgattggtcttaaccaaccagaaaggataagaaaatttatactggaaagtagatgtgatggaagaaaagaaacagaaaaggtagtaaaagtttttataattaaagagtttctatagtaaagacttattgtgatcattgtttcctatttatgtttgagtgcaaagtagagaaggtaaggaagctggtatttgtgttatgtgaactgtttgagttagatgcttagtgaaagtctgcagccaaacacaatggatccaaaatgtgatgagctcttttatagaaatcactaatctgtgtcttcattcagtgttccaatagcaacagatacacaaaaaaaaagtccatttgccgtgttacgacaactacagttaatcagttattattctgatccatcaggaaaatgttcaagtgcattctgttttccattgacgtaaaactcaatcactgctttcatgcgttccgacttatcaggatggtaattcaagtgcacaatcactggcttcaacttccgcagattagcatctttcctcacagtcttgaatagaactttgctgttcataaattggtatatatccatggttcttttggatatatggagaccttcataacctggatgtgaggggaagaacagttcctcattgaaaacagcttgatcccatgatttgggttcacgagaaaggcggccagctactctatccaaaagctcaatagaaggaattgttggccttatgaagaaaaatccggaattataaacccatatgcgcattgtgtgtgcgtatcttgcccagcccattaagggctcatcaaatacatcattgaaaccataagctgtcctattgtcatgaccatcactcattgactctacatcagcatctctgtaaagatgatcaaacggattctggaagaaaataatatcgatatctgataggagcacactatatccaagctgcaagaattccctcaatatgcgaaactttagtccagacacagcatggtttccacctacctttccaatattgtcaactccttcgtcaggatcccgcctataaaatggaacacctttagacttgcaaaaggtttcagtgctgtcatccaatgcaacaattaaataatttgaaatcccaactcgtttgatgttagtaaaccacatctcaagcatctctctcacattggagtttgccaacgcaacaattagttctttctttataagcacctggtgcaatatcttggccaatctgggatttatggattcatcagggataactgttggattttttctaatagccttgacagtaccaaaaggaccagccttatatagaacctcgtcttttccttgcccagctaattgaagcttcattgttagttcattaatctgcttcctaaattcagcatttttcctctccaacaatactacatgtgactttaggctggtaactccctcagaagtctcacaggcaactgagtcagcctataaagatagaaacataattgtaaaaccatatctgataataaaacaaatatcagtgcatctaaggttataacaaaaagtttaaacgatcaacaaggtgcattcagttttgatgtatgaagacatattatacacatttaatttatggtatacgtgtgcagggtattgaacacaatgactaacatatcctgtaacactgcatacaagccaaaagcaaacaaagaaaggattgcacttcacaagattgtttggaagacaggattatcgaggattcatgtagtatggagttgtattgagttgaatttaactaaagttatgttccaaatgtagcttacaagtttatggaaacataacacttgtaaaaataactctgtggaaaaagtttcataatcttttttttcatggtattacatggtgtggcttacatattgataaatttacttccacccctcaaagtgttactatttgaacaacaatttatacatattacaagcagtagttaaacagactgtgagccatatactttttctattagacccctggtggcattacaaaaattataaataacagtactaactacacacaggaaattaagattcaaaaaaaaaatttcaacaaaaaaaaagacaactgactgatttttcattgaaacataaattcgatgtccaggacacaagaaaattttggcctggtttggtacaatccaggcaaagaacttaacgaagtagaaccttggtatcataataactgcagaattaatacaggaaattgcaatcttaaaattggtagtgtctcaatcaatgaaggtggcaattggaactacatgagtgtatcgtgaagagtatgcacgtgtgaaagcgggggacaaaacttagtaccaactcaacattgaagataaaaattcatctccgtactcattagtaatttgagcatccccctggctaacttactgtatcttctctttcagcccaatttcttgacaatggctcattgctagtgccttgagaatcacatctattagctatagatgacaaccacttgaaatactgttgttcatagatgggtaaaaaactaaaaacaaatagatgtgttgctacaagaaataccgtgacaagctactggctgcaagcgctgccaaccaaagtgaactagtgattggccaaagatcaatatttccaaacgaattgctcattatttgtgacaaaatattgcagtgtgtgccatcaacaccatgaacaagcatataagggaccacttcaacagaggtaacaaccaaccccctaatacattcatggaatcatgggtaataatcacatagcgttgcagcaatcaaggaaaatctctattttaaggtcatacgatcctagcaattgattgactgatttgtcggcttgtcccaatacaattgccttcgtataacacaaaccttccttatcgtatcatttaagcataccttagagagttgagctttttttttcttttgggtaaaatgatcttacttttttccgagtgatctcacgcacaccgtcttactaatccatataacaatcaggattccgtgatccaatcaccgattgctactgttacagtagtccaaaaatgaatcgtgttcgactaaaaaaatgaattcccctaacattagaaaaccccaagctaaaacagatgccccaaaaccaacaatcgctaaccgccccagttcaaaccccaacgatccccgcccacgactctcccctcccttcccacgagacgacgcggcgggcggcgaaaaggcaaggggacgggggagataggcgcggaggcggcggtttacctggcgaggccaatggagggcggcgtcggaggagcgggagaggaggccgtcggggtagaggaaggcgcacacgcagccgagcgcgacgccgacggcgaccgccgccgcgatgcgcgacccgcgcgagagcggctgccctgccccgccgcccgcgccgccgcgcatcagggggccctcccgccggctggccatccgccgctcgccgccgccgccgccgaggagatcggagggaacgggagatctgggagaagggtggggcccggctactgactagtggtggcttgcccgcccgagacgtgacgctcggtttgctttgtttgtgtggagaagtgggacgaactgtatcgagtaagattcgttagtggaggaaggggacggtggatatgtagtgcaccacttatcatatcaactgggcgtacggctcagatttgaccagatttttgcaattgggagtgtactgctccctccctctgttccatccttgttattactccctctcccaccgtctcgaaatataacaaaatacaataacctataatcagataagacattttctaatactatcgaggactaagaaatgtcttatctggtcttagatttattttaggacggaaggagtagttgttttgaaatttttttcgtaattatattttttaagtttagcatttttaacataaaataaatatattatcaaaatatatctaatgttagatttaatgaagctaatttcgtgttttacatgttgctaaattatactaaaaatttaattaaacttaacaaattttgaatagcaaaaaatcacggtgatttataatatggtacggaggtagtattatatttctgtaaggaacccgtttccaggagttgacttttggcacaacccgcaaggtccctgttttaaatagtatcctcactttgtttataaaaagaatgggaggactccaggagtattcctgctggctcactgtgaaatactacttgcataatttatgtgaatttctctgtgtttcaagtgggacatatataggagtaaagagtgattgcaaacatttactagtagcatatggttggtgtagtagggacacaagtgtgacttgaaagatactccatccggtcataatttgttgaaatttatggttaatcttttaaaactttgcaatttttcaaatacttattcaaaaaaaaataatatacatagatttactgtgaaaattactagcacgatatcccacttattctaatatgtaatcgatcgtcatgatttcagaactttaaccaaattttgttctaaacatataatacttatgaccagagggagagttttagtttgtgcttgtgtcgatgattggattttgacagtgaaattttagtggtgcttgtttgaaagcataccaattttggatttttagaacttaattaattttacaattctcaaggacatgaactaatattgtggccagcatcagaacattctttttttttccaggttcatgtagaaatcacatttagtttatatgaaaatgctacaaaatccacatggaatgaaaaattttgtgttctatagaaggcatgaaattaaataatagggagtataggcaatgattttctcatgtctagtactccatccatcccaaaatataagaggcctataattttaggaaaatccatagtttgcaattttgactaataattaaactgacaatatactacgtgcttagtactaaggagtattatgtatgtggcatcgttatattcgtcatattatgccaattttgttgtgctaattttgtggttgttgataatatattatgaaataaactaaggggcaaagttttatgttgaaaaccaagtaaaagacttaatactccttatattttaggatataaagagtagcaaattttattgttgatttaggatgtgtcgtaatgtgttaataggctaggccgcttcctcgtttattgtgactttgtactgcttaacagtgtatttcatgtcaaaactctttatattgaagtttctttaaactatcaaacaaatccatcttttaaggccaatgagcttgatccaacgaagccttaaaccaagtgaatgcattacatttgacatttgtcaacgaactatcccatttgtcaactgaatggatggccacagtatcggcaaagcgaagtacaccacgtgcaaagggagaattcctggatgaatgatcatgttcttcaaggacgatatggaagaatttccaaggaatcgtgtggcgatctgctgtagcgaagtacaccatagaataattttgagatggatggctgtgaggcgttcacaatttcgcggaatctcgcttgaacagttgaacttaacaaatttcgagcgtctcaagcaggtcaaaacaatatctaaaaacgtgaatattaggaaagaacctaatatcaaataattaaaaggggtgatgcttcgaacccaggtcgtctagctcaccaccttgtggagctagttggaagaccctgggcgtttcaaacgtcaaaacaagatctcaactgcttgaggtgcatttcgaatggtttgtttgaaatttgttaaatttatttgaaattagcgaaaaatcgacctctcccaacggggctcgaatttcactattctaatgatattgtaaagattactcatgatcagcactttcagaataagtacaacaaagtttttcttttttttgaggaacagggtgtgtctgaatctgattcagaactcagaagtgtccggttcattcatgttagcattaaaccaaacaaaaaactgttgagcctgcaactctgcatgcagtaacctctctaataagcattcgttgatcaaggctggctcttgagttgtacaaacggaccaaaacaaatttttgccattaaaaaaagcaagaaaacgaacaaattagcatcgaaaatatatcatatggccgtgcaaagatagtggcaacatgatcagatcacttctcctgatagatgtatataccacacggatcatgcatgcgtgcattgcagtcgccatgcacacgcacgcaattgctcggatcacacgatggacagattcctccggtgaggccgcgtcagctcgtcggcgtcggcgtcggcgtcgagctccggcgcatcggtggacatggctttgtcgttcacgctcacgcgcgcagcggcgcgttcgccggacgtgggcggcgcgggcggcggcggtgactggtctccggccgaacaggttcttgaacccgagcaccagccgagacttgaggcccctggtgttcgtggtgtccttggtgatgacggcggcggccggcgcggcgaggtcctcgccgtcccagagccggcttcgcgggatccggaagctggcggacttggcggacgcgcggtctatggcggccgaggccgtggccgcggcggccgccgcctgctcggagcggcgcaggcgcgtgcggagcccggcgagctcgcgctcgaggctgtcgatccgctgggtggtggcctgcatggacgccctgatgtgcgccgactggcgcagcacggcgtcgcgctggaggatgtcgccgagcgtcatgctgctggcggcgtcgcccgcggcggcggcggtggcggcgaagccgccacaagcaccgaatgcgccggagagggagctcttgaggagcgaagcaggcggcgcggcggagctcggtgcgccggcggcgccggcgtggtgatggtgaccgccgctgagcagcatggagtggtgggagtggagctgctcgacgagcatggcctgcacgacgaagcggagcgggaggcgcgggttctggacgaggtgcatgaacaggtggtgcgacagcttggtgcagttcacgttgtagcacaccctgctcttctcctcctccgtcagcttccccctgtgattctgcatccatcccaaattcagtgcagatccaacacaaaaatcattaatgccgtgtttagttccaaactatttcttcaaacttccaacttttccatcacatcaaaactttcttacacacacaaacttctaacttttccgtcacatcgttccaatttcaaccaaacttctaaattaagtgtgaactaaacacattctaaatacatttttacacaagagatgcattgaattatggtctgtcaaaatgctgatgaattcctctgaacttcttatagaacttattttaagataatggaaattgtttatatcttcggattctgtctttaaggtacatgaccattaaatttgtgaactcttaccagatttaaattgtttgtttcaagatcctacaaaattcatctgagactcatggctagaaaatattataacttgagttgtgacttgtagaatgcagggtgcaacacaatcctcaaaagctcaacttcctttgacctgtagcccagtaggataaggattgtgctaacctgtacctccaatgacaacttcctttgaactcaacttagcaccaaagcaaaagtatactaataatcagatgattaatgattagtgactagatgattagttttcagagcatagaatctgatgcatctccatgactccgtgtatagtttgcttcagcacaaaggttctgcagctaattagcctatccaggttgacttgcaattagttactactccaaatagtgctgcacctatccagtatccaagtatgacttgcattgggagcaaggaatcttgatcctacagttgagctctacgaggattgctttgcattcagcaacaaattcgccacagtgcactgcttccgaaaccaaccgacacactacttcagtagcaaaatgcttacagcttgatgaatcattggatcacgtgatgaacagttcaaggtctagcgaattttcgttcccccgagtatttaatttgactcgaccatgctactatatcaacttggcataaattttaacaaattttgggaatttgatgttgtaaacttttttttttacttacctgcaggtagtgatcaacgatggtgtacatgaggtcgtggtcgtgggcgaagcgcgcgcgcatggcctcgacggcgacctcgaactcctccacggggagcgcggccacgtcgtcgagccacctgccgtcggcgccgccggacgacgcgagcgtctcgaggcaccggacgagcagcgcggcgccggcgccggccgcctcgccgccgaggaacgccgtgcacgcgcgcagcaccgcggcggcgcggccgtggtccgtggccacctcctggaagaagtagtcctcggcgcgccgggccagcccgtcctcgccgcgcagctccagccagtccgccgccgcccacgccgccgcgaggctccccggcgacagcgccgcctcggcgccgtagcacgacgccaccgcgtccacgaacgcgtcgacggtgagccccgccggcaggtccacggcgacgtcgctgcactccgacagccgccgcttcaggtagctgtttgcgacgtgatcggatcctaccaataaaccaaattaaaaccttgctaaaaaaatggaaaaatgctcttgtgaaaaaacgtgggtagctgacatgggatccacgagttacgggttcacgtgtcagtcagttagggcatgttattataaccaaaataaactagagcaagttaacaatattgtcaaaattttagcaagatttcttatgtatttatcaaatttggcaacatttttttaacttttctaaaaaaaatagtatagttgaaaatagcatcaatttgaacaacctgaatagtaagttaaatgatctatttttaaatttcacgcatcatgaaacataatgttatttatctatacttcatcgtctcttagcttgtgacatcaacgatttggcagagacagaagaacaatccaacaggtgtacgtgtcgtactacgaaatcttggaacttattatgagagaaaaaccattgccaaacaggatggagctggaaatgtcgatctggcgaatggttccatggttccatgagcccacaaagatagcaaggccaaagtatttgagcggattggatcttgattatttgcaaatactacaaatgacagcagggttggcaattccggcactctaccagtaacaaatgaccctagtagaactgcatcctgcagctctgctacgctatccgtgagaggaaaagaacaaaaaagacgccattaaattccaacttttcagaagttataactttcttgtgtttatgcatctcgcaggtggcaccagcctcagaagttctaacttttcagcctttaaacacacggttgctgtacactgtacaaaccccattaactcttcactaaactggaatgcacagtacagcacaagaaacatttcagtctgctacctgcacaatagtactagaactcctaatgagcagcagttaattctgcaataacttgcaactaaaggttgcttaggagtatcctagaaaaccatgtcggccaagttgagcacagttaagaactgatgcagacatgacactaacgttcagagcttcctaaaggacactgatagtaaattttgaagagatctgtccatctaacccacatttattcacaccttccttttgtttggttagcatgaatgcaatgcttatgtatgtgtacgtcgacgaaatgccatggtcccaatccaccataattcatattcgaattccagcaatattacctgtagaactgcgtcaaatttaatagccaaactgcgtactacctagcacatgttatattgaagggaccaaatcctaatgataatgaatacccctattccacacaagatctcttcttctcctagccttctactactactgtattcaattcagttcaaagttcaaatcatcactgcagcctgcaaggtaaaccaatgcaggaatacaggagcagtacaaaagtgcaacgaggatggaaggcagtaacttgtcgaggcagtaacttcgctgacggttactgaatgtttacaaatccctcctgcatcccagtgctcagaccaaggcagggaagtaaatgtgctacagaattgtcatcaataattttgcctcttgcaatgccattgggagctgttcctcgtggggggcagagaagcctgtggcattgcgggctcactactctaccttcttggcccaaatttaagcacaaccaaactgctcatctacctgcaaaccttttgcaggatctcttaatgcagaaaaatttaattgatgaatgccattataatccatgtatttatgcaagttccagttgatgaaggattgaaagccacatttgccagtgccactacattgatgaaatttgcaggcacataatttcttttttaggcagaaaatgggcatctgcccaacgaattcttgtgcagtgcggctaaaccataaggatgtaacctgaaatgttgtatacctaaagaaggcagtagcccagccacagtgaatctatgagcactgtctttttggtgcaaggaaaaatgcacagtaactaatgtgagttactcccttccctttcttaccatcacaagaaacgtatgaccagatggatgtggactgatcatgcattgccatccgtccgtttctatccagccggacccgtattaatttgccatgaataatttgtttctaacagaagacatgcagctgcagcatgatctattacactattcaatttttaaaaactgccaggactgcaggacatcactaacgcagcaggttagaaaattcagtcacattctaatcggtaataatatccttcaaaaaaaatcggtaataataagatactatgtgtggtaaaaattcgataaaggacggcgttcgaaatcagaaagaaggactgaatttttaccctgtgcagaaagaaagcaagtgttcaagaaaggaagggtctttcttaccctgtgcagagcgaagcaatgttcttggacacggacgatcacatccggcttgcacggcccattcgcccgcgacctttcgccgatgcatcatcagaacagagaggaaacaaaattcaacaccgatctcccagtcagattgcgaaattcaccaccaccaccacaagaaccaatcaaccgaaaagatcaacaactgaaactgcagcaaacgtttacgtaccactcgcgcaccgcgttcctgagcgccgccggcatggcgaactcctccgccgccggaggcggcgagcacgaccgcgacgtggccgccggagaagacgacatggtgggcgaatcgaagcactcctcttcttcttcttcttcctcctcctcctcctcttcctcttcctcctcgtggtcgtcctcgtagatggtgtccacgacgccgagctcttgccagcttctgctcatctccatctccatgacgccttcgaaatctctctcgccttcaccttcttgtcctatctaccgcgtcaccgctgcgcttctagtaccgggcgacgccattacaattacggggagggggtggtgttaaatcggggcggcaatgaatgcgtgcatgtggatgataaatgctgtggcaccctcatccatcttcttcttcctcttctctctcactcccagtggtggtgtccttcaggctgcactgcaactgcagtgctgcagctggtgcttatatgaggttcttttgtttttgaacactgtgtcttgtgaggggtggatggagaggaggatcagagatagctgcagccagtggtgtactggtgtggctgtttggttggtagcctgataggtggtgtggttgcaaggtttgcgcgagatctggaccgttggatcgggcaatggatggttcagattaggcgagcccatcttgttaccgaggttttgtagggctttatggcagtttaatggtttaacatatgttacgcatcattgctgaggaagtacggtgcgaaaaaaaaacctagaatcttaaaagaattaagagatggcaattcctactatagtgagcaaaattcaggaagtaatcaacatatggagagttttttttttctaaaacatatatatggatcatgtgtagggctaaagatttggcgaaattattgtaagcgtcttgagctgatcttttcttttctttgtttttattttcagcttctgagcaggttggttttgtgggtaatacctatccaaccagcttatgcacaaaattgctacttttcctaactatatataacacaagcagtttgctggctcaaatttaaaaatatattttccttttaaagttttgtttatatatttccttcggaatggggaaaaataaactaaaacaccaatatatatgaacatggtctattagatttagaggttatttttaaggctgcattcgatctgcacttttaaagatagatttttagtgcactcaaaacaagaaaccttattatcacatgattaattaagtattaataattataaattttaaaaagatttgtttgaattttgtaaataacttctatacattttttaaaaaaaacacatcgtttaacaatttaaaaagtgtgctaacgaaaaacgtgaaaattgaagtttggagttgaagaaaagaattagacctaagtctgtttagcaattgttagatctatcttgacacgtgctagctcatctcaaaacataatccaaggttgataaaaaaaaagaatgccctagtttggagagtgatcgacctagaagattcatcctagtttggagagtgatcgacctagaagattcattcatgcacatttgtcgagcataaatctatggtaaaaatatcgattagattgcagacgtgagtaagttagcacttagcacggattcgttatacttgtcatgtacagtttgagtaactacaacattttctatgtcagtactataatgacatagatgtattgttgacatatgcggtttgttcgtccattgcatttgtcgtatggactatggacagatgaaaggctgtcgtcggtttaatttgtcttcatgggcggatgggcctctccttctgtacgtagaacaatcacatggttgatggttggtcagcatagcagatctcgctgaattaaaagatgtaactgttgtttttgctgacacgctgttccaagggtgcttagcacgcaagagcgctggaggtgcgtcgagattcgtgcggtgttaggccacacgctgatgccgaaacgatatgcgttgtacacgactaccacgtagtacatgcttcagcaatactccctccagtcacgtgatggaatttatcctttgaacttattcaaaaatttgttttattgttaaatataatttaaacgtgacttatgtttttttttctaaattacacagtaccacgcagacactcacaacgcacgcacgctcacccctatgaacgcacgcacgcacgcacctactcctatgaggatcttcgaagactgggccggcaaatccatcttggagatcgcacgcagctcacccctatgaacgcacacacgcacgcaaatcctactcctatgaggatcttcgaagactgggccggcaaatccatcttggagattgatgaagtcaccgcaggcgcttcgccgtcgcctaccgctgaaagcacaagccgttaaatcctaaaaaaatatgcccccacggaaagtcgaacccaggatttaaagtgctactgagactcttgtaaccactgagctacatgctcatgtgacttatgtttgtatacatttgcattaaaactttgaataacatacatggtaaaatctcgtgatcaaagttaactgtgtatatttatgaccagtgagagtatatgtttgataattttggagttcgtaattcttgttctgtacgtgtttgtgttgttctcgatctccttttttgttggatgcacctaacctagtattagttttccgtccacttaattatagggaaaaatcagtacacaaatttaattacacgtgagataccacgaaagcttgcactccttgcttttttttcaatgtgttggttaattaaggatcagggagcaacaaaagtcaggcgcattaagatgaacagtaggaggaacagtgtattctgttagacagttagagaaggatactttgcagctggaagccttcacttaaggacagaagttgcaacttgcaaccgtgccatccatgttcagatacaactttttgaaaccttccatctcaaaagaaatacggagcagtaaaattctgaaacttgaccaaagcaaagaagaacatggtgggcatggctgatggctctctcatgtcatgcgacgaaacgcaagttacggagctgttgaattcttcccgaattggatgcggtttctcggcgtgttttttttttctttttgttctgttcaacctgacgctagcagaagttcagaactaggaactcgccgtggcagacttagggcctattcactttaatgccaaaaaaaaccttaccaaattttagcaacttgctaaaaattttgcaggatttcttatatagttaccaaaatttggcaagaaattaaatgtaaccactttttttgtaactttaccaaaatttaatagggttgaaaatggcatcaaagtgaacagacccctacgtaagctactcatagatatacaaatcacgaggatgatcattgagttgacaattcgttattggtttttttctccattttatatgtatggtcatgtacattttcgaatacaagtcaaaagataaatgtaggcgaatgattggcagaactagtgaaaatatgagcggtgatcaccttcatcttacgctcgtaggtagaatcggaactttgtttcttacatggctaacaacaaatcaagcaaattaaaccaaagtaacaaaacctaataaatcaataacggtgcaaatttgcaaaaccatccttcaaacttaatggtcctcctcccgtgttgctcatttccggcgataagctgacccggcggcaaccacggcggccggcggccggcttcgctcgtcctcggcagcaccggtctcctggacggagcccggccgtgcgtcctccgccgccgatccggcgagctcccagtagtcgatcaggtgcctcctgctgccgccgccgccgccgtgggagctcccgtcctgcgacgacacgccgcggtagccgccgcgctgatcgttgctcctcctgatcgcgtcgatcacgaacgggatcagcccctccatttttgccacaaaacccctctcctctttagtaatcttctctcccccttcgtctcgcggtcgcggctgcttgtgttgctgtggttggttacttgggttggttggtgttacgttcatggctgtggcttgtgtatttgtagaggccacgaggtcgtggcggcgcgggcgaaacggggtcgcgcctggagaaggtggcttccggtgggcggtcgttgattggggtggagtacgaagatttccttcgtgttcgtcgtcgtcgtcgggctcatcttctcatccggaattcaggattccgttctgcttcacattttcttttctgtatagatgcgtgggactctggaataggggaaaggatgagagggatcttgtttttcagggggcgcgtacacacgaaaccggagcacagcagtgcgtttgctgccgtaggttgggttctgggttctgttcttttattacttgtcattctggaaggcgtgcgaatttgcaaatgttttttcacatgaaaatgtttttctattcacaaggagttagcttttgatgtttttcacacgaaaatgttttttttttcacaccaaaatgttgttgcttcataacaacaaacacaaattcattttagttactctttttgacctatgtggtactcagaaaagaacagagtattcctttaaaatccttcaagaggtttcagaaaagagagaggtcggtttgtgccttttggcataaacaaaagaacatgttggtcacgtgctcgataatgcgagaaaaaaaagattttagtgtccatgtttgatgggctcgctattacgattagaaggtgcaattaacccaccattagtttagaaagactgggccacccccttatcagcatgacacatcacgcttaacaatccgaagcatatgccgttcgtcatgagtcgcgtgtattaattccatctgcttggctgcttcttcgcctgtcaaaatctgcagggcaatgcaaaaccaccacccacttgcatgcacagcgcaacaatccgcggcccgccggcgcagcaacagcgaagtctgcgacctcgagtcgcccagcgagaatttctaaaaccccatcggaattcggaagtggcgacgagcactgcaaatcacgtggtttgcgaccatgacgtggaaaattcaacgagaacggcggtttttttgaccgatctgacgtgcaaggctcaacagcctttgttacttttgacacgccttgattcattctccccagcagctatacagagagggcaccaaccaactctgattttgttgagttgaaagtgatttttatcactgcttctgcattgccatcaagcaaatccccacggcaattgggtgtaacataagggagtcattgccagaaaatgcgagaaatatcggcatccggcttgaccaaacagctatggaaccacggggcacgggagaaacgtagtatagacatagcaggcaagatccaaccaactgacgtcaaaataaagccatgggggagcccagcaataagaggagcaaactagcataacagtaacttcattgcaaaaactgcaaaagtagcagattacaccatatagtcacgagcgcgtccagcgtgctcaatttcaagcagacactagaattcagaacttgcgaatatagttgcaaaaagcagacaatagacaaccagtacgaccttggcaacagcatgccttttaagttcgataacttcttgacacattactatcatgatgatgtgactcagtaatcctttcgccttaatcccttccagcataggatgaggctggcccacgcccatcaatttctggatctgaaacagaggagaggaatagtcaagtttacattatagcatgagaaagaaccaaaataatttgagcaagaccaaagaattaatatgcaaacagctgctttcgaagtgttcttgagtaagtagagcgaatcagactcgttgcagctggcggcgtccttccctgggccagcacagtcatgtgattggctgattgctaatcagagtcttcatacaatccctcatcgtcagaaagctcatcaaatgaccggatatctagctggtaacgcaagataccaccaatgccaccgaatcctctacaaaactgagatccctcttgagatttattagtgacaaactcaagcgagcaaccaaacttcttgtattcattagcaaaccattccagaagagacattttttcctgaacttccaactcagcattactagccggatcacggaaattactctggtcagcttcctgctctttgttaaaatgtttgatcacagtttcaccagatgcactgttcttaagcacatatctgttggtttcaaggttctcccacactattagagtctcaacagcacccatctcaagagctttaagagtgtcatcaaccccaaagacatatttcccagtatcttgactgatctcttcaaaatacttgccaattagcttcttctcctgtatgaacttgacatttgctagaatctcagctgacaattcaatagcttggttgaaaccattctcgccaccataagaaacatcaaccacattaagtatcttggcttgaagtcgttgatcaaacatgtcagactgactcaattctgtcttaaaatcagcagaaccagcgaggattaggcctgaaacattaggctgacttgtagcaggattaatgaagaactgagtagcaagctcagctgttttccggacataattatggcgtttctccatccgaagacgagcaaaacgcaaagcagattgtcctcctctaccatgcttctttgggagatcaacagtgaatttgtgaagcacctcacgtgtgttgccacttagtgtgccaaaaagagtaccattaccatccataacaatgaacccaaacttgtcatcagattccaagagctcattcaaagcttcagtgtggaacttgttatcacaaagatacagtgatacattgataggcttgaagggttcaaaatcaatggtaaccttcttttccttcccatcttcagtaacaatggttccagtgtagagaaccaatccatttggaggaactttgttatagagcttcagcctctgctgagctgaggtaatggcagccaaaacagactgacgattgactctactcttgatgtttgaggcggtaccatattcatcacccaacatcttagccactcgcgcaatctggtcacgtggaggcataataagagagatcatgcttgtgccatttcctctagctgactccagagccttgattagcttcttaatcttccagatctcaatgttcctatcagtttcatggctgtcagacatcttgacagagcttggatgactggctcacctgtacaatgccaaaacacagggatataagggatttgaagggaacattaaccagacagttcactcaagaaaaacttgcaaacagattaaaaaaaaacacagaacaaagacaagtcatattattgttatatagtacattcaactttcttgttgacacaagctctgttcatgataccaaattggacatggacatgctaaataagaaatgatacctgtctcctgtacaaattaatcaataatgagactgatttcttcaaagcagcatgctctattactttatacgtaacacagtgaaagaacaagaaaaacaaccaccgtttatcttactaaatatctcacaacaaaatttcggcagcaaaggtactatcaaataaccacaacactcagcagacaaggttaaaattaaaccacaacactcagcagacaaggttaatattgcccaatgggtggcaaattttggtttggtttaggaaaaggtaggttacgaaatgtgaaaaaggttttcatttgcatatactcaaatgatttttgcagctaacatgaaacaatcatgaacacatacgatgttatcactaggttacaggtacttggtaacattttttatgtgggacaaacatactgaaataaaataaagcatggagttaacccccaagacaaatgaaggacctgcatagccatgtaaaattttcagaatcggaatgtcacccagataaaataataaaaccaacataaaatctaaattatatccaagaaacagaatttagtttcaataatcacaaaaccgaaatagagagtacactcatgaaacaaacggaaagtacaattagtactagtcaactagatatcaacttggaaaatcacaaaacaatgaaatatggaatataatcagtcaataaagttaaaacagcacatcttagatgtatttatcttctgccaacaatgtaataaaaaattaactataggcaatcaatataattaaagtaaatcattgtaagaccaaacatgcatctgtcaccaagactaagatagaagataagaactaaacctcaggctaacattttaagatcgaatggcataaatttatagaagttgcattgacattgacatggtcagtgttttgtctttacaagctaccagagtcatagaagatcaagaaaccttcttaacttcttgattgccatgttcatcaaggggtattccttctagttcatgttctactagcagtccagcacatacattttcagttaccagttacttccaaaatcaataaggcaaacgtgcagcaatctacagatttcagaatgtttgaatctttaaaatcatgtaaattcagaaaaaaaacacatagtttgctcaatgctcactactacttcaagttaacctaaatgatacatcaccaatgaaaaggaaactattagcgcaacaaaacatacaagagcagaatgcaaccatgaagaagacatataacatgtaattttcaaaccaacaacgctaaaaagagcgccgtgaacttgagtaaccgcatgtccgcatggcaccatagcaggaaggctcgtctaatatgacaataactccaagcattaaggaatcaaaataacccgattaatatccacgatggaaaatagcatgtattcctatgttaatacacatcccagtacgctacttcaaatagccaacaaacaaagccatctcctggcaggcaattacaacttacaaacacagcatggatccaaatacatccacctaaattagtggcctaaatcaggaaaatcgcgcggaacagccatctagagtacttcccgcacagatcccgagaccgggaggcgaaggatcactacacgccctagaaatttcgccacagaactaggtcccaatcactcccgatccacctcgcgctaccagtacaccggatccagactctaatctcgaccaaatctgacgaccacacgaaccatgaaaacaacacaacccgcgacgattcaacagatccaacctgctcccgatccgccgcacccacgcagctccgaacgatcgggggagaagaagcacgagacgggatcggatcgagggggcgcaggagggaggaagaggaggaggggctagggtttccttaccgaggaggagggaggaggaggaagaggggagcgccgacttctcgcgggtgggaaaccctcgcctctgaacttctggtgtggtcggctgtttcggagagagagagagataaggccccggaattgaaccacgcgatataaccctcggttccgtggggcccacctgtaagccggggtgcggcttggtgggggggggtggggctttggagacgacgggatcggaatgggtcccatccggcggctttcccaggatctggatggacggttggatcgtcaccgcccagaggcgaacggaccggattgggccgaatttttctgcaccaatgattaacaagtgggcctagtttctagttttgttgtccccaacgaatttcttctaccctttctttttcaaatatccatgttattattcacacgtttcaaacatcttcttgttacatttttattaaaattaataaattttttttgcaaaaatataaagtacttactttagctaatactcctataccataaattttatggatttaaaaaagtatcttatacagagttatttggttcactaccaaagttttatggatttaaaaaagtagcttatttggttcactaccaaagtttatctcaccatgtcatagcttagattaggcaaggtgtctatttagtttgtgccacgcttatggcatgattcctccatcgtgacgtgggtccgatatatcattttgcatataaaagtgtggcaaggttttatatggtgttgcttcagagaaatgttccaataggacagagtgcccttacatagagttgacttaataaatcttatgttgtaacgtttatatgttgtatttgtttgttgcaggtttctggtccatttgactaacaagaaacgattgggtgtgttaatagtaaactaatgtcgaatgttctatacttgcctcacaaagttgcgtcgttttttatacagtggagaagtttgactcctcataagcttttgggggccttggatgcttaaaggagtcactgcttaccaatgtccacgatgagaggaccaaaaaacttcttaagtttagaggactggaggaaggtggaatttagtcgacctagcccatgagaagatcaatgtgtttctaaaaacatggttgaagatcttttgtggtggtagtttgctagtgtttttagaggttttttagttatggattgttaagttatgccaacagctagggttcttcgcccgccgggacattgtgtttcatttcgcgctggcatccttagttttgttcttttattttgttatatggatctttaagttgggtgaaaacctttttgtctaaaagtgtagcaagcttattctcttttatggctgaagtatgatttcaattttgttggccacgtgttggacatgttagctaacataagtatgacaaattttcagtaatgtgggtacgccaatcaaacagtcctcggaagtacccaaaaccatgttagttgtatccactattacataacacgtagaatccacttgtagtctcgaattatgcctagtatgaaaggtgacctggaaagaagatgatgtataaaatggttattggaaccataggtaaccagaaaggctagaagttatagttttatgatagaacatccgtaaaatgtgtaattttttaattaatcatgttattaaatttgtagctttacgataaattggatagagcatctatagttttacaaaatttactcaaataaatgttggatgcacaaggaggtaaataatttcgttgatgtgtgcgtgtttttgtgttctaggtttggtttgtggtggaggacttgactgttaggttttaacattaagcttagacacagcaacttaagtacttaaccacaaaaaatgacgcacaatgggaaaaaaaatataagtcaagcaagtcatggcaagatgacccgtgcggttcacatagagataggataaaacgagtcgatttgtgtggaaaaagaagaaaatggcgcgtgctttgacgctttgtagcattgaccctccttcctagggtcttttcctgcaaattccaaattggagcacatgattttggtgcatgagtatctaaaaacatcagtagtattctatattcttaagtcttaaccccgtcgaaatcaacgtatcaacactcaagatcttaccactgtacaacctggctccatcacgtgtgatttgttgggctcagaagcaatagcagctgttattggatggctccgcagtacaaacgcccatgcttttatccatcgccgctcgtccgagcacgtctcattaactaactcactcactcaagtgaggtcaaattacagaagctcaagtcaaatgcttatctaatctgccgatactgtcgccggatgatgccattacaccccttcactctcacgcagaggctgtccaaaaccatcaaatcgtcgtgacgacgcgagacctctcgctagcctgacagactggtccaacccaaccatcttctcctccgactcgagccggaaatccaagaaccgagtccaccgcgctcctccccttccacggtcgctgacaagtggggcccaggtggaccggcccgcacgcgtccctgccgccctcacgtgcgggcctcggtcgcacgtgtcgcgcgcggaacttgtcgcgcccacacaccaccgtcgctccgtgctaacgaagatgcggcacgcgcggaccgtcggattcgcatcgtgcgggtgaggggtgcgtgccgcgtgccccgtcgccccggacgcgtccaggtggcgggcgtgcggacagccgttggattggatccagcggcggtggttggatagcgcgggaagggaggaaaaagggttaggaaaaggtcattaattaattcgattaattatttttcgcggtgattaatacctcgccccactcctcctcttcgcttatttcattcgctcgtcgcgtcgcctttgccttgcctcgctcggttccaaacgcaaagcacccaattccatttccgttcccctctcggcgaacagcctcgcctcctcctcctcctcgccgccgacgccgacgccgacgcctccccggcatttggttcgcgcgggtggtgccgtgagatacgtggtggacggggtagggatggagtcggacgcctccacctcgccgcgccggcggagcaccagctgctacagcgacagcggcgattcgtcatgctccgagccgttcagcgagtgcggcagcgacgacctctcgttcacgccggctgccgccgcgggaatccaccggctgctgctgtcgtgcgcggcggaggcgtcggacgggacgatctcgtcgctcgtcgcggagctggagtcgccgtcgtcgtcgctggactcgctacggcgcgccgcgatggagctccggctgctggcgaagcacaacccggacaaccggattcgcatcgcggcggccggggcggtgcgtccgctcgtcgcgctgctgtcgcacgccgacccgctcctgcaggagcacggcgtcacggcgctgctcaacctgtcgatctgcgacgagaacaaggcgatcatcgtggaggccggcgcgatacggccgctcgtccacgcgctcaagtcggccgcgtcgccgccgcgcgggagaacgcggcgtgcgcgctgctccgcctgtcccagctcgacggctccgccgcggcctccatcggccgcgcgggcgccatcccgctgctggtctccctcctcgagaccggcggcgcgcgcggcaagaaagacgccgctacggccctctacgcgctctgcagcggcgcgcgcgagaaccgcctccgcgccgtggaggccggtgccgtgcgcccactgctcgacctcatggccgacccggaagaccggcatggtggacaagcccgcctacgtcttgcactccctcgtcggcatcgccgagggccgctccaccgccgtcgaggaaggcggcatccccgtcctcgtcgagatggtggaggtcggctccccgcggcagaaggagatcgccaccctctccctcctacagatctgcgaggacagcgctgcctaccgcaccatggtcgcccgcgagggcgccatccctcccctcgtcgccctctcccaatcctcctccgcccgccccaagctcaaaaccaaggtaatcatcaatcacatttcctcatcaaaacacaatcgttttacacgttcttgcaaattacaaattgggaaatcgtgtgttgatcggttttatgattacacaggcggaggcgctgatcgagatgctacggcagccacggagcgcgagcctgcgcgcgaggccaacggcggtcgttgcggcggagtgaccctgacctcgttcaattcaagtccccaacttggcggtgccccaggtgttgtgctttgcttcccctattccggcggcgaccggggccggcgccggccgccggcgcgcgcgtgtaaatataccaatcagcgtgtttgcgtccgcgagcgagtgtacattttcctcaagcgagatgacgacgaaggcgatggtggagcgaagaaaagtctcttgtaatttcattcttccccaccacttgttttttttttcacttcacttttatcccctaccttgcttggttgtttcctcctcgtcaaacgaggagaaggttgtgcaaaaaaaaaaaaaaagctacaaaaatttcatgtgtgagcgtgtggtatcaaacagtgagaatttgtgctatgtgtgtgttttagttggggaaaaggaaattttttggtgtcacatcgaacgtttgaccggacgtcggaaggggttttcggacacgaatgaaaaaactaatttcagaattcgcctggaaactggaaaccgcgagacgaatctttttagactaattaagccgtcattagcacatgtgagttactgtagcacttagagcaagtttaatagcatagcccactacaaactccaattcacttatagccgatctaatagccaatttatataatagttgcttactatactaatatatagtcccatctatcatacacacattgtgtcttggagtccgtgctgcagctggctacaaatctatagcctgctatttctctctaattttttatctcattaaaatatgtttatagctggctaatagtctgctattgtacctgctcttatggctaatcacggactaattaggcttaaaagattcgtctcgcgatttcccccgtaactgtgcaattagtttttctttttatctatatttaatgttttatacatgtgtccaaagattcaatatgatgtctttgggaaaaaattttggggaactaaacggccctatgtcactgtgtgtgcgctacgtcaggaatctcatgcaggtctatgtgaaatacaacagaaaaacctcctgtctctgaaagcaccagccagtcggaatttcagctggaatgaatgaccatgctgctccattcagttcctaccgtgtctgcaccgtttttacgagtggttacagtgaaaccaccgtgagatcaaggttaggtccgttgtaggaacggcgagttcgttggccgtgagtgcgtgtgcgtgcatgacttggtaaaccagcaaaccttttactacctgttcaaaccaacagggaaagcacaaaatatttttccagtgaccatccttgtcatctactgctactcacttcttctgcgtctttcttcttctgctgcttgtggattgtggtctagaagacgcaggaggacggattggtggagagtggcgtgggggcccgggagcggtaaaggcgagagatcgatcttgcccgtgcccggtaggtcgatcattcgttcgcctgcagctgaaaacgaccctgttctctggctgaatctagcctctgctggtagttttcagtttctggagctctcgtttcccgagccatggaagaaaagcatataccgttgcctacgccaacgtggctactgttgctaggacggtatttctacgtgtcttttttacgggtgtgtttaattcacgttaaaattgaaagtttatttggaattggaacggtgtaacggaaaagttagaagtttgtgtatgtagaaaaattttgatgtgatgaaaaagttggaaatttgaagaaaatttccaaactaaacaatggctacgtctcctgatatgggtagggatagtaggagttgtatgacgagattgagcacatcgtttcgttcacttgtcgtttgtcgcttgtcgttgcatgtctatgctacggatgatgtattgtacgagtactggaagtacatgcttgtgtggacacgactgccttttttggatgacgtggagacacacacccggcgagcggcaaaggtgcttccaatactagcatgagatttttctcttttctatctgaaaaacatgcggtttcctgctccaaccacacgaccttgtttgtgcacaacgcaacgcgtggacaagttctcggtggagtgttcgtaaccctgatgtgacagtgactgtccttggcattttttgttactttgtcaagtgcagtgcagctaagagaaaaagaagagtgtcaactgttactacctaccatacggtgtattgctcgtgcatcgaccaaattaatcgtcaatgcccttccaaaaaaacaaatatttgactcggacggcggggcgattgacttttgccctgttcaaagcagcgcagcagaatccttcaaaacagaaggggaaaagaagcagagctggttgtcaacttcaaccatgaacaataccacggcaccccattcgtagcaaccgatgacctaaaaagtcacccacggaaaaaagcacacaaaacccacatctacacgcacgcaaacattcctgcaggagaaaaaaaacaaaaacaaaacgtattcaccactatacgcacatctcggatgccaaatgcttggcataattgcgttaattaatctagccccctgccaatcatcgccaccccggtagcaacggtgcgttgtggttgcccccgcctccgctgcgctgcgctgcgcacccacacatgcgctgccggctcggccggctgccgcgcgaactgacacgtgagctctccccctcgccccaatcggatcgtgaactcgtgagacaaccacccccgcgcgcgccacgccgtttgcgcggcccgcgcgggggtggcccatcggacggatggcggggggacacatgtggtcgtgtggtggccccncgggtggatgccgcccccgcctccctcctccgcgcgcgcagccgcgcccccacttcgtgcgtgcgcgcggtgcgtttgcgttgcctttccgccgctgggagcggagccacagccgaacgaacggaacgaacgaacgtgttgcggttgatggggtgcaaagcgggggtggcatggagacgggcggctagcatgatgattgctgatgggggtggggccgtggtggtgcgagatgccgctgcctccgctgctgccacacacgaccacacatgcaaaataaaacggggatcatgtgacggcacatgagcgtactgtgcggcggtttgattgatctctctggctaaaaagaaaacgtttccttgcctgacgtctttctttgatgattgagtgtagaggtagcagcacaagtaatccctccgtaaaaaaaaaacaaaccctgatttcgtgtccaaagtttgaccgtctgtatatttaaaaaattataaaaaaattaaaaatataagtcacgcataaagtattaatcatgttttatcatttaacatcaatgaaaatactaattataaaaaaaattcatataagacggccagtcaaacgttggcacgagaatccatggtctgtcttttttttttgacggagcgagtatatatgattagcatatgcctgttgtttctgcctggttgttgtagttttgcagggatcggtacgtacggtaccgcattccgcatgtgtgcgtatcgtcggagtaaattttattcccaacatgtcatttttgttatcggtggagtatattgtaccatgtggagtggtgtggtggaaattaaaccaaaggtggttgactgcgatcgatcgatcgagattttgtactagtggtactgttcgtacagagttgacaatctactactactactacctttgtttttatctgcattgacttgccatcgattttcttccatgcgctgcgcgtgtttcttttcctccgatcttatacgtacgtattagcgtatatcttcacgaagatctgcgcgtgacagaggtgtggcaccatggcatgggcgggacgccggaacagggtagggtttggtgtggggtgaccgtgacaggagcgtgtgtgtgcatggtgcgtcgagctgtacgtacgtccgacctttgtagtagtggttgagaccagccgcgaatccccgacgcgtggcagccgagcgcggcccacgctggaccgcgaccctcacacgatgcatgcaccggcggatggatcgggcaggcaccacccccccgtgcggacgatgcggccggtggcgaaagcgagacatggccgccgcaagcagcccagccagcgcgccaccaccaaccactggatacacaaaaacacttcgcgcgcgcgcgcccggcacgccggcgtgggagacgttcgccgtaaggcgtaacccaggcggtgtcctccgatccggaccttcgattcgacgagcatttgccggatttctcccgtgatatttgcggtgtatacatgcatgtggcgtgtgctcggttcgatcgggagctagttggcgacttgcctaaccccgatcgcattcaaataaattgccgtcgctatcaccaaatgatgcgtgcccatccccaataatcccgagctaatcaagccgcggtcacctttccggaatcgaggtccaggcagtagcagttaagcgttgcctttttgaaaaactcgatgaagttacggccatgtacgcaacgataagcatcagttttcgtactccattcgttagttcggcgtacgaccactgataattttggagtcacatcagatcatcattttgcccgtgcaaaagcgagtaaatccaatccaaaatactcaagtatccaagggatggagtactatttatttttcctactcttcacatctcggtacagtaataaaatgagagtgggtcaagttgattagtagtactcctattttcctactatgaagtactatggtttaaaattctgactgtttgaagcgatacttgtctctggagttttggactgggcacaatttgacgttcgagcatttctttgctctgatttgatttttttccccttatgtatgcttgagttgattgaccaaatgaattacgatgtataggctcccaacaataccaaaaagacagattccttttcgcgtatttcgttgaacgttgattccatactctactatgcaacttgcatttatatacggacccattcgtgcatcgttcctattttattttttgaatatcaaacgcaccggatttgatatgttcttttcttcttcttttgagtacttgttagacaaaaccgaaagcacataataactccatatccgataatgtagaccgagcacagcctctgaattattggagggaaaaagaaaaagcagaaccttttgagttcagtttggtcatgggctaacctcgcatgaaattcagatacatctgctggcattttgcctggcggatgtatctgaattttgcctggcaggaacaggaagaaccaattgcattcggacatcccgtccggcaatctgaatctaaaatttgttcctcagttcaattatctatcttccccaggtgctactgctacatctgctggcatgaaagaaaaagctgtactactgtttgtgatttgtatgaggaattgaggtggtgtttggatccagggacttaactttagtctctatatttaaacactaattttgagtattaaatatagattacttacaaaactaattacataaataaaagctaatttgcgagacaatttttttagcctaattaatctataattagagaatgtttactgtagcatcacataggctaatcatggattaattaggctcaatagattcgtctcgcgaattagtccaagattatagatgtgttttattaatagtctacgtttaatatttataattagtgtccaaacatccgatgtgatagggactaaaagttttagtcccatctaaacaggttctaaggatacttccagggagctgcagagcaaataagaaaaagaatcaaacccaagaagattcccactatttgatattgatattccaattttcctgtttccctagctaagatttctgagctgtcattgatgtgcatgtcccttggtagaccaacaaatggagctgtcatgtcagcttaagaaactagctggagaaaataatatttggacagaatcataagttgttcatgtcatttggccttggccgcgacacgcacggttaaaatatagaggattgggttgcctttgtagctttctcagaagctgttgcatgagaatgctggggttcttttttcgccattgtaagctgaaaccaacaatttggttgcatcagataagtctttgcagtagttgggataacaagatatctcccaagatagtgatctctctttaaaataccatgtactgctaccatctctgtgacgaactcgtgttgtaaatctgcccgtacaattccgtttccatttagtaccaggatctcttcaattattttgtaggatttggtttgtcggtgtgagagacttgagctgagacaagtagagattttagtaatgtgctagtcatgtgtcatgaatggtcatcctgacatctttgcaatgatgcatcaaatattcaaacccgaagctctgctcagagctaagaatgttattttcagtacaccgaattcctgaaacattattattgtagtatacaagtatctgacgcaaggtgccttggattatcaaagatgaagtgatctaagaaacttaatatatagaccaccagaaacaaagtgatctaagaaagccgcgaggaaaggcaggattgtcttttgtgagaacaagcctctctcttattttcttttcttttgttttttcttgagaggatgaacaaagcatttcagctgagcaatatgtgaaccaaaacaatgctgcaatgctactcaatgatcaatattccaaagccattagcttctttcaggacaaaaaaaaaagaaaaaaaaagtgggcaccagatagcacctgcactgcactattcctaaacaaatccgccacagaatacttggggagaagttgaccaacgcatagcaacacaacaaaattaagcactactatttcgtatcatcatcatcatcatttttgcgttaattaatctccaagacgcggttgagaggagtagtggtcatgatcagaacagctagagcgtgtgaccgaaatgagggatacggatttgtgttatcttttggagaaagaaaagaagaaaacaaaagaaaaggcgcgcagatgcagccactcgtgtgacgcactttagttgttcgggaagcaacatccctgcttctcccctcgagcagttgttgagcagtagctgctgcttgtgtcacgaacaagacactccaaactaatccgagggagatagatggagatggagatggagatttgatattagctaggaatttttgtagtggtgggaggaggaaggtgacagtggaaagctgcccggcaactgaggcgaccggtctctcgctctgcagcatgcgatgcatgcacagtgcgtttaacaacaataatggaaatggtttatatctccggcctctgccattaagcacacaccgtagcacggtgcgtttaactgcaatcatagagagtggccatggctgtatgatctatgatctatcagacttttgatcgatcattgtagtttctactgatgaagagagctagtgcatgggaaatgtgatgcactgatgctgatgctttctgatcagttcttggacttgtggtgatggtggtggtagtctccatccatgatttggacaagttaaattgtgtgtgtgtgtgtgctgtaaagtaagtaaagcatgggtgcttcctgttcttcacctcgaggaaatgtggagaaagcaggctagctgctctgttcaggctgtgtttgtcttcgctgccatcgtagtcgtgtcgtttggctctctctttctgagaaattttcaggtcgcgcatcacttcagctgctcctgccgacttccatttccatttcagttttatggttcctgtacgggtacacatttaattgtcctaggagttgtatgatttgatggtgcagacaaatcctctcgtcggctggaatggatgcttctgaaaatggccatctcgattcttggataagcaagcaacttgtgctgtagagcactggtgtattggattctatcgttcagcctgttgcccagccgccatcgagaaggaccaggggtcacatccagccattatcgccagcagattattgtgtggctgtatcagacagcaacttggatctaaccaaaatacttccaaaccttttgacgagcgcctgcaagactatttttcaagcctcggctgcaacgagagaatttcacactgaacagttcgattatagagggagaacggcagaattgccgcgcgtttcgaacttagcccggttacttttggataacaaccagtacggctaacgatctcagaaacttcagtacctttggtgctcactgaagttgctggaagtctgaaacacatttaagaaaggttgatgctgtcttgtgctgaaacatacagtacatgtctcaaaatgatcggagagtatagttgggcctcatctgatttgtgcaagcacttgaattatcagccaatgctcttcttatgcaaggtagagaaggaaatcaagccttgtgttcgggagctcataatcattggcccatcccaggcctttccacgggtgggccaattattatgggcctccaagtgaggccttagagattaaaaaaggaataagttcaccaggcatccctcaactttacgtcaaggttgtttcacatccattatctcgaataccaaaatttttcaccactaactatacaaaactgtgcaattttggtcctatagcagtaggaatctttgaattcgctgatgtggcatcctagtcaacaaaaaaaaaaaggccacatgttagtgaaaagggaaaaaaaaaatgggtgggcatctcatatttcttctcttttctcttctcttctctt

SEQ ID NO: 48620 - DNA, 22397 bp, Oryza sativa
  unsure (1)..(22397): unsure at all n locations
tgctatgcccgccaccgctccacacccctcctcctccggctagggatgcaagcggggtgggcaaacgggttttttaccccgcttatctcacttctagtttagtttttcttctaaattttgtactaccatatgggaaatgacctaacaagcgggtttttatataggtagcgggactatccacttgcatccctacctccgggcaccttttgccgttgcaacattgaggttgtggcagtggggcttgggcgcattcgagtcggcggacctcgggcgccgggcacgggagaagcttgtccttggggatgcagagcaggtgctcaaggttgagcgcctcctccagcaagcagttcgcctcggcctcgatgaaccacaccccttccccgtgtgcagtatatctagggctccccgaggaccggctccgtgatgtgtcggcgacggggtagtagtggacgagcaccttggcgaaaccctcccacatggcaaagatcgatacggccttgtcctcgacgatttcagcgaatgcgaatggaaagacctggatgaagtcgacaaagacacggacggcggcggtcttgtcaatggaggatagtggaagggagccgcccggggtaggccctggctctatcgattaggaggaggaaggaaacaggggtagttgtcagttgagctcgcgtgcgtgtaatgccaccaccaacgtcgtgtagttgacggggagggttggtaacgcctcaactacacactgacatgtggggcccgatgtatgctaggatccttcaaaacttcaagtttatatgaaactcaagaaaggcgtttatgtaaaatttaaggtgtttatgcaaaggcagggtccgtcccaagtttaagtcaaaatttaagtgagcgaggtcggctggtatctctaacagtctctctatgtctatttggctagttagccaacaaaattaagtagttaaatttacctttcacttcaaaagcctctcctaattacacttttaatacgatggtgggtcctatatgttagcctctcttgttcccctacccttcttcttcacccttctctctcctcttcttttcctctttgtccccactttctttttccaatctccctcgatgttgctgtccctcgtctttttccttgtgccgttgctgcccaatacttcttccacccaaatagagctccccagtgttcggaccgacttctccactggctgaattcgaccttgagtggtggtcttggctgcctgtgatgagcggtgctcgtgaggggagtagcaacggctgcactcaagagctcttcttcggcagaggcaatgacgctcgcggcctacggcggcagctttgtctcacccatcgaatccttgacagttgcggtggcgcttgtgaacggagcagcgacaacaacaacatttgtgggaaggtttgccagcgcgcggcggggggggggggggagggtggagagagagagtggttgggccatggttgacaagtgattttggttggctaaatttggttaccaagtggaaggttggagaggctattagagcataatttttcgctataattgtcaaaatttgtggaaggttggagaggctattaaaacataatttgtcgctacaattgtcaaaatttgacttgagagattactggagcatgatttttcgatataattgtcaaaatttgacataggagactactggagatgctatgacagaatccgtagggtgtgttcgcatacactggttcccaacccggaatagtaacacggaaaatggagcagtctagtagcacgtgattaattaagtatttgctatttttttcaaaaatggattaatgtgatttttaagtaacttttgtatataatctttttacaaaaaatacaccgtttaatagtttaaaaagcgtgcacgcagaaaacgaggctgatgggttgggaaaaggggtgccgaacacacgcgtagaaatgctagagacgtcacggttgggcgtttccttccacgcgttcacagtgttcactggttcagtttagagtttgaaccaaaattttgtgcgatgcgaggccccacgtcgttgcagaatccagtatggaatgctatatgtccattgcgatttgtgtacgatccacgcactcgcattggcataccataccataccaaaggcaaggtcgcccgtagccacgtattactccctctgtccacgtcactagcggctcggccccgcgaaacgtcgcgcaccttcccaccgttccactccaccacgcgcccgtgcgccacacagccgcgtacgagccgttgtgtgagcggaccgccctcgcgcgcaggcgcgcgtcgcgaccagagcaggacggcgcagcggccgtgaaatgaaaaaataaacaaaacaaaacaccgggagcccagctacccgcaccaccggcacacgcgtaacgcatgtttggacttggtgctcgtcgtcgcagtcggtgtgcgccaccacgcgcggaggtgggggcgtggggctcgcgcacggcgcacctgccgcgcgcgtcgcggtacggcgctcgggcagagtggccccgtgtgcctgtggctctgctggagcctacacgggcggttcagccagcacgcaccgaactgccaaaacgtccccacaaaactgatggaactgaagcttgtagagaatatccggtgaacgattcgggcgcagaggtatctcacccatcgaaattcctcgtcagatgccgatccttttgctatttcgtagccaactttgctaatttgatcgattattaattagtaattgattaattctctttgcttagctgctaaagatatatgaagtggctcgcttgaagggaagggcgtactaaacacacgttatctcgtcttcttttcttgcacatatggacacgccaatgagtattgaatagtgcacttgcttttgtgtgaaatggtccaataaacctaagttgctcgtggcaccaatcgcctctctccttttccaattcaaagagataggctcgcactgttgcaattggaatgacgttggtccaagttgctctacaaaacatcggcgacattctacagtaacctgaatgtgactttggcacccattctatcaaacacaaaatacgctctaatgatttaacacaattggattactagttttttttttaaaaaaaactacatactagtttatgtgcttaccgttgacgataacaacacaacaccatataaaaggccactgatttaaggccacacattcttgttgaacgaaaaacacgttcctgtttctccaaagagaaccaaatgtggctaatgaaaatgcagacaagtcacaataaaaaacagaggctactatagaaccaaaataaacgctgttccgctattatccttgtaagcacaacagcgaaaaatgcctaaaataaaccagagaaccaaaagcaaaacgggcaaggaaacaaaaagaacagcttaggtttattttagcaaattagtaaacctaagctagggcaaggaaatagcgcgaaaaagaactaaaaaaatgccaaaaagaagagcacgaaaatgacaaaaagaaattagtaaaaacaaaaaaaaggggaacagaattggagaggaaacagcttccgtgccctagcttcccacccttccagcgagagaacagcgccgcatccatcctccaccgcctctcgtttatatttctgcgaggaacgaagcgaagcgaagcgaaggcaaaaacatccgccgccgccgccgccgccgccgccgccagttcgtcgtcgtctcgtcccctttccttcctccatccctcgctcgcgagcatcgcacgcgctctccccatcctcacatggcagctctgcgactccacgcacaacccgaacccctcaagaacaacccctgcttctgcttctgctgcttctcctaccccgatcccgactccctctcccgtctcggcctcgccgccgcgcccatccgcgcccaccgcactagctcctgattcgagcccgagtcgagccgagctgaccctccccccgcgtcgcgtctcctcctccgtcttcttgcggccgcctcgcctgttcttgctgtggttggttcttgggatcaggttctctgattcttgctgcgcggcctctttcgccatggggaagagtgagttcctctcttcgagttggttgtttggtggtgttggtgttttttttttttctggttgtgtgatgattttttggtgatttcttcaggtaagaagagcaaggtccgtggcgttggcggcggggacgacctgatcgacagcagcgacgccgacagcgtgggctcgtcgtcgacggcgctgtcggatctatccatgtcgtacgctaccgagcacgtcggctcgcaggagttcgtcctcgacaagtacatcgatgctctctatgagaagaggtgaagtttctgtctcgccatctctagtttctactacccctgttgccatttcggtattgtgtgcgcggtaccttgatttaattcgcgtagaaattgtgtgatcggcttctttccgtaggctttgcttcgatgaatttgtttcttatgcaactatgctgtcagtatggattgttattggcgtggtatgatattaccttgtttgaaatacatgagggcttgacacctgctcttaattggctgagatatttgattccatagatagctttggataatatttataatccgtcaaattatacgttactatgaacttttggattttagtttgcaagttgttcttatagctataaattaatgggatggttggagtttttttgctggattactgaatagtagacttcttaatgttgttctgtttcatgtgtactaaaagcattgtgagttcaagttccctgtatactatacttgtacagttactatggcccattatgataaactaagctagacaaatttattgtgatgtgttgcatcaatttttcagagcaacgtttcgtgacatttttaaaaccaactgtgatttcattggaaacttttgtaactgcaagttaccgatagttgtgcctgacttgctggtttacttacaaccacattatgtctgatgatgcgaagtcctgattgtttactgatgagggctaaggagctctatcgtttgcattcttctcacccttgcatccttctgatcagtgatattgaacagtcttatctatattcaattaatggtcttcacaataattttacgatctatcattgcatgtcttattctacaaaagaggatatttgggggtagaagtacaacatttatggaacttgtcttttgattatctcttgccactttgtatgtgacaaggccaccctgtatcatgtattgtatttagggtgatacttttattttttcgttaattgttgagaacctttgatgttacatgatggtgccaccctatattatggcacaaggtccacaatgcttctgcttacgtcatagttgctttttttccctgaaaaaacttgcttagctccattgttgttgtgaatgttgaatcctgtttatcaaatatggatctgacaaataagtagcaccatcatgttggatgttgaaattatcaagcttgctcttttttattgtacttaatattttaccatttgtgttggtgcagggggtctaccagggaagccgcactctctcaactggttgatgcttttgaaagcttcattcttcatggtcttgtggagaacaagtaagctaatacttccaccagtcaatcttacagttgcatctagagataatagttacttagttgtcagcaatatggatattatatagtactagtgattattgtaaacatgaaagacttatatgacaatcaagtccaacctagtcagatgtcagactaacacacttctcagtgaagatggactatatattaattcattctgttccattgtgaggacgtgttactgactttattttttccctctttcgaagatatgccaccctgctgagtctgttcaacagttcgataaagaagggatctacaaaagaggcttgtttagcatcccgtgccattggtatgtgccctgtaacactaaatactcatttccgttcattgcagctattgtttactcaccctatctattgggtgttttttggacttgtaggtcttttagcccttacagttggtgctgggagcagctcacatgaaataatggaggagtcacatgcacaactttctagggtccttcaaacttggccagatgcttccaagatgatttcggtatgtcaagtattttttttttctttagctttcaaactttctttgcacttccattcaagtgaatctatattgaaatgttgtaggcacttgattgcttggctgtggtgacatttgttggtgctgctgatttagctgaaactgagttatctttgaaagctatgtgggatgtgattcatccaaaatcaggttcaaatgtatgtataggtctcgttgacttttaaaaataatataaagtatttggacaaaggcatattttttttaggacaaactacaatcaaatgtactttggaatttttgtaggtgggaattatccgtaaaccaaggccccctgtgttagcagctgctatatctgcctgggcatttcttcttacaactattggttcatggaggataaatgctgatagttggaaagagtaagtgatacatcccacccaactctgtgtgcttgtgatgtagtaagctattcatgttcgtgaaattatttactttcttttttcttcatttgctaggcctattgcatttctctctactcttcttggtgcggaggatcgtgctgttcgaatggctgcgggtgaagcattagctttgtgctttgagctaaatttgcttgacgtttcctttggagaagatgatgatgttgagaatggaggaactgttggttctaagagtaaacttttcctggatatgcaagctttgaaagccaaaatatcaagtcttgcctccaatctctcaatggaggcagggggtaaaggtgcagataagaaaaatcttactgaccaaagagatctgtttcaacggatcttggattttgttaaggtctgcctcattttttcatgtttatgtttgaatgtttggttccgtttatttgctgccaataatgttgatctttctttccttttcagtatggtgagtgccctgaagaatctgttaagatttcaggaaagcgtgacgttttaagggtgtcatcatggtctgaattgattcaggtgcttacctaaccactttctctactgaattcctgaatttctgcatttttttttgtccctgcctaattttttataatgctatagttgaacttcttgaggcggtttcttgggagaggcttcctcaagcatgtgcaggtactgttttccagagtgaagccatttttgtattgtactaatttatctggtatattaatgtgacaaaagttggttctgtttttgatgcaggagaatggacttcttcaagatgtgtttgacattaagactgacaaagctgaaactctgtcatccactgataaggtgagaaactgagattttagctcccaccaccaattgaaagcccataattgcaaagtgcttttgaactggtaacttgttacatgataaccaaaagtcaatggttggatatatatttaaaaaagaacttgggaagtatggtacataaaatgcagtaaaccatgattgatggtaatccgctttaggtttagggttttgacttgaagctaccaattcagagtaaacaaaactgcaaaagtgggcactctatccttagcagcatttgcttccctgaggacaaggggagaaatgtttttagcattttcatgcacacgagccttgactactcatcaaactgctgaatcagttagtcttcatcttcttaggcccctgcatggatagttattccttttcttgaaaatcaaggggagctgtgtgatttttatcaggtcattaaattgttcaaacatgcacgagcttgcttacacgatcttccatgagcagcccctgctcgtcttttttcaaagtttatcctgcttgttttcacgtttcactggatttgctaattccttttgcgtatttctcatatacttttggattgctgatcacaaacaatcgcaaaacacttgcagaaaatcttcaggtctggtgaagagaaaggaagagctctaaagttgaacaaggaccgccgtttagcccaggtgagctgacctgttgctttctgttaacactagttctgttctgtgtggtgtgtgacccactttgttaccttgtttttcttcagttttgcttaagacatgatcaaaacagggtttgtttagaaagtagcttatttaactgacatgaaaatggatgctaaaagcagtgtctttttgggtccttggaggaaatgagagggagaactatatcctagtgttaatcataaaaggtacgaagaggtatcaagaaatgtttttaaaaaaagaatatataaagagatacctgtacctcaagtaccataaacaaaatcctcaagcgcaaaattaaaatgcttatgtttcttactttaccagtgcaccacaagaacagtggtggtgttacgtgtgtctgactataatagtatatttgatcttctggacttcatttcaggagaggaagaatgccgttatgttggacttggacgagtagcctagtgaaactgcagccgttcgtcctcttctccgtttagctggacttatctgtaacgagtgtttggaagtcgcgatttgttatcacgacgctatgcaaagcaatactgcagaaatactactactatactagatccaaaccagttcgtgtttatcaactcagcagtgcctttacatgtaaaggtctaaaccagtttctgttgtccggtcgctcagagtgcctttacatgtggaaacaaacgtgctgaaatgaaatctgattcctattggggtctatttatgcatgtcgttgctcgtgtttcctgtgattcttaagtactctcttgctcgtgtttcctgtgattcttaagtactatctctccgtctcagaatataagaaatctagtcctgttgagatacgtagctgaactgctcgtgaacgttggccaccgggcaacagctgaactgtctcaactctcaactgcctaccgtcatatggtcggaccggcgcgcagcatgaggacgttggcctcgtgcgctgtgtaccttcacaggctggtcggcgcaggcccgtggatgtggaacctgatatgttttgtggcatggctgtgtgtaattcaatcttttttttcatacggaggaagtaacttctaatatcaccaagtcctttaatagttaaacccggtataaagtgtatcctaacttttaggaccggagcaaaccgagtcctttgacaatattgaggggtccttcgataatttttttttagaactcttcgataatattgagatgtggttctatcggtgttctcatttttagttttacttctagtactacgtaggtgttacatgaaacaaataccgtactatgttattaagccatgtagacatcacaatagttgaacccatctttaataatatcgaggaacttcggtgttaaaatttttgaacttttacggtaacaatgaatgtcatctctccactcagatactttataaaataaatgaaacataaatttctgagccttacagattatgcaaagacaattcatgtacataatgtggatcgatctatattgttataatttagatccatgtttcagcattgttataatttagatctacatttacaaaaattcatgttttacatacaacaatatcgatcaatctatcttagtattataatttagatccatgtgacaatatagtggtgtaaatgtttccttatgtctctgctaatgggaagaaaagacaaagttgcggagtgcaaatgtttctctttttctctaactagcaagaagttggaagtaaaacataatatttgatagttaccatagtctttaatgtattggctttaatggatggtgcagcaaaattgcttgggaattcactcaaacaagccatctgtttcttgttccctaaaaacaggatctaaaggctcattaccgattatctggcctgcagagtgcacagatcctaaagtggttcattcttgcaaaatgaggggaaaagggttattttaacaaaagaaaaactgtgcggatgttcagctataccagcgttgtgaaaacgaccgaaaatctcatgtgacgtccaaccccccaaaagttcccattgctgattgagcttctccttcaccatttagtcactcaatataacatcagtacagaacctgaaactgtcatgatgggaaaaattttaaccgaagagaagacggttacttggtttgcacattcacactagcttcagaaacttgagctggtgcaaactgattatggaatatcaaatatgcatgattatgacatgataatgctactggatgccaaagaaatcatcgattgatcattgatgcttacctaaaagggatttgtggaagataatcattgacagccctgtaaccttgatacccattgtaccattaaacacatcaatatgtcagctatttatgaatatgatcttaatggatcaaatataagatcacaactgacatgtccctcatgaaatgccaagtttctccacgactttgccagcaatctgaattagtccattctcggattctcctggattcatattcaatccctctgtttgagtcagggacctcacgaacaactgtcagaagtcatgctgctgtgaccgcagaaaaaaatattcaccaataattaccacatgaacattctccatccttgaaatgatgaaaccgcctgacatctctaacaacaatttcccgtccaaccgcctttgacatgaacatcattgcagtatgacagtcaccacatattctcaagttttttaaaacagtaactgtagctccaggaggcaactttagaagtccaaatccaactgccagcttctcactatgtgcaaataatatgtattccttttcatgaggctccatatcatgcaacacaaactttgtatcaggaacatatcccagctttctcatcctagcaccaatcacttcaaggaattggtagacttcctgtgcttctggatgttttgtatcaccaacaagaaacacatggattttacttcctacttctatccaactgcacccaggctccttcttgaccccacgatcacgcattagctttctaactcttgcagcatcgacccaacgtccagcagctgaatatgtgttagacagtaggatgtatgttccatcatgctgtggtatcatccgaaacagctggtcagctgcataagcaccaaattccatatctccattagtccgacagccagagagaatcgcctcccaaatggacggggtaggctcaaaaggcattgtcttgatcaaatctctagcttctccaattcttccagagcgaccaagtaaatctatcagccgtgcataatgatcttctccaggactaatgccaaagtccctcttcatggactcaaaataatggaagccttcatctaccaaaccagcatggttacatgctgtcaaaattgtgaggaaagaaattcggtcaggatctatgccttcagcaaccatctggtcaaatagctcaagtgcctctctaccgtgtccatgttgcccaagagctgaaatcatggcattccacgagacagagtctaaattgggcatcacaaggaacacaagacgagcatcgttcacagcgccacatttggcatacattgttagaagtgcatttccggcagaattgcttgcctcaaatccacactgtacaagatgtgcgtggagctgccttccatgcttcagcgctccaagttcaccacaggcagctattgcacccgcataggtgtagtcgcatggtttgacatcctcagctttcatctggttaaacagtttcagagcatcttctgaaagccctccgtggacatatcctgagaccatccccatccatgacaattggtttttatatggcatccctttaaatacctcaactgctttgtccaaacagccgctgtcaatgtatcccgacaaaatggtgttccaagaaacaacatccttcagattcatagtgtcaaatatcctcttcgcaatcacaatctttccacccttcgagtacaaagtcactaacgcattgttaacaggcaatgctgcctcaggaacgaaattcggctgtaaccgaataatctgaccatggactgacttcccatgcacaaagaatccagcatttgcacacgcactcaggacgctagtaaaagtgaactcatcaagcggaaccttttccgacaccatcctcctgaatagctcaaaggcgtctgcacacattcccgattggacataccctgagatcatcgcattccacacgacatcaaacttaccatcaacctcctcaaaaactgatctagcagcattgacatcgcctctcctgacatagccgacgaccatagtggtccatgtgaggtcatccttatccggcatttcgtcgagcaccttccgtgcgtcccaggaggcctcaggcgtgtcgcacttcatgtacagagcaatgagcgcattggacacagacaagacagccgccgcgccggacttgagcacggagcagtgcagctgcgtgcagtgtggcgcggcgaggttgtgcatctggccgacggcgctgatgagcgcggtgaaggagtaatcgtcggggcggagtgagccggagcccagcagggcgtggaacacggagaccgcgggcgcggcgagggacgccctcgcgaacgcggacatcatggcgttgtggagcacggtgtctcggcgggcgggctggacggtgtagaagaaggcggcggcgtcccggagacggccggcgacggcgtgcgcggcaacgagggaggtggcggcgacggggcccgggtcggggtccgagcggaagagagccgcgggggtggcgaggtcgggggagagggtgtagaggtggatgaggcggagggtgaggtgggggtgggacggggcgtggaggaggtcggcggtgagaaggcgggcgtggaggcagcggagggcgcggaggaaggaggaggaggggcaggtcggggccggcgagtggcgctcggcgaggcggcggaggaggagggagcattggtgggcgagggaggcgacggcggtcggcggcggccgccatggccgcatcgcgcgttggcgtggtggtcggggcaattcggagcgcgcgccgcgcggcccagtgttcaattgggcgtgggcctttggttgggttcaggcgtttggcgggttagcggatttctgaacattactttcaggtgttcaaatgtttctgagcatagcaatgttctatggagtattgaagagcaagaggaggcacctctagcagggtttacattaccggttgaccactaaatttcgagccacatcgatatcacggttttcgataaattttgatcggtttttgataaatttcgactgaatttcgaccaaatctaatgtttaaccttcgaaattctaatcgaaacttaattccaaaccgtgtcaaaacgtcgaaattttgcggaatttgaccggttttcatcggaattgtgaaccctgacctctagagcatttttttttggattacacggtagtacacaagcacatatgttattacacacaacactatacttacacgctcataaatatgtctttagcttaaaagatactacctactttctagaatgtagcaatctagaatgggatgacatgttctaggatgggtcttattcaattataggttaatacgttctgaaatggagggagtagaaaccagcgacacgtttccgacctgatatttaattatgtgttttactgtaccggctcttacgtatctatgacagagaatctcacaattcttctccatgccactttctctcctgtaactggaggtacactgaagatttctaatctactactacctactaacataatatgtttagcctaaacacgatcaccctagaatcagattggcagcgcaccgttgcatccactgcatctactgatctactacgtactaacataatatagtacactgccggtttgattacaaaggagtcactgacgatcaggtgtgacgtggcagcatccctcatccaatcccttcacttgcattgatcaaggactgcactacgaacaccctccaacatttagcttaggatagagatggttaacgttttttggacaagaagaatgtgaagtgatcgctaaaaaaacatgaatactagggaagaacctaatatcaaataattagaatgggtgaggcttcaaatccaggtcgtaatccaccatcttgtgaaactagtcggatgatccctgtgcgtttctctgaagtgattgttaccatgacacggtgttggcatcttttgttaatatcacgttgtggatgtcgaggataataaaaagaaacatcggcgtgaccgatcaatgcacaaaaattgggaaaacatagcgttgattcgcggtgatcgtgtaagcaacgagtggaaacggccctaatgtggttgactcccagttttccatgctgagagtcaattttcccaataatcaccgttttctaaccacctctgaacttccttccaacctcgaaaacctgatgcaacaaagcttgctaaaaggtggggttctttgttgaaattcgttattataggaccatgtttggtttatgattaactaatgtcacagactcacatacagccttaattagttatgttttggcacaaagtgaccaatggaatggtttccacaagttcggaaccacatggctaaggaagtcaaaatagggtcaatgaaccaaaaactaaccacctaaaagtgtcaagccacatcataaagaaacatgtgcaattgtcaactttggcattttaatctcgatcggcgtgtcagagcatgtcactggttttatgtcctcctacatgctccaagtcccaaaccgtgatccaacaaagtacagctttataaattgtaagctgaaccgttttaagcaaggaatcgatgccaaagaagcaggatcaaaccctaccaaagaatgtgactttaaaagagtggtacttctgtcaccactaaaccatgtcgtcgaatgcactccatcaatccatatgtagccatgattgatgcccacaggatggaatgtatgtaaaggcaacgcctaaagatgataattatcgcctgaagatcgatcgatcgatcgatctcgctaattaacgggccatctgcccgttattacataccaaatggtactcagatcacactgatctgaccaacacactagctgtcagtctgtcacccgttacaagtgaattattgagctccaggctagtcagaccaacggattctggctagcacaaagaacaaatcttcagcgattccggcggcagcagcagcgagaacctgacgaaacggtcgccatctcccaaccgcaaccatcgcgcgggccgggcatgcgcactcggcgtctgcgtcggcgacgcagctgagctagctgtggacgacaggcatgtggaaatatggaataaaccaaacgacgtatttacaaatgaaaagtaatttgtaaataaaactttcatatacgtgctaataacaaactaaaggaggagtccctccagttgtggtggaccgtcctatcgagccttgagctcctacattgcttcctctctgacgatgtttccttccacgagtggcactgctcttgccaactcaacgttccgcaggagcatcgttatggattcgacacggtcgtgacccttggtgcgcgttccatttggaaggaacggaacaatcgtgtgttcaataactgttctctgccctggtccgatgtggtaataggcatggcgcaagaggccgccctttggtatcttgcccatcccctgtcgccaacactgccttcctagcgtattaggtcttttagtcgtcccattgtaatcgcaagaataggtttaagttctcgtttttctctttttcctccttttattcccaacccctcctcccccaccccttctttttttttcgtcatctgtgtaaattttattcctctgtgtaatccttttacgtattccaaaaagagcaaactaaagcagaatgctaaaaaataaattttgatgaaaaaaatttctaaaatcagctacaaatttaaggttgaaaatttaaaatttggttgataaacataatgaagccggacgcttcagtgtgcgcgctgagacagctagaggatagaaacaaccaagcagcaaagctaccttcctaccgcacactagctacctttgaggcataggtcgcctctcgcctttcagaattttcagggcctcatgattctgccatggatgtaacagcgagacgtcgatcccgatcgatcgacggtgtaacttccgatcaaatctcagcagcacgcattccgttctcgagtagtaggatccgcgagcacggcgacaacggacggacggaagcttgcgttcttgatttccttggcgccattatccttgcttgattagtgagcgtacgtgcgagattagttgcattgcacaatcgcgcatatgcaacgggtgaagcgacaaaaaaaaatctgcgtgtcaaaagcggaatgaattgatcctgaaaagtttcaggttcacacgtgaatcatgaacggcttggccattttcgtatcccactggattgcatgctggcactcgcgcgctcgtccatcacaacgtcagatagcacgctgcatatgctgtccattttctagtacgctggccgctgggccgtcgtcgtactgaagagcgagcacggtagctgatgcttactcgtagacttacctccgtcacattataagtgcagccgtggtttttcgcacccaactttaaccgtccgtcttatttgaaaaaattttgaaaaaaatttaaaaacataagttacgagtaaagtactattcatgttttatcatctcataacaataaaaatacaaattataaaaaatttttaaataagacgaacgattaaagttggatgcggaaacttatggttgcgcttataatgagacggagtgagtacacgccaaggccagcagagaacgtactgtccgtccgtttctcatgccacagtcgcggttccagtcaaagttttttctcgtcacggcgtctgaaatcttctctctgtgtgtcccctatctccggcacggtttatgtcacaattttcatgccagcttgacaatgttggcgatgcgccgatgccacgtttgtgccaaggcccattgtccccaccagagttttccaaaccgccgataatcgcgcagttatagggtactaaggactcgtacaacggtttttattagtggtctttctatttctatacaagtaaatttaataacatagaaaaaagaaaaaagagtatggttgttgtaacaccctaaaaattcgacgacaaaatctaaactctaaaaatacggatcttcaaaaactttttaaataaagttgcatcatgccaattttgttcgattattttattgaattttgatttcggagtttataaatcgcgaataatggataattagttaggaataaaccctgaaaagtaaattgactaagtaaataattaaagtacaatttaaaataatatttagtgaggatagaaatgagtaaaatattattacgactatatttgtatcaattaaattgaaaagtgtcggaataagaattaactctaattaaattcaagaaaattatataaaaataaaatatgggtaaaattaatcaaggatggacccattggatggaataacacaaatattgagtgaacttcatttgtacaaaaattaaggtttatagaatcaattttaaataaataaataggcttaaatcgggtaaatagaaaacggcactattcatcggccgccaggtgttcgacgaggtcccctagcctaaccctgccccgctgccgcgccgacgccgcgcccgcgccccacgcctcgcgccgcgcaccgccgctaccgctgtcgccgtcgccgctcgcccgtcacatcgccttgcaccccgtgtcgccgctgccacgctgtcaccgtcgccgtcgcgacccgcctcgcgccgcgcgccaccgctgccgccctgtcaccacccgtcccgtcacgcgcgtgtcccatcgcccgccgctgcgccgcgcaccgtcgccgtcgccacgtgccattgccgtcgccgcctcgagccctacaccgccgtcgccatcgccgtcacgccgcgccgtcccatcgccgcgcgcgtcccgtcgccgcgcgcgtcccatcgccgcctcgtgccccgcgctgccgcgccgccgtcgctcaccctccttcaccgccccctctctctcctctctctcacaccctataaaaccccccagcccttcttttctcccccacacccattcccctccatcacctccctttttaccgcgccgccgccgtagtgccgccgcaccgccgccttcgtgctgccgcgccgccgttcccgtgccgccgcgccgccgttcccgtgcccccgcaccgccgttctcgtgccgccactcccgcgcccccgtgcgccaccgtcgctgcccccgtcgtcgccgctgctgccgccggtgagccgccctccgttcccctagcgtccaccgccgccaccgctcgggtgggagagagagccgagagagagagggagaggaaaagagaggctggcagagagagagagggagaggaaaagagaggccggcagagagagagaaaaagaaagagaggaaaagaaaaagagacaaaaaaaggaaattagagggagattagggaagtttagaaaatttaaaataattggaattttataggttaattatagtcatagaattgcaaaatttaatataaattatggattattcttggcaatttctataagaaatcaattcgcggtaataatttagatgtagttaataactaaacaaatagatgaattcttatggattattatagattatttttttgggtaatccctataagtaatcaattcacggtagaaattcggatttaattcctagggattttagccgtgtattatatttaatcatctagtcatagactaaattaaatcatataatatttctaggatttcgtccgatatttagctcgcgatagaaatctctaacctattatatggatataatgctcgggtagattaaattaaaaacttatgacaacaaaacatttatacccgcaaaatagtttgaatcgaaattgggtttgccttagttcgcgaataataaagttaaaataaaggaatcgactttcgcattcgactttcatttggatttatttggattttgtttgaattctaatcgaattcaaattgttctttcgcacataattatagagaccgagggagccgcggatccgggtgaaggccaagacccgcaagaccttgagcaaggcaagtcatcactattccttgaacatgttgatcccaattgcgaagttgttttgtttacaaataaaattgcatgcaattatgaatatcctacttgtaattatgccatgccttgattattgtttaccccttattccttcgtaaccatgtttacgtatgagtctctagtcaattatgacaattgcttagaaatgctattctagaatcatgcatactcatatttatcaaatgctatatgcttgggcaattacctttgggaaggtaattgagatgcggcatgtggagacatgagcgccacattgccatgatattgatgacatgatttgtgaaaggaaaaaaaagttaaacaactgttttcgactggggcggctggaggatttgggtggtgtccggaaaaggctagtgccgtccctggtcaattaaggaacgagccatgaagttaagcatgaaacgaccccccgtacaaccgcacttctcgtatgggtatagacctagcggagtggatagctgagcggaggcagtatccatgcgtagtggtcttcttttagctgtgtgatgtggcagcagtctgctggcagatgcccggttcggatggccaggtgaatggcggatgcctattccggatggtcagaggctggcttggcaatactacatgaggatacccataagagaacaatcatgatggactgggttcaacgacaagaagcaacgtaggagtgtgtgtttttcccttcccgggagcgccagaactcctctcactgctagaaacgtatgacgcctagagtgcatgaggatgtaaagttcatggagcgggtactgccaatgcgaggttatcgaaaagctttgccgtgacgcgtctcatgtgttgggatgaggctcatgtgttgggcagtcgcggagtgcgggtaaagtgtacatccactacagtgtgagtaaaccaaatctattcgaatagccgtgctcgcggttaatgagcactgggacatgtattacacttggctagactctaaattctttaacttgagtgggatggaatattgcatgataatttttatgctgatggagccacttcctgagaggcgggaatgtggacgtcctcagaaaatcataacgactctatggcgggaagctatccttgggatcacaatggatggtggacagaaccgtcattgtttaatatgaacaatggtattaaaacttgattagtctttgctaggtcttaggcttgtgaaaagaattataaaacttgctttgcgcaaatgaaccatagccatcctttgaaatcctctgtcatgtgcatcattgctgtggtggcttgctgagtacggttggtactcacccttgcaaatataaaatttatcagaagcgggagatgaagcttcggaggatccctatgcctactaccaggagggagatgaagacgaaggcgcccaataggtcttagtacggtcgttgcctgtggcaatggcatgccgctgcttaaattctgctgccttacctatttctgcttttggatgtattccggaccgcttggtccgatgatttaagactatgcctgcaggcttatgatgtaataattcgtactagacattcgtgtatgtgtatttggtatttcagctatgaattcgtgtgtaccagactacttgatccagggaaatggtactgtttacacgattgattcctgttataaaaacgggggtccacagttgttatgcatgataacggctcagagtcgactcttagtatttatttgagcaaattttgttgcatggtagtgaaagaaaggaaagaagagtaagaaaaaatatttttgatacattaatgattagagatcatattgtctctatctgctgtagaatgctactctctagataacgtagagcttatatctgactctatctttatacatgtcctaaaagaaaccgcaataacctccttaaatttaactaaatttaaaaattaatttaaaattttgataaattttatacgatttgtcatggttactatgggtaccgcttatcgtcgggacacgataatcccggtccggtggtctgagaaacgctggtcccgcaactcgcgatttgacgatttgtcttgcacagatcaccggctacaattcgcgagctccatcaatcccatacctgtgcaagctacctgccactgtacagactccatacatgttacttctactactagtactagatgctacaccgtgtagcagcgcactgtttcgccgctatgtagagtgaaacggccactccgctttcaggccgcacgtaacatcgcgcggaactcgccacgtcagccggaacccactgatgacacgcacgcaccaacagtgtgtcaccgcagacgacaagaccgtcgcgcaggggacactcccacatctcacgtcgtctcagccccccaaagcatccgctaccttcactgacatatgggacccacctttggtggggtagctggtgccagcggaaggggggaagcaccggcgccagcgtggccgcttcttccccactgggcctccgcgtttggttgtttctggagcccctggaattcctcttcatttattattgttcccccctgaagctgacgtctggggcccacctggggatgtggcccacgtctcattgggtaggtgctgatggccaggcgtttcgcgtgtttttgtgaccgcgccccggttcaacacgccgaagtggcggcttgcggttagtcgctggctggtggggcatgcgagatacccgggcccacgtgtcggtgagaggaggatttctggaagaaaggagcgcttggtttcgcctaaaanaatagggggggggggcaaacgctcgcatttgccactcctggcgaggcaaagcctctccaactttctcctaacgaaaaccacgccacgagaaggaagtgagccaacgacgctggaattttttgaaaatttcagaaaaaattta

SEQ ID NO: 48621 - DNA, 7892 bp, Oryza sativa
  unsure (1)..(7892): unsure at all n locations
catgccgcccatggccgcgcctgcaccgccgcaaaccaatcccccacgacctgttcgtccgccaccgccgccgcccccgccgaggcagaggctgctccggccgctcccggcagaatcgccgccgcccgccgcgctggccaatctggaactaaccggttcccccgtcaaacccgctgttgaagacaggggaggcgagaattccggcgccgcgcggccgcccaagccgccgcacctgaagccgctgcactgggacaagctccgggcaatctccggccgcaccaccgtgtgggatcaggtcaagaactccgacacattccggtgcgcccccctctcttcaccccccccccctccattcttccacattacccccatctctctgtttcaactgagctgtctatcgatggcgcggcagcgtcgacgaggaggcgatggagagcttgttcctgaacagcggcggcggcggcgcggggagctcggacccggcggcgaggagggggggatccgggaagcaggagaggcggttgcttgacccgaagcggctgcagaacgtcgcgatcatgctcaaatcgctcaacgtggccgccgacgaagtgattggtgcactcgtgcgtggtgagattgtgctctcaatttcttacttctcgcatgacgtatgtggtgtttggtcccctactactgtgtcattgtggaatttatcaattactactactgttatgtgctatgctctctgcaattccggtggccacatgtcattgcacagtagtacaatctagtcactgttaaattaagcacacaaacatatagtacctgacaagtgatttggtttgtttttttttttggaagatgagtaagcctgtttggtttctggggcaaaaaaaattctcagaattaccttactgctatcagagaaggaaatgaaagatgagctaaatgggagaaattccagctttttgactgtacttaattttctactagatgctaggttagcataatttatcaattcactctgtgctaccgttgaatttctgactcttctattcatctgaaatcgacaatgaaagtcggggcatctgtatgccacaaatcataaatcacatgtcagtatgccaccaagacctcaatgtccttacaaaatcatatttttagtaatcttgttgactgaacggcagtttttgagatatttaactctgtactcatcactataatcagtaaatatttctagaagtgtcacactgttctacaccaacgcacaaattatacctgaaggttctcgaaatttcaggcataagcaattgtcgtattgctcacctaacaaatatgggagtacatgcctagcataccagggaatctctctccctctccaatcccccaacatgacaccttttcctttaattttgatgtgaactgatagagaaggctcctatacttgtcctgcattttgacctccattgtcacattcaattatatttttggtggggggttactttcataatcaaattttctggatgtaatgcgttccaacaaggataatttgtgcaccataagtccgatgattacatggcaatgctgtgtttgttccaaataagcttctattggttgatgttaagtttctagagctgagatcctgggactgtgggtgcaagtgactggactggagtatcactatgcgatgaaacatggacgttttctttttgttatgtaacttttaatttgttggtacatatacttttgtgaatagccagtgatacagtctgttgccaaaaatatatttttaaagaaacagtgatgtagcatcattggtcatgtcatgttaggccatggtgagatcagtaggcagattgtgacatggatagaataggcgagatgcatctttcacaaagacactagtgctataccttttcgtgtctgttctgtattgtgataatgttatattacatgtctgtattttcaatgtgataatagctgcatttactagtggcatgcacacagatgagctgtcagttgctttagaacttctgcactattagtttgtagaacgtagattatgaggacttccttgccaattttcattatccaaattaaacttacatcttcatttcaaggtttgttttctcattttattcatcacaaaccatcaacttctctcttatattggcctacagacgtgtcactcgtttatcgtttgagctggaaataattggtgatataatttctattattttttattgtgaatatgttaacacaatattcttgagtttatcatgtccaatttgtgaaccaggattctataggttttgtgagttactaatccattcttaaagtaattgaataacaaattaacttggttgatattacatacattgctcattgttaaaaaaggacagttgaaattcttgtacaccgaaacaaatctggttgaattatagaagtggttgtagtaggtctaaacgtctagtttcatcaatgccttactgtcaagggacatcccttaccaaacttaggtgttttattgcctgatcttgaatagtacaatcatctttcaggttgttatttgaccatctatatatgctaagaaatatgttttctttttgtagataaaggcatattgcattccgtactaaaaactacatatgtcatcatgataagcatgtcacattccgtgctataaactccatcatatgtcatgagtgataagttgtcagagatcacgactgtgttgggaggctaactaccagtgaacgctattgattattgttgttggtgtacaaataaaattcagtagaaaccataactgaattgttgcttctttacccatgcacagtgacttatatccccagattttcctattatttctattgttaggcgtctcgcccggcgaaaaaaatttttgcccggcgaaaattgttaggcgtctctgtatgtggttggtatacatcaactagaattatgaatgctgtgaacctttgtgggattatttaatcatcactgttacgtgcatgcacggtttccttagggaattcctattatagaaaaggttaatgctgtgtatgctacagtagtgggcctatgatgcagttgttttcttatgatgtcacatggaaacattcattggctatgttggatacttggatccaacaacttccattccaactggagtatttgtttattgtccagagccaacatatctcatcaatagttcaatacatttggcgtgatatttaaaacatagttgacagtactcagtgaaaactcttgcataactgcattactttttggagtatgaatgatgcaacttttgcctgatttagttataaatgttttaatctgtgttaccaggaaatcctgaagatttaggatctgagttctatgaaacactagctaagatggcaccaacaaaagaagaagaattgaaactaaaaggttatagtggcgatttgtcaaaaattgatccagcagagcgctttctgaaagatgtacttggagttccttttgccttcgagagagtggatgcgatgctgtacagagcaaattttgacaatgaagtgaattatttaaggaaatcttttggaacattggaggtaaaatagctatgatgatcttatcattccatgaagcttacaatacttcctccattttacctaccaattatatcaaattaccaactgtttagatattattctcttctcttaaaaaatgtaaatttaagataggtgttttcatgcttcacaaaagatatgccacacattctaagtttctcacccgtgatctgtccccaaaaaaaaaaaaatcaaatagatcacttatcaaacttctgaattctcaattattttggagtaaaatgtaatattccttcagaaatctttcaggcagcctgtgaagagttaagaagcagcaaactttttttgaagctgctagatgcagttctaaaaaccgggaaccgcatgaatgatggaaccaatcgaggcgaggcgagggctttcaagcttgatactctcctaaagcttgcagacatcaagtcaacagatggtagaacgacattgcttcacttcgtggttaaagagatcatccgatcagaaggcttcgattctgatcagagcgcggttaatcctggcagcggcagcaaggaacagttcaaaagggacggcttgaaattacttgcagggctcagcagtgagctctccaacgtgaagagagcggccacactggagatggacacactgagcggcaacatcctgaggctcgaagccgatctcgagaaggtgaagcttgtcctacagctcaaggagacttgctcagatcaaggcgcgagcgagaacttcttccaggcaatggttgtcttcctcagaagagcagaggcagagatcaagaacatgaaaaccgcagaggagaacgcgttgcgcctcgtgaaggagacgacggagtacttccatggcgacgccaccaaggaggagcctcaccctctgaggatattcgtggtggtggatgaattcctcctgatactggaccgtgtttgcagggacgtcggcaggacgccggagagggtgatgatgggctccggtaagtcgttccgcgtccctgcaggtacctcattgccgcctcatcggaatgagaaccggcgagttcttagctcctccgatgaggacagctcgtcatcttaggagcaaacatttttggtgcataggttagctgataagatttgagagtagtgattcttccggagctgaacattgtggtgtatagactgtaatcaccgtcagaaataagggagtcgtcactgtctgtcactgttaaaagtagatgtttaccaaagctaaagaaaggtagctgtacaaactacaaaggcattcagtattatggtagtatgttcttaccattcagctcaaatagcatctgtttgagaattatcatattaagagaaaatatatttgttggaagtgtaacttcagttttcttttcaatatagtcatgttaccgctgaacaaatctatgcaacctttgaacaagtcatgaacagatttcgtggtcgaaagtgacaattcaattatcagctcggtagcgtcattttagagaaactagctgttgcgcggccactacccaaacaaaatcatatattttttagtatgattttacttaaaatttattaaatagctatctcattgtcttaagactttaaaagaccaaaccttatcatcctcgcgtttctaattatatagtttttaaaagtcacaccatttgctaccccttatgtcatctcattctttatttgcttgctcgatctaccactatttctattcattcttcttggaacctttaaaaattggattttatagtttttagagtttattgtcatgttgggtttcgtttttataatttctatatgtcccatcaaatgttgccattatattcctctacggcccgtccactgtttcttctctttgttgttattgagattttaaaaatcgaacataattatcgtttgggttcatttttactttctagaagtcccgccaaatcatcagcggctttgccattgtactcctctacggcttgcccgctgcctcccctctttattgtcattgagattttaaaattgaacatgattatcattgggtttttttttacttttttggaagttccaaacctttaaaaattggacttgtagttttttttataatttttagaagttccatcaaacgatgccactatgcccctctacagcccgtccatcgcctactctttattgtcattgtgattctaaaaatcaaacataactatcgttggaatttattttttattttctagaagtcccgtcaatcgtcggcggctctacaactatactcttatacaccccgcccgctgcttctcctttttattgtcattgagattttaaaaatcgaatatgattatcaatagggtttattttttttactttctagaagtcccaacaactgctttacttgtttgcttcatggcatgcctggcgcccctccttttaatcgtcattaggattctatttggtgttttattaataatttttatatgtcgtatcaaccgccaccactctactcctttataggtatattacttaatttatctcgtcatgtgttttatatggttttttctttcaatagtctttatttttatcacaaattttagttatttataaattgtattcctaattgaaatcttatttttcttttttctaatttcagaatttattttttaaaaaattagttaataccgtattgtgttcttttaatgtttttattttttattttcaatttcagttgtttcaaaattgtattcctacttgaactctcttttaatttttctaattttggatattattttattttttattcaaaattttaattaatttcatattgggttcttatatggattcttctttcaatattgcttatttttaattccgaatttcagctaattttaaattgtattcctacttaaactcttcttttattttattttgctaattttggatttatttttatttttattctgaattttaattaatcttgtattgggttcttatatgggctcttcttttaatattctttatttttaattccgaatttcagctatttttaaattgtattcctacttggactctcctttccttttctaattttagattttattttatttttatttcaaattttgattaatctcgtattgggttcttatatggaaacttctttcaatattgcttatttttaattccgaatttcagttatttttaggttgtattcctacttggactctccttttcttttctaattttggattttattttatttttatttcgaattttgattaatcctatattgggttattatatagaaacttctttcaatattgcttatttttaattccgaattttagctatttttagattgtattcctacttggactttccttttattttttttctttttctccgattaatgtgggaatttctagcctccatagcgaatgtggtgcctccttttcgagctgtcttaataatataatagattttcagtcagttagtgctatttggagaaattttcagttgaaagaaggattggggtgcgtttggttctttgccaaacctaaccaggtaaccaaaatttaagcattgctatttttttcggtttggttgattttattgagttacatttaccgatcactacaatccaaaagattaaggaattaaatttgaaaatatactattcatttaattttttctcagtaatattcgggatgtaaaattttttagggaaatataccgtcggtctcgctcaaccgttaagcgaaagtgacgtgggaatgacgtcgcaggcggtatcgcttagggaaagcgcactttcgcgtaacggttgtgcgagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 48622 - DNA, 9794 bp, Oryza sativa
  unsure (1)..(9794): unsure at all n locations
ccgacggtatatttctgtaaaaaaatttgtatcccgaatattcgtgagaaaaaaaatcgaatgaccaatatattttcaaatttaatgcaaagattaagttgatgagaaacgacgagcaatttattttatatcctaacactaacacacgtgaggcaaacaatttattttgtactcagttactttcccaaaactttggcaatagccaactcttgccattgccaaaaaaaattggctaagactacaaacgacaccaaaccaacaggctgttggagatgtttggacttgacctgaaccgtccacatcttatgggcctctatatttgggccttacattttcccaaccaaaataacaatacgaatcttgatgggaagtttagacggctgagatttcgcggtaaccgccattcaaacccgccaccgagttccccgccccaaactccgccccgctctctccgaaccatcaaacaatctcgcaccactttctctctctctctctctctctctctctcgtcgcgtgtcgtgtcgtccggaaatgccgccggtgtcgtcgtcgacgtcgaggccggcgtcgctgccgtcgtcgccgcacaggccggcgctccggccgggcagcctgcagcggctgctccggccgccggacccctccgacgacgacggcgccgcccccacggcgccccgctcctcccgcggcggcggccgcgtcctgctccaggtcaccaacatcacccccgcgctctccggcgccaaccctttctccggccaccacggcttctacctccgcctctccgactccgcgcgctcctgctacgtctccctccacgccgaccacgacgacctcatcctcaccaacggcctccacatcggccaggtcatcgaggtcgagcacctggtgccgtccgtcccggcgcccgtgctccgccatttccgcgtcctccccggccgctacccctgcatccagcaggaacccgccgacgacgccgcgcggcgggccgcggcggagtcaaggagtcgtgccgaggcgccggcgccgttggtggcagacgccccccatccggggcaatagaagggcacgccaggcgggcggcggcgcctcccctcttcgatcagctaccgccacaggtcacggtcgatatcgaacttgtcggaggcgggcgcggcggcgaggaggagcggcgccgccgtcctggggaagctgaggaaggtcagcgtcacgtccatcgacggcaccagcaccgacgacgacgacgaggagtccgacgtgtcgtcgctgtcctcggcgaggaggaactgggatttcaccggaggcgtcaaggacaggaggcccgtcgctccacggagacgcgggaacagcgtaaatccatttctttgaatctcccaaaatttcgcgccaaataacacacaaattgcaacaaatcaaagctgattcggtcaatttttggtctatcatttaggtttctccaagtaaatccggcccaaactctactatcacgcagaatgatgatccgatggagtcggtgaggaggaaagccgagaaggcattcaacgtgctctccaagagggcgtctgctaagatgaccagagaaagctctaattgcacggtggcgacgccgcagagcgctgcggcgtcgagcagcatcaagtggtgtgagagcaatgtgatgtggagcacactttcatcaagcttgctgaagcatggaaaggtatactggtatatctccctagttgattctactgcatttttttttgcttggttctgttctttcaacaagttaattctggtgattattgtttgcccccaattgcaggaagcagtgaagcagagagatatggcactgcaggctgtgcttgatggattgctagaggcatctaccactgagaaattgataaaatgcctgaggtgagtgatgtttagagcttatgtagaattggcgagaatgattgggtgaaaattttacatgaggattgagaaatttgggaataatacagtctgttagaacagtaaatttgattgatatctgatttcacttaattatagaattgtatgatcaagtttctatacttgtaaataacattgcaccatgtaattgatagttcatttccccctctttttgcagtacttactctgaactacaatctgacaaggaagaaaacccaaaggagctcatcgacaggttcttgaaattctctcaggaactggatcatgctatcttcatcgcccaatcacagaccaaaattaggcatgtaaaagcatgtggttccaattcaacatcctcagcttcaaccaaagctgctttgaaggctgcattggataggaagcagtctgccatcttatggatcagagaagccattgaagcagacctctcacctttttctagccatacaagacccactgaatcaccaaagctatcactggcagagtcaaagcctatgaccccattgttctgttgttccaagccaaagtgcaactgcagcaaaaggtcctcaaggaaagcatctgatggttcctctcaaggaagtaacatgagtgctgccatggacctggctgtagcactgagatcagagtgcaactgttggttcctcaagtacatcgacaagttcttggacgatatcgaaagcgagaccatgtatgcaccatgtgattcccaagttgcaggccttctgcagcagcttaaaagggtggatgactggctcaaccgtgtcgcgctacatgagaggatgctttcggttgaccgaacaaacaaggatatcatgttttctgaagaagaggagagcgatgcgtgcgagagggtacggagaaagatttatggagcccttttaaggcatgttcaatatgctgcaatggcgctagaaggtctaaatggtgtaattgatgaagagaaggacgagagaaaataacagtaactgtgcaaagagctttatcaatatatagaatgaacaaataaattttgtgtagctgcagataatataagtttaccatcgtcagaattctagctggtagaagcatgttaggcataacttccaaatgctgtctgataaatgttggatgctctgatggtattgttgcaactattgctaatcttgtctgtgatgagacatggcatccaaaaactaacaattgcctcaagtgcgactttaaggccatgaaagatctgaatagtactattggtgaacctaagtaggacattgaaacaaagctgaggatatctggtgcaatttacactctgatcaattacttgctacacttgtcattacatacttgcatacatgctcatgactgcatctcacatttcattacatgttcttcggtacatttcaatttgtgttgatgtactggtgatgtcaattgtcaagtgtactgcctttttcaaagttagggcccctttgaatcaaaagaattatgaaggaattttataggattgaaatcctataggaaattttcctatgtagccctttgattcaaaggattgaagttttccaaatcctacaaatttcctatggaatggcttatagtatataggttttggaggaaacttagcaagaggtccaacctcttggaaaaaatcctttaagtctatctctctcatccgattcctgtgtttttcctgtggtccaatcaaacgatcattcctatgtttttcctgtgttttgcaatcctctgttttacgcttacattcctgtcataatcctatgtttttcctattcctccgtcttttgcagggatgaagcaaagggtttacccctgtgtgtctctgggttagtatgtgtacaacaaattttgaattattttttagaaattagcctacctagtacctctcttttgataggattaagcttgtattattcctgtcaatgtatatttctctctcaaaaaaataaacaaggtataggattagtgttacaaatgccaacactgtgacatgaaaaatactcatctcaaatggaagtcaatcatatcacttgatctttgatcattaacatgatcatgattacttcttcttatggctttatggtaaatgccaagtagtaggaagaaaaatgaataaagttacattacatgtatgatatttgggactatatgggccagaatcaattaatctctatgcaattcaatgttagctctgtatatccgaggcgatattatttttgcagagaagagatgttcagatcaatattgctgatgttgactccattgtaagcgattggtgcatacatccacgtgtcatcagagcttagcaactgcacatgatagtttgcagcaaagttaggaaggtatttcacttactgtttatagaaaaataatttggttattaacaatccttggctagatgacaatgatatgtaatgtacccaccttaatctgaagttgcaaaaatttgacatactgcactgcttcctccagcattgtactgatgtcaacctgtcagatcatacttatcaagttacacccaaatttctttgtaccaattatcatgctcaaatgtatgaggcaaaaacttagttattgcctgtagttaagtttcatattgagcttacctttgttccattgggaaccaagttctgcaggatcctcaatctttcattgatcctctctctcctcttctgtagaacggacaaatttaacctcatcagaattccttgaatcactttgtcattttttttacacattttattttatttgtacttacccttgcatagagactctggggatcggttgccgccccacggttggccctagtacccatcttcttcgagctcggcttcgcgttgccctccaggtttccttcctctgaggtgcaactgctagaactttgcgtatcaatgtaggtgttgccgccttcgtcgctgccaataggatcttttttgccagccttcttgctcttctttgatgcctgtatcagttcatcaatccaattaggcatggaaaataaaacagcatggtaactgaagtagatcactgttctattaagttatttgcaggggcataccgtcatggcagcactagacttcctcttggtagccactggtgtaacaacctttgtagcttcttccactcttgctgatggatggttgccatgtggagggctgatcagatcctcagtaaggtaggggatggcgcaatgcgcgtcgagatcggcgatcgggaacggatccatgaccgggaactcaaagcttccatagctatgagctggatcagggaagctggtgacgctagagctatggccatgctgaggccagcattgtggaggcacatcgtagttgagacaaccagaagaagaattggagtcggtgtcaaggccaggcaagaacatcgctgccattgcctccatggactcatccatttgctcgtaggtgaagcagtgatcaccatgagctccaagaaactgcgccatcgcgtcggcctcgatcaacggcaccgctgatgtgtatgatctctccatttcagcaaggtgaaaaggcctcaaggcaaagaaaagcactagcttaattagagagatgctgccgctatagtcagctgcaatggctgagttgcttctgccatgcgtgtgatgagagggtatttgtagggtgggtgcagctgggtggccaccattgctgaccacgaggatggagacgccacacaaaaacaattaatcatcaccaattgtttcttgttcttggcaaagaaatgttatctccaatcctcagaggtcaaccccgtggggacggtgctatgtttgatggcggccggattcttgatcttgatatcgacagtccataaacaaaaccagcatgcgcaattatgtcgcggaggtacggcgagtattatttatcttccaggcaagattggtatgatggggattgtttagccttgaaccaagagatgcattggcctctggccatttgcgcaattactactctcccttgtagaacgtgggaagtggtggtgagttgaagcgagaggcggatgcaacgcaagcaaattaaagattattgggattaagctcttgtgtggcttgctcagtatctaaaaaagagttcttgtggatgctgcattattgtggtgaatgatcagtagatacaccagttcatgccgttgtgatctcgtgcttgcaatgggagctgcagaaactacatatgttgccatttcctgcaacttggatagctgtcagatcctcaagatggggggaagaacagattccattgcacggagctgatgttgcaacaaaagttcttttgtgctcatttgatcttgcataacccatgtgggttcaattataacttcaaggtgtaatgtgaagattgtggcaagtcgtttatatttacaatagggatatttggttatcatcacaattggtaagtggccaccaatctttgtactatgaactaaacagcagtaatcaaatatggatataactatgtaactgttctctttttctttttctgttgataaatgctgacttcttttttgggtggaagaatatgcaaagtacaatctccatgtgagactttcagactgaaaaagggtttgcatccgatccaggcaatgttattggaaaaacagaaaaaaaaaacttatcttagctctatagtacgggataggtggttggatctgcaaaactcaaattagtcttaacttctaaaaaaactataactaggcatcaagttgctttttgtattttctgatcactacatatgtatttttttttaattagagttctacagttgattcgttgctgtttgtgacttatttctgaacagtatatttgatatggtggtgttcttctgaatgaattgacaagagttcctacccttttgcttcaaagaaactcttgctttgcaaatgtttcataaaatcaatttaaattcgttcattctttcacttatatgagattatgagcagcagatacattttttaatgggagtattctgcacagttcaataagcctaaaaataattagcattagttccattccagacaattaaatatgcttgttcagtacagttcaataagcctaaaacaactttcaataaacataaaagaattatcactagagtgaattaaatatgaaaaatcggtgattgaatctattatactatacatccatcgaattctttagcttaccatgcatcgttatttaactaatctctgtaaatgattacaacaatcaactaacttgagctatccactgatataatttacattatataacgttattaatgatagtctaagtactttgtttgtacttatatttcaattaaccctacaactcgtttagtataatcttatcatgatagactagtagctattctgaaattttgttgcatgtacttctgaagcactcttaaggctaaaattatatctctctctccttaaaatattaagggtggctccaagaaggctagaagtcaatgtacttgcaccatctctttctccaagttatcgcttttcagtcattgttggatcaattgaggccacaatctattgtactatttctcaaaattgactcacttgatatatattctgcacccagtcttaactggcaaaaactgtactacatttgtgagaaaaattagagtatgttgtcggctagaggttaaaataggcgatattttgcaccttgaatacttgatgttagaatcaactagggaagagaacaaatggtgctgccaaaaaaaaaaaagattgtaaattgcacgcaactcttttgtctttactccagacagattacttactgctaactcattgtcagctaaggcagttgacatttgcttactatgatattagactattattatttttagattattagtaattaacagagaaatatgcatacataagggtttgttttcttcactaaaattggttgactctcggttcataaacagagaaggaagtttccttagtgtcattaaagtaggtaaacagatttctgacttgttaataaaatgtacatttggatttaattataccgacttcctcatgtgtttttcctgtcattctgagtgcattgaacctatatcaaagtatgcacctttcctcatttaattacaaaattgaataagtctaacaataaagtttatgctaaaatacactgaacattcttaattttagacaactcttacgaaagagtatttcatagttgagttaataatccaggaacaaaaaaagcttagccttggctgtcactcttgtcacaaatctaggcagcagatcttgtgttggaataaaaccacacacacggaatcggtcagcattaggcagcactcatggttcattgcattggacgataattaccctaatgctttcactactaattagcactaaaccaaactattatgtatttaatcctaccaaaggcttccctgatccatggcaattatcaaaatgataaacttagtggttttgatgctaagatgcagtactactgtactgcttaagaatcaatgacatgaattatattaacatatcaagaagatgcacgtactcccctgcagaacagaaggattatcgaaattggggtccaagttgtttaatgattattcgatccttgtcatgctttgacatgattaaactacctaaccaccaatccctaaccacctagcatctaattaaactccttgtctgatgtaactaacaggattgcataaagtaatcaatcaagtacaactccatggaccaaagcagaaacagaaaaacaattgttgagtttactaagaacactagaccaacttgcagatcttagcataacacgtaatcagacggggggaagtggctattgctggctctatcctgcttgggttctttgttttttttaggccatcctcttgttgaggttactggaatgatgatgcagagtgtgcaatattgttttatataaaaaggacgctttagtacagtattgccctttattagacaattgccctttattaagcctcgtgttgcatacgtacttaagcatactgagtacttaattagctcctgcttattatagcctaaactttttttttgaacgactcgcacgagacagtgcgaagttctattgatagagcagaaaaaaattacaagattacggtcctggagggtcgtagccaggaaaaggaaaaaaaataccaccacccacgcaccgacatcaccaacacacaagcccaggagaaggctagcaccggaccggccgccgctaagcgtgaccgaccgccactagaccgacaaagggacacagacgagattgcccccaaggggatgccagaacgacgtcttcaagaagagaagcgacggaagaccgccgccgccgtccgttgggactcaaaggagccaagactgagctttcaccaggcaaacgccctcaggaggtgagacagcacgacaatgccctcaggagggtgatcatcgttgtcggtccggccgaggccggactaggttttcacccgccgctcaccacctacgaatccacggctgacgcaccaaagctccaccaccacactagcgtcatagcctaaacttctggttagcatacaagatattctacaaagcagaaccaaaattttcatttcttgatcctatcgtcatttgtataagcaagttccaatgatcaaatcctggttctgttgaaaccacagcagttcagttcacaaacgtcagaggctgcttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnat

SEQ ID NO: 48623 - DNA, 752 bp, Oryza sativa
cagcagtatatgtgtatgttttcttgtattacaaaatatatatgaccggaaagaagagaagcctccactggactgcacaaaaagcttagtagccctttattttttttctcattggataaaaccaaaagcatgcatacccaactattacaaaggctgcaaaaggaccgctagtatcatgatttgctcagaattgggttgaaaattggaactgctggtggcccattttgacccacatctcagaaagcgaaaactttctggtgtgtcgaggtgatggtactccacgcagttctatacatcaaggtgatagcgacttaattaatttaccataatccatcacaccctcctttagttttaattgaaaacgtacaaccttactaattagaaaataagtgggcaattgagttcagtacaaattacatcgaggaggtgctagcgtgctactacagcaaatttagggagaggcaaaacagaatggtccgaaccaagatttacacaacatatcaaaaccgatccgattaaagcgaattccatacttttcggaccgggtcgaaaacataaactgcttgtgtttacatgttataaccacataatgatagcaataacatagatgagggggtgtactggccggtctggtcggtcaagggacaatagtaacatatacgcacaatctaaatcgagagctctctcgatttagtcataacgagcgacgctattagccattgtccaaatacgatcagccattgtccagatat

SEQ ID NO: 48624 - DNA, 1615 bp, Oryza sativa
acacccccttaatataccccttgtctgttggtacttaatcatctccgagtgctttctgtgctccattttgtaaagctggtaaccgcagcaaaaactctgctcgtggttggctttcaatataggccgggtccttgcgacctttccactaaaataaaatctatacagatagataaatacaaatctaactgggaattcaatcatattttttagggtcggctttttttgtgtgtacatgaatttgactatagatgtataaatgaaacctaatatgcgattccagattcatagcattcccaaaaaataaagagcgatgctcggtactctctactcgtagtattatacaactagtagaattgatttgaaccgttgattcataaggacattttagtactttactaacttagtgattagaggtaaggttggtatttaggatattatccactcttcattaaaaaaagtttttgtacatttagatctatcgcttggctactcgacggcacatcgccttccgttgctggtcggcaaatcgtcctgccgggcgctggcggctccggtggccgcgttcacaaggccgttctgttcccttttcttttcaattcattgcccggtttcaaatataaacagagaagtactccctccgtttcacaatgtaagtcattttagcatttcccacattcatattgatgttaatgaatatagacatatatatctatctagattcattaacatcaaatccgattacaccattgtgttcgttgcaattaaatctttataacaatatcttacatgactatattttgataaaagaaatatctatgttgtaaattacttttattatatatgtaagttacttttatcatatatataaattacttttcgatttgattaaattacttattatacaaccataatgttgtgagttgtttattttattatcttttttagtcaattccataattcgtgctgattaaatttaatttttagatagactcacgtttttacctccataacggatctactttaatgtcatgacaaagttacttcctttttgtcttaagttacttctataataaattatttttaagctttactgaaattacttttatatgtctaagaagtaatttagtgaaatctaaaagtaatttagatatactataaaagtaatttgtaatttttcatcaaaatataatcatgtgagatcttgttgtaaagatttaattcttacgaacacaccgtgtaattggatcataaatcggatgagtagtttaagagaaaatttcatttgaaacataggtgataggaatatattttctacttaattgatggggactagtcctacagttaaggcatctagataggatctctcgttagcactaaaacgagagggctcttgatctagattttgccgagaattatcatgtcgccaatagtcggattcttgtagcattcagttaaggaaattaatctatttaaggaaacttatccagaagagaccaagttcgaggaggatgcggcatggcaatttatctagtaattaggaagagtttattagttttcttttatctttaagaaagtgtgtttagtgtccaataagaactttatgtttttcttttat

SEQ ID NO: 48625 - DNA, 2180 bp, Oryza sativa
cctgcaccccttgtttatgtaaatcgtcgagtcatcatatatgccttgtaatctttattactatcataatctaaccgtcagtcggctaacatctattactagagagtagccgatagagttagattttattgttaatctagattgtatagcatatctaccatcttttagaggttttcatcatcttgtctagatctccatttattcttatgcttaattaatgctgcatcggttgagttcgatctattaagtaatattcataattgcaatatctagcttgttttatgaccaccaatagaggtagtatcggggtttcagccgatcttacctgatttagctattttatactttgtatgcttacttgatatgctaaatctgccctttatattaagatattgttgcattaaagtatattaggcttgttatttgatatattttgtctgatttaatatcttaatatggagtggtatcggagtattagccgatatatgttagatctatttgatcggctatgctataaacatatatataatcgttatcttaaagtatctttaaacataagtgatttatactgtcttgacttgctgttcgatctatcccaatcactcggtttaaatatattttgagaaaatgattatatatcgttgatgtctacagccgatcgagtagatttaactctatattgccttattcttcattgccgatctaataccaataacatcggctcaatgttcgacgatatgtcatcggcccctagccgatcggttatcgtttatggatttaaccttggttttcttgtttttctttcttattgattgtaggatcaaatcaactggcatgcctttgaacccaagagcaagatttacgacctacactggagttaagcagatctcccaggccagtgtgtgtttttcgcatcaacaatttgtttgccaatttatcatatgttttagttaatctagtcttagtatctcaatttagctctatcggttgcctctcgctttagtgtttctgcctgtatcggctaagttgttttactagattagattagctaaggcatttatcaccctgaaaatcagtcaagggcttgatcgtctagatattatgtttcttttcatacttagtgtatgcatcagttaagtttaatctattaagtcgtgcttagaaccataatctctagcctgcttattgactaccaataagggttttatcggggtttcaatcgatgagttatctagacgttgcatcaacttataaggtttgcatatataaattggatttagctgatgacaacaaaggtttcattgtttaatctactcttgtggattttatagcatcagacctccagccgatgtatgctttaaccatcggatcagtatttatcctatcatattattattagcccattggtttttgttggtttatattataactatattttattatcatcagccgattatctttgcattattatctacattgaacatatagccgattgctcaaaaccctattgacatcggctggaatcggcatcggttagtatcggctatcggctggaattactccatcggcttgtcaggcgatcggctatctgatatattgtttacatatcttgtcagttgcaggatcaaactgactgacacacccgcatctcatcaacatcttggacctgcactagagctaaacagatctcctaggccagtgtgtattttctttttacatcaacatgactccaagtgctctatgaaccggattgcatggcctgattattgtcgggtaataggaaaaaaaggggcaattgcaaatttactactaatttgaatcgttattgtaagactgctactagaaaattacaaaaatgccactagatctgtcagtcgagtggcatccttgcaatattgaaaaaaccagtggcaaatttgcaaatgccccaaaaaaatcatgtccaacttacgtatacggccatatgcaaggaaaggactaggaaacaaacagaccgaatgctcctaatttttggtagccatgcacgtacatagatgagaaaagataataactaaaattatctcattaaatattgatcaagtttttgttagtattagatcaaatcttgaatctatggtctacctgtcgaaacatgaattcggcaataataaaagggggtagcggacgagacctaaagtgga

SEQ ID NO: 48626 - DNA, 3255 bp, Oryza sativa
tgtaaaatatgatgagtgtaacctaaagttggctacatcattgaaaattcacatagcaaaatagctataaagaagcttggatgttgtgaataaagaaatttccaaagtattgggcatacgccatgcgcacactgctttaacagacgtgctttagtccctaaaagacacatggtttcaccacacctggaaatatatggcatatgtggtgtaaaatccgagtaaataaactcataaaggatttaccaaccgcctagaaaaatgaccacaatatataatcagcctaagccataatattggtcaataaaaatgcacacttacgtggcaaaaagcaacgatattgtatccaatcaattgcttaaaaacccaaacagcaccatgactatattaaaaagtcagcggggcagctatataaagctttactgtttgacaccttttaagatgcattgtaccaactcctaaaaagttgagtaactgcggtataaaaggattttaaggtattgggcacttgatcacgcgcactttggcctaagcaaaaagtgcctaagtccctaaaagaacgtgacaggccacacctgaaaatatgggctgcagacatattaggcctaggccaaaaaatatgccttcgataccctttaaaggatgacgcatgtaacatgctcccgggtgatatagaccatgtgatctgagtgattatcccttatgggatactccaaaatagatataaaaattgaatcccgactggcgcaagtattcggttgataacccttacggggaataataaatagtccagtctttgagcatagaaaatagacccatgatcataaattcatgttgcatgtatccggaacaagtccaaattagagatataatcctcacgcttgagttgatgagctcctgagcatatagcttgtccttctgtcatagtcaaaattgtctattggcaatagctgacgcagtcggcatggagatgaaatgaccaacatgaagacgaaattgctcatcagaagtaacggaagatgtcagtggtagtaaagatgccaccaatcaaatgtaatgaagttgcataaccatggaggcgaagaaaccagtcggcaacagtcaggtcagctagcagtgaagatgtaggcgcccaacaacaacgaaagaacagtcggtagtgacaaaagcaaaccgacgatgaagacgtagacacgcatcaacggtgatggcgaaatccaccaatcatgaagatgaagaaaataatcggcggcgacaaacgcatccgacggtaatgatgattagcggcaatagagatagccgactatgatgatgaagtttcccatcaacggcagcagagtaggctatgttgatgaggcttgacaagatgttgatgaagatggcgatgtcggtgatccagtcaatagcgatgtagcagccgatgataacgatgagatcctctatcggcggttgcgtagtaggccaaccgtgaagacaaataattggaggagagttgatgttgttgcccaactcgtctaaaccgaaatatttgaagttgttgaagtagaatgtctgctctgaatcaaagatgaagataatgactcctgaagttgactcgttggttgatgaattgatttcttcagcttgacataaaatttgtcaaattttgagccttgtatttgtgtagcccccgactctttggttagttgggaaacaactgaacatagagtcgagaattatagcttcttgtcgtcaagtagtcattgcttgattgaagatatgtgttgaagatgtccaagtagaaatcctgaatattggagagcctcttgttgtagtaaaataacatggcatcgcatgccgagatgtcgaggctcacaaagacgtcgtggttggtgaagtagcaaaacttgcgaagtagcagcaatagagtttgccagtgccgaagataataaagatgaagtcgctctaccatgatgacaaagttgcattgccgtgatgaagtgaacacgagtcgtcggcaacagaagcaaactggtagtgaagacccgcagttgtgaagataaaagcaccagtcggcggcggcataatcagtcggcgacggaagatgatgatgtccatcagtagtggtagctgtataaaccagacgtagaggtaagggcactagtcagcaacagacgagacgaccggcgattaagatgtagatgcccaacaacggcggcataataggccagccgtgcaggcggaaacatcagtcggtgacggacgaagcgcgcggccgatgaaaacgtagacgcccaacaacggcggcataataggccagccgtgccgacggaaacaccagtcggcgacgatggaggcaggccggtggtggagtcgtagacgcccaacaacgacggcataataggccagccgtgcagacggagacaccagtcggcggcggcgaaggcaagccggtcggtgaagacgtagacgcccatcaacggtggcataataggccagcgtgcaggcggaaacaccagtcggcagccatggcaaacgtaggcagcttgtgttgaagatactgatgcctattagtagtgacagcgatgtagccagccgtgaagaagatagcatcagttggcgttataacaggccagccgtgcaggcggtgacaccagtcagcggcggatgcggcggccggtcggtgaagacgtagacgcccaacaacggcggcataaaggccagccgtgcaggcggaagcaccagtcggcagcggcgaaggcaagccggtcggtgaagacgtagacgcccaacaacggcggcataaaggccagccgtgcaggcggaagcaccagtcggcagcggcgaaggcaagccggtcggtgaagacgtagacgcccaacaacggcggcataaaggccagccgtgcaggcggaagcaccagtcggcagcggcgaaggcaagccggtcggtgaagacgtagacgcccaacaacggcggcataaaggccagccgtgcaggcggaagcaccagtcggcggcggcgaaggcaagccggtcggtgaagacgtagacgcccaacaacggcggcataaaggccagccgtgcaggcggaagcaccagtcggcagcggcgaaggcaagccggtcggtgaagacgtagacgcccaacaacggcggcataaaggccagccgtgcaggcggaagcaccagtcggcggcggcgaaggcaagccggtcggtgaagacgtagacgcccaacaacggcggcataataggccagccgtgcaggcggaaacacca

SEQ ID NO: 48627 - DNA, 3634 bp, Oryza sativa
gcccagcaacggcggcataataggctagccgtgcaggcggaagcaccagtcggggggggacgaggcggccggtcggtgaagacgtagacgcccaacaacggcggcataaaggccagccgtgcaggcggaaacaccagtcggcggcgtcgaaggcaagccggtcggtgaagacgtagacgcccaacaatggcggcataaaggccagccgtgcaggcggaaacaccagtcggcagcggcgaaggcaagccagtcggtgatgttctgactgatccattcctggagcgtaagagataagcctaaagccatgaatcccttttatgcatatctggatctggatcctgcagaacaaacatataggatgagtagtatctgatataaatataatactcgagaaaaaatcaagtattttaaaatatttataaacatgtatttctcctcttgtcaattttgatttccccgagcagatgactcattacgtttaaacgctctgcccaactagtcatagccaccaagcactgggagtcggcctaagcacttcccaaacatgcatatgagtgacatgagttcgtcattaatggaacaaagtttcacggatcagaatttactactcaggtacttttgcaattattaagagcagaaaataaattatattatctctatgcttttgatttcttccgagtaatacttagcaccttgcgttactcggtccatccaacgagcccccgggtgctaggaatcggcccaaaggcaaccatccattggcaaaccaaacggaaagcataggaagatagaactccataactcgataggtacttttgtactcagattatgtcgcaagcaatcaagataaatattataaaaaatatgatataacatctgtagcccccgactcactactcaatggaagaccaattggtgtagtgaggcagaggaaaaggaaaaatatcatataaagaataaaataaatgatgacttagctttgtaatattccccttggtgatggcagaagtggccaatgtgggaacaaagtcgtccatcaataacaatgaagacaccagtcggcggcgacggaggcaggccggcggtgaagtcgtagacgcccaacagcggcggcataatagaccagccgtgtaggcggaggctccactcggcggcgacggaggcaggccggcggtgaagtcgtagacgcccaacagcggcggcataataggccagccgtgtaggcggaggcaccactcggcggcgacggaggcaggccggcggtgtagatgacgatgcccatcaacggtggtgtgaccaaccgaccgtataggcggggacaccagtcggcggcgacggaggcaggccggcggtgtagatgacgatgcccatcaacggtggtgtgaccaaccgaccgtataggcgggggcaccactcggcggcgacggaggcaggccggtggtgaagtcgtagacgcccaacagcggcggcataataggccagccgtgcaggcggaaacaccagtcggcggcggcgaaggccagccggtcggtgaagacatggacgcccatgaacggtggtgtgaccgaccaaccgtataggcgatgacaccagtcggcggcgacggaggcaggccggcggtgaagtcgttgttgctatcagcaatggcggtggcgaggacaagccggcggagtggactcgcggccgatcgaccggaaagctgagacgcctcgagtccatgaccagcatcaatcgcctcaatagtgccgcgtagttatatgcgaacaacaacaaaaaatagcaagaaattaatctgagattaaaaatcaatatgataaataatgataaaaatcagattgagtttccccctgactgatttggatcaagtcagagaagaggagcttgaagaagtggtcgacggaaaggaagtgaaaactcccaaagcgaaagcgaagtcggcgactcatgaaattgattccatcgcgctcgttgataggaaactcgacgcaacccctacctggcgcgccaactgtcgaaacatgaattcggcaataataaaagggggtagcggacgagacctaaagtggatggatgcagagacaaaggatttagacaggttcaggccctctcaatgagaggtaataccctactcctgtttggggatttgaatccgccgagtgtgtattgatctgacgatcaggttgtctcatgccccctagagggcctcctgcccaccttatataggatggggggcaggattacaagatagaaaccttaaccaatacggtatcggtttcctaaatctattttacaatattatcgaatcaggactttaggccgctccataatataaaaggaaacgtaatacccaagtcatgatcggttacatattccatagatatatgttatcccctattactagtcggataaccatgccgtgtgggtatggggtacccataatctccacactacctatctactgtatcttaactaatataaatattcgtatttttcctttcgtcacctcgtgcatgcggtgatttttcgtcccgtcagcccccccccccaaatcccagtcgaaattccgtatcacacaaatagacccacattgagcacaccttctctctaaaatctcaaaccatcccaatccaaataaaaacttttcaaaattccaatccaaatctaaatcggaatcataaaaaaaaatccaaaataagatgacgacgtcacaacgatttttcgtccataccgcgatttttcttccgtcgcgcacctcctcttcaaatcccacatcatcacaatcctacccaaaaacaaaatctcaatttcaatccaaatccaaatcgtaatcaatgagaggtctcctctcataaaaaccccaaaatcaatcacggcaacgacatcatcatcacataaaaaaaaatagaaacaacccatacacaaccaacaacaccggcagatccggccgcgaggggacggcggcgatgtcgggcagatcctctcagttagatccgtccgcgggtgccgccgacgtcgccaccgccggatccaagggagaagcttggggcggagggggagggggtaggggatcgctagatgtcacaccctgaaaattcaaaatatataaattgttgtttaattggaatttttagaaataattttaaaagtcttgaaaagaaaatctaagtttaattaataaattccaatataaaattgggccagataaaatttcattaaatactttgcttaattctataattcctagatttttctgggatttatttgagctaagaaagtatttgtaataaatggaattgcatttaagaaataatttaaattgaaaaggttttaaaaagtcttcttttggctttgggccgaaagtcggcccaaaacctctcttctctctctcctcggcccagccggcccagtcagccgcgcgcgcgcggcctcgctgtcgctgacaggtgggtcccgcctgtcggagtcgtcgtctaccttcggccgtcgccgccgaaaccctagttcgcgccgccgccgtttcctttccaaatccggccgcctctttccttctccggccgaatcaatagaggggaaatgatctccgggatctcctctacctttctcctgggaatctttggtaaatcgctttggaaag

SEQ ID NO: 48628 - DNA, 6644 bp, Oryza sativa
gttgcaccctttgaagattcgtgattgaaaatggaaaaaaattggtatggattttattactggtttacccagaacgtcatcaggccatgactctatttgggtaatagttgacagacttaccaaagtggctcatttcattccggtaaagacaacttattccggaagtcgcttagcggaattgtatatggcaaggattgtgtgtttgcatggcgtccctaagaagatagtgtctgatcgaggcagtcagtttacttcaaatttttggaagaaacttcaggaagagatgggttctaagctgaactttagtactgcttatcatccgcagacagacggacaaaccgaaagggtgaatcaaattttggaagacatgttgagagcttgtgctctagatttcggtggaagttgggataagaatctaccttatgcagaattttcatacaacaacagttatcaagctagtcttcagatggctccttacgaagcactgtatggtcggaagtgccgcactccgcttttgtgggatcaaacgggagaacgtcaggttttcggaacggatatcctaagggaagcagaagaaaaggtaaagatcattcaagaaagattgcgtgtggctcagtctcgtcataagagttatgccgacaatcgccgcagagatttgagttttgaagagggagattatgtgtatcttcgtgtcacgcctttacgaggagttcatcgttttcataccaagggaaaattggcaccgcgttttgtgggaccttataagattgtcagtagaagaggagaggttgcttatcagttggagttacctcaatctttggcaggagtccataatgtgttccatgtgtcgcaattgaaaaagtgtttaagggtacctaccgaagaagctaatattgagcggatagaagtccaagaggatttgacttatgttgagaaaccaatccgtatactggaaacaaatgagagaagaaccaggaatcgagttatccgtttctgcaaagttcaatggagtaatcactcggaagaagaatcaacttgggaacgagaagatgaattgaagtcagctcatccgcacctgtttgccagttcttccgaatctcgaggacgagattctgtttaaggggggtaggtttgtcacaccctgaaaattcaaaatatataaattgttgtttaattggaatttttagaaataattttaaaagtcttgaaaagaaaatctaagtttaattaataaattccaatataaaattgggccagataaaatttcattaaatactttgcttaattctataattcctagatttttctgggatttatttgagctaagaaagtatttgtaataaatggaattgcatttaagaaataatttaaattgaaaaggttttaaaaagtcttcttttggctttgggccgaaagtcggcccaaaacctctcttctctctctcctcggcccagccggcccagtcagccgcgcgcgcgcggcctcgctgtcgctgacaggtgggtcccgcctgtcggagtcgtcgtctaccttcggccgtcgccgccgaaaccctagttcgcgccgccgccgtttcctttccaaatccggccgcctctttccttctccggccgaatcaatagaggggaaatgatctccgggatctcctctacattttctcctttggaatctttggttaaatcgctttggaaagctttggaatcgagttcgattcggatcggttttccctctctccaagccgaaggtttccttcgccgttgccgtcgccgtgggccttcgccgccgcctccgagcccctttaaaaggacccccggtgtctcctctacccgtcgcagccctcgccttcgcctctcgtcgccggaagagccttagcgccatgtgccctagcttcgccgtcgccgccgccgcttcagccatgctccgccgtcgctccagctgtcgccgccgctcgggaagaccgccgtcgtcatcgccaagtcgccgccgtcctcgtccgccccttcgcagccgttggaacccgccggagcttcgtcgccgtcgacaacccgaaggtagccgccgcttccttctcgtcgccgtcgccgtccgttgcttctccgccgtcgttttggtcgtcggtgtgttcgccgtgtcgtccgcttcccgttggtgtcctccgttcgtgccgtagcgccgccgttcgccggtgagcgtgcgccgcccgagccgtccgctccgccgagccgccgccgccgtcggtgacgtcatcgctgacgccatcggggtcgtccgccgtgaaccgccgtggactcgatcaatctcggccgtccatcttggatcggttagatctcggccgtccgttcgcgtgaaccgccgcccgtgcgccggtccaccgaaaccctagccgctgacgcaataatccttcttttccttttcaaaaataattcattattgcgtcataattcaatttaaaccgatttaagtgttttaatccgatttaatctttaaaaattcataactaattcatcttagctccgatttagttggttcaagtctctaaatttttctaaaattgagatttacacattaaaaatatccacatgtactgttcatgcttgtttatgtgctgttttggtgattttgcttctttttgcttagattccgtcgtttctggagagtccgttttcgcggaagaagagtttgaagagttccaaggccagcaaggcaagtcacacagatcccaaacaaccctttgagcatgttgatcctatttaaagctattgtttctattcaactattgcatctattttcgaatgtcattgggtggaattgacctattctttgttatggccctttcgtacttgattaccttattccttgataccttgggttatattaatttgactagttgagctttatttatattggttcaactagatattagatataattgcttagccctgcttagaaacattagtacatttatgggataactaatgactcactattatttcatgatggcttattgatagttcacgatggtcaatcgtgattagttaattaattaatgtgccaactaaaacctgataatggtgggttgtgggcacatggttttgatggtcgtgctcatgacaattaaggaccggttcacgagtttcagttgtgaaacatttatcgtgccaaccacaagccagcatgggcaacggctttatcttttgtatagcatggttcattgcggggcaccagactgagaagtggcggagataagcccacgggggtcgctggggagtccatgccttgtttataagggggtgattatgatccaggaaggtgcgctgcagtggattgtgttatgcgaggggtattgtcacaactcctttccgagataccgtggtggtattgaggcacatggtgacatgatgtggggttgtgtcttgtgggtacagtggtacacctctggccagagtaaaactattcgaatagccgtgcccgcggttatgggcgggtctaacaatgtctttcgtgattagtctcacacctctcatcattgtaaaagatgcttaaactggtaataatttgattagctcctggtttggaatgggacattcctggtttggagatagaactgtgcagccggggtggttgttcagaatggttgggcctatacaacagggtatgttgtatagcgttggattaatattgtttaattattacttaactgttttgttaaattctcaaatgtttgctaaatgctgcttttgcaaatgaaaccctattatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttatttattttccgctgcttagaactttattgattgagaggaactatctacctctgtaatgacattttattcgcttattaattagagtaatatttgtactctattatcaatttgttattgtgtgcctcggctgattcctggacgagggttcacacacatgtaagcgtttggaattttggatagaaattccgggcgtgacaagttggtatcagagcctctttgaccctaggttatgccaaatggttacccatagaagccctctgaaaaatattggaaaagtagaactgttctcctccctttctcttttaattaaaccaaactaatggcacatgcacttcataatctcttttaatggttctcattcaaaatttattccagtgttattagtactgtacatctattactgtactaatggctcattttaccagcaaaagttttataatactgttttatttaatcttgctgcaataaaataaatttatcatgttgattttatcattttctttcatttcttttgaaaccagttattcaaaattacaaaatttgtgacctcgtttccaactattttaacttatctcgcaaagcttggtttactttatttacttacctttttactctgattttctaactttattcaaattaatccaaaaacttgggctattaattggataaaggtcttaactcccttctttcacttgtctttagatgccgcgttacaagcctgagtacctgtttggtgttgagggttttgtccaggagttgcgcacgatgtcctttgtcattggatttgggactgcccctttttatgcccagattcctcatgatcgtcatgaagagaagtgccgagtcaaagtcactttgaacagtaatagtgaagaggtcccctcagtgatgtttgaagctggaggaagaaactacatccatgcatgtcaggaggtggcaaggatcgccataggagagctccgtgatcgctacagtgatcagttggccgacattgagtatcgctaccatcctcgccaaccccagggaagtgaccgtggcagttaccttgagactgaaggaattgagaatgatgttaccacgaaacatttggttgagatgttgtgggctatggatgaaagtcgtgcggagactgtattagcagctcaagatcgtgaagaccggaatcgtggtaagatttgcaagttagaagacaaggtggatcgtttggagaaggaattagccgcattgaagggagaagcaccgccgcagaaggccaggattcgtcttaccgcaaggaagagagctctatttgtccctcgctatcaattggcgccaaaggttcgtgtggtggagaaggaagttgccccagctcaagcggatccttcggtcatcatcataagtagtgatgaagaagaagaatctaagcacaacaattccaagattgagtgggtagcaactcaagatgataaaaacgagccttcaatcgacctccgatgcttggaagaactagagtgacttgttaagtcgttgtcttagatcgttgtgttagttggtttgctttaagtttgcttgtgtgtggctcgcatgtgatttacatcagtggtgggatgtaattgcatgtgtttgtttgcttttgagtgttaggaagttggtgagtttagtggtgtgagagtctttagtttgtaataatgaaactcagttaagatcaataaaagttaaagtaattctctgtcctaagtagtttccccggtttctcttcttgtgccctgtccatgccagatggtgaacactcgtagcaatgggaatggtcccaacaaccccaataacaacaacaatggagagaatcccactctggcccaagttcttgctcaacagacacagcttatgaacatgatgatgcagcaatttcagaatcagcaaaaccaaggaaataatcaagcactctctttgcaacgtagcccctctgtcagaatagaaattcaaggagtaccatttctggccaatcttatcttgttaaaatccaaagaccttgatgtcatcctagggatggactggttagccagacataaaggtgtgatagactgtgccaacagaaaagtaactctcaacagctatgatggtcgagttgtaactgttcatgcattgtcatctgagtctttaaggtcaagactgaaccagataactttggaagagattcctatagtccgggagtatcctgatgtgttcccagatgatttacctggtatgccgcctaaaagggatatagagttcagaatagatttggtacctggaacaactccgatccataagagaccttatcgaatggcagccaatgagttggcagaagttaagaggcaagtagatgatttgctacagaaaggatacatcagaccgagttcatcaccatggggagctccggttatttttgtggaaaagaaagatcatactcagagaatgtgtgtggactatcgtgcactaaacgatgtgactatcaagaataagtatccactacccaggattgatgatttgtttgatcagcttaaaggtgccactgttttctccaagatagatcttcgatcagggtatcatcagttgagaatcaaagaggaagatatacctaagacagcttttaccactacgtatgggttgttcgaatgtactgttatgtcttttggacttaccaatgcccctgctttcttcatgaacctgatgaataaggtggttatggaa

SEQ ID NO: 48629 - DNA, 17481 bp, Oryza sativa
tattatgccatcctttggtatcctgggcacttgcatatttgctgcgtggcttgctgagtatgtcatatactcaccttcaatcattcatcaaaagaagagttctacaatgaggctgatgggggggaggattaggtgtagccctggtcaagctgcctgtggagtggaaccgtctgcgccgtttatttattttccgctgcttaaaactttattgattgagaggaactatctacctctgtaatgacattttattcgcttattaattagagtaatatttgtactctattatcaatttgttattgtgtgcctcggctgattcctggacgagggttcacacacatgtaagcgtttggaattttggatagaaattgcgtgacactagatccgcccaccaaaaagaacgccgccgccacttctgctggatctgcccacgggagcaccgatgtcaccgccgctgccgcaggacaagcttgggcgtggagggtgaggaggaggtggtagagaatcgcccgccggatccgcctgccggaaacaccgccaccgccaccgtcaccggatccgccaatagtagccgccgactccaccgccactcccggatccggcccgcgggagcagctgaagccatcgctgccacctcctctgctaccggcaagggagagacgagagggagagagagggaccggtgggagaagagacgggggcggcggcgcggcgctctctctaactctcggctgttggcaaaggaggagagacggggattcgggagacggagaaagcgaccagagagaactgagaagcggaggtggaggatttcagagaaggagataaggttcgataggtgggcgggtccataccaattttttttctttaccgcgctccaacatgtatagggtgcaggggcggacacactaacgttacccatatttttaaaatgtagctacacaatgtagcacaatgtcgatgattctcaattggttagactgaaacatttgaccaatagttcatgagttcgattccatcgatctcttcgttttttccattttatccaattcctttcctaacctgatattttgctggttatcctctactgttcttttcccttttctctctaattttatccttttcctttaaaataaaaatgatatggcaagaacaaacatgttatcctctactgttcttttcccttttctctccaattttatccttctcctttcctaacctgatattttgctggttatcctctactgttcttttcacttttctctccaattatatccttttcctttaaaataaaaatgattattgcaagacatacatgtagaatagaatacgaggttaactaaaattcagaaaaaataaaataagctccaaaaaatagaaaaataaaaataagagttcacgtagaaataaaattttcaaataaaaaaggaatgaaaaaatacaaattgtaaaacaatagtccattaaaaaaatacaataatagcaaatgataataaagagaagaggaacaacagacctataaagcaatagtgtggtgacggttaatgggacatctgatgaaaactattaacaaaaccgaaaagatgattaggttcgatttttagaatcccaacgatgattaagaagaggaactacgggcaagtcgttaagcaacactgtaatggcggttagtgggctagaaagtaaaaaataactaaaattcgaaattaaaatatgtaatattgaaagaaaagtccatgtaagaacatttttttcttttttcattgtcttttgctgtttgcatattggcctttttttcattgttattcacaggttgaatgaacgtcacaaattcacagatcgaatgaacatactcaaattcacatattgaacatcacatatcaaatggacaccgcaaattcacaaatacatctaaaaaatgttcatctaactatttttctattttcggaatttattttatttgttattcaaaattttaattgatctcgtcatgtgttttaaatggtctcttcttttaatagatttaattttttattatgaatttttaatttgtattcctaactaaactcttatttttctttttaaatttcatattttattttatttttatttagaattttaattaatctcgttttgtgttctatatggataattcttttaatattccttaattattgtttcgattttagttgtttcaaaattataaccctacttgaactctctttgatatttttctaatttcagatttttattttatttttagtccaaattttagcgctacaatttttagtccggttggtgcggaactaaaaattaccaaccgagacaaaagatagatctttagtcccggttatttcaagcgggactaataataggcatctttagtcccgggttgtaacccgggattaaaggggctgtgaagcaggactaaaggactaaagatgagttccctagcagacacatgaagaaataaaattaacaaattttattatttttatttttctagttgtagatcaaatagaaacttgcatgtttgtgtacagacttatatcatcacaattgatgttactaatttttttattttttttcaataactatttaagtcgcacataaatgttgggtgtcatgacacctaggtacagagaatcctaatctctttattgtacccttcctttttttgctttgaaactacactttaagactttgttcttccacggggtaatgaagattggagaagatgaccagttcgaaactgcactaaaagttccagttcacctatctttgttacgctggttgcttgacgaaacgagagcatagcagcagtgtatccaaagtattctgcaaattgagatctattgttctgaattttagtatacttatatgattattgtgatcatgttatacacatttagatcttttagactgaactaagtaactaaccattctcaggggcggatccaacgtggggactcgagtcccccctacacccacaagacccatggatacccccagagcaccttctttaatttttttcaccataaataataaactaaaggtctttagatggctaaaggttagagaaacaacgtacttgaggccccccaattttctgttgctggatccgcccctgaccattctagatctcagccagagatggggatgaattaggacaaaacaatgtttcggtagtaatctatgcagtcattggacagcattagctgaatatcatatgagatctatcaacaatgaacacatgtcttgcaagaggtctcttctgttggtgccttcgatcatttctgttttgttaatatttctgagtttcttacaactccaacatttccaggccctctgtaaggactaggatatcgactgaaaacaagaaaagtatgtaacaaatatcagttagatatatggactgtttgattggattgttggacagaggaaattgtaggaaaagttttctggacaaaataaataaatgcttggaaatagacagcatcatgtaaactaaacacattgctcacattgccaataggcagctctctaaagagcaaaccaattgcctcacgagctgtacatatcccttgtaaatgtagaacaagtaaaatgaactaaacatgactaatactcctgtatggagcaattaacgaagatgagtcctccaaaccaacttgtgggtatggataaaaatctaaatatgacaaaaattatctcgctatacaaatcctatgagtgagaaaacttgcaaacctagcgaggtgtgatggacgttagtgtcaaacttgaggacgacaacggctgcccctccgctgaggccatcggcggtgcatatgttggcacgggcatcttagctggtaacacgggtagtggtccattggattggagaactgccatggcagctctgatagatggacgtgcacatcggtccggatgtgcacaccagagtccaacagccatgacacactccatgctagttgtgtcgtattcattgttgagccgctcgtctgctgcattgagaacggctccttggccgtacaggtcccacacccattccaccagtcggaagaggcaattgttctgggtgtcctgcaggctaattggtctcctcccacatgccacttccaatagaacaatgccaaaactataaacatcggactcagcgcttgctttgcccgtgattacgcattcgggatcaagatagcctggtgtccctgaggggtgagtcattgtttgtatcccaacggcatggtcaataagccttgcaaggccgaaatcgcctagcttcgcattgaaggattcatccagcatgacgttgctcggcttgatgtcacggtgaactacacattgatcccactcctcatgtaggtagagtagtgcagatccgagtccatgaacaatgttgatcctgtggcaacatccaagttagcagatgaattgaatttcaaaggtgtcgattgcacataacgaaaattactaaatcaatgagttaattaataaacctcattggccatgtaaggaaggtgccattgccgtggagatggacgtcgaggctacggttggggaatagctcgtagacgaggagcagctcggtgcggccatggcaccagccaatgagctgcaccagattgcggtggcgtagccggcttattacctttatctctgacttgtactccttcctcccttgcttagaggaatttttggcgaacctctttatggcgacggcgaggccaagctctctgaggtagccccgatacactgcaccgaaaccgccttgcccaagcttctcctccggcgcaaagctcttcgtagcgtcgacgagctcgtggtacgggaaccgccttggtcccatccccatctcaatctccacgatgggctcgccgtcgtcgtcatcgtcactgccgtgccagcctccatcctctgcctccctccttttcttgctctgacgtcgtcgtacaaggactgctaccatggcgaagaggagaatgacaaacattaccgcaccaagtgtggctcccgctacaactccgccacgtctggaatgcgacgttatcggggtcagggaaggcggtggtggtgacggtgacgacggcggcggcggagatgctacttttgctgccagcttctgctcgaacgacgaactcgacttgaagtaccaagaagtcagctgatgctgctcaaaggctgagcccgttgatgccgagaagccgacggtgacgttctccggcaaggctctcttgagatcaaccatggagctgagggtgtaaggcgtcgtcgtctcatttatccatagcttaattgacagtattctcgaattgttgttgtagtcgacggtggcggtcatgttcccgatgaggctgaagtttggtagggactcgttcgtcacagatacgacggagttgacgtcgatgccgatgtggtcgttggttgtgttagggtcgaaggggttgacgaaggtgtcgaactcgacggcaacgaaccggttctggccggtcgagacgttgccgactgtctggttcgttaggccgaggttttcgccaccttcgtggcccactggtaacctcgatggatagctggtgaggaagaaggccataccgtcgccctttttgcttctatcgctcggagcgataatgttgaaggagaagcgcgtggtgaagctggccacctcgccggtggcggcgtcccagagctgcaccggcggcgcgtacaccacccgtccggcgctgttgcccatgcccgacacactgttcgcgcttatgtcgacatacccgacgctgacagaggcttggccttgaatgtcgatgttctgattgtctgaggaggcgaaggtggggtagttgaaggacaaggcggcgacaggagccggaggctgcatgtagcagacggagaagaaggtgacgaggccggcagcgcaagtgatcaacgaaaagccggccatcgccgccggccagagccagcgtcggcgcgcaagccgcaaggtgggttgatcggctggcttgacttggagcaacgagtcgatgcacaatgcgtacactgcttgtagtgcactggcagtgaatggtgccccttctccctggaaaaaaaacccttctttttgatggagctatgtgaatgtggaactatggaagctggactacaataattgtctttgtcgagctgaaaagaacaataccccaaaaatcaacgatgctgctacaatctccatgatccatcggagagacggagaaacatgcataattgtaagtaaatcgtaatgttcagacttgagagatattcagggttgcctcatgcagtcgtttgacgcagaacaagagcccagcggtcagtcaatggcccagcttatctgaaactatattgtgccaactccactgatcgatcgatggagagtgatgcggatcgcagaaagactttaaagactcccctttggccgtggagtttagtctccgcaaatttgagctttgttgtcatctagtacaaccgatcgaagaccgaattaagtgctgagttccagcttgcagcatacacgcacacgaccgtcaccgtgttgaaaaagacagtgaactctctactgacagtatgagctttcaattacttttcgagaccttttacggcaattgcgaggtatttaaaggtatctggaggtggaacaacgtgtaccctaatcaagagaggggcaaggtacgaaacaaaattattgtaacatgatggcaatggagtaattaactagtaaaacatgggcattatacatgaattgaatacctatatccatcgatcagtatatcattgtgcagattggtatgtcgtgaggaaaaaaaagtaaatcacggatacaccgttgatttagcagcgatcaattcgatctgtaccaaaataaacagaaagatcgcatctcctttcttctctcccttcgcttcgttcttgttctagggtttgaacggttcaacggaaggagacagaggaaaaagcgtctgcatggttgagggttgaagaggagatgaggtagcccggtcgatgactaggcgcaagctagcgcatctaaaagttatcctatgcttattcacacagttgtttagttatttatgtagtttataaactccttatataaggtactggaatttctgtgggatagtaaatgagatctccgcctatggtgttcttctagtgtttgaacaggtgcactcacgaggagacacggtcgaggaagaagatctggcatggtcgagcatttgacaggaggcaagacctgattgacatgtgcaggttataagaacacaacgtaaatctagagaaaaacacgtaaaagagaacatcaaagaacggtgtaactctagataaaatgatgcaacttaagaacctgtaatgctagtgccgactaaacgacttaactcaaacacaacgtaaatcaaatctagagaaaaccacataaaagagaaaatacgcaaataataacatgtaaagctggtaccggggaaattaatgttaacttcgtacgggagtacctacgcggtaccgattctaattttggagacaattctaccctttttgctctaatagtaaaattatatttttatccttagtacttaagtacctataccaatagttaaataccttttacatgatacctatgattgaggagtgttggatcttataccttttttggaatgcaaacaccgtaaaaaagcctatcagattttgttgaggaaattgcagcagtaaagccactgctgaccctatcagaaccaactcttctctttcaaattttggcttgatcactctgtgaagtagcagagatgtcaatcttggacgatatgcttgctgcatgaatctcttatgtcttaaatctggcaattggctgctgttatttttgtgtgttaacaattttgcttcgatgttctcgattccgcgttcaatcaacaccggagtactgaacataaatatccacaatttgagacgattgcataagaactgcttcagtagaaaatgattggaggctctttgtgctcttgtttacagtagctagagcctatattctatttattttattaaatttagcttattaattatatctaggttcctgttgtttatcgacgaaaagcctgtgatggtagtgttacctatcttggttcctcttgttaacgccattgtgttgcatgttgtttttcctctttcttgtgcctttacttttcggattgagctttctcattttgtcttgaaagttgaaacaatactttagactttgttcttccacggtaatgaagatttggagaaagggaccagttcgaaactgcactgaaaattccaattcacctatttctattacgctggttgcttgacgaaatgagagccaacgatagaagcaacatgaatgaaacataatgtatcaaaagtattctgcaaattgagatatattgttctgaattttagtagtgtgatacctatatgatttttgtgatcatgttatatacatttagatcttctagactgaaaccattctaggtgttagccagagaagggaatgcattaggacaaaacaaaagtttaagtgataatcaatgcggtcgttggccagcattagctgaatatcatatgagatctatcaacaatgaacaaatgtcctgcaagaggtctcttctattggtgtcttcaatcattttttttttgtttatgtttctgaatttcatgcaactccaacaattccagaccctctaaggactaggatatccacttaaaacaagaaaagtatgtagtgaataacagtcagagatatggacggtttggttggattgttggagaggaaattgaaggaaaagttttctggacaaaataactaaatggttggaaaactgaaagcatgatgtaaactgaacacaattactcatgttgccaattaggcagctctctaaagagcaaaccaattgcctcatgagctgtacatcctattcaagcggcaacttgtaaatatagaacatgtaaaatgaactaaacatggctactgtacggagcaattaacgaagatgagcccttcaaaccggctaaagtatgcgaaaggaacttgaggtgtagggatgcaagtagttcgacttgttggtatggataaaaatctaggagtaaatttcacaaaactacaggtattttgaccaaattatcacaaaactacagatttaaagagctgtatcacaaaactacacatttaacaccaaatttatcacaaaactacagattttaggttaactatcacaaaaatgcatatttaatattgaacttatcacaaaactacaacttttagagtttaaatccctagcactattgttatggtggagctataaacattattactttgtgattaaattgattctaaacctgtagttttattataatttagttactaaacgtgtagttttgtgacacttcatcttaaatgtgtagttttgtgataaatttggagctaaatgtgtagttttatgatacaactccttaaatctgtagttttgtgatagtttggtcatagtatctgtagttttgtgaaatttactcaaaatctagatatgacaaaagttgtcttgctatacttatcctatgagtgcgaaaacttgccaccctagcgaggtgtgattgatgttagtgtcaaacttgaggatgacattcctgtcgatgatgaaagttgcccctccgacgaggccataggcggtgcatatgttggcacgggcatcttggatggtaacactggtagtggtccattggattggaggaccgtcatggcagctctgatagatggacgcgcgtatcggtccggatgcacacaccagagcccaacggccatgacacactccatgctggttgcgtcatagtcattgttgagccgctcgtctgcagccttgagaacgactccctggccatataggtcccagacccattccaccagtcggaagaggctattgttctggttgtccagtaggctcattggtctcctcccacatgccacttccaataaaacaacgccaaaactatagacatcagactcagcgcttgctttacctgtgatcacacattcaggatcaagatagcctggcgtccctgaggggtgggtcattgtttgtaccccaacggcatggtcaataagccttgcaagaccgaagtcgcctagctttgcattgaaggattcatccagcatgacgttgcttggcttgatgtcacggtgcacgacacattgatcccactcctcatggaggtagagtagtgcagaaccgagtccatgaacaatgttgatcctgtggcaacatccaagctagctgatcagttgaatttcaaaggtgttgattgcacataatggaaattatgacaaattaatgagagttaattaaaaacctcattggccatgtgaggaaggtgccattgccgtggagatggacgtcgaggctacggttggggactagctcgtagacgaggagcagctcggtacggccatggcaccagccgatgagctgcacaagattgcggtgacgcaaccggcttatcaccttgatctccgacttatactccttcctcccttgcttggaggaatctttggcaaacctctttatggcaaccgcgaggccaagctctctcaggtagccacggtacacagccccgaagccgcctttccaagtttctcctccgtcgcgaagctcttcgtagcgtcgacgagctcgtggtacgggaaccgccttggtcccatccccatctcaatctccacgatgggctcgccgtcgtcgtcatcgtcactgccgtgccagcctccatcctctgcctccctccttttcttgctctgacgtcgtcgtacaaggactgctaccatggcgaagaggagaatgacaaacattaccgcaccaactgtggctcccgctacaactccgccacgtctggaatgcgacgttatcggggtcagggaaggcggtggtggtgaccgtgaccacggcggcggcggagatgctacttttgctgccagcttctgctcaaacgacaaactcgacttgaagtaccaaaaagtcagctgatgctgctcataggctgagccaattgatgccgaaaagccgatggtgacgttctccggcaaggctctcttgagatcaaccatggagctaagggtgtaaggcgtcgtcgagccatttatccatagcttaactgacagtattctcgaattgttgttgtagtcgacggtggcggtcatgttcccgatgaggctgaagtttggtagggactcgttcgtcacagatacgacggagttgacgtcgatgccgatgtggtcgttggttgtgttagggtcgaaggggttgacgaaggtgtcgaactcgacggcaacgaaccggttctggccggtcgagacgttgccgactgtctggttcgttaggccgaggttttcgccaccttcgtggcccactggtaacctcgatggatagctggtgaggaagaaggccataccgtcgccctttttgcttctatcgctcggagcgattatgttgaaggagaagcgcgtggtgaagctggccacctcgccggtggcggcgtcccagagctgcactggcggtttgtagaacacccgtccgacgttgttgcccacactgttcgcactgatgtcgatatacccgacgctgacagaggcattgccttcaatttcgatgtactggttgtgtgaggaggcgaaggtggggtagttgaaggacaaggcggcgacaggagccggaggctgcatgtagcagacggagaagaagatgacgaggtcggcagcacaagtgatcaacgaaaagatggccatcgccgccggcgagccagcgtcgatagatcgtgtgcaaggtgatactgatacagtactgtgatactagtactgtgtactgatcggcttctccagctggaggagcaacgacacaacttcctatactgccagtctgagtctgtatttgaggtatcctccattggacccgttctcggcctggcgcgtgacgacgaaacaagagtaagtcaaaccacatgccactaaagtggagtattcgtttcgtacttatggtacaatgtcactgaactcttcaaataattgatactagcatatattactgtctgtgtctcctctagcactaaaataaatatagactgtagccgttgtgctccccaccggccgtggcccgcggtcgaccccgtaccgtacacgctcaccctctagttactgattggactaactgtatttatggcgtcatatttttcattaaaaaatagtcgatatgtatttatattgtaagtctctaaattacatatgtaattttaatgtatttacaatttaagttctaaaattgcatatgtaagtcttaaaattacatatgtaaatcttaaaattacatattaaccatatgtaaatgatgcgtaagtggggtgtaactagtatgtaaatttgtataaatatataattacaacaataaagtcaattgactgctacaaacccatagcaactccggatcaacaaataaagtaaaaaaaatgcaaagggataaacaggtggagaaacggatgtgcatcgtgcacacgatgtccagcgcagcgcataccagccgttaaaatccgactgtactcagccacataatgtggcgtcactttttcagcaaatccgttttaaaattagttttttttctccactatccatctagaaactacaaaccacataatctttagctgccctttggcgcattttgtttggtgtttctgtagagatgtgctgaactgggatcatgttcctcttaaccttggtgacttctttatccttgctgacattagagctgaattaaacatatagctgtgaaaattgccctgcttgctgccatttgctggactctatatatggacaacgagaaacaacatcgtgttcagggataaacttgtttactcacccctaatactacctttccaaattgtctctttcttattgcagtggagtcctttgcatcggctggagatgaagagtgatctagagaagctggtaaagaggtttaaggagagaggagctgctctaagacaaaacagaatacgagttgattgatcttgctagccccatgcaatgttttggcgtttggtttgttttagattgctgccgctttttttttaacgagacggtgcgaagttctattgatagagcaggaaaaaattacaagattacaaccttggaaggtcgtaaccaggaaaaaggaaaaaaaatatactaccacccacacaccgacagcgccaacacacagatccgggagaaggctagcaccggaccggccaccgctaagcgtgaccgaccaccgctaggccaacaacgggacatagacgagatcgcccaaaaacgcccttacaaccaacacaaagcccgactctattcacgtcttccggatttaaggagagggggtgagagaaaagaaggaacacctctccccctagggcctccgacgtgaccaacttgtaggaactaggatgctgccgcaagaggatgagaatctagagcgtgcttgcaccaattgctcgagtgatttcggcaaggggatacctaaacgacgtctccaaggagagaagcgatggaaaaccaacgccaccatccgtcaaggtctcaaaagagccaatactgggcttttgcccggcaaccacccttgaggggtgagacggcacgacaacgccctcaggagggagaatgacactcgagcactgatgctgggttttcacccaccgctcaccacctgcgagtccacggctgacgcaccgatgctccaccgaccgcccaacctctccgacatgtgggaccactgcatcagcgccccctgcacagaaaaatcgattttcgtgtgcaggcctcttaactggaacgcatgcgaaaatttcaattttcgtgtgcggctctttaagaggaccgtacggaaaaatcgattttcgcatgcggtccacaaatcgattttcgcgtgcggtcatattaagtgaaccgcacgcgaaaatacctctccctcgcactcacttcaaatttttcacacctcctctcccttcctttactttttattttcactcctctctctctgtctctcactttccttctctatctctttctccatctctttctcttctccactccactcctctccgtggctggcgacgaggcgcgtcgaccgggtgggcgcgccggcgagcggcgaggggcgacggcaaccggctcctaccaggatccggccgcggcggccgtcccccgcccggatccggtagcggtggcagtcggcgcgacggtggcggcggcaggcgagctcgacggtgacgacggtttcgacggtggcaggctcgatagcgatgacggttgcggcagcggcggctgggtgcggcggcggcgcgacgacagcgacaacgccgggagtggcggcgggtgattccagggttagggttaggattttttatttttttattttttttttgtgcgtgcgggcggtataatttgaccgcacgggataatcgattatcccgtgcggtccacttaacccgaccgcacgggaaaatgattatcccgtgcggttgggccgcccgcacgtgaaaatattgattttccaagacccctgagtgcagatgggcaaaacctctgtacggaaaaaacccatttttaccgcacggaaaaatgcttttcatagtagtggctccgcgtgaccgcaaggacggcggcagcggggcttcgcgcaccacgcgcttgtggcggccgggggagcctccggaggtggcggcggcggtagctttcccatccagatccgggccggcactggccagatctagcggggcgccgggagctagcggttggcggtgggggaggggttggcgccggggctagtgacggcgcggagactggcggcaggcacgggtggcgtcgtggtgggtgggcagaggccactcgcgccgaagttgcagcgtcggcgtcggcgttcgtctgcgcgggtccacagaggtggcgctgcgcaggcaggggctacggcggcgtggtggttgcggcgacgatggacggctgtggcgcgcggacgtcgaagccggcttgctccaccctggatggatctgagcgttcgtggccgaatccgtcgcctccgcgcttgatctggccagggcagccagccagcggggcggttgcgtgtggtggcgttgcatggctcgggtgagctccgatgagctcgatggctgcactgcgtcgcctaggcaggttccagtggggttgctcgctggcgacgagcctcttgctcgcgatgtgcggatgtggagttggcgggacgttggcttgcgttggcatgaagcaggaatggggcttgacatccacggcggtgtcttcctcgttgccggccgagtgttctccctccttttggtttccaccttctttggccagaccctgttctggttgtggggaatgctagggggagggcggaggctccaacttgctgtaggaatttgcagcggattgatggcgtttcgagggtggccaagggcacatccttgccgttggttacggtcaaagtatgacttcttgtgagacgccatggacttttctgtggccgtcgatgtgggggtgcttgtgtgggtgatatgaagacactagtgaaagccttgtcgtgcctttggccagttcgacgatgacgacgcccgtgggtgccgtttcccttcttggaggcgtcgtcatggcgttctttcatatccctcacaaatcttcaggtgaaaaaattgttccggatttcggacgagcggcggcggaattacgcgtcgtgtcctccttggaggcatcgtttcggagaagttcctatgcatcgacgattgttgatggcctttttcggttcaaaagctttgatactttaatgttcggcgaggccttcgccttcttaggtccgcttcgttcttgtggtgggtgacactctcttcggttgtttctactgatgaagtcggagctgctcgctgatgaggtgcggtgacgcttggcaacggtgacatgttacagtctcttccaaggagttggtgctagtcgtgtgaaggaagtggctctttgatggcttggctgatgtccattgttggataacggagctgcttttcgatcgctttggcgactttcgtggtttcagtgtcgctgcggttgtgaagtcggcgctgctgggtcgcttgggcggctagctcggcaacgataacacctcttctgcaatgtcggagctgtggtatcgcttttgtgtttagcttggcagcgatgtcctgtgtttgggctctgccgtcattgttagttgtgtagctaggtctcttgcttttttctctacggtgggtttcagccgatttcccataattaaccatgtagttgtatggtttttgggcccggtttcccttataaattaggtcaattctcttcttctaaatatacaagctgggacaaagttccacctcagttttgaaaaaaaaaacaatgccgcgagctgatcgcgaccgtaatttgtccatgcatttgtaatgctcggactcgaactcgagagatattagggtgttaaactaatgaatgtccatttttcttcagggatgtaaaatggatatttctcttaaattaatgatgtctatgtagagagcagaccaagaaaacatagggttttgattacgccacaagtgaaaattaaactgattactgtatcaccaagacacgtactcgtaagaattagccatacaaacaacaatagtactagttgtatgcttgcaactccctacagttccacgaagataccacaaatcaagaataaaggggttctttggatgccactctgtttattctatcagcaaatttgacaatgccacacttgtggaaaattttgactaaaaaatgatcaatttaggtgtgggtgtcgatggattatatctaatacaagaggtatacctgatccgtaatattgacagtcctgattgtcaaaaaaatatatgacatattattaatgtagtagaaccaacaaacgctaggttaagttagttaaatgtgtataccacaagtgtaacaaattaaagttttgcactcaatcaaacaacgcctaaggacactattggatcaagagtgatgtgggaatgcgcccccctgggtgtgaagaaaatagtcttccgctaatttgcgcgttgtttgcaatctggaaactgaagaccgggagtgggtccagcttaagtcaagggtatttagataaatactcaagattttgtatttaaaaataataggtagatagatatactatgtgatgcatgtgtaccaaaacaaaggttgtattcaatccaagaggttatattaaactcataatacgtatgtgatatatatatatatatatatatataggacactcatatggggctccatggtgcccaggcaccatggtatgaaatacacaaattcgcccaaatttttcaaaattttcaaaatgtgagtatatatctagttataagtattcgattcatacctatacctagcaataaaac

SEQ ID NO: 48630 - DNA, 12266 bp, Oryza sativa
tgttgggatgttatatacctagaatcaaaatctaacatattacatgtttaaattcagttcaaacttgtttgaactagttagtaaagtagttaatgttaatacctaaacatttaaaaaaaattcatgctcatttgaattgagtatatactcaatttgaatcatggagcccgggcaccatggagcaccaaacaaatttaatatatatatatatatatatatatatgtatatgtatacatgttatattttttttgcagggatatatacatgttatattaggcttctgcctacaagtttattttaattaccccctcatattttgaataaacaattaaccttagaatcctaacccggtcctgctaaagaccgaaacgcttagatctatactatagctttggagacttggacagcgttcgtttgggtgagtttgagggagaaaacgtatcgttttccgcacgatggtacgtttttttaaaaaaaaatctataggaatgttgctttaaaaaatcatattaatctatttttaaaatttaaaattgttaatactcaattaatcatgagctaatagcttacctcgttttgcgtatcttcccaatctcctcgatttccttctcctcgaacacacctttggaagagatgagtcaaaatacatgtatacagtaagtccgtccgtacgtgttgaaaaacaagaaatggcctgttgggccatatgcctgaacgaaatactccaaacgtggcctgttccgctttttgcgcctgtcactgcgggcgaaatgcaaatatgtaccttcaaactgctggccacttgaattttactttccagttttatcactgctggccatagctgcatgttgctatagtggaggagtataatatcgttcacttgttgtggcgattggatcagcaaatcaaggagtaccaaccatccaaattaatcacgcgctcactcggggtcgtagctgttgctgtttcgtgttgagcaagagaatatccagactttaatattctcttgtttgtgaattgtgatatcacctgccagctgggtcttgtcaggtcttgagcaagctcggcatcatgaaacgccttgttgtttaaatgatcgatcgaacactgtctttgctaatgtacaattgtgtgtataggaaactcggcgagttcacatgcgagtgccaggatcactgcatcgctataactgaacacctgaaaatgcatagatccattgcatccgttgcctctactctactgagcggatgaaagttaaattggcgcacgtaaaaaaaaaagctattagcacataattaattaaattttaattattacaaacttgataaatgtatttatttgatattttaaagcaactttttatatagaaagttttcgcacaaaacgtaccgtttagcagtttgaaaaaccgtgctaacgaaaatcgaggtaaaatctgtatgtgtgaaaaatgctactggttgattggttacaactaatggtactgctgtttgtttgcatatttttttcttgtctaatgatgaaatcgtttgctttgttcgtgagagaatttatatgtgctacatacccaatttggtgccgaatgctcattaacttgcctctacggctctacctgtgatgttccggtggccaaattatattttttaacgaatcgatatttagatggtgccaatttcatttaatagagtagaaaaaatatataagaaaaggaaaagaaagcccgaaaccaggtagcaatgctgcgaggtgttttgctaccccggacccaagtcttagcgaaccatattttgtcgcgtttgaacttaattacgtgtacacaatctcccacggcatttctctcaactttttcaccaggccgaccaaaagttgacagccagcgttttgcgccgatcatcgtatgagatctatcaacgcgatgaatatgtagtcctgcgagaggcttcttctcttgataccttcaatcatttttgttcttttgtttttgagtttcagttattgcaacttaaacaataaatgagttaacccacagaattgctaatttgccatgtagatctctgcctgagggcgaggaagagaagaatatattcttaccttatcattgactctagacaaacgatgaaggactctaggtacaatatatgcaatgaattttttttaagcgaacgattgcaggagctctgctggaatttttagtaagtgagaaagttcaggttaaaaaaagggttacagggatcccggagtaaaaaacaccccttttagaacaactggagaataccgcaaggtaagctaagaaaaactatcgacgaactaggcggttcaaaaatgaaatgttgctctgccacgatgaaggactctagatacaatatccgatgaaaaaatatatatgatgaaaagatggtacaccgaagtaaatttggaaatgatggctatatttgtggaatggttccttgtgtaatgtggatgacttaggaatcgagtcaagctcaatatagttgaacatgccctaaggaataggacatccactaaaaacaaaaaaagtatgttgagaatgacagcatccactgaaagaatgaataaagcgtagagagaaaatgacaggaaactaaatggttggaaaattgaaaagcatgacgtaaatgcatgtacgtacattactcacgtcagcactaggcagctctaaagaacagattaacggggtcacgtgctgtacataccattcaacgatcaactctaaaataagagcaaatcaaatgaactaaaaaaacatttagcaccatcttttcacttatgattatgtatgtaaaccaaaatttaaattttaaaacttagtttttttaaaaaacaagtgtgttttggttttatttgtgatggaaaattggtgagaaaattggaaaccatgtaatggtttttggttgaaaatttggtttggaatattggcgattatcggcgtgagtgctgcaatttaaatctctaagggtttgtttagattggtggattatcacgggatttttggaggaatactattcataggattgtttttcccttttaataccattcggatcacaaaaaccaatcataagaaggtcgcaggaaaaatttcctttacttttgttccatgggagaaacatttgaaatatccatccactctaatctcttttttcattttcttcgtgttggaacgaggcaatcaagcattaacaaatgcaaagaacagagaaagaagaatcagcgaagaacagagaaagaaaaggcagatctcacatgattggaaacatatcctatgcacacaagcttccgtatacactccatgcacaccaactagcagatgtcacagaaaattttagaaaaaattggacacatactcataatagtattacacatatctgcaaagtctcatattcaaattcattatattttagtcgtaacaataaagtgaaaaatctgacagtttttagggtaaaaatctgtcagaattttgtttttttgttacggctaaaatataataaatttgaagataagatttcacacgttggtgtaatactattggaagtatgcgtccaattttatctagaattttatgtgacatttgctagttggtttgcacggagtgtgcacggaaagcttttgtgcataggatatgtttcccatatgatttctttaaataagttccgtacaggaagcaaagcccatacgacaaagaatcccaagagcaaacaagagcaaagaggtcacgcgcagaggtcaccggcaacggtatcgaggtcagcttccagtgtggagctaatgcggcgcgtggcgtgcggaggtcgccggtgacggattgaggttggcttcggtcatggataccgcgcgtgaaagttgccggcgacggatcgaggctggcttctggtgtgtagtggatgccgtgcgcggaggttgacagcgacagatcgaggccggcttctagcatggagactggagtggatgccacgtgcggaggtcgatgatgacggggatcgagagcagcaggccaacatccagcgtggagcagcaggctagcatgaggtaccggtatctcgaggtactttttgttggactggagcaaaatctttttctcctatcttacgtttttcctatgctataatccgaacaagccctaaactagatttcaccacgatagcaagatctcaggccctcctgagaaaggatccctgcccatagctaggtatccacaattttctatctaatctgaaataagaacacgaagtagaaaaaaagtgcacttataattaaatgatgtggatcaatgtgtaccatgagtgggcaagcgtacatccctaacgaggtgtgattgatgtttgtgtcaaacttgaggatgatattcctgtcgacgacgagtgctggccctctgatgaggccaccggcggcccatatgttggcacgggcatcttggttggtagcatcggtagtggtccattggattggagaactgccatggcaactctaatagatggacgagcgcatcggtctgggtgagcacaccagagcccaacaaccaagacacactccatgtctgtcgcgtcgtagtcaccgttgaggcgctcgtcggccgctttgagaacggctccctggccgtaaaggtcccatacccattcgactagtcggaagaggccattattctggtcatccagtaggttcattggtctccttccacatgccacttccagaagaacaatgccaaaactgtacacatcagattcagcacttgctttgcctgtgatcacacattcagggtcgacatagcccggtgtacctgaggggtgggtcatcgtttgtgctccaatagcatggtcaatgagccttgcgaggccaaagtcacctagctttgtattgaaggattcatccaacatgacgttgcttggctcgatgtcacggtgcacaacgcatagctcccactcatcatgtaggtagaacagtgcattcccaagcccaagaacaatgttgatcatatgacaatatccaaggtagttgatcagttgaatttcaattcacatttgtggattgcacatcgcaagcaatagaaaaagtacaatctgcaatatgaatacagttcatttatagcctcattggccatgtgaggaaggtgccattgccatggagatggacatcaaggctgcggttgggaacgagctcgtacacgaggaggagctcattgcgaccgtggcaccaaccgatgagctgcacgagattgcggtggcgcagccgacttatcaccttgatctccgacttgtactccttcctcccttgcttggaggagtctttggcgaacctttttatggcaacgtctatgccgagctctctcagattgccacggtacaccgcgccaaaaccgccttgcccaagcttctcctccgccgcaaagctctttgtcgcgttgacaagtatgtggtatgggaaccgcctcggccccgtccccatctcgatctccacgatgggatcgccttccgagtcgtcctcctcttcctccctcatcttctttctctgacgtcgtcgtacgaggattgctaccatggtgaagaggagcacgatgaacagaattgcaccgacggtggctcccgctacaactccgccacgcgaatgttgtcctgtcggctgcttctgctccaacgtcaagttgaagtaccaagaacgcagctgatgctgctcaaaggatgaacccgtcgccgccgagaagccaacggcgaccttctccggcaaggcgctcttgagatcaatcttggagctgaggttgtaaggcgtcgttgagccatttgcccatagcttcaccgacatgatgctcgaattgctgttgtagtcgacgatggcggtcatgttgccgatgaggatgaagctaggcagggattcggtcttcactgaccggagggcgttgacgtcgatgccgatgtggtcgtaggtggcgtcggggtctaggaaggagttgttgtaggtgtcgaactcgacggcgacgaaccggtcgccggcggtggcgttgtcgaaggtctggctagtgaggccgagggcgccgccgtagcccatgtacggcatcctcgacgggtagctgacgaggaagaaggtctgttgcagttattcctggtgtggcccgagctgatccggacgacgcgggaatgcaacggtgtgtaacggtgtggcgagatgcccgggcaaaggagatcggtggcgactagttcgtgcagcgcaggaagcgcgatgaagcagagtgcatgacggggagtaacctcgtcgtttccacatttgtaggatcaaagttgttagcctataaatagttggtggtaacagaatttgtacgcgcgcattcagttttcatttcagttcgaaataaacaccgaaagttgcccaaatactctcccaagttattttgttcttgttctctgcattctctgaattctctgtctccctgaaagtttcttcagtctgctgtgccggatagctacaggacgcccacaaggtgttcgattggtgttcttcgccaacaagtggtatcagagcactcaggttgagggctgatctgacaccatggcgttggttccggcgggagccgcagcggatccggcgagggggagctcagggagtgcgttctcctacccacaactcacggcgacgaattacaccagctggtgcattcgcgttcaggcaatgatggaggaccagggcgtgtgggacgccatcgagccggcggccggggtggccgtcgacccaagaagggacaagaagtcgaagtcccatctgctgcagtccctcccggaggacttgctgatgcaggtggcaaagaagagatcggcaaaggaagtgtgggattgcttgaagacaaggttcgtgggcgcggaccgcgttcgcgaagcgcgcctgcagacgttgaagggtgaatttggtgccatggtgatggagccgggggaaactctggatcagtacgcgggccgcatcaccgcgatgagcgtgcgtcactcggtgttgggctcgacactgagtgattccgcgatagtgaagaagctgttcgacacggtgccagagaaattcatcagcctcgtcgcaggtattgagcagttttatgagattgataatatgccatttgaggaggcggtgggtcgtctcaaggcctacgaagaacgagttcgcaagaagaaggcggccgctggtggtgtcaccgccgacggtcaagtacttctcactcaggcggagtgggaggcgcgtttcaggaaggacggcagcgagtcgtcttcgccgcagaaaaacaaacctcccagcgacaggggaaaccgtgcccagggcggacgcggtcgcggcagagggcacggtggaggtggtggacgcggcagcgcgccgcggaacagtggcgctggtggctctggcggcggtggccgtgacaagagccacatcaagtgctacaactgcgaagaattcggccactactccacccagtgccctcatcccaagaagaagaaggtggaggcccatctcgcgcaaaccgacgacgcaaaccctgcattgttactggcggtgaccgaagacgagccggcgagcgggctggtcgtacacgaggagcgtgtgtggccgcagctgctgttggctgacagcggagcagccaccggggacatctggttcctggacaatggggcaagcaaccacatgacgggtgatcgtgctaagttcagagatctagacgtatcaatcaccgggagcgtcaagttcggggacgcctcaactgtgaaaattcaggggaaagggtctatcctgttctcctgcaagaatggggatcaatggctgctgcaggatgttttttatatccctagtctgtgttgcaacatggtgagcttgggccagctcacagaaacggggcacagagtggtgatggatgaagatgtgctcgaggtgttcgacaaaagtcccctgcggctggttatgcgggtgaggcgcacccctaatcggctgtaccggatcgagctgaagctagccactccggtgtgcctgctgacaaggatggatgagccagcatggctctggcatgcacggcttgggcatgtcaatttccaggcgatgaagctgttggctgacaagggcatggctggtggcatcccggcgatcacacatccaaaccagctctgtcaggcatgtctggttgcaaagcagataaggcagccgtttcccgcaacggcgaacttcagggcggaggagccgctcgagttgctccacattgatttatgtggaccgatcaccccgacaactatggccggtaatcgttactttatgctaattgttgatgatttctcacggtggatgtggatgttcgtgatcaaaacgaaggaccaggcactagaggctttcaccaagttcaagccgctggccgagaacacggccgggcggcgcatcaagacgctgagatcggatcgcggtggcgaattcctgtcgggcgaattcgcgcagttgtgcgagcaggcgggcatccagcggcatctgacggcgccatactcaccccagcaaaacggggtggtggaacgccgaaatcgttcggtaatggcgatggcacgatctctgatgaaagggatgtcagtgccgggcaggttttggggggaggcggtgcgccatgcggtgtatctcctcaaccggctaccgacgaaggcgatgggcgatcggaccccgttcgaggcatggacggggcgcaagccgcagctgggacacctgcgggtgtttgggtgcatagcacacgccaagatcacgacgcccaaccagaagaaacttgatgaccggagcgcgccgtatgtgtatctcggcgtggaagaaggcagcaaggcgcaccgcctgttcgacccgcgttgtgggcgtatccatgtaagtcgtgatgtcatttttgaagaaaatgtaccttggcaatggagtgtagtcgcaggggagcaaaactctaccgagttcacggtggaggaggatggagttgatgcaccgccggcaggagcgccggcctacccagtaccgcggtaccgggcgccatccccggcagtcccgcaatcgcctccggcaagcccggtaggggcgtcatcgtcattgccgacttcgccccagtcatcaccgagctctacaccgccttcaacacctgctaccggctctgccgggccggtggcgtcaccaggttccggcggcgaccttagaagcgatgagggtcccgtccggttcaggagtcttgaagatatcatgcgggaggcaccccgcgtggacctggtggaggatgaacacgatggggacgcgctgcttgcagagatggaggagccatcgagctaccgcgaggcagctggccagccggcatgggagaacgccatggcacaggagctgcaggcgattgagaagaattcaacatgggctctcactgcattgccggcaggacacaaacccattggcctcaagtgggtgtacaagctgaaaaagaacactgccggcgaagtaatcaagcacaaggctcgtttggttgcaaagggctatgttcagcgtcaaggggtggattttgaagaggtgttcgcgccagtggcgcggcttgacacagttcgtgtcatcctggctatcgcagctgatcggcggtgggaagtgcaccacctcgacgtcaaatcggcgttcttgaatggcgatcttgaagaagaagtgtacgtagcccagccagagggttttgtgaaacgaggagaagaacacttggtgctcaggctgagcaaggcgctctatggattgcgccaggccccgcgggcgtggaacacgcgtctcgacaagtgcttgaaagaactcggttttgcacggtgcacgcaggagcaggccgtgtatactagaggaaaggggcaagctggtgtaatcgttggtgtgtatgttgatgacttgattgtcacaggagaaaatccacatgagatagccatgttcaagcagcagatgatgggggaatttgagatgagtgatctcggtcttctctcttactatctggggatagaagtaattcagggggagaatgggattgctatcaagcaagctgcgtatgcgaagaagattctgtctcagtttggtatgcagggatgtaatcccacctcaatccccatggagccacggtcgctgctgcacaaggatgctgatggaaatccaattgatgcgaccgagtaccggcgtgtcatcgggtgcctgcgatacttgttacacaccaggccggatctgtcctacgccgttggcgtggcgagcaggttcatggagcggccgacaacgatgcatctcaaggcggtcaagatgatactcagatatctaaaggggacgctggactctggtctggtgtttgcaagcggcagtggctcgttggacatcacgggtttcactgacagtgacttggcaggtgacatggatgaccgtcggagcaccggcggcatggcgttctatgtgaacagcagcttggtgtcttggtgttctcaaaagcagaagacagtggcgctctcgtcttgcgaggcagagttcatggcggccactgcagcagcatgtcacgcgctctggcttagggcgttgctgagcgagatgatgggtactgaagcaaagcgggtgaaactttttgttgacaacaagtcggcgatcgccttgatgaagaatcctgtgttccacgggaggagcaagcatattgatacccgctaccatttcattcgtgaatgtgttgagagtgggcagattctgattgagttcgttcgttctgaggagcagcgagcagatgcaatgacaaagggactgccggcggcgaagctggcgactgcacggcacctgttgggtgtgcgtgatctcaggccacgccaagactaagggggagtatgttgcagttattcctggtgtggcccgagctgatccggacgacgcgggaatgcaacggtgtgtaacggtgtggcgagatgcccgggcaaaggagatcggtggcgactagttcttgcagcgcaggaagcgcgatgaagcagagtgcatgacggggagtaacctcgtcgtttccacatttgtaggatcaaagttgttagcctataaatagttggtggtaacagaatttgtacgcgcgcattcagttttcatttcagttcgaaataaacaccgaaagttgcccaaatactctcccaagttattttgttcttgttctctgcattctctgaattctctgtctccctgaaagtttcttcagtctgctgtgccggatagctacaggacgcccacaaggtgttcgattggtgttcttcgccaacaaggtcatcccgtcgcccttgttgctcttgtttttcggggtgatgttgaaggagaagcgcgtggtgaagctggcaacctcgccggtggcggcgtcccagagctgcaccggcggcgtgtacaccatccggcccatggtgccgccgctcgacaggttgttccctttgcctttggtgagctcgatccattcggcggcggcgccggcgagcgccgcgctgccctggagggtgatgttcttgctcgcgttgctgaagctggagtagttgaaagatacagtagtggtagcgacgacgctaggcatgacgagcaagcaggctagagcagccatgaacggttttgtcatgaggacgccggcggccatggccggtctttgagcggaatcagcggccggacaatactgccaatgccaaaaacggaaaactactagtagtactcaaatcagcaggtggccagtcgccagtcgccactcagagagaccagtcgagatcttaaggactctgctaatttaacaagttggtggttggcaaatcaacactaggctccatgagaccatgaccctgacagctctggctcctcggaaggtgctgaaatgtatcatattttgtctattttgctaatagatgacgaagttaagcgtaagttccgtttcttgttggtatcttccctttttcttcaaatacattttcaagaatgataaaatcctttttatatatatacatcaagctggtttatatatatatatatatataaaaggtgaagctttggacgtcattggcctaggcctgcggattgtttgcaattttttcgtcttttttcaccaaattttataaaaaaatgtactccctctgtttcataatgtaagtcattctagcatttcccacattcatattgatgctaatgaatctagacatatatatctaattatctatttagattcattagtataaatatgaatgtggaaaatgctagaatgacttacattgtgaaacggagtaagtataaaatt

SEQ ID NO: 48631 - DNA, 2170 bp, Oryza sativa
acttaattaatattaaatattttatgcatgtgtccaaagattcgatgtgatgtttttgggaaaaagtttttggaactaaacaaggccttatacacacttcgaaattactgaaaataatttttttattaaataatatgaagctttaaattaataatactgagttgtacttgttatgatgtcttacttttttagtatttttcttgataaaggattttctgaatttaggattgataaaaatacaatattgtacattttctgagttttcatggtgttgtctaaaaggacaaacagtggtttctaagtgtacacaaagaagtaaatatatttattgatccttaaaaactcacttacaatatatgttctcttggaggggtctatttataaccttagagttaggtatgcattttttatatttgtcagcgaaatcagctatctatatcgctgaagaacctaatttaagttagttttacaagttggtggtctagactccttgtattgcggttcagagatgcgatttaaactcggtggaaacataagggatgtaaagttgatttaatccattggggataggcacgtagatcaggcttttcctagcggctgtcccccaacccaattcgttctgtaggcaatggcccatgaggaggatggcggccaccccttcaattgtaatgggccgatcgtttaattcgcttcaattgtagtgctgctgcagtacgtagcacctatcgttgcccatctccctcactcgacttattctaatgctggaacagaaaatggccggacagatctttctagagaaactacagtgccataagattcatggcataagtacacatacattactcaaatcggcaattaggcaacaccaaagaccaaatcaactctaaactaagaacaagcaattaaaaaacaaacactaaacactagcactgatgcttgagcaatgaagacgagtccttcgaactggttgaatcggagggaaccgaggaccacgaggtgtgagtagcatggccactcgtcgtcgatatggacgacgactgcgtcacacctgatgacgacgacatccctgtagatgacgcaaagagcccatgaaacgaggccatcggcggcgcgtacgttggcacgggcatcttggccggtagcaccggcagctggcctccactcgattggagtatggtcatggcatctctgatagacggtcgcacgcttggatcagggtgcgcgcaccagagcccaagagtgatgacacgctccatctccgcagaatcgtagtcgccattgagacgctcgtcggcggccatgagaacatctcccttgccatacaaaacctaggcccactcaaccagtcggaagacgccattattatggctatctagtaggctcatcagtctcctcccgcatgccacctccagtaggacaatgccaaaactgtaaacgtcggactcggcactcgctctaccggtgatcacacattcagggtcaaggtagcccagcgttcctgacatggcggtcatcgtctttataccgatggtgtggtcgatgagcctcgcgagcccgaagtcatctagcttgcattgaaggattcatccaacatgacgttgcttggcttgatgtcacggtgcacgacacattgttcccactcttggtggaggtagagtagtgctgatccaagcccgagaacaatcttgatcctgtggaaacaaccaattaagcaagataaaaatagaattagatttgacactatcgaaacagttgagatgagaaagttaacgccgagaattaataacctcattggccaagtaaggaaggtgccattgccatggagatggacgtcaagactgcggttggggacgagctcatagacaaggaggagctcgttgcgtccatggcaccagccgacgagctgcacgagattgcggtggcgcaaccggcttatcaccttgatctctgacttgtactccttcccttgcttggaggaatctttggcgaagcgtttaatggcgacgacgaggccctgctctcttaggtagcctcggtacaccgagccgaagccgccttgcccaagcttctcctccgccgcgaagttcttggtcgcctcgacgagctcatagtatggcaatcgccttggccccgtccccacctcgatctccgtgatgggctcgccattgtc

SEQ ID NO: 48632 - DNA, 9997 bp, Oryza sativa
ctggcatgacattcccccctccttgagttccagcttgcccccaagctggtgccgcaggaaaacggcgacggagctcgcgcggattctcccaggtggttgctgctggtgcatcgccggtccaacgaatctgtacttgctccaccatcttggaacccttgcggatgaagcgatgatccaaaatctgcgctggacaaacgtgagtaacatttgtcggatccagcacaggaagtggagaatgaacttgttccgttggagccaaggccttttttagttgggaaacatgaacaattgggtggatcaaactggaagttggcagatccaagcgatatgccaccgctccaaccttgtcaagcacctgaaatggtccatagaatcgaaacgaaagtttacgattagccctggtaaccaccgactgctgaacgaagggctgaagcttcaaataaacccaatcgcccactgcaaaagagcgttctgaacggtgctgatcagcctgttgcttcatgcgagtctgagcacgcaaaagatgatctctgatcaaagcttgcatcttctcacgttcatgcagccactcaacaagatcgtctgatcgacaagcagcagaagctgaaagaccaaagtagcgaggcttatgtccatacagtacttcaaagggagtggtgcccagagcagagtgaaaggacgtgttgtaccaatattctgccaacgcaagccagcgactccactgtgaaggacaggcatggacaaaacaacggaggaatgtctctaggcatttattcacacgttcagtctggccgtcagtctgaggatggtaagaggaactcattcggagttgagtgccggctaacttgaatagagtagtccacaatgtactagtgaaaatgcgatcacggtcagaaatcaaagactgaggcaagccgtgaagtcgatggatatgttgcatatatgcttcggccacatccaaggcagagaaaggatgagtcaatggaacaaaatgactgtatttagagaatttgtcgaccaccacaagaatgcaattgaaagaagccgacttaggaaggccttccacgaaatccagagagacaatttgccacgcatggtcaggtacaggagaggttgaagcattccaggatacttcacatgctccgattttgcttgttggcaaacagaacaagcttgcacatactgaacaacagtggcacgaaggcgaggccaagcaaacagctgtttaacgcgctgataagtgacttgtattcccgaatggcctccaactgccgttgtgtgaagattagcaagaattttctgttgaacttctacattgtgaccaacccaaagtctgttctgaaaataaagcaccccattgtgtagagaaaaatttggtactgctccagaattgatacagagagtttgtaccttgctgcaggcatcgggatcagaggaataaccggccacaatttcattgatccactctggaactgcaactgataaagctgagagttccacctgatcagagcctggataatgagataatgcatctgctgcgttgttgtcaacccccttcttaaaaataatcttataacgaagccccaagagtttggtaagagccttgtgctgccagggagtggtgagacgctgttcagtaagaaatgccaaactgcggtgatcagttcgaatgaaaaattcatcatgctgtaaatatggccgccagtgatctaccgcaagcattatggccaaactctccttttcataagtagaaagtccctgatgtcgcagtccaagaactcggcttaaaaaagcgaggggatgattattttgcattaacactgcaccaatgcccttgtcagatgcatcagtctcaaccacaaaaggagttgggaaatctggcatagcaaggactggagctgtgatgagcgcttgtttcaaagcttgaaaagcatcctcagtttcagcaatccaaatatagagctgaccattgcgaagcaaatttgtaagaggtttactgagaatgccataattgcgcacaaatttcctgtagtatcctgaaagacctaaaaagctacgtaattcttttacagaagtgggtgctggccaatgttgaataacttgaatcttctcagggtctgtggaaacaccattaggttgaattatatgtccaagatatgctaattcttgttgtgcaaaagaacacttagtcctcttaaccttcaattggtgtttaagcaaaatctgaaacactgttttcaaatgctgcacatgctcttctaaagatttgctgtatatcaaaatgtcatccacgaatacaagcacacacctcctaagtaaggtagcaagcacactgttcatgactccttgaaaagttgccggtgcactagtcaaaccaaaaggaagcactctgaactcaaagtcaccgtgatgggtttgaaaagcagttttatgcacatcatctggatgcattctgatttggtgatattcggagcgcaagtccaacttagaaaaccattgagctcccgcaagttcatccaatagttcatctatcacaggcaaaggatacttattcttcactgttatggcattaagatgtctataatccacacaaaacctccatgaaccgtccttctttttaacaagtaatacgggtgatgaaaaaggacttgaacatggttgaattatccctttactcaacatctcttgcacttgactttcaatctcattcttttggacatgagtatatcgatagggtctcacattgactggcccagctcctggcagcaaaggaatagtatggtcaaattgtctgattggtggtaaccccttgggttcatcaaaaactgaagaaaactctgtcagtactgtctgcaccacattaggaatctgctcttggtgctccaacgcgaaaactgaacaaaattggactaagacactgttgttctgtcattaagttccctaagttgcctggaacttatgtgggcacattgctcagtatcagaccttacaccatgtaactgaatctgagttcctgcacaagcaattatcagagattttgtggtccaatccactgtcattagactgtgctgcatcaaccaatccatgcccaaaatcatgtcgtagttgttcaattccagaaccttcagattagtaaagaacacatgtccttgagtggtccattcacaattcagaatctcagaacaacaatgtaacattgctcccccagccaccttaacttgcacatgcacaggctgctctagaacccctataaaactgcttgccacccttttactgatgaaactggcagagctgcctgagtcgactaaaatcaagatttctttgctttggatttgccccagcattctcatacaaccaccagtttcagatccctgcacagcctgtagtgaaactgccattaacgtttgctcaacaacatgatctgttgtgctcaacccgtcctctgctgattcatgcaacactgtgaataactcttggacagcatgcagttgcacagtattagaacacttatgtgtaggcgaccatttctctgcacagatgtaacagagaccttgagcacgacgttgagccttaagagaagataatctctcattcattcctgatgaacgttttacttcagactccttcctttcttcagatttaatgcccatgttgatgcccccagacctcattggaggagttggcaaaggatatgcccctttaagatttgcaactgaacgtcctagagaatttccttcactcttcctaacttcttttccaggcacttcatcagctgtctccagcacttcctcctgtaacaaagcaacagccaaagcagactcgaggtctcggggtctctgaagtaaacagcattacgaattttcctatataatccctcagtgaaacggtgtgtcagataacgcatattcactactggatcatacacaagcaacttattcatgagttcatcaaactgttcgtaatactcccacactgttcccgactgtttaattccatccatctgccgaatcaacagttcatgttgatccctatcaaacttatcagatagcgcagcacagaaatcctcccagttaggaaaccgaacatgagctctagtggatctcaaccaagatgcagccctcccagaaaagtagatgatagccactcgcacccacaaccccgggtacgtgttattcacatcgaaataatgctcacacttcatcctccaatcctgtgagtcggtaccatcgaatttgggaaaatctaactaaggcactctatggctatactgacgttcctcaacctctccatcaaattccccaaatcccgaatcaaaattttcacaggaatgcaaaggcacaggagaaacattgacgtacccttgcccggagttgggatcagagtggtaaccactccagatgccctcctccagtgatgttgtggaacgccgtggccaccggccagtttgcccccgccttccgccgcgcccaactgatatgatggtggaggagtcggcaacaatggcaccttcctttcctcgcccgtcaacgggacccgaggggaaagtgccgctgatggagcttgctttcccttgttggcggcatcatgctgctgctgaagttcgtcgacctcagcacgcaagtccttgatcgcggcttcaacttggggtcgccatccactaaccccttcgtccaacttcgccaccgccacctgcatctccgcctgcttgttgttcaacgccaccagcgactcctggatgtcgccgagcaacttgccgaaatcgagattctgcttctccattgcctcaacctgcgattgcaaacgagaagtgtaccttggtttctccaggatcgctgctctgataccaaatgtcacggcacttgtggaattcacgccaagacgatgacgaaaccatgggaattcgaagaggaattcgtgaattgagaagagaaacagaggaagaacagaggaagcaatagaacagagagagagagagagatttgaattgaattgggaatttagttgtttctacaatgttcgattccttctctctctactttgccgatcttatatagcgatgtgccaaaagatctcgctccctctctgacagtggcccggtcgacagctaccgggtccactcactcgacacatacttgctcgtgggccgccgatctcgcatggatcgtctgggctgggcttcctcttgtcttcctcttgtcaccggtcgagacgttgccgattgtttggttggttaggccgaggttgtggccaccggcgcggtctggtaacttcgatgggtagctgccgaggaataaggccatcccgtcgcccctgttgttcctatcgctcggcgtgatgttgaaggagaaggttgtggtgaagctggccacctcgccggtggcggcgtcccactcccagagctgcaccggctgcttgtaggacacccgtccggcgctgttgcccatgccgttggcttcgttcaagctgatgtcgatatacccgacgctgaaagaggcgttgccttcatattcgatgctcgggttgtttgaattgaagttggtgtagttgaaggacaaggcggcgacaggagccgtaggcaggtagcaaacggcggagaagaagatgatgccgacagcgcaactgatcaaagaaacatcggccatcgccgccggcgtcgatcgatcggcgcgcaagggtgacaacgatactaccagtactgatcgatcggcttgaccagctggagagaaacgagagacaatgcttacagccttcctacgtgacaatgcagtcgggagtcccgcagatttaaggtaaccggtcagccctcatcagcggtgtaaaattttggtgtgccacgttgggtattatatagggtgtcgcatgggttgtttggacactgataaaaacactaactacaacatccgtcactaaaccgcgagacgaatttattaagcctaattaatcctaattaatccatcattagcaagtaccacattgtcaaatcatgtagtaattaggcttaaaagattcgtctcgtaaattagtcgcaatctgtgcaattagttattttttaattctatatttaatattttatacagggatacttaaacgttcgatataataagacgtaaattttttatgtggtaactaaagagggccttacctctggacggatttggaccgcgcttgcgccagcctgtaaataagtgacgaaagaagagtacgacaaaacacaggtaagcagatgatgtggatactaaacgctactagctagtacgtatactcgtttcgtccttattatgatacaacgtctcgtaagcaaactaaggccttgtttagttcttttttttttctaaaaacatcacatcaattctttacatacaatagagcactaaatatagattaaaaaaaattaattgcacagttaggaggagaaatcacgagacggatcttttgagcctaattagtccatcattagccataagtgctatagtaacccgtatgtgctaatgacagattaattaggctcaaaagattcgtcttgcggtttccagacgatttatgaaattaattttttcattcgtgtccaaaaaccacttccaacatccagttaaacatttgatatgacacctaaaaattttcttttcgcgaactaaacaaacaggccctaagtccacccaaaaatagtattagacctaatgtatataaataagcaagctatttcattgtccatgcttttcttatccacaatctttatctcacttatatatttaattaatgcatgtatccaagctatttttttttatctcgtttctacatttgtttatagttagcctataacctaagataaaatattctatggtaaattggaaccatgccattataattttgcaaaatgtgagatatgccatcggtatctcaatgacatgtaggacccacatgagtcaatgacatgtgagtcaggatggtacatctcaaattttgcaaattataatgacatggttccaattttctcaatattctaaggcactctagttttacggttttatcacaggattgcggtcttttgccaaaagacacttgacctattactttacatacttgctattttactactgtagaaaagtggaggaaaaacttttggatttttatcgttggattggctaggagattcgtgcgcatgatcaagaataaaaagttgatagcgtgcgctgtgggtaggtgtcgtcgtgtcgaaatcgtgatgcgaagctagtgtgggaacgtgctgatctcccactgtgttacaaagcaaattctaatttacatagcagttgcatctaatatacactatagttaaaatataagtacactatatttatattatagttatggtgacatttataagtacgctaaaaattattcgtcaggagttatataggtagtcccttatttttccctatcctcttcaattggaaagagagaacttttgaaaagacaaaattgccctcaggctcacttggtaggttgaagggcaatttcttcttttagaaaatctctcatttgaagaggatatgtcaaagcaatggccaaaatgtattttggcaaagagaagcaaaactgtaccatcatacggcaaaccgcaaaactatatcttagagtgaatgtcataattatagagttacctagagcaaattttgtcaggttataaaactctttaaagtgattgataacgtaacttactatttcctatagcgaaaaaatagatcaagttatttttttttgtctagatagagaaacaaaggtactcccaacaaatctaaacgtatgataacctagctgctaacgatgaaatccccataattcttgacaatcctgtttgtcgcggagaacatatcttaggaccaagacttctagttgtcgctaggatcggttgaaggtgaactttacaacgatatttgtttttgcgaatttatcacaaatcaagacggattccctgtttgtcaaagggaatccgttagggaagtctagatctgttgtagtgcgtgaatccaaatccaattgtactttttatggtctacctttttttttttttttgttattgatagaaacctaatctacgttgtcagcttttgtttttctcaactatttcgatcacattcaagaaacgttgccacatgcctctaagagttaagagaccgagatgtatcacaaaacaactatatggtggtagcaaaagacgatagtaaaaaaaaacttaaataaattggcaatatcattctcattcccccggtaaggtgatgtccagaaataggtctccaaccatgtgacatcaaaactagtttgaagaaatggtaacaagaattgccactcactaaacaatgagacagacagcaacactacaagtgatgccacataattaatctctttttcttaaataatgttcgtcatggacttcgttttggcataaatggtcaagaacattctcattaagtaaaggataaaatgttaaatgtgtaacaatccaatggttttaataattaatactccctccatctcataatacaaggcatagtcaaacttggcacagtcttcaaaactaatctttgacctataatctctcatatattatagagtttagcgcaacaaaattatactcttcttaaagtaaatttatatgtcaatccaatgatattaattttagcaaataaaaaaaaatttatattataataattatgggtcaaatgtttttaaagtaaattcttaaaatatgggcacatcttatattatggaataaagggagtattacacagggggatggatcacctctactacccattagcctattcaactcatgtccacgatatcactcgagcagctggtgtgccagccaccactagcaaacagagactcgagaagccggctcggtctaacaaggaattgtaacacaagcttgccgttgatttattggtaatattagttcttccacttgtattaattgtgccaaaatggcacttctttctgtgctccggccatagttttcgaccgtcggggtcagaaaagattgggctgaatcaacgatcgattgtttgatggtcatatgggactgaagaccgaaatgctgagctctagcttggagcaccaagtcaatggctctgtttaaagagctggaggtttaagaagcagctttagctagtgagaatctgaaagctactgcttcatttttctgaattctgtcggagtggttctagagtccttcctctcagaaggtcatatgtagtctttagctagcattgccgtttttggagatttctcgggagtgtagcgttagcgtggctctacccctttccgctgtttagagttgtgttagccgtcgtagtagtcttttccagcttgagcttttgttttgctttttctcccttcccttggcataggccggtctagctaattgcgttatgtaacaaattctttttcttctaatatattgatgtacaatccttttgcgcattcgtgattttttttcatgaattctgtaatttatgtgcctttgaatctacatcataatcaggattatttaggaagctgaagggaaaatcacctgaagacggagaggttcactactaggaagcaccccactttagttataggtgggcaaaaaaaacatctgcatgtgaaaagattgggatgttatttggttgagacccacatgaaaaaaatcgattttcgaatacgagcctgtcgaaacaagattttggcaataataaaagggggtggctatcaagttaggaaagtggatgggtttagagacaagggattttatacaggttcaggccttcttattcaagaagtaataccctactcctgtccggggatgattccgccgagtgtgttattgattgtatgattgggagaaaaaagaatcgtcccgagaggaacccggacccctccttatataggggaagggatccgtattacaaagtacagcccatatcctaacggaacatgggattacagatagaatacaatcgcaaccgactag

SEQ ID NO: 48633 - DNA, 3199 bp, Oryza sativa
ttagaatccaacccgaatcctcataaagatgttctatctatatttagtaccgtatatccgactaaagtataaccgtcatgcagatatggggtaaccataatctccacattagcccccgagaaccttcgcagttgaccaaaataatcttctcgaaacaaaaaacaataatccgagtgcttcaattcaacttgctccggcttgccgagtactaaaaaactgtgaagggcgaaaacatggtgcatcgagtagatgcacctaattaggtgtagccccccgactatgtgattagttgaaaaactaaacagatagtcaagaaccaagtggttttatagcgaagcacgcatggtacttagtaagatacccagccaactgcttctcaatctgaatatatcaaggacaaaaaatacgagaagggccgagtgataaacactcaaaaggtccaaaaatagatatatttggtaggaatccgagtaagaaactcttataatgatccaccaaatatgataaagatcatggtaattaagaagttcattagcctaggctataactcttaccataattaaaataagcatataacatgctaaaagaatgaccattaataaaccagtcatctcaaatgaacccaacagcttttgtagcctaaaaagcttacaaaaatggtataacacctttctgtcgggcaccttttcatgtgcatcataataattctaaagaattattgaatcacgttaaaaaggattttaacagcatcgggctgcgccattgtgagcacatattgccaaagcaaaaagcacctaagtccgtagggatcacaacgggccacgctgaaaacataattgggctgaaatactgtacaggcctaggcccattagtactcccgataccctaaaaataccgaagtccaaacgtcgcttcgtcttccccgccgagactctcgccattccccactccgtgctacagtacagaaccgcgccaacaaagctagggttcatcaatccgctccaatccatcctcaaaaacttcctgaaatttctccccgcatccaccgctccgattccccatccctttccagccgtatctcgaactaaatcaaatcatctagttcacattcatggcggaagaaagagaaagcttcgagagtcagtgggcgccctccgatgtgacagaagataatctgaaggagatggtggcgcacggcgttctcccgacaaaggagattatcgggtggcgaccggcgttcggcgaggcattcccgacccccgacacacacgaaatcgtggtatttgcgcatttcttctatggcggattttctcttccaacctcaaggttcttccgggggatcctaaacttctacgggattagcttgcatcatttgaacccaaactccatagtgcatattgccaattttatccatgcctgcgaagcttttctaggcattaggcctcatttcgccttgttccgccgcatcttcttcctcaagccccagccaaataagagcaaaccatacgtcgttgggggtgttggtttccaactcaggggaacactaagccaaaaatacttctccatgcccttcaagacctcaaataaaggctggcacgcaaactagttttatgttcagaatcctgagcccgcactccccgagtactgctgtcttcctccggtttaccaggatacatggaactcattgcctatgggagatgaagctgctcaagcagtagaactgatggagaggatgataaagctgaaagaacagggccttcaaggagaacagatcacccggcactttatcaagtgtcggttagctccaatcaaagaaagatctcgcacagccttcgaatttgacggcaagcatgacccaaaccgtgaagatccggattctcttgacttcaaggtcatgaaggaaaggatgtataacatcttctcaaacgccatcgttgtcagctactcacacttgctgccagtcgtaccgttcaacgcattcaatcctcctccaccggtgcgtattcatatacttcaaccttcctcaaaatatgatcttgtcttcctgttgaatcaattaacaatgaaagatattacacccaggaatttgctctgatgaagtcgaatccaccaatcgctccacgccgatctccccgccaccaaactgggcaagggagcggaggaccaagaattcggtctgaaactcaaccaagtgcttctgatccagtcggccagtcagattctcgaaagaggaagctggttctaagagacgacgaagccgacgataccaccaggaggcctgaagactgagagacgaccaagaaactaccaaaacaggctactccaaggaagaaaacatccagtcgccctgcgccaaagatcaggaagtcttccaggtgcaactcatgtaacgattcctcttgtattgatgcacacccattgcggcgataatactgataatcaaatttgcaggaaaccatctgatatagacccgtctgggaaagactctgacccgactaacatggacacaagctcttccaaagaaaccggaccaactgctgaggatcatccgagtgaaaatcagccggcaacctataatgtagaacccagcaacgagcccccgactgggaaccagtcagtcgaagctgaagtcggtgctaaccaggagcccccgactggaaaccagtcggatgcagggccaagccaaaagattcccgaggttgaagctcaaacgaacagtcctctcgggaaggatgctgacaatgaatcagaaaccagatctcctatgaaggcaccaagatccattcgtccccgaccgggaatcatcacagttagacatgccatctgaaatcattttgatccaacaaactttatttggctgcttcatcttcgttcatggatacactagggccaataattggtgatgaagaagagatcctccggatacaagcagctgaggattcacgccctccgattctggtcaagtggtgggatgacaacatgcagcctcaagggatcgtgataaataagcaaaaagaggacgaagagttatgcctactgaagaaggcacttggtcaggcaacccgcattgtaaatgtaagttctctggtacctgatctcaaccatcttgtttgccatttaattcatgcgctaattaaactgtcttgcagaggattcatcttaggaacgaagccaaaacagtaaccttagagaggttagt

SEQ ID NO: 48634 - DNA, 10708 bp, Oryza sativa
cattatcctccatatactgacttattaatgtgaacctgttgatgcagaccgcaagatcaaatctcaagctcaattcgacgtcctggttggcaagatcaaaaaacttgaaggagcccgggatgaggttgctaacgctgccgccccaatcgttcaagcgatgttcttcaataacaatggcccgagtgcacttgatgcttctaaaattttcgacaagctgagagttgctccggatacatatttcaagaacatcaaagaagctggaagtatgggagcaagtctggcgttggcgaagactaaatccctttatcctagagttgatattgacaccattgatggctttgcagacgggacgagcgaagaagctgctcttgacctcatcagtgatgcgcagaaagtggctgacaaaattgctgctgatgtagttgagagattccaagataccgatcttcgaccgactggtcctgataattctgatgatgaaaagactaatactgattaatgtaccgataattttgatgattaatgatgatggaggcccaatttgtacaatactgatgaatttatgttgtgcttgatatcttaacttagctcctgatttcataaaagtttttgtcaaaccttgttgagcctaaaacccgcaaaagttgttaaaaaactttcagtcctcattgactaagccaagaaatcaaacagggcaatgatacatcaagtaagcaaattgaattgatataaatcacactccattattattatagtagccccctgactgaaaacttcgaggaaaaaacttgaacttagcagtcaaagaggaaagatacaaacgaaatgcctaagcgtaaaatcgacgaaggtgttcaatattccaagaattgttgatgatagtaccatcttcgctcttgagtcgataagaacccggccgagtgacttcagcaattatgaacagtccttcccataagggagataatttatgccgatcctgtgttgtttgaattttcctcagaaccaggtcgccgactaaaaaggctcgcgatcgaacattccaattatgataacggcgcaacccttgcaaatatcgagtcgactgaattaaagctgcttctcgggcttcttctagtcggttgatgtcgtctactcggccctcttcatagccctcctcgttgaagttccgaaatcgtagtgattcaaattccacttcactcggcaacattgcttctgctccataaaccaaaaagaacggcgactggccagtagcccgactaggagtagtgcgtaaagaccaaagtacggacggcagctgatctacccacttgccagcatagggacgtagtcggtcaaaaactcgtgatttgatcccttgcagtatcatgccattagcgcgctcgacttgtccgttactcatacggtgtgccacggaggcgtaacaaattttaatgccgaagtcttcacaaaagtctttaaatgcttcgccagtgaattgagtgccattgtcagtgatgatccgattaggtaccccaaactgatgcacaatgttgatgaaaaaatatctagctttatctgctgtgatcgtgatgaccgatttagcctcaatccacttggagaatttgtcgatggccataaagagatgcgtgtaaccgccgactgcccttttaaagggaccgaccatgtcaagcccccagaccgcaaatggccaggacaacgggatggtttgcaactcttgggctggcaaatgagtttgtctggcaaaaaattgacaaccttcgcatgtccgcacaatcttgtcggcatcggacacagctgtaggccagaaaaaaccttgccggtaagccttgccgacaatggtccgtgcagcagcatgattaccacaaataccagaatgtatatctttcaacaactgtctcccttcttccaaagacacacagcgctgcagtattcctgatgggcttttcttgtacagctcagtctcatgaataatgtaaagtctgctgcgcctggaaatccgctcggcttcatttttgtcttgagggagttattgtttggtcaaaaattttatgagaggttctctccagtcggcttcaatcatgcctatgcctcgagtatccatggcttcatttgcttcttttctgggcatggttggttcataaagatgctcaacgaacacatcagaaggagctgcttcctgttttgaaccaaaattggccagtctgtcggctgcctcattgttatgtcggaggacatgggtgagctcgagtccatcgaatttattttccaacttgcgcacctcttgtcgataagcggtcatattatcatctagacatgaccactctttcatgacttgattaacaaccaactgtgagtctccacggacgattagtcggcgaatacctagagatattgcaatccttagtccatgaagtagcgcttcgtattccgccacgttatgggacacagaaaaatatatccacaatacgtagctcaatctttctccagtcggggagattaaaacaaccccagctccagtgcctgtaagcctcttcgacccatcaaaatacatagtccaatattccatcttctcctctggcatgtcttcttggcactcggtccactcggcaaggaaatcagctaaagcttgtgacttgatcgaagttcgtggtttgaaagatatgtccaaagacatcaattctaaggcccacttcgcaatccgtccgtttgcttcgcgattatgaagtatatccccgagtggaaacgatgtgaccaccgtgactgagtgactttgaaaatagtgagataatttcctgacggtaattaagacaccatataataacttttaaacctgaggataccttgtcttggagtcagctaaaacctcgctgataaaatagatcggtcgttggactttttgaatatggccttcctcttcacgctcgacaaccaggaccgtactcacaacctgggaggtcgccgacacatataacagtagcggctcttgcggatgtggcgaggccaaaactggtggagtggtgaggagtttcttgaagtcttcaaaggctttctgtgcttcgggtccccactggaaattgtcagtcttcttcagcagcttgaagaaaggcatcccccgctcgccgagtcgtgagacgaaccggctgagcgccgccatgcaaccagtcaacttttgcacgtctttttgggagcttggcggtttcatgttgaggatggcgttgattttctctgggttggcctgtatgcctctttgagataccataaatctgagcaacttccctgacggtactccaaagatgctcttttccgggtttagtttcatcttgaaagcacgaatgcttgtaaaagtttcttctaaatccgcaatcaggtcatccttccgcttggtcttgacgactacatcatcaacgtaggcttcaacattgcgaccaatctgagttgaaaaacatctttgaatcatgcgttgataggtcgctcctgcattcttcaatccaaagggcatggtgatgtagcagtaggccccaaagggcgtaataaacgaggtcttcaagcagtcggattcttttagtcggatctgatgatatcccgagtaacagtccaagaagctgagtaactcgcagccggccgttgaatcaaccacctggtcaatgcgaggtaacccaaaagggtctttgggacaagatttgttgaggtcggtataatcgacacacatgcgccattgccctgtctttttccgaaccaggactgggttagccagccagtcgggatgaaggacttccttaatgaagcctgctgctaacagcttggttaattcctccttgatcgcatccttcctgtcctgtgcaaaacggcggagtcgttgcttgatgggtttggcgtcttccttaacatgtaaagagtgctcaatcacctctctggggataccaggcatatcggatggtttccacgcgaaaatatctttattattctgaagaaaggtgatgagcgcgctttcctatttacaatctaactcagcgcctattacagcagtcttatcaggatccgagggatctaaaggaatctttttcatcttggcaccgcctttctttggtcttcgtcagcttggttgcaggcacttctccctcgcttgccgtggtcgcagccagtcggatctcttcgcgggcgagagtagtctcatgggtttgagccatctcgcaactttctttgtcacatgtgacggcttgcttgatgtcgctccgtagtgatatgacccctcgaggaccaggcatcttcatcatcatgtaggtgtagtgcgggacggccatgaacttggctaaagccggtcgtccgagtatagcatgatatgctgtctcaaaatcagcgacttcgaaacaaacattttctgtgcgaaaattctcccgagtgccgaaggtaactggaagagtgatctggccgagtggtgtagctgacaatcctgggataacaccgtggaagggtgcattactcagctttaattccgtgcgaggaatctgcatatcgtccagggtcttagcgaaaaggatattaagtgcgctgcccccatcgatgagagtccgtcggagcttgacattgcgaaccactgggtctagtaccagggggtaccgccccgggtggaccactcagtcaggatgatccgagcggtcgaacttaattgctgtctctgaccaccgaagatattggggcgtgttaggctgaaccgcattgatctcccgttctgttagcttctgttttctcttagactcataagccaggggtccgccgaagatgtgattaagttctttgcgatgatcttgaaaaccagtcggggcatcgtcttcatcatctttcttctttgatgtgccctgatctccgtctgcaggtttgcgtgcgttcttgacgtattgctccgcaaactgtttgtagacgaagcaatctttggccacgtggttagagttgggatgatgcggacattgggagttcattatcttgtcgaagatgttgacgcgggaatgttgtcgggaagatggagaggtggtcgccacaagttcttcgggcttacgcttgcaatccttgtggttgttacttccactccctcctacggtcggcgtgtctttctttggcttccaagtggtgcccgactgtttggacgcggtgatagcatcttcggctttggcatactcattggctttttcgaacatctgcttaaccatcctgggaggtttacgtccgaacttgccgactaggtcgtcgtggcgaatgcctttagtgaaggcggcgatgatgacatcgtcggtgatgtcggagatcttgttgcgttgttcggagaagcgtcggatgtaatctcggagggattctccagacttctgaacgacgttgtagagatcgaactgtgtgccggggcgttcaaaggtgccctggaagttggcgatgaagtgatcacgaagttccgcccatgatccgatcgtgccacagggtagtccgtggagccaagatcgggcggagtccgctagggccacaggtagatagtttgccatggctttgctgtctcctcctgctgcgcggattgcgagaccatatacggtgagccaagactcagggttggtggtgccgtcatacttctcgattccagtcggcttaaagccggctggccaatccactcgacgcaggtcattagtgaaggcagctactccgtccacgtcgtcgtcgtagcgatctggtgaatggcggtgacttcgtgctgcacggcgctggttgatcgtgtcgcgaaggtcgacgggacgtcggtgaggtggagagcgaggccgttcgactcggctctccctgtgacgttcgggaggcgagtgaacagatcgttcgtcgtgacccctgctcctgcgactagatcctgtgccgatgatgctgaggcttggctgatgataatcatgagatcggaagtgggggactcggctaccagtcggggtgcgggtgcttgtggagttggctggaaccgaggcagcgatcatggtcttcgtctggttcaagatgttgacaacatgatcggcttggttgagtgcgtcttccttgaggagggtgtcgaggagagtgattgctgcaaccgcgttctgctggggggtgcgaaagactgctgtcccatcgacgtcttgttgcccaatgagctctctcgctctccgcccagattccaaggcgtgttgtcgtcgatcttcagcctcctttgcaatccgttcgtgatcctgttgctcacgctgtagtcgttctcgctcttgtcgctgtcgctcttcctccagttggcgacgttcagcttcttgccgtgcgcgatcttggtccgcttttcgggcttggcgctgttcctccgtttcattgtcagccatgaatacgccgaagtagaggggcgtgtagttatcctcatagctatcgtcgaagttgtcgaggtcgccgtggtcgtagtggtagccgaaatcgtcgtagtcgaggatctcggttggtcgagaactgacgccgggggagctgaggtagccatccaactcttccgtcgagactgtcccgagaggttggagtataacgccaacctccctggatctggatcggatcggggccgaagccggagctcgcctagatcttcgagtggaagatgtcttgactgtgaagacaacggccaaatcatcaggaagtttcatcaggattgggggataggacccgtcgtcttgatctggtcgcggaagagtagattggatctcatccgagtggtttgaagctgactcgggagagatgatcttggagtaggcctcggccgagttcgggataccgaatggcacagggacctggtctctccccgactggtttaaatccgagtcaaggagagagatcttgccgaagtcgttggtgatgaagttgaggctgccgaactggaacgcatgcccgggagggaaggcgaagtcgtcgatgccagaaacgaaacccatcgcacttagtcggcgagaacttgacgctacccctacctagcgcgccaactgtcgaaacaagatttcggcaataataaaagggggtggctatcaagttaggaaagtggatgggtttagagacaagggattttatacaagttcaggccttcttattcaaaaagtaataccctactcctgtccggggatgattccgccgagtgtattattgattgtatgattgggagaaaaaagaatcgtcccgagaggaacccggacccctccttatataggggaagggatccgtattacaaagtacagcccatatcctaacggaacatgggattacagatagaatacaatcgtaaccgactaggatcccgggtattttcttgagatacaagtttagaatccaacccgaatcctcataaagatgttctatctatatttagtgccgtatatccgactaaagtataaccgtcatgcagatatggggtaaccataatctccacagagccacttaaaagaattgtatgcaaaaacaactttccagccaaccctcttctttataaccatccccccaccgtgatccactatcctctccttctctctccctctctcacttagcttttctccacctctacttctccccctctagatccactggcgaagttaggcctcggcggggcgccgcgacgggagccagcagtggggcgatgggcttgcgaaggcggtgatgagcttttggcagtggcaatggtaggtgcgggctgggagctcaggaaccggcagatccagcactcgggaactcagcggaggcagatccagcactcggaacctcggcagcgatgacaacaacaacgaatctggcgctagccttgggagctgcagggacatctagcggcgatgacgacggcagaggcagatccggcgctcaggacctcagtggtgatgacaaggacagtggatccggcgctcaggagctcgtcaacggcagcgtcaggctcagaagttgcggggctttggtggcgacggcaatggcgccggtagcgaagatcacgtatgtatgtggaattctttcatcctacatggcactacaataaaagaataaaaacttaacgggacctgcatgtcgttgagttgaaaaattttaaaaacaaaagacctagtggacccaataggcccttgacataggggtctcgagcgacgccatgtattgttgtttccccatatcagcatcaccaatgtcgtccactgcggcgagctcgagacggccagtactcgagccgacgtgggcaaattcgagacgacctcctcacagcgaagatggagacgacaggctggtacgatctcgtcggagagctgcactgctgcctagctcctcctccgtgagctccgccaacgatccgtcgtcccaaccttaccacattagctccgccaacaggaagaagcctagtacaaaaaaccggtcagccaccggttcaaccggaaaaaaagggaaccaccgtgagctccgccaacgatccgtcgtcccaaccttaccacattagctccgccaacaggaagaagcctagtacaaaaaaccggtcagccaccggttcaaccggaaaaaaagggaaccagtgcatgccacggttcggtttgcagaaaagaccggcagggaaaaatataaatttctagtatgagcagaaggggagtcgaaccccagaccacatgcttgaggcgctacaagccttgtactttcccacctaaccaactgggcaagagatatgtgctattcagaatggaatacctattttatttaacagtttaaagtcaattatgacttaaaatatagttagccatgaaccggcggtccgaccggtgaaccggtgaatagatgagctcactgggtcattctccggtccggctttttccactatgggaagaaggcggcaacgctcaccgtaggtctccccaattcatcttccccttcccccattccttcgcatcgtcgtcctcccatgccagatcaaacgggcctccaagtttcatggctccgacacaaaatagacttgtcccacccccaatgggggcccaacatactcccccgctcttccaaaaactctggcccaaggcccattttaggacttgagtttagcccaataaaaaatgttctcccgacgttgcacggcccaactagccatgctcggtttaagctttttcttctttccgcaaccgaagcgtcttctaccgcgccgccgccgccaccatactcgagtcgtcggccgcgcgccgaccgagatctccggtgaagagcagttccggtcggcaaagtatactgtagctcctccacgcctcccgcccccgcaggtgttcttgctgctagctaggtctggaagggaactatcctaatcccaaaatggcgggaccttgtcaggcacttcgcgccggcggcgagggctgattctctgatggtgctgcacagcgcggcggtggacgctaggctgcgacagtgcatcgccgccgacttgtcctactggaggttcctcttccaataggtgactaggtgagggttacctcataacctcaacttaatgtgagaaatgctagtggttgattggtcacaatggtacattggtactgctgtttttttttattttgtcttgtataatgtgaatttcttttgtttttttattgagataatttagatgtgataaatgcccaatttggtgtccaacactaactttcctctaaggttgggtatgttcgtatttactccctccgtattttaatgtatgacgccattgacttttttacgaaagtttgaccattcgtattattcaaaattttttgtgcaaatacaaaaatatttacgttatgtttaaagaatatttgatgataaatcaactcacaataaaataaatgataattacataaattttcttaataagacgaatggtcaaacgttgattaaaaagtcaatggtgtcatacataaaaatacggagggagtattagtttagcctcttaacgtcttccgatcgatgtccccttaacaaaagaatgtaagggcttcaacctcattttaggtcagcacaatcctgcatcaatgttgaatagctaacttggacattcaaaagaggctatgcatggacttttatggatgaaaaattgctgtaactattgtagtggtttttaattccgaatgcgtaaatcactggaactgtttctctttgtcaaaattcgttctcattactattctgtcaatcatcttggtaggtttgaccaagcgcgtctgatcatggctaaggacataatgtgaaagagaatgggtcacttgctactgtgccatgatataatgtttccagatcttccctttcttctggaaggagtagtgtccaatgggttgttctatcagattctgttgagaattttgcagcagcaaacccattactgagtctatcagaaccactcttttgtttccaaatttgtcttgatcgatccgtgaggtagcagagttgtcaatcctaggtgatatgtttatttcatgaatgtctaatttaatgaatcttttttttttcgggccgacaaagagtgctgcccgaatttttcttaagatttgggggagaacaaccttttggttgaaaagctgaaaaacagggcaaaacaaccagctgaaaagctacagatcatagtgagtgaactattatgctgttactattttttagtgttaacaattttgcttggatgttcttgattccaccaccgaagtatccaacataaatatccacgatttga

SEQ ID NO: 48635 - DNA, 4056 bp, Oryza sativa
gtcgattaatttgacatcaccaaaggaagttgagactgaagttacagacggacagttactgacctcattggccatgtcaggaaggtgccattgccatggaggtggatgtcgaggctgcggttggggacgagttcgtagacgagtaggagctcgtcgcggccatggcaccaccctatgagctgcaccagattgcggtgacgcaaccggcttatcaccttgatctccgacctatactctttcttcccttgcttggaggaatccttagcaaacctcttaatggcgacggctaggccctgctctctcaggtatcccctgtacacggcgccgaagccaccttgcccaagcttctcctccgccgcaaagctcttcgtcgcctcgacgagctcgtggtatgggatttgccttggccccatgcccatctcgatctccacgatgggctcgccgtcatcgtcatcgtcgtcatctccggccaaccctacgtgtctcgcctcctctgcctcttctgcctcccttctcttcttgctccgacgtcgccgcacgaggacaactatcatggcgaagaggagcacgacgaacagtgctccaccagcggtggctccggctataactccggcaagtccgggaccagaggtggtcggggaaggctgcgccgccggtggtggattctgctggaacgaggagttgaagtaccaagaatgcagctgatggagctcaagggatgagcccgtcgccgccgagaagccgacggagaccttctccggcaaggcggtcttgagatcgacggtggtgctaaggttgtaaagtgtagtcgagccattcgtccatgtcttcaccagctggaccgacaggatgctcgagctgctgttgtagtcgacaatggcggccatgttcccggtgaggctgaagctgggcagcgactcggtctgcaccgatacgatggagttgacgtcgacgccaatgtggtggtaggtggcgctgggatcgaacaagttgttgaaggtgtcgaactcgacggcgacgaaccggttgtcgccggacatgacggcgtcgaaggtccggctggtgaggccgagggcgccgccgtccgccgtgtccggcatcctcgaagggtagccgacgaggaagaaggccatcccgttgcccttgttgtccaagtttgtcggggtgatgttgaaggagaagcgcgtgtgaagctgccgaccttgccggtggcggcttcccagaagctgccccggcggggagtacccacgcgtcccatggtgccgccgctcggcaggttgctgccggtggtgatctcgatccacccatcgccggcgatcgccgcgctgccctggagggtgatgttcttggtcccgttgctgaaggtggagtagctgaacgacacggcagtagcgaggctaggcaagaatcccaagaacagcaggcaggctatggcagaagcagaagcagcagccatggacgatcttgtcacgagctcaccagcggccatcgccggcggccgaatcagccggagaacacagctactacaagtctacacctactacttgtagcaaacaaaacttgcagttctctgcaattccacgcacattcaggtcaagaaccagaggctaattaatctgaaacagcgaccggtctacactgactgacgcggtcaggtttagaaaagaaatcgaaaattacgcggaattaaattgctcccaggcttggcgtgatggaaagagtctctctgctatctaatacgagtattaatctgcatgtttgttcatctacggactacggagtagaactgatgagcgatatgctgacctccgcctttgaccttttctcgtgtttctgctcatcctctggtcttctggagactttctcgtgtttatgcaaaaatacgtcggcagatagtggtggcaggtgttgaaaagacaagggtgaacatctgaagaagatagtttcctcaaaaaaaaaaaaaaaaaaaaaacatctgaagaagataccgaggttcttctgctgggcgtgtttcactttcgcgatttttaaaaatactgtacttataatattccaggtgattagtgtgatttaaacaggcccggccaacttatttaaaggccatatgtaatattactccataataaggaaaagtctctgaatgttgctactccagtaataaatagcgtttcacttcttgttgcaccggttggaacgttagatcaagaaattgaggaccaaccatcgagtaatcacacctcacttgctgtttcttgtgcactatttgtctgtttccctctctgtctgtctcagcaatttagaccacctgcatctgatctgatgcggtgttgatcagcagaaccaactgtgctcgagatgagatagatgcagatttcacagataaggaaaaagtccaatttaactctcttaaatattggtcggacttaatttatatcattcaaccacacaaaagaagagcgggaacaaataggtcattacgaataaatatatagaagatgattttatatttttaatataatttctttttatgttggtgtttaagtcattacgaataaatatgtaaaagttttacctattaatttgtatttctcaataaaccgttttgaattattagaaaatactccctccatttctaaatgcttgacactattggctttttagcacatgtttgaccgttcgtcttattaaaaaaatttgtgaaatatgtaaaactatatgtatacatgaaagtatatttaacaataaatcaaatgatagaaaaataagtaataattacttaattttttttaaataagataaatggtcaaacatatttaaaaaaatcaacagcgttaaatatttagaaacggaggtagtacgagaacccaatgagtcccgaactttttactgcattttgggcaacagcaatgtttatgaccgagttaggcagtaacgtgggcccgtacgtcaggcggtagtagcagcatatgaactccacattgtatgtgcaggacggtagggtataacatggggcccactataaaaactcaccaatcatcagctgccatgactccaactgcgagaaaacaattcgttgatactcattgacactgtacaaataacataacttattctttgttgcccggtagtagctatatgatctaatagtaactatttactacttccacgatgtatcttacccagtagtaaagatattttaatgtctaatacccacttttaatccacattatggatgcccttgccgctggccaccaatggcgcttagctcctcaattaagctatcactaatcactagcactagcagtagcagatgaaatcacgaaacgcgtccatgatcacacgaggggcgtgtactgctactgcttcaagaccaccgggacctgcccttttaactctattcaactggaggtgcatttcatttcctctgtcactagctgccatcgatcttggcagaacggaattgaacatgctgcctgccggccgtaactcgtgtacacaacagggaatcttaaaatgtagatatctgctcctatccaataaaaattatctagaggtacaggtacttcacggtatcaaatcatttttgatctttttaatttaacaatgctcatcctatccagttagattcaataatcggaaacgatttagtaccgtgaggtaccggtaactcgagatactttttactgtatcggagcaaatctataaaatgtaaggattgatgcatcgatcatgtatggatgcttttttattcttccaatgcagaagctttgcacgtcaatagaagctaggtcatctgcaacactcttagaagctaggtcatcgaaaggatacgtgggatacagagagataaaaaggctgtcacagacaacagaaacttgtagaggatatgcatgctaaattaagcacagactaattaatttatgtgcgttgctgggcccctggggccctttgtacgcgctgcaaggtatccccttttcaacctgaacatgtacatgcactactgctgttactttggaagcatgccaaataaaaataagccagtatgccaaccaccgg

SEQ ID NO: 48636 - DNA, 6686 bp, Oryza sativa
ggaggaggagcaggcgaggtggtggggaggcgatcatggcgatcaagaggaagatgctgcagtgcagcagcgccaaggaacagcacggcgggaagaggttcaagcggagctacttggccggcggcgagcagggcgacgccgccgccgccgccatcttctacctcgcctgcctcgccgcctgtactgatgctttctcacctagctgcctctagcttagattagatagaccgaatttagtcttctccatcttcatctgagaaaccaccatggtcttccggctagctctaagactacgagatagtggattagccgaccttagtttgacgcctcactcctaattatttctttttcatctgttctctctgggcctttctgatcgcttattcacgatcttgggccgcttggccagagaaagatctgttgggccggaagatctgttgggccagcatttattgtagttgaaataagtctactatacctccctcatctcttgctcttgattcgtagcaaattgactcctccggaaacggttgttactaacgtgtcaagttggccgccgctgtcgctgagtcagcacctgcgacgccctgtatcgttccatgacagcgtcaatctcaagcaaactcaacagcagttaggaaacccacaaactacaagagagtcgaattcttagggaaactattttaatccctcgaaaagatatccccttgttatttacatgtcatttaaatgattataaaaaaatttaaaaaaattgggaatgtctattaacatgtgatataacacttcacaaacatgcaagttcaagttcaacttctacaaatcgtaataaaaaaacaaattaaaccgcggctagttaatgtatactcagagtcaaatttgttttttcgttgcgagatgtcgaagttgaatttttacttgcatgtttgtggagtgatatatcacatgttaatacatcttcttaattttttttaatttttttcataactatttgagtgacatgcaaacaacgaggggatatcctcttgagggatcaaaatccacttccgaattctaagcttcctggccgcgtcgcgtcggttgtacgcacagtttgtaaacttaccgtatatacagaagcaaatgtcaggtatatttggttaattggtttattaccaaaacacaaatcacaccaaattgatgaaatttcatcaaattttgatacctcacgattcgaacttaccgaaaccatcaccaaattgcatgtcggtttagggtcttttgcaacgtactgaccaccaaactcgcctataaatgcgagatcaaacaaagttcgtcgagttcgagatatttgagaagagacacagagagccatcgcgcattgcatcttgcaagattgaagacgatcgagacgccgccgaagctttgctccgtcccccatggcgacgacgagggttcggtgcagcgcctgcctccacgagtttgacctctgcgtcgccggcgccggcgccaacgtctgctcgacgtgcaaaaggccatggaccaacccgccgcccgcggcgtcgtcggcgtcgagcaccttgtccttcgcgacgttctcatccgtgaacccgccgcccgcggcgtcgagcccctcgcccttcgcgacgtcctcatccgtgaacccgccgcccgcggcgtcgtcggcgtcgagcaccttgtccttcgcgacgttctcatccgtgaacccgccgcccgcggcgtcgagcccctcgcccttcgcgacgtcctcatccgtgaacccgccgcccgcggcgtcgtcggcgtcgagcaccttgcccttcgcgacgtcctcatccgtgaacgcgccgccacagcccgcccatggaacgaccacgagcggcttgtttggacgatctgggccaccgccgccgtggagctcgtcggcgacgagcttgccaaggaggccactgacttcgtgctggccgccggcgccatcaccagtaccagtccagacgccgccggtggcctatccagcacagccatcggtttttgcgacgcccttcaggagggtcacggaggagggccacgcgtacgacgacaacgagccggtggagtcgccggcgtcgaggggggggggcgaaccaggtggcggcgaggccgcggcaaacgatggggagctcgtcgtcatcaagacgcactgcgagttcccggccatcgcgcggagcacgccaagggacaacttcgccgttctcctccacgtcaaggctcctagcatcgccgcggaggcggcgccggcgcgcgcgtcggtcgacctcgtcacggtgctcgacgtgagcggcagcatggaaggctacaagctcgcgctactgaagcgcgccatggggttgctcggccccggcgaccgccttgccgtcgtgtccttctcctacagtgcgcggcgagtgatccggctgacgcggatgtcggagggcggcaaggcgtcggccaagagcgccgtggagtccctccatgcggacggctgcacgaacatcctcgagggccttgtcgaagccgccaaggtgttcgacggccgccgctaccggaacgccgtcgccagcgtcatccttctctccgacggtcaagacaattacaatgtcaacggcgggtggggcgcctcgaactcgaagaactacagtgttctcgtgccgccttccttcaagcgctccggcgaccggcgcctcccggtccacacgttcggcttcggcaccgaccacgacgcgtcggcgatgcacaccatcgcggaggagaccggcggcacgttctccttcatcgagaaccagccgtcgtccaggacgcgttcgcgcagtgcatcggcggcctcctctcggtccccgtgcaggaggcgcgcatcgccatcacctgcccgcacgccgccgtgcgcgtcaggtctgtcaactccggccgctacgacagcgtcattgacggggacggccgggccgcgtcggtggacgtcggcgagctctacgccgacgaggagaggcgtttcttggtgttcgtggacgtgccagcagccggcgccggggaagacgtcacagaactgatcaaggtgagctgcacataccgcgacaccgcgagtcggcagcagatggtcgtcgccggcgagcacgccgtagtgcaaagaccagtggaggtggccaccaacacggagccgtccattgaggtggagcgcgagcgtttccgcgtggaggcaaccgaagacatcgcggcggcgcaggaagcagccgagcgcggcgcgtacgcggcagcgaaggcgatactcgaccggcggcaggaggcgctcgcccggtcggcgcggcggctcgcctgcgacgccaggtgcgcggcgctggtgtcggagctgcgcgagctgagcgcccgcgtggcgaacaggcgggagtgcgagcaggccgggcgcgcgtgcatgctcgccggcatgagctcgcacgctcagcagcgcgccacgtcggtgcagctgttctcgccggcgtcggcgctttcctccggcgccgtgccatttggttactcgacgccggcgatgcagagcatggtggagtcgtcgcggaaggcacgagagagcggcagcgggggcaactgaagctgaagaagaagacaacaccgaaggcgtcgaagcttttaggttaagtttaggttgtttttggtttggatttgtcaatcttaagtttgaaattttaaattgtctttgtctagagcttttggtcaagtacgtttgagtctgaattaacatgtgtttcatttcatacgtttgttcaattaaaggtatgcgttccccggctcaggctgtctcattttatttgggcgcaattttcatgtctttttttaaataatggaatagaatatcttgtcctttgctcaacaagctacagtcaattattacagtataacacaaaaaagataaagttcacaaaaaaaacactaaccatgaagaaaaagcaaactaaagactaccaaccaaagataatgagtacacaattattgaattctgtttgtgaatctccattcaaaattggtaaactgttgcataattgttatctcaagattacgacatgcaacttttaatcactcgccctcttcatcacacttttgtagcagtgcccaagacctgaacaaatatgtcgccgagaaaattacctacacatatgaaacagatggtgatttgtcaaaaaccatgtcattcctactcaaccatagaatccaatatataatagaagctcctatgagaataaatttcctatttttcttgtccacccccagaagccaatcatcaaaaatatgagatatgctattaggagggtaaagaccaaaagaaaaccgaactgctctccaaataaactttgcaaaatagcattccataaaaaagatattgaatagtttcatttttcatacagaaacaacatctcaaactaccattccagttcctccttaccaaattatatttagttaacagtacccctttaagcaagtaccacattgtttattaaagctgaatacattgactgaacagaaaattatacattttgatgatagttccatctaaaacatgcaattttcatgtctgtgcatgtcttatacttcatctcaaaataaaacaattaaatttgcccagattcaagtgcaaacggatcggcccatttgcacactcctcatatttcatcacccagggccgtacctaggaatttgaggtccattacgaaacacaatttgaggcccagaaaaatgagaaagaataaagaataaatcagcggtggagctctacctaagtcggaaggagattttttttaaaaaaaatgttactaaaatgttatgtcatgatttagtgatttattttttattaggcgaaaaactaaaatatttaatgtctagaacacacgctcaaatcatcgtcatgagctatagccctttgagttggccatgattaccatcgaacacttattggagctgaagaaatcaagctaaatcataaaataagtaagagtgaaacttttaaaaaatgaaataagatgtcattaaatatatcaatatatagattaaaatataacaaattgaaactcctaacttttagggtccctgatcggttgctcaaagatggcaatgccgtcaactcactagctgcctggagtatgcatgcattctactccttggcattagccatcattactttacctccttctccgaacaacatatttttcaaactttaaaccaaattttctcctaaattatctaactacattgttgtattaattgcaattgaatctttacaacaatatcccttatcattatattatttataataataaaaatacataaaacattaagttataaaaactaaaatatcacaaaatacttgatataatatctaaagaacaatattaaacatttacaaatgagcaagtgaaacattaaaaaaggacttattgaaacatccaaattacaaagcgtgcaacactaaaaaaaatgtgttgcaacacaatttagtttcacttaaaacatttgttttttacatgtgaaacatctaaattcaaccgttaaaacacataattattttctctagaatataatcatgcgagaatttaattataacaaattttctccactatacatggtcttattattactttataccatatccaaagttgcgcaaaacgatggacaaacgcaagacatagtagacaaaccaaatttcgaagcatttcaccatgcggtagtaaaatgcatgagtaaattcaactgaaatacttactccatctacttttgataatcatatttccaaatctgaaaattttatttttaatagacatatttcaatacaacaatctatcatcttaatgactttttcggatttaatgcatgactctccattcttccacacatgattggctacataggcattaagaaatgtaaatattaatgaatcgcttgtttacaaggaatgactagtagcatgtttaaatggatgataagtagaattacttatccttgatctatgtgacaagatgaaatatgactatcagaagtagatggaaggagtattacaggttctccttctcgtcatctgagctgccggcttcttcctcagttcggaccagatccaaaaagcttaagcttccgtcgccgccctttcttctctttcgcgacgactccaccatgctccgcatcgccggcgtcgcgaaccctccaaaccccccgaaagagagagatggcggcgccgccgatccacacatcggcattgaccacgtcggcgccgccgctccaaacagctgcaccgacgtggcgcgctgctgtgcgtgcgagctcatgccggcgagcatgcacgcgcgcccggtctgctcgtactcccgcctgctcgccacgcgggcgctcagctcgcgcagctccgacagcagcgccgcgcacctggcgtcgccggcgagacccggcgccgaccgggcgagcgcctcctgccggcggtcgagtatcgccttcgccgccgcgtgcgcgccgcgctcggctgcttcttgcgccgccgcgatgtcttcggttgcctccacgcggaaacgctcgcgctccacctcaatggacggctccgtgttggtggccacctccactggtctttgcactacggcgtgctcgccggcgacgaccatctgctgccgactcgcggtgtcgcggtatgtgcagctcaccttgatcagttctgtgacgtgttcccc

SEQ ID NO: 48637 - DNA, 11707 bp, Oryza sativa
  unsure (1)..(11707): unsure at all n locations
cgctcctcgccacggccgtgtgctcgcagtgcgtcctgacgacgagcgccccattgctcgccggtgccacgccgccaccgtgtgccgctaccggcggctccaccggctcgtcgtcgtcatactcttggctcacccagaagggcgaaaaggtcggcggcggcgcgggaacgccggcgggaaagaaggtggacggcggcgccggcgaagggtttggcacggccaccgtgtcgcgccaccgcgcgttgcacgccgggcagatgacgctcccggagaagcagcggaggtggaacgtgtggctgcactcggacgtgacggtgggctggctgtggtctatgacgccgcggcatttgtcgcacgacgaccatggccggacgcgcatgggaaagcccgtcgtctgtccaaacggcgtcgtgctgcctccggcgggttgcggcggcgggttcgatggcgcgttggtccatcgcgcgttgcacgccgggcagacgtcggcgccggagacgacgcagtggaggtggaacctgtgcgagcactccgccgtcaagggaggctcccagaggccgaagtcgccgtggcagccgtcgcagcggcctcccgccgatgccatggtatcgtggatcggacggacggtggcgtcttggcttggatagttggatcttgcagaatgcaatgggaaattgggaatggctggtctgtgcgtctgctgctcgtttgatctgtatttataggcaagtttgtcggtttgtccacataataattactactccctccgtttaagattataagacgttttaactttggttaaaatcaaactaacctaagtttaattaattttgtaaaaaaaatattaaaatatataataaaaatttattcaattatagatttaatgaaagtgttgtaaatattaatattttttaagggtaagctaaacttagaatagtttgactttaaccaaagtcaaaacgtcttacaaccttaaacgaagggagttgtactgaattttgtactatcaaaattttctattagctgtaacacacaaatttacacaggcatcattatgatgtgtggcctcgtactcttaagatcacatggaacaggaattataattggcgcacacacgtcaggaagaaaagtcgcgtgcggtttcttacagagtgacgacaaagcttgggggtacgaggggcggggtgagggttaaggtttcggggtaggggtgggggaggtcggtgctaggagggggaagtgggggattgggtttagagggatagcctgggaggcggcgaacccgacggtgggtggtgggcaagggcgggtggcggcagtaccgccataccacggggtcggcggtgagcggtgatggtggcggaggcaaagcaaggtgaggggaaggaggccggccaggcaaggccgcagcaatgtggccagggcagcgtcacggcgaggggagaggatggagaatatgtgcaggggcaatttggtccgatcacgtcaaaatgtgggccccctcaagcctagtcagcgcaaatatactaaacaaatagacgcggtgtcctctggcaaatagccatgttttgggagtgtcttcccccaaaactcacttcgtgcagtgtcctggagctaattccacaaagtcgcgatgtcctgtagcaaaatttgcctttcaaataattagaatgggtgagcttcgaacccaagccatctaggccaccattttgtgaagctagccggaataccactagacgtttctcgcaactctcaaaatcaaacaatcatttcacattcttttacctacatgcataatactacatccgtcccaaaatataagtattttttagactccgatacggtctctgagatactactttgaccaacaataactataaaagtaaaatgttttaaataaaaggagttgcatattatgatagtttgtttaatgataaattttgtaacatcaattttacgttattgatctttttttatttttttgctattaatagttaaagttaaaaatgtttgactttttactattctaaaaatgcttatatatttttgggacggagggaatagctagtaatgtgtccagatattttgacgtagggagtaaaataactatagaccgaactttgataagatttatgctaacaataaaccaaatttatatgcccctaacattcttgtcaagttgaaaactgtgcgttcaaccggcgcgacgcggctaaggacatgtaggaatttgacatttcgactctatgtttcctaactgctaatttggcttctgtatattttactacattttggaacccaatagtactactagctactgtagttcgttgcgttggcttgagcttaacgctaatcatggaacgatggaagtcagttaggagaacatcgtattattattggacaaaagacgcgtagcgtacgcctatctacctgtaccggaaacggaaattgatttttttttcttaaacaagacatctgcatagaagcacgatgcgtagaccgaagatgtctacggactacagtacccatttttgctccgtgaccgttgaagaagacgcctaggcaacatattttttataagtccattctactttttgtagactttttccagacgtttaacgctgtgctccatcaggggaaatcggactccgaagtcaagactttcaattggtgatttccaactaaaaatcagagattggaagtttggctgagtttagttccaaacttttttttcaaacttctaatttttccatcacatcaaaactttactacacatacaacttctaatttttccgttatatcgttctaatttcaaccaaaatttcaattttggcgcgaactaaacacacaacacaacctgaaaatatatgaaactttcgtcttaacatgaaaatttcaaatcgaagtctgaaaactttcatcccgagtccaaaactttcatcttcggattagaaaactttcaaataaaaaatcagagaacttttatctcgaatcaagctttcatcttaaaaccacaaaaacattcatcttaaagccagaaaacattcaaatcaaagtatgcaaactttcatcttaaaagcatgaaaacttccaactaaaagatttgaaattttcacctcaaaaatcataaaaactttcaagtcaaatatgaaattccatctcaaaagtattatatggtattgatagttggggctcatgtaccctgccatgttgttggagtgtatcttggcgtacacaagaattttgaggaaggtggaatagacttattacttttttcgggctttcggctggcgatcaaatttgggcacgtgagtctgcgaattttggagaaagcatgtttgggccgtaactatctaattttcgagggataagttcactggaggtccctcaacttaacaacgagatttttttttttgacccttaaccacaaaccagaaatgtgtacccctaaactcacacaaaccgtgcactcaaggtcctatggcagtatatgtgagtggtttcgctgacgtggcatcctagccagccaaaaaaaaattaaaaatggtatgtggggcccacatgtcagctgcacattcacgagcaggcgggcagatgcgggtgcggcgctcggcagcggagcaggctcggcagcgcgtggggaacaagcgggagagggggagaggaggtgggcgcgggcgcggctagtgggcggcgtggagcgagcacgccggcggcggccggagagggggagagaggcggcaggagcggcgggcaagagcgacaggtggaggagcggtgggcggagggcagcaggcgagtgcggtggagcggagggcctggccggtgagcgtgagcagcctggcgccacactcgcccgctttcgttgttgtcggccatcgattcctctctccctctttcctcgtcgtcgtcctcagcgcaccaagctatggcgagggcgggtcatgcgcaggctgggcaagctcagatgggctcgccagccgcctccccctccctcccaaactgttccgcccggcagccaccgatcgtgacgacgatgaggaagatgatgatgaggaccccgtcctggtcggcatcgtccgccacatcccgtgcgcgttcgacagcgccaaccgcctcctatcctcctctcccgccgctgccgtcgcgctgtcngacctcctcctctcccaccgcagccgtcgcaccggccgcctcctctccttttccccgccgccatcgttgcgccagccggctctctcccccttctaccaccgcccccgcaccaccgtcggccacctttctcccctctgctgccgtgtccactcgagagaatcgggagagaagagaagagaagagaaaaaaaaagaaatgagaaatatggggcccacaccattttctctcatttacatgtaggccccacatatttattttattttttttctgattaggatgccacatcagctaaagcgggcggctatactacctcgggatctatttttttatggttttacatagtttaggggtacatatttctgattttgtgattaaggaatttcaaaaagtctcggtgttaagttgggggacctccggtgaacttattctaaatttccaattttcgaaacaggatggtgccgatatcgtctgctctgtggccttttgggctccatggtctgcaatccctgccctatcttatctttgttttccaaggaaaattgctgtgcgatgtattcaagttaacccgtgtacaatcgaagcgaagcaacagcaatcttgtggtcaatcaacttctcaagcctcgcctcttttttaagaaaaaaaaggaaatctttaagcttttcagtactagtaatcgcgagtggttagttcagatttggtatcgtgtgagatcaactcttgtcataaagttaaaaaaaaatacttagtataggacttgttgaatttattaccaattttaacataactaaatttttgtattaccaaattttaataggttaaaagtccaaatacattgttatcattgcaaccatacaaaaatttacaaaatccggaatttttcacttttaaaaaactctaccaataagtacttggtaagactttaaacttaatgcatcaaatactaccgaatttgataacaccaaaacatatcatattttggtaacaccatatattgatagggttaaaaatgatattccctccatctacttttgatagtcatattttcaaatttgaaaattttatttttgatagtcatatttccaaatctgaaaattttatttttgatagtcatatttcaatccaacaacctatcttcttaatggctttctcggatttaatgcgtgactctccattcttccccacaagattgccatggacatcgagaaatgtaatattaatgaatagcttgtttacgagaaataactagtagcatgtttaaatggataataagtagaattacttatacttttctgtgtgccaagatgaaatataatgatcaaaagtagatggagggagtaataagttaaaaaaaaacccatattatcacatctcctcgacggctcgacttgttttcttcttcctatgcctccagaacaaactactctccagattctagagttcttacttcttctaaaagaaaagtttgacaaagaaaatgaaacaataaaacatggaacgaagaggagtcgacggcgaccgcccagccaacgccggccgccgccgcgagcggtcgccggtttttgcgagacctgacaggcggtgacgtggacgttttccaaaccccccgggtacacagatgacgaccagcttaagagcaggtacaatactaggctataagccagcggtaaacatattttaagaagataaataaagagagataagaacagcgggctacagatttatagccagctgtagcacgaatttcaagacgcagtgtatatggcaggtgggaccatatattaatagtgtagtatgtaactattgtataaataagctattaaattgactataaattaattaaagctagtagtcagctatactattgaacttgctctatgaataagctggcagaagaatctggaagctagtgggtttgtgtggctggggtatattcgctcccgtggcattcccgatattatcgccgccgctgcgtggtgggcccccggcggcgccacgggatgctcgtagctgcgagatctgcggatcatccgtggtcaccattcctgttgtctctctctctctcttttttttcacgtggatggacgattgggaattgggattggtattgcaaccgggtgtttttttttcacctttgctgtgtttagttcagcacaaagtttagattttggataaaattggagatgatgtgactgaaaagttgtgtgtgtatgacatattgatgtgatggaaaaatactgaagtttggatccaaactttggatctaaacacagcccttgtcttgttgccaccggaagtccggaatgttggcaataacacatgaggcccttccggaatgttggcaataacacatgagacctcgtcgtttggcatattcatatgcttatcagccaaaatttgaattttcaacgttaaatttggagctgattttggggttttttcatcgaagtttattttcagcctttgcttttagatcgctaagaacacatatataaaagttttattcacaaaatgattttcgtttgcaaatatgcatttggcatatttaaaaaaatatgccaaacgatgaggctgatgataaacaatctacttgcattgtaagaatgtttgtaaccttttttcgttatactccctctgtccctaaatatttgacgtcgttgacatttttaaacatatttaaccgttcgtcttatttaaaattttttgtgaaatatgtaaaacaaatatatttaacaatgaatcaaatgatagaaaaataattaataattatttaaattttttgaataagacgaacagttaaacatgtttaaaaaaatcaacgacgttaaatatttagagaaggagggagtatttaaaaagtttacagactattttgacaaccgatgtagatgaatacttcctcggtttaggaattgggattttatttataagttatacaaagtaaatataaaatggacggtgcatattgattgaggtagaatattagtactactgtttcttctttttggaatatactgcaaaacaacactaatgtaatgttcggacaaaacttaaacgtcattatgaatattattagctcttaataatcggcaatagccaataggtcagagacaaacacccatcagaggatccggattcgatcaggtgagtgccggacaaacagtatgcggcgccatcgcccgtcgccgccgccggctactttctgttagagcacgggcctgtttagttcaagaaaaaaaaattatttttgaatgtcacattggacgtttaactagatatcgaaatagatttttggacacgaataaaaaaactaatttcataactcgtctggaaacagcgagacgaatcatttgagcctaattaatccgtcgttagtatacgtaggttaatgtagcacttatggctaatcatgaactaattagactcaaaagattcgtctcgtgatttcctccctaactgtgcaattagtttttgtttttatctatatttaatgtttcatgtatgtgtccaaagattcgatgtaatgtttttaggaaaaaaatctgtgaactaaacagggcccaagtttagccaactactaactccaaatcacatatagtcaacttaatagttaattcatacaatagttacatactacactattaatacctgatcccacctgtcatacatacactgtctcttgaagtccatgctacagttggctacaaatctttagctcgctgctcttctctttcttatttaattttcttaaaatatgttaccaaacgacgacacgtagccagaaacacctcgacacgaacacccccatgtcacaccacaccacaacacgatcagttcaactttttttttctcttttttcaaaatttcacatccttttccatcaatttttctttaccccgcattattgcagaagcaagaaggagcaaatatgcccttttctatttctttcacctcccctgattctttcttgggcgacaaaccacaacctgccacgtactctactctacccgccgcgcgtcactagctaatgacacgtgggcctcgcccatgcccgggcccacacgtcagcgggacacctcacctgcctgcccctgcgctgcgccggctgcgccttctggagaaaaggtaaagaaagacaggtcacccacgcacctcgcgcttaatttatttgtttccatttttatttttaattttttttcctcacgctttctcggttccatttggctttattaataattaattagactttttcctcttggctttataaaagagagcgcttaaaccctctccacctctccatatccggcttccagacgcttctctcctcctctaatctcaagtctctgtctcgtcgtcctcgcatctccactcgccatgggtaattatgctcacctccgaatcgaattaattcccccgtttgattactgctggtgcttcgcgtcctgatctgattgatgtttttttttctgatttttttggtgaattttctggtggtgtttttggggacgcaggcaagattaagatcggaatcaacggtgagtttgctatctgaattactacgagtttgtgctgtgctgggtgtggtttcgttggatttgtggtgatttgagtgggggttttttgtgtgtttgggattgtgattttgttcaggtttcggaaggatcgggaggctcgtggccagggtggccctccagagcgaggatgtcgagctcgtcgccgtcaacgaccccttcatcaccaccgactacatggtacgctcttcgatctgtgggtttcaccgtcttcatgtgcagatctagtcgtttgtagggttctacagtggttttagctcagatatacatttgcgtgctcgctcaaagagatgtttagtggttgggagttgttttgattgagatatggcagttaattttcccagatctgagtactttttttcgcatgtttagttgctgaattatgctgtttgctactgcatatggctttgattttcgtgtggtgtgctcacgattgatgaattctatgttggtcgtgtgatttgcagacctacatgttcaagtacgataccgtgcacggccaatggaagcacagcgacatcaagatcaaggactccaagactctgctcttgggcgagaagccggtcaccgttttcggcatcaggtaacttgatattgatattacagcttagatgaaagtaacttgtttatggtagcgagcgtggaactgatgtttgatcctgtgcaatttgaaaggaaccctgacgagattccgtgggctgaggctggtgctgagtatgtcgtggagtccaccggtgtcttcactgacaaggagaaggctgctgctcacttgaaggtattatcactgttgcttttcattccaacaaattggcatattgttacatattgttcccatgggattgcatacaagcaagtaaataatgctatggttatttttaagaattaatggatgtagttagattacaaaatcttacacgattttgctaatgatggacacctttgtgtaaaagcatcattatctaactaaaagaaactaagcaatccatggtttttgattatgcataactaaatgtaggcagagatgtgccacaaggggaaagctcattaaaatttgaagtttatgaaccccagtgatatatgtcaaggtctttgcatttacccaaaaagatttggcctgcaaagttaagagtgactacctaagtcttctaaagttaggatgatgcatcacaaagcagacagctcctaattcttttgccttaatttcttaagtattagcatatataacttatggctttgtgttgtcaatttagttttttttattacttgatgccttgtttatttttactctgaaaagtacttgttgtgcatctcccttgttgcataagttagctatttcggtgcattttttatgcttacatggctgttctgaaaacagggtggtgccaagaaggttgtcatctctgccccgagcaaagatgctccgatgtttgtctgcggtgtcaacgaggacaagtacacttcagatattgatattgtctcaaatgctagctgcaccacaaactgccttgctcctcttgccaaggtatttttctttccgagtgacaattttctactttcagttggacttttggtttggttcttaattgactcgttatcatccaataggtcattcatgacaactttggtattatcgagggtctgatgacaactgttcatgccatcactggtaagactttcttggctttttggcagctaatatgaacatctagatgttctgtaatagctaacgctgatgtacttgttttcagccacccaaaagaccgttgatggaccgtccagcaaggactggaggggtggcagggcggccagttttaacatcattcccagcagcactggtgctgccaaagtacgtcatgaacctcaatgttgtgcatgcacaaccacagttcaaaatcctctttatagttccaataattttgtattctcctgtgttatggggctgcgtatagttttctttttgactttatttgggaatgttaagtagaagacccagtgataatagcaagtaactgcacaaatggcgcgcttgctgatttcagccctagagtttttgttgataaatgagcatgtgcgctgtctttattcaagtatgaattctctctcatgtcctatgacgaattgcttgctgttcatgcttctgttcagagttgtttctggcctgcttagggaaaagggggtgcatgtgggcggtagtttttggttgtgaaagcatgttttgttagtaaaatgggactgcagccttaatgacttctaacatcaatgcattgcaggctgttggcaaggttcttcctgatttgaatggcaagcttacgggaatgtccttccgtgttcccactgtcgatgtctcagttgttgatctcacagttagaatcgagaaggctgcctcatatgatgctatcaagagtgctatcaagtaagtatatagcttccaacgcaaggggaatgtacatctcattttgcgcactgttgctagaactgcatcttgtggcaggggataccgctcagtgatgtatgttactgaaacatacatgtgaaggattcctagaaaagtgtagttacgtgtgttggtgggcgcagaactgcacaagttatccttaagttagtagtgtgtccctgacgagaatatgctaattgttttacaggtctgcatcagagggaaagctcaagggaatcataggatatgttgaggaagacctggtttctactgactttgttggtgacagcaggtatgcctttttgtcttgagaggccctgtaagaaatctgtaatgcagatctgctccaaactaagtggttacggacgaactatctcctgtatgctatcattcattctctgtactcatctttgactcaggtcgagcatcttcgacgccaaggctggaattgctcttaacgataactttgtnnnnnnnnnnnnnnnnnnnnnnnnnnnnnnnnnnnnnnnnnnnnnnnnnnnnnnnnnnnnnnnnnnnnnnnnnnnnn

SEQ ID NO: 48638 - DNA, 3507 bp, Oryza sativa
  unsure (1)..(3507): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctgattaaaaaacagtagcagtttagcacgtcaagttcagacttttatctttatctcttgtagtaaattttataatgtttagtcctaattctttccgcaggcaggagacggccaaccaaagaaataaactactcgcatctatcgctgctgatcagctgccggcagcacaccagccacctccactcctcgctctgtaacgctaccccgcatgctcagcccagcaagacccaaaaatccgagcgtttccaactaacatgcaaatttacaaaattatcctcccatgcacgtttctactaccattaaatatggtggtagtacgaataggtctgatcccttgaatagaaaagaatctacggtttagctagatttatttttactaccattagaaagcaccgttgtgagattcaaaaataattcgtcaagtactttgttttgagatagatagatggtcaagaactgtcgtaaagtaaaaaggagaaaataggtaacaatccaatgattttagagaaactcttacctttttatcattgacaaggagccagttctatagattaccattgacgatctcaaatctatctatctatcgattatattattaaaacaactttaaaaggcgacgccacgttcgctgtggggggctataaattcccacattaatcgaaaaaaataaaagaagagtctaagtagaaatacaatttggaataaaaataagcaatattgaaagaagaatccatataagcacccaatacaagattaatcaaaattcggaataaaaataaaataaaatccgaaattagaaaaaaaaagagaagagtccaagtagtaatacaatttaaaaataactgaaattcggaattaaaaataaggaatatcgaaaaaagagtacatataagaactcaatacgagattaattaaaattcagaataaaaataaaataaaatccgaaattagaaaaaaaaataaaagaagagttcacgtaggaataaaatttaaaattaactgaaattcgaaattaaaaataagcaatattgaaagaagagtccatataataaaccaatacgatattaattaaaaatcaaaataaaaaagagagttcaagtaggaatataattttgaaacaattgaaattggaaaataaaactattaaaaagatagtctatatataacacaatacaagaataattaaaattcgaaataaaaaataaaataaattcagaaaaatagaaaaagaaaaataagatctcaactataatacaatttataaatactaaaatttgtaataaaaataaatactattgaaataagacacaatctagaatacatgacgagattaattaaagttcaaaataacaaataaaataaatttcaaaagtagaaaaataattataagagttcaagtaggaatataatttatgaataaaaattatcagaatgaaaaatatgcaatttaaaaaaaaagtccatctagaacacaacgatgacaaatgacaataaaaaggggagaagcaataggtagagtactagcggttgatgggatatctaaaaactataaacaaaatcccaaacagaatcacaatgatgattaagaggagtgacgatgggcatgccgttaagcagcatggtcacgacggttgacaggacttaaggagagtgaaaatataccccaataataatcatatccgatttttaagatctcaatgacaataaggatgggagggagcaggtgagctgtagaggagtatagtggcgaagtcactaatgatttggcgagacttataaaatgtaaaaaaagaacacaaacaataattatgttcgatttttaaaatcccaataacaataaagagaggtggtagcggacgggccgtagagtagtaaactggcgatgttggaagatacttctaaaaattatgaaaacgaaacccaacaaaacaatgaactctaaaaactataaggactaattttaaaagttctaaagaagatgagtaaaggtagtggtagatcaagtaagcaaataaaaaggtgacaaggaagtaatggataaagactggtgtggcttttaaaaactataaaattattagaatcacgggaatgataactttaaataaaatcatgtgtaaaaaatagataattttaaattgatgctagccacgcaattgcgcgggccgcctaactagttatattattaaaacagtcttgaaaagaggcaccaagttcgctgtgggtgctagaaattcccacattaatcgaaaaaaagaaaaagagagtccatgtaggaatacaatttagagatatctaaaattcggaattaaaaataagcaatatagaaatattgaaaggagttcgtacaagaacacaatacgatattaattaaaatttggaataaaacataaaataaatttcgaaattagaaaaataaaaaagagagttcaagtaagaatatattttaaaacaactaaaattagaaataaaaaataagaaatattaaaaaaataatccatatagaacgcaatacaagattaattaaaatttaaaataaaaaataaaatgacttctaaaattagaaaaagaaaagaataagagttcaactaggaatacaatttataaataactaaaattcataatagaacataaagactaatgaaagaaacgaccatctagaacgcatggcgatattaattaaaattctaaataaaaaataaaagaaattcccaaaaatagaaatatagttataagagttcaagtaggaatataatttataaaaaaaatagtggaatgaaaaatatggaattttcaaacaaaaaattttatatagaacacaaatgataaatgatagtaaaaatgagagaagcaacatgcgtataaaggagtagattggtgatggttgatgggaaatccaaaaactattaagaaaaccccaaatagaatcctaatagcgacaatgaacatgcagttaagcaatacgggcacagcggttggcaggacttctaaaaagtaaaaagtaaaccccaataataattatgtttgattaaatcttaatgacagtaacaggtgaggcagcgggcgagctgtagagaagtacaatggaaaagccgctgatggtttagcaggacttctagatagtaaaaaaaatgaacccaaacgataattatgttcgagttttaaaatcccaatgacaataaagagatgagacagcggacgagtcgtagaggagtataatgacagcgtttgatgggacttctaaaaattataaacga

SEQ ID NO: 48639 - DNA, 830 bp, Oryza sativa
aagataaccagaagaatggcatcttccggttggtcgagtgggtctgggacctgcacggacaaggagatgttatctcagcggctgatgagcggctcaacggtgactacgacgtgtcggagatggagcgtgtcattactgtggggctttggtgtgcgcatccagacccaagtgcacggccgtctatcagagcagccatggccatgctccagtctagtgggcaactaccggtgttacctgccaagatgcctgtgccaacatatgcgccgccggtggcctcagtggaggggctcttcacatcgtccactggaatgttgtcctcaagtgcaacacaatcatcatcgacaaccagtggctatattacccacacctcaagttcctctaacacatccacttcagctggttcaaaggactcgtcttcgttgctcaaacatcaatacttatgatgttcaattcatttgcattgttactgattttgacttgatgcttgaatgggatgtacaactcgtgagccattgattttccttttagagtagtctaattgccaatgtgagtaatgtatgtgcatttatgccatgatttaaattttactcccattttagttattctagatagatttatcctgccattttctctctaatatctgactactataaagtgcatacctggcttgttttcagtgaatatcctagtctttagagggcctggaattgtgaattgtcgaagttggaagaacttgttttaaaaaaaaaaacaccaagagaagataactcttacacacttcacatatagttcgcatgttttcacttttcggtgaataacccaaaggtgta

SEQ ID NO: 48640 - DNA, 878 bp, Oryza sativa
acgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttgggggtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgccttcgcctacacggctggactattatgccgccgttgttggccgcttatgccatcaccaaggggaagcctccgtcgccgccgagtggtgcctccgcctacaggctggtttattaagccgccgctgttgggggtttacgactttaccgccggcctgcctccgttgccgccgaatggtgtattcaatggtaatgaaggaagactttggttccaca

SEQ ID NO: 48641 - DNA, 8478 bp, Oryza sativa
ggcggcgctagagcacgggcgccggcggcgggcgcggcgggaggaaggcgatgacaggtgggccccacccgtcagcgagagtggcgggcgggcccgcctgtcagcggtgcgcgcgcgcggggaggccgatgggccgcgggggaggagagagagagagggagggagaagtgggccgagccggcccaagagggaaggggggggaaaaagaacttcttttagggttttctttttataaaacctttttaactttgtttattccttttcaattattatttgtgctctgaaaattccactaaaatttatttaagcattttaggcttttaggaaatatacaaaaatcctccaagcctcatttgacttttatctttgcccattttaattgttggaggctttcacatgaattttaattattctttgcacaatttcgaggatgaattttagagtcgatttgggacgcgacaaacctaccccccttaaacggaatctcgaccccgagattcggaagaactggcgaagagatcgggatgggctgccttcagttcgtcttcgcgctcccaagtagcttcttcttcggcgtggttgctccactggaccttgcaaaaacggattactcggttcctggtcctgcgctccatggtgtccaggattttcactggcctctccacataggtcaagtcttcgcgaacttcaatttgctctgagtcggcctgctcggatggcactcgaagacatttcttgagttgcgacacatggaacacatcatgcacgttgcccaaggaggcgggcaactccagctggtaagcaacttctccgcgtcgagcgatgatacggaagggacccacataccgaggtgcgagcttcccttttgtctgaaacctgtgcacacctcgcaatggcgtgacccgaagatacacaaagtcatccactgcgaattccagatcacggcgacggttatctgcataacttttctgccgagactgtgccacctttaggttatcccgaatgattctgactttagcttcagcttctctcaggatatcagtcccgaacacttggctttctccaacttggtcccacaatagcggtgtccggcatttgcgcccgtacaacgcttcatagggtgccatttgtatgctggcttggtagctgttattgtaggagaactcggcataggggagactcttatcccaagtcttcccgaagtccaggacacatgcgcgaagcatatcttctaagatctgatttagacgctcggtctgtccatctgtctgcgggtgatacgcggtgctgaaattcaatcgagtacccagctcttcctggagcttcttccaaaagtgagaggtgaattggcttcccctatcagatacgattttcttgggaataccatggagactcacgatcctagcgaagtagagctccgctagtttattccctccataggtggtcttcacaggaatgaatcgagctaccttggttaatcgatccacaattactcatatagaatcatatccaccttgggtttttggaagtccggtgatgaaatccatcccaatttcatcccacttccattctggcacttagagaggctggagaagtccggccggtcgttggtgttctgccttgacacgctggcacacatcacatagagccacaaactctgcaatttcccgcttcatgctaacccaccagtatttctccttcaagtctaagtacatctttgtactgccagggtgaatggaataaggactttcgtgagcttcctgaagtatcagctgtttaagttctctgttatcgggaacgcatacccgctttccgttccataaggttccgtgttcatcctctgtgaaaccagcggctttaccctgtttcatattcttgaggagtccatgcatgtccggatcattcttctgagcctcgcggatttgatcgagcaaggtgggcttggcttctaacgcagccaagaatccgcgaccaactatgcttaggttcagggcttccatctgttgattaagctcgggtggaatgcctcggacgttgagagtgttgcagtggctctttcgacttagagcgtcggcaaccacgttggccttaccaggatgatagtgtattcccacatcataatccttgatgagttctaaccatctcctttgccgaagattcagatccgactgggtgaagatgtatttcaagctcttgtgatcagtatatatttcacagcggttcccaatgagatagtgccgccagatttttagagcatgaaccaccgctgctaactccaagtcatgtgtagggtagttgccttcatgaggtcgtagctggcgtgaggcataggctaccacatgaccgtcctgcatgagcacgcaccccaatccttggcgcgaagcatcacagtacaccatgaaatccttgcgagtatccggcaagattaacactggtgaggaaaccagcttttctttgagagtttggaacgccttctcgcattgcgggctccacacaaatttctcttctttcttcaacaactgtgtcatgggtcgagcgattttggagaagttctcgatgaatctccggtaatatcctgccaaacccaagaaactgcgaatctgagtgactgtcttgggttgcttccaatcggtgacggcggtcactgtttcggggtccacagcaactcctttagcagatattacgtgccccaagaatttgacttcggacaaccagaactcacacttgctgagcttggcatacaattgatgttcccgcaactttcccaacaccagacggagatggtgctgatggtcttcctctgattgtgagtatatcagaatgtcatcgatgaaaaccacaacaaacttgtccaagtattccatgaacactttgttcattaagttcatgaagaaggcaggagcattggtcaagccgaacgacatcaccgtgaattcatacagcccgtatcgcgtggtgaatgcggtcttcggaatatcttcttcccgaatacgtaattggtgatatccggaacgaagatcaatcttggagaatacagtggcacctttaagctggtcgaacagatcatcgatccggggaagagggtacttgtttttgatggtgacttcattgagagctctgtagtcgacgcacatcctcttcgtcttgtctttcttctctacaaaaatcacaggagcaccccaaggggaagtactcggacgtatataccccttttctttcaactcttccaactgtttcttaacttcggccagttcatttgctgccatacggtagggtcgcttgtgcagaggagtggttcctggagcaagatctattcggaactcaatctctcgcttgggcggcataccaggtagttcttccggaaacacgtctccgaactctctgactatggggatttctgacagacctatctgatgcagttctgaacttctgacagaggttgggggtgcaaagaaaacaaccggttgttctggccctcggtacagagtgacagtgcgcctcgcgcaatccactactccttggaattgagccaaccaattcatcccaaggataacatccaaattcttggtgtctagcagaatcagatccgagggaaaaggaatcccctgaatttctataggaacggcagggctataatactttgctgtcataacccctccaggggtggtgatgagcagagggtttctaagcctttctacccccaactgatttttccccacgaatggcacagatataaacgagtgggaagctccagagtcgaacaaaattgtagcagggatggaatggacgaggaacgtaccgacgatgacgtctggagttgtcagcacgtcctcggccgtcacgtgattcacgtgaccccgaatgacatccttcccgccgttgttggagcggggaggcgcttggccttgctgacgccttggctttggacatttatccgcaaagtgtccgggctcgaagcagttgaagcacagacgctgctgaccttgagcgtccctgcggccttgaacgggctgcacagttggcgtaggaggacggggcgcacgagtcccttgctgattctgctgctgctgcggcggtgggacgcgcaccacgaattgaggtcgaggcgcggagcgaggttgctgctgctgctgctgctgctgcgaggaggatccccctgggtagggattggtgtagcggaccctctggttagcaccctgctgattgcggaagttcgccaagcggcgcttgtgcgattccagctccttgtgcttggcctccaagcggatgctcttgtccaccagacgttggaagtccgggtagtccccagagactagacgaacggacagctcagggtccattcctgccaagaacttctcttgcttctcctcatcttcccgcacatcctccggggcataacgggctagattgttgaactcatgcaaatactccatcacggagcggttgccttgcttcaactcccggaattcccttttcttaagagccacgactccagcgggcacatgggttctccggaaagcggcggtgaagcgggcccaagtaatcggctgcccctctggctgcgcagcctggaagtggtcccaccagagagatgcgggtccctgcagctgatgggcggcgaagacgactttctcctcatcactgcactgcaccgtgtctagcttcttccccacggcatgcaaccaatccaacgcatctacgggattgttggagctggagaaggtaggtgggcggatgcggaggaactcggcgagtttagagtgttggggaggtggtggtggagcattctgttgtggcggattttagaggggtggaggaaagcattcatcatgttggcttgctgggcgaggatttgggtgagaatggcgttggtgtctggtggtggtggtggaggtggattgccttggtggttggggttgctgccctcgggttggttgccttcaccggtgttaacattctcctggtcgtcaccatctgaaaaccccacacagaaccagcaaacagagaaggagagctgacgattaaaactaaccacccacgactactataattcttgaatttattactgctattaaattggttcattaatgttcaagttgcttaggcaaataaaataagacaggctccgacatagttacaccacacaccggtgtaaccatgccccacacaactcaaaaagacaaacgaggaaaaacacacgcgcaagcctactaactgctcgtctaccgctgcgacgggccagggcggaaggtgagcaacagcgcaccctccgagctaccaacgccggaggcttccccctcctggggaaccacgggcgcaggctcggcacgaggggtctcgacgaagcaagtccacgccagggactgacgaacaagctcgggcctggaggtgctcttgcgggcggtgatcttctggctgcggcagacgcggcgacgcttgaggcggctgtcctctccctgggcgatcttgagctgatgcagctgcgcctccactgcgtcgaggtccttcttgagctgcaggttctcctgacgcagctccaggatcttcaggttgttctccaccatgccacggcgcaccatctgatggaagtcgatacgagccgcgtcgtacgcctccaccatgcgtgccagatgcacgacggtggcgtcatcctccgagctggcgtctcggaaggtggcgtagtcgcgggctcctccgcgacgagggtgatagcggtagggcgagtgctgcaactcgtccgggtagcgctggtgaagggtgccgatggcgaggagagcggcgttctggcaagcggcggggaaggaatccccacccgcggtgactgccagcgaagtccgctcgggagagccggagaggatcactgcagtgacctcccaaccagcgtgaggctctgcatcctcaccctcctgctccgggagcggcctggcctggtaatccactccatgcggataccccaagaccacgcacatgccccgcagctccaagacgaagccagtcatgtccaaaccacgacgggtaacgctgccggccatctacaaacaaaaacaaaaagagaaacaacattttaaaggacagattttgatgataagtgaagcagcaagacaaagagagaatagcgggttttcacaaataataaaggatttttatttttgaaaatattgctaaggcttgggatctacggctcgtcctagggtcaagggaggctctgataccaacttgtcacgaccggaaatcacccaacaggcgttcctgacgtgcgtgtattattccttgtcccaggaggcaaggtacaccaaaagttgatacaattcagagtttaacaagcggaagcgtaaatataattattacacgggcaacaacggcccagcacacaaagacaacgaaaaacagcggaagactagggcgacgaccacaggcgcttgacggcaggcacgagctagacaccaaagccttcatcttcaaggaactcctcatctgggcttggggaaaattgagcaagactgagtacaaccaccgtactcaacaagacacacccacaaatgcagaataaatgcaagggagtacaagggaattataccataaaggggttagggttgcagtaaacagcatttaaagacatttagttgctcaaggctattttgtaaacacgaatctagaactatacaatattattaatcaaggccgtgaacccacacgaacctgccttaacccaaggcctatgatgattcagaccgaactggcaacccgaccctgggtcccagctcgtcccaagccaacccaggccaaccattccatattttagttgttaagcaagttttaagaattaaaacactaacttgggtacattgctcggcttgcccataaccgagggctcggctattcgaatagattatactctgatcagaggtgtacatctttacccacaagacacatcttcctcacgtgtaaccacgtgccacataccaccacggtatacagacgaaagacgtgacatagtttccaacccatcctagccttagacaagagtaccgacccaatcccgcctacggccggaacccccgggacaggcagacggaactgagcccctcgcagcagggcaccaaccctgtgctttttgacatctcgactaccgggccgcagctcgtgtagccttcatttgccctggagaatgtccatcgacccccgacttcatccatctccaatccgtgtacttttgtttatgactagactgagccacaaactaagccttacccactagacatgtggaagtacggtagtgctttgcaacagaggcccgaagaccggtccttatatggccgaggtgctaccatcaaaaccatgcaccccgagcccagcctaaaagcaatttaggggattttgaatagagggggcggtgtgaagccaattccacaataaaccaacaattccagagtatccaggtgatatgaatatttcccaaagtctatagttgtaaaacctcctaaggttacctaattaaattgcgaagcatctacctagaattaaactagtggtgtcatgagtagagagtccactagttgaggttttgtttgcctagggtgaacaaggtaataataataacaataacaataataatatggtcataacaaaggtaagtaggcatggctaaataaaacagtgataacgcgggaatttaaataaagcgataatgcaataatttaaatcaacataattttataaactgggattcaatatgatcaagatgatgtgtcttgccttgctcgttttcccaatcgacggcttcgacttccacgaagagcggatcttccgaagctgcagcgtctacacgaccaacggaaaagaaaaggcttaaacactaaataactccacataacagcagaaacaaagcacaaaaatgggttctttacatcttaaggaaaaattagagacttgaacggtccaattccgagttcaaatggccaagatatggccatttgaagtttatatgctctttaaatggatatttacgaatttcttcatttaaattttaattaaaaatcggattattgcgtcagccgagggggcgggcgtgcggaccgggtccacgggaggtggggcccacgcgtcagccgctcggtccacggtggaccgggcgcacgcggctggcggcggtcggcgccgtgggtcccgcgcgtcagccgcacccgcgggcgcgggcggctgacggccgggcccacttggcagccgcgagggcgcgcccgagggcggcctcgccggcacggccgacgggagcggcgcgcccgcgccccgatggtcaccgccggcgaccatcggcgcggcggagcggcgcccgagagagcggagagaagggggaaagcgaacggcggtcttcggctcaccccgggacaacgacgacgacgagaacggcggccggagcggaggaaagcggcggcgcggttcgggatgacgatgacgacggtgctccggcggtcggcgggc

SEQ ID NO: 48642 - DNA, 2091 bp, Oryza sativa
ttgcccattttaattgttggaggctttcacatgaattttaattattctttgcacaatttcgaggatgaattttagagtcgatttgggacgcgacatgaatggagtataaagtatcatgagcttctttcagaattgcatcctttaaatctttgttgtcggggacacagattctctcacccaaccatacagttccgtgctcatcctccaagaaaccaatagcttttcctcttctcatattcttcttgatctcttgaatatcaggatcattaatttgggcttctctaacttgatcaattagagtgggcttcgcttctaaggctgcaactgacggagctcgtggctcctcaccgggagaccgcacaggccccccctttgccggttcggccgggggcttagggtgagatctcaagctctcgctgtatgtggaaagatcgcgtgccaggaagaaacgcgagacacggacgatgtatacaggttcgggccgctgggaagcgtaataccctactcctgtgttttggtggatttgtgtgtggaggagctacaaagtgtgagccgatctatcccttgctctaggctctaaatctggaaaaaatccatcctcctctccctatgggcaaggtcctccttttatactttaaggggataccacatgcactcttccctttccaaactggacttttcttctttacataaatggacggagatttgcacggttgccctccgaacgtccttctgatgggacggcccatacctacctccacttctgccgggggcaggcgcgtcgtgggaacgtggctatgcgctgacgacatgagcagtgtcagaccggtcacaaatcggtcattcttgtccaccgcgtgtcagcttagcaacgtgcatgtttgcccttcttcacacaacatcttgcctgtaatggttaggatgaagcctggtattcatctaacagggctaacgtgtcatctctaagaggtaacacgctagctccggctggagacgcgtgcctagaggctctcgtcttgacgggacggggcgaggcgtgcgccaggccgccagtcgccacctaaccgttgatctgaccggtctgtgactggtcacagaccggataaaagagtgcgctgcattgcgctgcatgctgcatgacacgcttgaccagatcgcaataaatgcggttaggtgagccctaccgtgttcacccaacctatgtacataatgcaaaccccacaaggggtcggggcacctcggccctcggagctggggcaggagcaacccgacccccccccctcggggaaatcaggaggagggcggacacctcaccctcgggcccgacgtccccgaaggtgccaggccacgtgggcgattccatctgcctcaagcctccgggcgcaatactcccggtcccatatcaccgacagcaacgaaacctctaccgacaattcccaaatttaatctttcaaattccttgcataattccaatggcaactgtcgtccttctgtagcattgcaatagccttttctgctaagagcgtctgctacaacattagccttccccggatgataatgaattcccatgtcataatccttaattaattccaaccatctccgttgtctcatgttcagatccggctgagtaaagatatactttaaactcttgtgatcggtgtacacttctgtacgagtaccgaaaagataatgacgccaaatcttcaatgcatgaacgactgcagctaactcaatatcatgagtagggtagttcttctcatgcggacgtaactgtcgagaggcataggcaaccaccttcccatcttgcatcagaacacaacctaacccaagtttggatgcatcacaatacacttggaaacccttctttggatcaggcaaaatcaaaataggagctgatattaagcgacttttcaattcttgaaaactctgttcacattcttccgaccacttgtacttcacatctttctgaagcagtcgtgtcatgggcttagcaatcttggaaaaattctatataaacctccgataatatcctgcaaggcctaggaaactgcgaatctctgaaactgtctttggttgcttccaattggttac

SEQ ID NO: 48643 - DNA, 2495 bp, Oryza sativa
atgattaggttcaatttttagaatcccaacgacgattaaggggaggaacaacgggcaagtcgttaagcaacacggtaatggcagttagtgggctagaatgtaaaaataactgaaatttgaatttaaaataagtaatattgaaagaaaagtccatataaaaacacattgtgattaattaaaatttgtactaaaaataaaataaaatctgaaattagaaaaataaaaaagagagttcaagtaggatataattttgaaacaactaaaattgaaaaaaataaataaggaatatgaaaataatagtccatatagaacacaaaacgagattaattaaaattctaaatagaaaataaaataaaatatgaaattagaaaaagaaaaataagagttcagttaggaatacaatttaaaaatagtaataaaaaattaaaactattaaaagaagagaccatttagaacacatgacgagatcaattaaaatttcgaataacaaataaaataaattccgaaaatagaaaaataattagatgaacatttttttcagatgtttttgtgaatttgtgatgtccatttgatctgtgatgttcattcaatctgtgaaaactaatgaaaaaaaggccaatatgcaaacagcaaaaaacatgaaaaaaaagaaaaaaaactttagtcccggttggtaacaccaaccgggatagcgctgcaatttttagtccggtaacaccaaccgagatgaattaaaattctaaataaaaaataaaataaaatatttaattaaaaaaaagaaaaataagagttcagttaggaaaacaatttaaaaattcataataaaaaattaaaactattaaaagaaaagaccatttagaacacatgacgggatcaattaaaatttcgaataacaaataaaataaatttcgaaaatagaaaaataattagatgaacattttttcagatgtttttgtgaatttgtggtgtccatttgatctgtgatgttcactatgtgaatttgagtatgttcattcgatctataaatttgtgatgttcattaaatctgtgaaaaaacaatgaaaaaaaaggccaatatgcaaacagcaaaaaacactgaaaaaaaagaaaaaaaactttagtcccggttggtaacaccaaccgggactaaagatggtagtgctacaatttttagtcccgggttatttcaagcgggactaatgatgggcatctttagtcccgggttgtaacctgtgattaaaggggttgtaaaccaggactaaagatgagttccccagcagacacatgaagaaacaaaattaacaaattttattatttttatttttttacttgtagattagatagaaacttgcatgtttgtgtatagacttatatcatcataattgatgttactaaatttttttaattttttctataataactatttaagtcacatgtaaatgttgggtgtcatgacacctactaggtgtagagaacctagtcgctttcttgtacctttccttttttgctttgaactacactttaagactttgttcttccacggggtaatgaagattggagaaggggaccagttcgaaactgcactgaaagttcaaattcacctatctttgttacgctggttgcttgacaaaacgagagcatagcagcaatgtatccaaagtattctgcaaattgagatctattgttctgaattttagtatacttatatgattattgtgatcatgttatacacatttagatcttctagactgaactaaccattctagatctcagccagagatggggatgaattaggacaaaacaatgtttcagtagtaatctatgcagtcattggacagcattagctgaatatcatatgagatctatcaacaatgaacacatgtcatgcaagaggtctcttttgttggtgccttcgatcatttctgttttgttaatatttctgagtttcttacaactccaacaattccaggccctctataaggactaggatatcgactgaaaacaagaaaagtatgtaccaaatatcagttagagatatggactgttgaattggattgttggagaggtgtaggaaaagttttctggacaaaataaataaatgcttggaaaactgaaagcgtcatgtaaactaaacacattgctcacattgccaattaggcagctctctaaagagcaaaccgattgcctcacgagctgtacatatcccattcaagcgtcaatttgtaaatgtagaacaagtaaaatgaactcaacatgactaatactcctgtatggagcagttaacgaagatgagtccttcaaaccaacttgttggtatggatgaaaatctatatatgccaattattgtctcgctatatagatcgtatgagtgagaaaacttgcggacctagcaaggtgtgatggatgttagtgtctaacttgagggggacatttgtgtcgatgatgaggggtgcccctccgttgaggccatcggcggtgcataagttggcacgggc

SEQ ID NO: 48644 - DNA, 7411 bp, Oryza sativa
  unsure (1)..(7411): unsure at all n locations
aacccagtacaatcacttcctttatttacatacttaaaaaggtacttgataaggtacgttttattgcaccattccacattgatatgaccttgaaatttcttgagaagagctagattataagggacaacccaccgattatccagcttaactccattctttaccacatagcgaccattgttgcgtcatcgatagataggatagccatcatcatctatggaagtcacatcacagaattgttttggatacccctttgagcacctaccatctttcatgcaaggagaatgtggattgtgctcaccacatgggccatgtatcatgaattcatcaacaagaccaaacccaaatttatcagtgcctatatctggtatctcagcacttataaggctatcaatgaatgcaggtgaaggatctccagattgacccatgagccatgttaatgtatgagaatgcggcaatccccttttttggaactcgacagtgtatacaactggaaaataaaacagcaagaaaaaagatatgaacagctagcagaagcaatacatgtggtggtaaagagatgtgtataaagactggatagctataatcaatgagatatggaacttaccagcttgtattggaccgaatgcctgtccattcttaatatatgtaatgtactcatctagcttcatatggtaaacacgtgtgaccatatcacttctatcatttggtttctggcctagctcaaaacgaatcgcctgagcaatttctggccatttaggattacatgtgaaagttgaaaatatgtgaggaggaccgtaggcaccgcacaacgccattgaatcatggtaattttgcaccatgtatcgccttcctccaatgaaacttgatggcagaattacctttataccaacatcttttccattagtgtctcccctaccaacagcatcagatataccttaatgtgtttcagagcgaaggttcttctggctcagagtatggaagttgaggcgagatgtctcgatacatgagaaagcattaacagcgagctgatcagaaagtctaccacaacaagtaaataggttgggctcatcctttcggtagtggcactcataccgataatattcaagcatggacgcctcatcacgactcgcaggcggctgatcatctacctctctaagcttaatgccagcacgaaaaccaacatcaccatatgggaagagaagtgggtactgcagtgacataagagctggatgaatgggagaaagctgactcaattcacctgaatgcttctgcacaacgacatcaaacttcgatatctcagaagatgtaccaggaacaatgagcgcagccaacttagaagcagtgggaaggcagtaacgatcaccctgagaatgacctgacccaatgagtttgatagcaatttcaggagcacttggagagagcagcttgtctcgagcaatccggaactgttgcacaagaggattgcattggtcaagcatagagataagctcttgtacaatagcagggtcagggacatctgcagcactgtcagcatggtcaaaaatattaagtctgttttgcagctcattggtggtgtcatatatgtatagctgtgcgtactccgggcgccgtccaggagcaggaagcaaagaacctattctatgatgcacgacaccattgatacggaagacataagggccatgaccagtgtttatgctcatgtcaatgttagctccaagttatgtgaatgcaaataatgaattatactgcctgatgagtcgcatgaaagagctggaacgggcgccgccatcaaaacgaagcaatgattgtaggataggagggaaaggcctatgcacaggtaaggagatcttcccaccacggcaacacaaattgtatgcaatcctcttagccctatgcgaactctggctaacgactctttcttggtaccaaaaaagcgcaccacaatgattgcattgataatcaggaccaccatagtaagaacgttctgggtacgtagctgcaagaatggggcaactcataagcaagggagcatggatatatttgtccaacggtagatatagagtccaaaaacagtgagaaaagtagagcgaaggaaggttggcactaagttatcacctttaagaatctccatgtagtcctttggtatagaatatgagaacctcactgacggtgaatacatgatagcctctgtgcaaacagaacaagaacggggcaacggaaatagcaaataagaaacaaagagaaaggaaagcaataagaggatccacctagttgaccgcaaagaagggtttagataagcaggtgaacaacctttgcgtacaatgacacatgctttcctagctgcccgccgtttttccnnnnnnnnnnnnnnnnnnnnnnntggtactattggacagaaatggtctcctatggcaacataaataggcatggcaatcaatagcaagaaagaaaaaggttataggtagccgaacaacaaaacaaatagcaacatggaactaactggcagagtgggtaggatgaatgagggaaggcccatgactccctgtggaacactcagatgaggaggcagaatgagaaaatggaaacaaaataaatttgtgctggcacgaatgaatgagcaaacacatgaacataagcatatgaatatatgctccgagcatacaacgtcgcaacgagagaacaattgtagtgaaatatgagagaacaaatatgcaatgggtgaggaatggaactatacaatgagatagcgatgatcacttcgagcgtacatacctattgagaacgatgaaccacctgtgaacattgggcgttcatcacaagcacaggatgaggatggttcatctatcgccgaacaaaattgtgaatcagcaaaaaagaacaatcaataaacatggtgatgagctcgctaactctgaggataccgagcatatgtacctatgggacatgatgagcttgccgcgagcactgatcgctcattggcagcataacatgaggacgactcatctattgacgttcaaaactatgaattagtgaacaacagggaaaatgtgcgctaatagcctcgctggctatgagaacaccacatgcaactataataagatcagcaagtaccatatgcacgcttccgcgggcagatgcatagggatctcgaccactccatgcggcagctgtacagcaagaaaagaagccaacaaaacacagacacattgcagatacatatgaatgggcatgcaatgtaaaaacaaatcataaacgagagaggcatgaaccaccacagaaacttggaacaaaacacagatacagataagtaatgtctaaatactggcatagagcacgatatatcccatggacacagggtgggaaaccatgaaaaacaaatccaggaggcaggatcaaacatagatacacctaaagatgtgttaaaaacaaacacaaaagacgaaagacataatgacatcgagagtttgcccgaaacacaccatggcataaggtctgacagaggaagaagaccatggccgcaaagccaaagaaccacggggcaacataagtgagcaaaaaacatcctaaatacagaagagcagcttatcacccatggatgtgtattaagcaggcataaaaatttttatccgatttaggtacctaagaggtggttacaatacaaacaaactacattcccaagaaagctttggctcaagctgcaatataacggtcgggttttgggccattcagctttcagtaacaggacaggcccgaatctttacaactaagcgtttcacatttttttctctaaactttggatggcataagtaaatgttatttgaccctcccaagggccaaggcttcttcctactttgtaggacctttactctacaggaatactgaaccatgctctaaaaaaggaaaacaaaggaggggggctatcacactccttcttcacgagtgcaagaacatctcttgtgattcctagtgcacaaagctaacttcttggcatgctttaccacaccattttccttggggattaattttcttttctcctagccacctttcaaatttattctcggtgctatgtatatgtgctaatgaattcagaatttgtcatacagaggtgggatgcaaagaagcacttcgcatgatctctctattgtcgaatctaaaggggaaaaaaagaaaccccacatatatggaatcaaccgaacaggcatcccagcgactgaacaaactgatctatagagatcagaaacgaaaggaaacagaggcaacctatgaaagaatgtaacttagcaggatgaaaaaaaacgaattaacacaaatatatgaaggaatcagcgaattaacataaatatgtgaaggaactgtttcctgttaattgaagggggcaaaataaggatcagaaatcaacaaagcagatatctcgccgataaaatcacctcatcgcatacacaccgaataaaaggtggtaaccagtgcacgagagagcacaaaatacctttgcgagcagtagacgagggaggcaactccctcccccaagtgaaaacgccaacagagaatccccaatccagcagtgcagcctagaaagcagaaaacccaaaaatcagtgggcacacgcatgatcgaaagaaccctcgaaccacaacggcgcaatctagagcaaggcgtaggaggaaaacaacatagcacaagggaggatacgatcaacgacgataccgtgcggagaaaaaaagatgagctgaggaagagcaagaaagaatagaactagcgctctctgtacaagaaagggagggaaatggacaaaccatcgcctggccatggtcatggggctctccgcgtagtggagcagtgagcagcagccaatcccgtcaccgctgtacgccatagcagtccaccatcatagctcgagagtcgagacaggggcggatagagagaggagcgggcccagggactctgagcgctagagcctcgccgatggcgacacgcggtggcaccgattcacgaccaaagcggaggagctgaggaagatagcggctcggccaatgctaaccgggcccagcatacaggaagcacacgggtcgcgagctgaatggcagacccaccgacagatgagcgcacagggaaacgacgagcgcacaaggccggcaaaccggactggcgatgggcaggaacaggccgtgttgggctagagaggcatttgggccatacgaccactaacgtgcgtaaccaccagatcacctattaaaaatcaacgtgtgcacaccgtattggctgccgtctgtccaaatcgctgggaagccggcaaatctagcacctttaagaaatttagtatttagtatactgaaaaaaaaagattattagcaaatcacgtacgaatttggcatggcctatgacgtatgtacacggccggccaggatccatttcatctgagcaaaatacatatatattgtggctaaacttcgtcaaaccttcctttatgcctaacaatatatctatatttgtaaggtatatctaaaggaacgatattaaacagcaactatctccagcttttggctcaaagatgggcataaacgaacattcgatcgataaagatgaattaatccgtcgttagctagctagcttaattcatttgaacatataagtgaagcatgcattcgccagaatttgcagctagtgatatgtagattcctcttcctttatgatattatatatgcatatagtgattgtgagattgagcctatcaaatgaagtgtttgtgtgtatgcttgattcgcaagatgatatgctatctccaccaacccttaattttacaccgttcgtacatcttttatttgaccggtttcagataatatctataaattagagagaaaaattcatatatatcaaccaccacaacggaccgacagagttagtttgtggaccaaaatgcctttaggataagccatgttttttctggtcgagtattcttttagagtgtagaggttaacggagacaaataagtttgtacgagattgagtaacaacaacgtccattgcagtttcaacgagatttttgaaagaatctcatgcggtactattatctggcactgatcgatgatgaaatccttgtgattcgatttgtcttttttccctcctgcctcagtttttactccgatttgacatgaggagttaggagtgccactggtatgagtgatgaaatacagagcggctgaaaggctaagaaactttcctggcatgttcatgtgtcatcaagagaatagccgaacaaatacatgcagtcacacaagatgcaaatatacatacagttactttagttactctagttggaagctgacgagagatagtaacgatgatgcctttcgaaagaccataactagtggctatatattctcctgaggatcctgtggcacaaatgtactcctgtagtagtattagtttttttttctttttctaagtgggtagtagtattcgattagttttaggtcttgtttgggggagttttcctagctgcagcttgctagaagctcccccaaacagtccacagcttctgagaatttgtagttacagattctgaaaaatgaactaaggagccagaagttggagaagctgggtttcagagcttttccagattctcagaagctggctaccaaacagctgtttcttagaatctaaagctccctcaaacatgcccttattagtgtagcagcagctagctccatgagtcagtcagtcagtaccttaataattttctcaagaacccgatgagtcccaaattgagataccggccggcacagccctgcaattcttctggattttgtgaattttcatcagatttatagttatccaaccaggcgctgttttagtgggttccagggtgtagagaaacaaacttttatggacagtttggcttgatggtcttcgctttatggtcatgttattgccaatttcatattcaccgccagaatgaaatggatgccatttttttgtaatacaagtggtgaagaatcacatagtcacctgctgatgcaatagctttgatctttcaagtttcaactcttgcatgccccaggaccaggttcaattctgacggtcaagtgggactgtggaggatacgggcgaccaaaggatttctaaccagtgctcaatttcatatacacaattttacaatcatatcaattgatttataccattataatctagtaaaatatatagtgcaaacctgaaaattactcttggatctaaaaataaacatactgagaggaaaagttttactcagggtgatatggacaaatatcgttttcaaattcaacgataatttttaggtttacacaacattatgaggtttgcactatatattttctcatatatttcccccttataatttaggtccaccatgatttagtggtcaaaatttctatcttttt

SEQ ID NO: 48645 - DNA, 4490 bp, Oryza sativa
ttccttcttttgccttctgcccaccttgtcttgtccaaacaaatgtacaaaaatgtggcaagctaattcaacgttttacaagctcccagaagaaaggaaagaacatcaaccgtatatctgaacaaggagcaaacaccaatgctcgaattctcgccaccaaaggcattttgttcaatcatatcatgtgcattagagaatatagtaaaagataatcggtgttcattgtcaatgccgtagcatcgccatgacaactccaatcatagggcagccaaaaatgaacaaagggcagtaggtattgaaattgttgcacccagaaagaatagttcccaagtacaagacaaccagtatgacaagggtgcttcttaagcaggagttgcctgcctcctagaagaggcaatcagatctcgtaattccacgtgctctccgctattagctttggcgctttgctttggtcagacagatcaaatgacgctgcgacctgaagagagaagcataacatggtcaagatgaaaaacatggtcggtagctataagagtacaacctctacaaacatctatagtgaaaatagcatagcaagttgctttcaatgttcggaaggagctagtcagacagcacaccagtgccttgttgcggatttaagcagggttgcatgggtacctttttgaacaaaaagtactattgacattctttgttaaatgaactcaaacaagcaggcaacaaatcaatataactagccaaatatttgttcttgccatcaatagcacaatatggtcacagaattacgatattgcattgtggcacatatcatggtctctctgtgtgagactgagatataggaagatagtcttctttagataagttagaataaagtcagcacccttctgtaccagtatcagttaaggcatgtcatgaaggctgactcttaagccggcccaaaacccatccatatcattaaggggttgttgatgcatgagctaacacatacaatgcatttatctgttaaactctccaatatttagtagtatatttagtgggatccatccctaatcacccgttattggctatacaatacagttcaatctccctgtaattcgcgtgaagagtcgactctgcatgtaacaacggctcaaagaataaagctttgttgggtgcattaactctcttccacctcagctggagtccaatgtggctgaggccatgagtcagctgagctggagaattgtagatgcccttacgaaccaatatacttcagctctttcccagggtttaatatgagggtctaaaacttggaccagaactgacaaatgtgaatacaaaatgacctttcaataaaaaatggtatgtaatatgtaagtcacttttctgcaatggaactgacaagactataaagctaaccattttaaagttatattcgcctatgaaaagccaaaaggccatcttgacaacacatttatattggaggacctaggagatgttagaataatatacgttgtataaagtgaaaacagacggtctagatatttagatctctattcacttgatgcataaataagcacatagtatagagagctaccacagtttatggccaaaaatcttccacatacatccctgtgagatcaacaactcaatgttctttcaagtcaactcacccattttgcttcctcatgtttcttcaggctctatccccatccttccaatctagatcctactagaattatccatcctaaagtgaccctatgatatttgagaactattgctcacaaggaactctaaagaacaacattggcagcttaataaacagacaggcacttgttctctatgcaacaaaagaaggttttcataaactgatcatagcaaatccttcagaaccaccaagataaatcagacagccattgcaaaaccatagaaagtactgtgtgaaacatatagtgaagtagcatactgaaatataagaaaagagtcacgatggaaagaaagaaaacatatacaaacatactgaaacatctttccaatgaatttcttcactaaaagttatatttttatacactaacattttcctctcaagttcctcacacgaaaagaatcacgatttgtttggatgagtacagaaaggttttaaaaagaaataatcgtgatcatgccccaactttcaaccctaattgtgattttaccctcactttttagggtttgcatatttacccctgtttcttcaaaacgaaatcaccgtttgacccaactatggatggcagttaggtgggtcccacaatattggattaaaaaatagaaatgaaaaagaaaaattaattaagaaaatattagattaccaatctgcccctagtaatagtatcataacattacatgttctcctcacccccactgctcccatccccaaatcgtagatagatcacgtggcggtggcaccgatggcagctccggcgagccggcttggcgcgcgacggagacgaaggctcctcgatgcggtgacgcgagcagcagcaggcggcggtggctcctcggcgtggcgaggcgagcagtaggcggagaggatggctcctcgacgcagtgatgcaagcaccaggcggtggcggtggctcttggcgtggtgaggcgagcagcaggcggagacggcggctcctcacacaacgacgcgagcagcaggcgacggcggcggcgactacccctcaacgcgagcaccaggcggcggctcctcagcgtgctggcaagcaacaggcgatggtggttgtctagtttttcaggtagcaatgatattgagtttagatggccatgatggagtgatttcacacacaaagaagttgaagttgcaagcacgggctgacgggctgttttcagtgctataggtaattctgatatgctatcagccatgttggcacactgatattcagtgctataggtaattcagtaattctgtattcagtgctatagatagcaacgatattgagtttagatggccgctatgttgacacactggatgctgtatcattactctatctgcagtttaacacttcgcgtgcaactcccattgtcgattgttccttcatgagttcatgcatgcttgatgtttgcacagttttgctatgaattaaacagcgtgataatggttgaggcgtgctgctcccagatttgtttgtaatataaatgttgtgatcctgttagtgatgaaactggtgtgcaaaattttgtttgatttcggtaaaagtttgtaaaaatcagttcagatttgaatcatttcatgaaatgtcagttcaaaacagttacaagtttcatacacaaactaggggtaacttcacaagtgttgtccaaaggtagagggaaatatacaataggaagcaagggcaaaaatgtagttttacactcaacttaacaccgttaaattgatcatccaaactaggggtaaagctttgcttcgtttcaataaaacaggggcaaaaacgcaaaccctaaaagtgagggcaaaatcacaattggacttcaaaatgagggtaagaatgcaatagccccaaaaaagaaaactagatttggcttccaaagggaagtgagcatgagatgcatacatttctagcaatgatagaggaggatgtattcaaactatctttctgcattccccaagtccccagtccccaacaatttcgcaccacccatggtccatggatagatacgcacagccacttcactagttgatgatgttcgtacttgtgcagttgcacatcatcgagtggggagcaaaatggttacagtagtaaaatgggaataagcctgtacttagcgcagatttggattagtcctagactgacaacaagatgttcagttccatacctagcagcgatcctttcaatttttgtaattctgattcaaaactaaggtattgaaattgaacattggcaatcgaaacagagataattgaagatggcatggataggcaagggaagtaaggataaaagggaggtgaccttgaaggaggcaccgatcttggagtccctggtccagtcgagggcgaggagcttggtggaggcttggtaggtggccttgatggcatcccctccttgaaacttgcgggtgacggcgaagtcccaggcgttgttagcggtgtcgaagcagggctcgatggtggtgaggcggtcttggccgtgcgcgtaggagtacttgacgcggcatccggaggagccgagcgtgtgggagaggctgagcttgttggccggatcgaaggtgagggagccgtcgagggcggtgcgggcgggcagcttggcggggcccggggagagggtggtggagtgcgtgtaggtgaggctgacgcggcggtcgagcagcagcgcggagttcatgaattggaagcgcacatcctgcaggaagaggaggaggaggaaatggggatcgattgattgattgatagcgcgcggcgagaggaagaagaagaagaaatagtagtagaaccgtaccttggagtggggcttgaggtccaggaggaaggagcc

SEQ ID NO: 48646 - DNA, 2876 bp, Oryza sativa
ccctccgtgcttcgccccgtcctccatggccatccaacgaccgccctccccctcggcgtccggctgcagcaggcgatcgtgcccgaccgccccagcaccgccaccacccatccccgcgtggtgggcggcgccgacagcaccaccttcgccaccgggaacacggggggccgagggatgcccacggattcgccggacgtgacgctgcacagggcgatctcgcggtcgtcgtccaaggccatggcgagccaaccgcccatgtggccgcagcagcgggcggcgctgaggcgggcggggagggcgaaggggaggatctcggcgcggcggaggctgaagaaggcgagaggtccccgggggggcccagggcggcggaggaggaggcgcggggcctcgaaggcgaggtcggaggggaaggaggcacgggcgcaggtgcgccaggaggagcagacgaggcggacggtgacacgctccagggggctcatcagcttcatgattccttccaggagctccggcgggagatccgcccaccccacggacaaatccgcccgccgccggggatccatgtccgccccgccccctgcttctctctcttcccccctcccccttttcttcctctttcttcttcttcttttttaattatttttctgtcaatggccagtttatatttgtccttacacttcctccctaaaataactttgagtacctgtttgaaaaaaaaaacctaaatattttgcggggttcttgaccgttggatcactttgagattcgtgaagtgcccaaccctaaccactcattttctcgctcctcactccgaacgccgccacctctccgcccgatacccctcctccccaacaactaacatacaaatattgttatatgcctcaccaattatagaatacgccaacagtaccagcggggttcatcagacctcaccctccctccctatcctatttctcaagctgatgatggtgaggtgtccccatcccgttgtctttgacgactcctcaccatcaaagacaccactgcctcctagctcgttgtgctctgagctatcaacattggtcgttccaccgcccataaattactatcaagttcttgtattttacaaccatccttctaaaacttgaggaactctctcctctttcttctaccccgcctcaaccttaaccctatatcttaactggactgggcctcctaagatcaaagagctcaccggaatgtgaagaaaatgtcatggtgtacaaatctcagattgaattggatggtccaaaatatgtaagatgggactttgagtttctattgtagggagattaataattttggaaaactattgaccttattactttctctcttttatgttgtccccacggcacacaggacaagatctctctttgggttgtttaatttgattcatggttaaaatttgtcaatccaactacaatagcaaaagtacgagtaataacaaaaagcttgacgcaaatttaattggcatatgaatacgttagctccacgccttgagaaaaatattttctttttttaaaaaaaaatttctgcaacatcatcaagatcactgtttatttcttaaaatatttaatttgtaaataatctataacaataatttgttcaataatctaaatcaaattattgcctaaaaagtatgagtaagcacgatcatggaattcaatcatgcagacacggaaatacatttacatataacatgagacgtggccatattaggcatcaaaccaaacatcctcttatttttggcagccagggaagagacaaggtcatattaaggattaacaaacaatttggttttgtggattcataatgtaatttgatatttgatgagtagcaacgattatgagttgttggaggaagaaaccatgggagaatatatatgtttttattgggaataggatgaaaaggaatgatcggtcatctttggaatatagagagatgtttgatgaaatcaatgggaaattgcttttcctagaaagagtgagatgttcctcgctagggatttcatcttgggaataagttcactttgattcccttaactagtgatcgaatctgattcatatccctgaaccacaattacggatatctcgaccccccaactattaaaaccggtgcaatttaactcccttggcggttttagagggcggttttgctgacgtggtgtctacgtggcaatattgacctggtcttcgtccccattcggcgctgacgtgtcgattaggtggcattagaattaaaaaatatgtttgggggcccatttgtcattaaaaaaatatgtgtgggacccatagacatgtggccccacatctcatgctctctcttcttccttcttcctcccccctctctttctcttccccatcggcgagcgtgggacaggggccgtcggcaggcagtggtggtggcgggcgggagggtgggcgagcgagggtcgggtcccctttgcgagctcgcgacttcgattagacctctttcagtccccgatcaaccaagccaccaccacagtcgagcttctctcctcccagaaatcccaatccacacctcgctggcgcccaatcaccaccactgccgaaaccccccaaatccggtctctgccgatcaccattgcggagctcgagctgtgacttgccgctgcaatccatcccctccgtttcttcccatttctcccctccctctccttcttttccctcttcctcttccacggcagagaggccaggactcggggagggcggcagtggcggatgaggtccgcgcggccctcgcacgctgtgtccagggcgggctcagggtgggagcaccgaaaggcagtgacgaggagtgacctcccccatctcttttgtggtcggggcggctaggctatc

SEQ ID NO: 48647 - DNA, 2146 bp, Oryza sativa
aatgggtccaattttttatcgtcttctttttatcgtaaaattattttaaggtattcactgcatcagaatttggtaaaatagaggataaatatattgataatagaaaaagagagcaatacctacattgggattaataaagtgggattcccagactttttaattttatattgatatgcagggcagaagaaaaattaacttattttgagattgagaaagcagggtaagtattttaaaagttatacttgtctctatcagttactcctatctcttaattagtatttaaatttctctgtctattatcgatctgaaccacactgccctcaacaatctctcgatacaataaaacacattatgacttctttttttacattcttgatccaaccatctctcaatggataaaacacattatactttttttacatccttaatctctccaatacaatctagaaatacttacttccatcattttaaaatatacgaattttaattttatgtgttttagaaatatatttgtgaaaagagggagcagtatatatatgaatatatatactgtgttactactactctactcctaattatatcagatccatctatccattacgacggtttaacaattttcagccttaattagacgatcgatgatttggtactgccttccaccattaattccatattgttgagacctttcaaagggattgaaaccaaattaggtgcggaataaattcacatctattttggtgtaaaatgaattaatgttctcaagccaatctaatttctttctctaccggattaactgaaaatagcatagtttcagctcaaattaaccagctatatatatacgtaccattgtgttgttatatttaggtggtgttattttttaaggaagatgaagataagttaggatacgtaaaacaagaaaaatattagcgcctgactaattgagctttaattattataaagcaacttctttgggatccgtacgggaagtacatacgtatcaatttaattataatacgctatacatccgtaaagaaaacttcattctttacaggaatctgcacaagtgataacacgtgtagataaatgtgaaaactttgaggtagtagccagtagactactccatgcggtcgtcaatgcatgcatggatgatctttttgttcaggtgtcacttggtacagtgcacctagcttacctagcacctcgaagctagctaggctttctgttcagttactactacatttagcctcgaaagaaaaatcaacttttatacgctaatttagtgatgtatatgttcaaatttatatacctaaattgatctattttgagacggagggagtaaccattacacctagctaatcttctgttcaatgcgcgtattcctaaccattcattttaatttggtcaaaactattaatcatctttgtgcatcattaattcactgtaaaatacttcatgcaaaatgcaatatatattggagtatttaataaataaccaagctaggaacttaatcaaatttactatatacggctatgtatatactttatatagatatgtacttgtctttcattctagactaaaacgaaataattacgaaaatgaagcctactggtggagattaattgagtgcataattatggagaataatgtgatggtctgaaggagggcaacaatattcttcgttgagagcctgagaatgacattttgacaagtataggtacaactcacctcaccggtcaattatattgcaaccatgcattatactatatggcaccatgcgttgaataattaagctacatgttccacgaaagtgctacacatttgtgtgtgaaaagtgaaaacaaccaaatattgacttttagcttagagctatatatatactatgtgatgttcacattatttcttgatagatagataaaagtgtgatatatatatatatatatatatatatatatatatatatatatatatatatatatatatatatatatatatatatatatatatatatatatggttaacagcacgctgtatttgctttcagaattgcaaataacaataaaaaacaactacaattaattataagtaattttcttagtgtacgtaatttattattttcaacataaaaatgttttgtttcctttgatac

SEQ ID NO: 48648 - DNA, 8975 bp, Oryza sativa
ttacaccacgacgccgatctcaaccggtccgccaatgactggaaacgagaacgcagtggctacaaaccaaggcgactccatgtcgaaaaatcctcccgccgaggcggagaacggagtatcgacgacatccgagctcaagaaggattctaatgtggccaaaccttgtcgttccgacatgaaccgcgagccgacgaagatgacttccgaagcgacaaggtcctggtgtcctatccacaaaaccaggaaacacactttgcaagcctgctgggttttcctcaacgtccgcgctgaaatttgcgcctacaaagagcgtggaattcagcgtatttctccaactcgtgctgtctattgtcctattcacaagacaaagaatcacgacctttcaagctgcaaggtcttttccagcgccatggaagcgccatcccctaaggtccaacagtcacacatccccatctgggataaagacaaggaacgaggagcgacgccaacttcagatcgatttgttggggtaatcgatatcgatcctcacgaaccatcagtcttgcaccttcacaagcgcgcctcgggaggtattggctatcgatgatgtcggcatatcagcgtgcaccaatgcagaagcggagaatcaattgaccactccagctcagcacatcagagccgtcaacgctatactgagggaaaccccctacgatcccgttctgaacgacaatctcgcgcgttggacagaacgactacgggaatcagtgaccaacctcagtaacgcgttcgaagaggccgctgccgcagcacacccagagcagccaccaactggcgatgccaacggtgaaaaccctgaacggagggaattgcctcagcgagctacccctccacctcgtggcactggcgatctccgagatcacatcaacggccgccgagaggcacgacgcacatgagacaatgagaatcgttcccgacgtcatgtctcttcacggtgccatgataacgaagatcgaggagaccgctcaaacgaggaccgagaccgtgataaccgccacaaccaccacgatcacaacgatcgcgaacggcgggtgccaaacgatactgatcgaggacgtcgccataacgacgacgatgatggagactggcgccaagacaacagcgggagacgacgacaggattctccagatccaagccgacatcctcgtaatcgtacgccagaaccaaacgacccatcatcatcgtcatcatcctcgtcttcctcatcatcagacagacatccatgaaggacacacgatcgccgacaacccaccgcccccagcgctgggtgtagggctttcagtcgttccctacgtgatgtccgatggcctgagagattccgaccccgagcaatagagaaatacgatgggagcaccgacccagaagagttccttcaagtctactccacagtactctacgctgccggagcagacgacaacgcattggcgaattatttgccaactgcgttaaaaggctccgcacgttcatggctgatgcatcttccgccctactcaatctcttcgtgggcagacctgtggcagcagttcgtcgccaacttccaaggaacctacaagcgccacgcgatcgaagacgacctacacgcgttgacacagaacccgggtgaatccttgagggaatatgttcagcgcttcaacgagtgcagaaatacaatccccaaaatcaccgacgcttctgtaattcgtgccttcaaatccggtgttagagatcgctatactacccaggagttggcgacaagacgcatcacaaccaatcggagattgttcgagattgttgagcgatgcgcccacgcagatgatgcgctaagacgcaagaacgataagccgaagaccgggggagagaagaaatcagccactgacgcacctgagtcaagcaagaagaagaatcgcaaaatgggaaaaggaaagctcaagcggaagtcctcgcagcagaatacgcgaaccctcccaagcgcccagacccacaaagtagcgacacaaagaaagcatggtgccccatacacaagacggacatacatgttttggaagattgctttgttttcaaaaaatcgctcgagaagcacattgcatctgaaaaaggcaaacgagtacgcgtggtcgaaaaggacgtggaggcggctccccaggaatcagactcagcatatccagaccctgacctccacgtttcacacatcttcggagattccacaacatactcctcgaagcgagagtataagaaagtggaacgcgaagtctgttcgacatggttgggggctgcacccaagatgaagtggtctgaacagaagatagagttctcggaagaagaccaccccaagaccgccgtcattccaggaatatatccgatcgtggtcgaacccactattcggaacatcaaggtcgcacgagtcctcatcgacggtggcagctcaatcaaccttcttttcaccagcactctggacgcgatgggaattccacaaagcgagttgacaccaaccgatcaaccctttcatggaattactccccaatcctcgtccagaccattgggcaagattacgttgcctgtgacttttggccaatccaacaacttccgaacagagcagatcacctttgatgtcgctgaattcgatacagcttacaacgccatcatcgggagaactgcacttgcgaagtttatggccgcatctcactacgcgtatcaagtgctcaagatgccgggaccgaagggaacaatcactattcaagggaacacaaagctggcggtgcaatgcgacaaacggagcctcgacatagttgagcaaacgcccagcccacccgccacgactgagccacccaagaaagtgagcaaaacaaacaagacgccgaaaccggacggcgcaatcaagatcgttccactctccagtgccaaccccgacaagatcgtcgagatcggggcgacactaaccgagaaataggaactcgtactcatcaccttcctccgcgacaatgctgacgtgttcgcttggcagccgtccgacatgtcgggggtccccagggagataattgagcacaaactcatggtgcgacctgatgccaagccagtaaagcaaagactgcggagatttgcaccagaccgaaaacaagccatacgagaagagctcgacaaacttctcaaagctggcttcatcaaagaagtacttcatccagagtggctagccaatccagtcatggtgcggaaggccaacggaaaatggagaatgtgcgtcgacttcaccgacctcaataaggcatgccccaaggatcacttccctcttcctcgaatagatcaactggtggactcaacagccggctgtgagctgttgagctttatcgacgcttactctggctaccaccaaatcagcatggcaaaagaggacgaagagaagacatcattcatcacgccgttcagggtattttgctatgttaagatgccgttcggactgataaccgcaggaaataccttccagcacacggtccagggcgcacttagcgaccagctcggcagcaatgtcgaggcatatgtcgacgacatcgtcgtcaagaccaaaacatttgactcattgattgacgatctgtgggaaacgttcgacaacctccgacgatatcgcctcatgctcaatccagagaagtgcacgttcggagcaccgtcgggaaagctgctcggtttcctcatctctggcagaggaatagaagcaaatcctgagaagatcaaggcaatcgagaacatgaagtcacccacaagactcaaggaagtacagaagctaaccggatgcatggcagcattgagcaggttcgtcgctaagatgggagaacgaggacaacctttcttcgctctgctgaagaagcaagacaaatttgtatggacacaggaagccgaaaaggcattcgttgcactcaagcgctacctatcaaacccccctgtacttgttgccccccaacctaatgaataattattcctctatattgccgccacgccatattccgttagcaccatcatcgttgtcgagagagagaaagtacaacgaccagtctactacgtcagcgaagctctccacgatgcaaagacaagatatccacagatccaaaagctactttacgcggtcatcatgacatcaaggaagctacgccactactttcaagcccacagagtcacagttgtctcctcctttcctctcggtgaagtcgtgagaaacaaatacgttgtcggttgcattgcgaaatgggtagtcgagctgagccagtttgatgtccactttgcgccacgaacagccatcaagtcccaggtactcgccgactttgtagccgattggactatgcctgataacaaatcagacaaccaagtcgataacgaaacgtggacaatggcgttcgatggtgcactcaacagctaaggagcaggggcaggatttatcttgacgtctccttccggagatcaattcaagcacgcaatccacctcaacttcagggcgaccaataacacagccgaatacgagggactactcgccgggataagagctgcagccgcacttggggtcaagcgactaatcgtgaaaggggactccgagctagtcacgaaccaggtgcacaaagattataaatgctctaaccccgagttatctaagtatatcacagaagtcaggaagctagggaaaaggttcgatgggatcgaagtccgacacgtctaccgcaaagacaacatcgagccagatgacctagcacgacgtgcgtccagacgagaaccgctcgagcccggcacttttctggacatcctgacgaagccatcagtgaaagaggttagcggcgaagttagcccggacacccccgacattagctcggaggccacaaaggcagaacgcgccgttgccgatatcgagaccacagacgactggcgcatcccactaatcaaattcatcaacagcgaggagctgcccaaggacgatacagaggccgagaaaataacccgtaaagcaaagatctactgtatggtcggcgacgatctatacaagaaagcgccaaacggggtacttctcaaatgcgtctcgtccgacgacggcagacacctcctccttgatatacatgaaggcatttgtgggtcacacgccgccggtcggacattggtcgggaaagcttttcgacaagggtttttctggccaaccgtccttaaagatgcatgcgacatggtccagcgatgtgaagcctgtcaattccacagtaaacacacaaagctacccgtgcaagcgctccagactatccctcttacgtggccgttctcgtgctgggggctagatatactcggaccattcccacgaggacagggtggctacccacgggggaaatcaaggctgacaacgccatcaaattcatcaaggggatattttgcagatacggactaccgcaccgcatcataaccgacaacggctcccagttcatcagcgctgacttccaggattactgcatcgggctgggagtcaagatatgcttcgcctcgttctctcaccctcaaagcaacagacaagtcgagagggcaaacgatatagtactacaagggatcaaaacccgcgtctacgacaggctcatgtcacatgacaaaaaatgggtcgaagaactcccatcagtactatgggtcgtacacaccactccgacgacgtccaactaggaaacacccttcttcctcgtgtacggctcggaggccatactccctagcgagctacgacatcagagtacacgagtacagaagcattccgatgaggaccaggaggagcaacgaaacgtcaatgtaaatctactcgaggaacatcgcgaacgagttgccattcgagcagccagctatcaacaggccctccgccgttaccacgagaagcgcatccgagcacgcatactttcgatcggcgactacgtcctccgacgggttcaaagccaagcagggcgaaacaaactctcacccaaatgggaaggaccttacacgatcacacaagtcttgcggccaggcgcattcaaaattgcagacggcgagggtcgcaagttagcaaattcttggaacattgaccaactacgtaaattctatgtatgagtcaataccatccgtacctgtaagacaccttacagtatcaataaagcctattcttaggcccatattagaatcaaagtgttcccgcccgatgatcccttaccctgatgacacctagcgttgaaacctatccttatgtccctttacgccgtcttgacaaggcctccgaggaacccaagggatcttcggctggggacgcccagagccgataaggccttgtcagatcctgtagagacgaaagaccatgtaagatctggtcatgtaagagttctcgccatgcatattaaccaagccgcgaaatcggaaattaactttccaacttcacggctgggggctaggatcagagcttattcaaccaaggcaggtcaaaggtccaagagccttatcctccgagaaaatccctcagacgacaaggctgggggctagggagagtgtacgactcaaacgactgattaaagtcgtgaactgagaacacactcttacacatgacatccggagtaagaaagatttgttaaagatagatttcttttctattttacaaaatacttcttacagtttttacacaaatccaaagctatattacacctttttcctgagatatctatcacagggtacgaagactaccaagaaggccaacgccaatccatagactggaatatcttctccgccaacggcgccatcgacctcgccaggtggtctatctctgccggagtcctccgagaacgagcaaagccctcacggagaaaatcgaggtccaggcgcgggcgatgatctcgtagacaagccaacacgtgccctccggcatatcggctcgatcgacgacattcctgcttcaaggcctcgtcgatacacttgccgacgccatcaagttgagcacaggctccgttcagccacgagatgtacccagccgcggactcctcgggatccccacgaggtactcgaagctctctacaaaccttggccatggatgtgcagcaactcttcaagtacgagttgaaccacacctcgcgacctcggagcgtttccacagcctgctttttcttcactacaaccatagttctctcgagttccgctacttcaaattttgtcttccaatattggatacgacgatcttggccagcaagagcactctcgagatctgctcagtgtgggaacgactaagtcaggctacacgcctcttccgagaacataggtgatctagtcagaggcgcaaaaagggatgaatggatcactaacctaaggaagtggtcgccatctccgtccccgaggcaagggtttggtctacattgtcgggcgatgcatgttggtcaaacgtgagagccggaataatcgccggtgactcgggttgcccatgctgctggacatcctcgtcatcaacatctctacaagggacaaaaagctttcaagatcaacatgcaagagtaagctagaataataactgctcgcacaaaggcggttaagatccagttttacacagcatatctagggagtacaagaggccccactcttcaaaaagggggagaacagattcccccaggtcaccgacttcttccatcatctccttacgcgtgttgctagccgccccctgatccaagatctcgcgcagatcgagttcaggatgcgccagctttacacacgcaaggacgtggcacgccccggtgtagatcccgttcgatgtctcctccccgatcctagccgcatgcttggaggggatctcctccatcgccgccgccagctccgcaagagaagatgtcaacgagaactcgtcgggattcgccgggatagtagacttaatgccacactccccggcgagctggtgcagaccagtataggtgacccgcaatgagccacggattttcgacagattgttcccaagctctgacatgcggtgctcgagccctgccgttgtcgctcgttgccggccaccaactccctcatcttcttgaggtcctcacgagcctccgacaactcgtgtgccaatcggtcagcccgcttggttgccgacgacgccgccgaccttgcctccacaatctcgtgaccgatgccgcgagcaccagcctcaggaggcgccccatctcaacctagagctcctcccaggtgaggacggtagccggtggaccacggccagccgcgggatcgttgactgggccgcttggtgtcacctcgcggcccccgggtgcgagcatgacatccgacgaggccgcagcgggcgacgtgccggaggtccctccggacttgtcttgcccagccttcgcccgcgccgccctatgagacgggcatggttcagacaacactcgaataaaatcacagaaacttaagttcatcaacttacttctcgccaaccgtcacaaggcgttgtcgtcgtggaggcgggagagacgtgtccgaggcctgaaaaatggtcgatgcgaagtaaggcgaaattcttctggctgtacgatttgacgacaggatagcttaccgagggggttgatgccttgcgacgatgtccgctcacagaggagaacttcctcccctttgtcggaacattgccaccacttgtagtagcagcagcagcatcagacgcctccttggcgaccttctctttcagagacgccgccacctgatggtccgcgagcggctcgatgatgtcagtcagatgaagggcctacgcttaatcaagtcacgatgtgatctcggaaggaaaacgtagaatgcctatcgggtacacttacattgatgcagcatcacgttcagccgcacctttctcacaaaagggaacggggatggtactcgccgttgtcggaccactgatcatcacttggccaacacgacgttccccagtttgctgttcagacctgtgaaacgagaccaaattttgataaatcaagaggaacacgaac

SEQ ID NO: 48649 - DNA, 1469 bp, Oryza sativa
gccatttgttgcgagaagaagggcactggaaggggatataacgggacttcaggccatccggaagtcggaacccgacgcaaccagacaccctgttggactccatccaacgcagctcgtagtagaagcgaaagagatcaagaaagggctctaccccaatgtaggcctcacaaagatgagaaaagatgctaaggaaggcgatagagttggggttcaaatggagaagagaaagaccgtagaagttcaaaaccaagagaagaaattcggaaggcacaaggagaaaaccgcagagaatatagtcttcgatcgcaaccatgcgacctaagacgggctggggattagtacctcctgcttcctttccatggttccgcgaccaggaagggcgccgtcttcctgaagcttcttcagtgacacactggtggaggatgatttgccgagatccatcgttgatcggagatcgccagagaaagggctcaggtcgatgaactagggtttcttgtggcagcggagaagacgaagagcgcttacaggcgggatgttttcttcacaataggcggacttcaaaatggatccccaaaattcctttaaatagacacacttccgacggtacgacttccaaggaaaggggagagatgcccgccggagatttctggatccgttacgcgcggcagttttttggacttcagtttaaattcactcgtgaccgttgggcttcacacggtgttctcgactacgtcctgtctctatggtcctcacaccgggaacgacaacagtctcgacacaacaagtcgcgaatggttacacgagttcatttaagcagaagtcgggggctactgtcagggttatgggttaggcataccctttacccttcgatatatgttacatatcggcatggcatacccacgcgcatacggatacttcccgcgtacactaaggaaatcattcacgaagtctacggatgggaagagtcttactcggacaagactgggtcatcaatgtatcgtatagggtctgttatctccgagttctacttggaaaccgcctgacctgcgatataaaagggaccccccagggaggacctggggcatcgaatctcagagccaacacgaccctcacagcctacgaagtcggagcccgcaaggagccaagtcgccggggatctagtcgaaccaactcgaccacgatctcgccggatccgtcaagttccattgttccctttgtaacttgtgttttccactatataatcccacatcaactagattatggctattacctaccaaggggtctgaaccagtataatcctcgtcttttgtctgcttgatgtcgtattacgtagattcttgtaccaacgtaccccaataccctctatatccggtctacgggtaccacccgttgacaggctgcatgtgcatcgagaaatgtaaatattaatgaatcgcttgtttacgaggaatgactagtggcatgtttaa

SEQ ID NO: 48650 - DNA, 2778 bp, Oryza sativa
gcatgcagcagtgttggtcgtggttccatatatttcttggcatgcaacgatcgaatccgatccgagaaaaagctactactgtcctgtgctgtctgcagctttgttcacttgtcacatcgattgatcgtcccagctgccgacctcgcgatctgcaatttacacagtacagcgagggatcgatgcattcatcgatcgatcaaaccgttaattacctacagaaccaacgtaccagaaggcttgctagctagctgcagcttaattaattcactgtattactacatgtgtgttactttctcgatcagcttcttgcttcgtacgtgcttccatctccaccacaaatttctctgctatatatagcttgctttctgcggctgcatccaccggagaaaacgacgtatatatacagccagccgacttaattagttttcggtcaatagttctataagctagtaatatataatatctcatttaatcctaatactatacatatgttgatgtactacatatatactgcctccatctcgtataatagctacttctaacatttaaattttgcctcaaaatatatacattacctagctacttctccaactatattatctcaaccaataatcacagcatctctcatcatctaattattccacctactttctttattatctcaaccgatcatgatcattaatttcacggtgttccttaacctctctaaaaaaaattcaaaagtattactgtagtgctatactctctttttttttagtaatataattgtttttgttacatcaaggcttgactaataactattttgcagtttctaaaaacaacaatcgttttacatttatttcacgttttcatatccattggttatttgtaaaattttcttaataggaataaaattcatcctttcatttaatatatcacttgccctttcaaactcagtcacattagatagaaattacgaataataaatttggcaccctaccttatttattgatatgaatatgagcacaccaaccttattcttaaatttgtaccatgtgtgaaatcaaacttaaacatattttaaacattggtacttcacaaaaaaaaatgtgctgtagatttaaataaaagattgcacatttacttttcggggtgtgcgtgtgtgcgcgatcagatttgaacctctgtatttatggcttggtatgtgatttgacaatttgaatttagagtattaaatataattggcatgttatattttaaatttgtatggcataaatatgtgatatcattttaggaattacgacgcttaccttattaaacgttatgaattttaatgacactttaaagaatattaattctttccttattatgagatcctacccagaacaaggtaatataccattggattctagtctaatggacagtgaaaacatttggagcaccttaaaaaaaattccattgtttttttatataaaaacaattattgtaagtaagcaattttaacatgtatctttaattttgtgttaaatatatatatcttgctagagtaattattgtcaaagtcttgccctaacaaaacaaaataatacacaatatattttttaacgaaaggagcatatagaatggctaacgcatgccacactgggaatatggaagaattaatccgatttgggatgaattgattattctcgatcgtccctaagaaattccagtaccggcatatatatagtggcattcgttcttgtataccaaacaagtaattattaacttgcaattcaatcaacaaaagattctggtacataattaattgacacatttaactaaagaaaaataacagcccccaagtccaacttttgaatgatgtgtaattgccctcgagaacatttttatatcgataaattagttatagctaggtctcgatgaaatgctagcttaattcagcttgcatatatagaagcataaccacacttacttaaattatcttgcttggaccaaccaacaaaacaataagagggttgagggttgaaagtttttttttcagaaaaaaatattacatacatgaattatctacccaatccatgtatatatatatatatatatatatatatatatatatatatatatatatattctcaaagatggggggctgtacaatatctatatatatgtctatatgagcatattaaagcattaaagcattttctttttggggtaaacctcgagaaggaggacagggagttcatgttttatattaggaagaaaaaggagttggcctagtttatcatgggccaaaaaaccaaacaaccatacgattaattgatgaaaaatcggcaaataaaaacccaactctatcagcacataatactggtggaaaaaccatttttggtcggtcggccaaaatacacaatattcccggttgcaataaaaaccgggactaaagatatctttagtcccggttcaaaaggttagagttttttttttatctttagtcccggttggtattaccaaccggaacaaaagatctatttttagtcccggttggtaacaccaaccggaacaaaagatccctattatctttagtcaccaacaccaaccgggactaaagatctatttacagtcccggttggtgttaccaaccggaataaaagatcggcatgcgcaacatgggcggcggagagtacgaggccagatcgaggaggaggaggagcagttaatatattctatctcctcactggccttatctcttcctccatatctcttcctccatatctcttcctcttcctcctcctctccttttaa

SEQ ID NO: 48651 - DNA, 1352 bp, Oryza sativa
cccccccccccccccccccccagcctattgcaacacagcaagtcagatatatgcggcaaccaacaagctagctgctctcgctcgatcgatgatggccacaccaccatatgcgcattcttcgtcctctgctactacctgtagcctgtagcttccttttattttcccctcctcttcttctctccttgcaatatatatttgctcctccgatcggtatcggtatgcatgagagagagagagaagctagatagcttgcttagctagaggaaaacgacgaggggacagagacatggtggcacttatgatagagagagaagagagggagagggagagtgagccgggcatgcagagatgcagatgcagtaggccatgcaacctgcctttgccttcatttgttggctcgcctgtttctttcgctacatgatatctcactttcatcccccttctttcagcaccttttgttttccatcatttcggttgggtctcttgccaattaacttaattaggacactgctttccacattgatgcgtgcatatatatattattattatttatattatattcctatttttatacttaattatttattgaccggttctgtctaataatgtggcatcgggtagtgtgtgggttttctatactaggcgattccattacaaaatctattatattattaaaggaataaaaaaggagcctccacgttcgttcttatggtctagaaattctcacattaatgggagaaaaagaaaaatcagagtccatatagaaataccatttagaaatagttgaaattgggaattaaaaaataaggaatattagaagaggagagtagagtccatatagaaatacaatttagaaatagttgaaattcagaattaaaaataaggaatattagaagaggagactagagtccatatagaaatacaattaggaaataatagaaattcggaattaaaaatactggatggcagtacagacagtcccttaaaaataagaaatattagaagtagagtgtatagagtccatataggaatttaaaactaactaaaatttgaaataaaaaagtgcctccacgttcactctcatgacgtagaaattctcatattaatcggagaaaaataaaaagaagagtccatatagaaatacaatttagaaatagctgaaattcagaattaaaaaataagaaatattagaagaggagactagagtcaatatagaaatacaatttagaaatagttaaaattcgaaattaaaaaataaggaatattagaagaggagactagagtccatatagaaatacaattagaaaataactgaaattcggaattaaaaataaggaatattagaagtagag

SEQ ID NO: 48652 - DNA, 1062 bp, Oryza sativa
cgctggtggtggtgcagagggagtacagcgtgcggcgggacgcggtggaggtggaggtggaggtgtcccggttcgcggcggaggagcgcaagtgggaggcggtggaggagctggcggcgggggaggcgctgttcgtggggtcggtggtgtcggtggcggcgcgggccacggagggtccgggatcagggggaactgcgtgtacatggcgcggagggaggtggagttgatcgccccgcacgccatcggcgtctactccctggccgacggggaggcggatgggttggccatctccggcggccactcgctcgccgcggagcctgtctggatcgccccctcgctcgcctgatccagattactccagctgcaacagcaatttatcaatcatgaatcaggaatcgatgagatcgtgttcgatcgtgtgttcgtgccgcctcgcttgcaaacccaacaataattactactccactagctagtagtactacttgagttcacaaccgtgctaggctttgctgtgaacaagtgtgttgatctgatggatgcagcaatttgctgctgttgtcgtcagtctaaatttgtactagtagctgtttgcaatgcaatagagagtgtatcgatgggactatctaattttgcttatagctgctgctgatgcttcatatttcttattgttgttggttcgatttatgttgtcttcttcctcttctgttctccgattgcttctgctctcatcttcttccttgcattccatggcaaaggaaacgaggcacagctcagctactgccaccgtggaaaaaggagcgagaaaaagtgagagcgcgatatgttgatgtttggggcctaatgggctttgtgtttgatatggggccgatgaagttttttttttctgggccgtaacggtggcccatggacattcctctagcagcctagccgcagcgggcgagggttggttggtggaggtggatgggaaacccaagaaaatacgaggacgacggcggcggcgacgattccaacgagaggagaagcgcaaggaggataggcggcggcggcgactgggccaaagtg

SEQ ID NO: 48653 - DNA, 7325 bp, Oryza sativa
ctgcagaggcttgactgtctctcttgaacaattacagtatgcacatcttaattcctcatgccttcttttaacaagaatgaaaaagttggtttttttgagtatgtacatcttacttgttcacgtcttctttaaacaagaatgaacaagttacacagagaacaaagcatcctcacgcgaagcaggtttaaatgctaaccgaaagctcatagtttcacgcacatatagatataggtattcttgttttgtcatcaattgtgcaactaccactgcttcaaaatcaccatctgtgatacctcctgtgaaggactgtctatttcaggtagacggtttttatgagatcgtttgtagtttgcacctttctgatgattgttgaaccagaagtaactacaccttaatggattaatgagcctatatgagatttgagtctgatcttttagaactttattaccaggcaagatagataactttcttcttgccgatataagtttttctcaagctgaattaacaaacacacggttgatatgtgcttttgcaactagcaatttattggtcctattcagttggctggggcctttatggcatttgcaaatatatctattacaccagtactgcttgtgcatcctgtggtagttttcttccctaatgtggccaatcagctgtttccttgtgaactacaaacagttttaagtgaatcatggacagtttgtactggttgtcttgtctgttttttctttggttcatcttttcttgatcctgctaatacactcagaatcacttaagccgaacagataaactgtgctatttacattagcccttctaatgatattactacttctgtaatcatataacactcagtcagaagtacttgtaccgggcagatacactgtgccatgtacgttagccggcctctaacgatctcattggtgcacttatgagcagggatttaggaaagttgatccagataggtgggagtttgcaaacgaaggttttcttagaggacaaaagcatctactgaagaccatcaacagaaggaaaccaactcatggaaacaaccaagttcagcagcctcagttgccagctgctcctgtacctgcttgcgtagaagtggggaagtttgggatggaagaagagattgagatgctcaaaagggataaaaatgttttaatgcaggaacttgtcaggctgagacaacaacagcagacaacagatcatcagctgcagactttgggcaagcgtcttcaaggaatggagcaacggcaacaacaaatgatgtctttcctggctaaggcaatgcatagtcctggcttcctagcacaatttgtacagcaaaacgaaaacagcagaagaagaatagttgctagtaacaaaaagaggaggctaccaaagcaggatggttcgttggactctgaaagtgcttcattggatggacaaatagtaaaatatcaacctatgatcaatgaagcagccaaagcgatgctaaggaagatcctaaagctagattcttcacatagatttgaatccatgggcaattcacataatttccttcttgagaattatatgccaaatggtcaaggtcttgacagctcttcatcaactcggaattctggtgttacccttgcagaggtcccagctaactcaggtttgccatatgtagctacaagctctggactttcagctatttgttcaacttcgactcctcagattcagtgcccagttgttttggacaacggcatacccaaagaagttccaaacatgagtgcggtgccttctgttccgaaggctgtggctccaggcccaactgatatcaatattctggaattcccagatttgcaagatatagtagctgaagaaaatgttgatattcctggagggggctttgaaatgcctggtcctgagggtgtattctctttgcctgaagaaggtgatgatagtgttcccattgagactgatgagattttgtacaacgatgacacccagaaacttcctgctatcattgattctttctgggaacagttcctggtggctagccctctatctgttgataatgatgaagtcgattcaggtgtactagaccaaaaggaaacacaacaggggaatggatggaccaaagctgaaaacatggctaaccttacagaacagatgggcctcctgtcatcacaccatacaggatgatgaggtacaataggacatacttagccaccatttgtcaaggtaccctgggatctcggtaataaactcccacatcatcacctacccttatgtctatgttatgttctatcattttgctgaaacaatactgaaacgtcaccctatatgtgggaggatactaatcttccacctatgaaacacggtttacccgaggggtttacctgcttgtatctaggtttggcaggcgtaagaattgatcaatggtaacttgtcaaatctgtatgatagctactttgtgttgtagctactgatagctttttttttttgttcttgcctgctctatctgattgcaactaacttctggtagtactggcagtctgccacactgtattgattccaaaattaagtaactttgactgtttcagattctggcattgattgattcctgccggtgtagccgaacgggaaagtgagggcacttctcataacttcactgaactcagcaacttatatgatatgcttaataagacaggttgaatcaatcgaagtccttttcaccagtgttatttgaaaacacatttgcatttattctgctgtatttttcctcttgcacaagataagattgaagcatttcttgcaactgataatgtcatgtttaagtggtacaagccgttcatctgtgcactgacctggtagcattagaagccattgttattgaatcatggtggttgcatttttcttgtctgtatagttttagagtccattttccagcattttggtataatattgggaaaagcagcatgggcaattcatcaggaggtgcctttgttttcaacaatgcttttatttcctttttgacttggtaggagtaagagctttgcgtgggtcaatgttttggtaagtagtaaaagttgtggattagtatttgtttgatactgcattaaaaaaatgattgaatgattagtgaaatgctgggctagtttgatttgtttgtcacagggggtgtactttatgtcgggaaaatgtaagcagtcgtcacatgctctttgttttattgtctaccctgttgtgataagataaactcgcgtcgtttctctctttttccttttctctttctctttctctttttttttcgtaaaggatgtttattaggtgccgacccagccaacattttcgtgcagaggaaaaaaggggggaatgaacatcgcccccacacatacaacgagggcaggtagaatagactacaaacaggggtttgtttgggctgtttggaatgcacagaaaagaaatatactatgtggtagtattgtgttaggagaaaattaacggggattatcaatctgtgtatggattggacgatatgcagggtccagactagacactagagaaagggggctttaaaccgcaagtggtttcagatttttgtcaaaaggggaatgcctgcctgctgggacagagattacaaaccccatgtagagtacctatcaacattattatcattatggaatcatcattatagtatagtacaacacatatgtaatgtagtatttgggatgaagggaagcgatggaataatatgcacggtcctggggattaatgtataattagttgtctttaattgaatcaatgcccttgcaatgcttgctttcggtgcgcataataccaacccagctgagcctgaggcagagccaaacaaaaacaaaaggttgagggaaaaggaggtggaaatggaagacagcaaagcaccagcgcatgcagacgatggatggagaagttggaacaagcattatgcattgcagcatcagctgcctaattatagcttaatactgccaataatgatgggatgaatttgcatcatcatcatcattatctcctctacttaactttacagggcagagctggctggaatatattagctatatctatacgaatacgatcatcattcatcaaccacaacaagtacgcatttcgattatctgatctgagttggatcgaacgtactgcagactgcctgcgcgcgggctcactctcaactcccacatgcacacttaaccaccgcaattaattagtagtagcacgtaattcaattgtgaccaaataagcaactggagtacctctgtatatgcagctgctttcttctcatcaatccatcatcgcaccatcactaactaattaagcatcaatccaactaacaacatacttgtaccaatgatcagatagccagatcgacatcaaataggataaaccaacaaaggattacctattgatagatttatagttaatggttaattaagaccacggttataactgttcgtcgtgaagaagcagcagtaacaataaattaatctctatcatcagggggtactaattacagtatgatcgatgtacgcatgtgaaggaagcaaaattaatcaaagaattatgatggagctagagcctcatcatacaatagaatattctaatcaaagactggtcagcttgctgcaaggagacgagcacgggcggcgggatggccgggcctccggcgagggcggcgcttggagcggcggccgggtcgtggtcggacgcgggggcgaaccaccttggactccccccactgccagtacatctgccgctccgccatgttgacgtcgcactccgggaacggctccgggtacctgttggtgtcgtagcacacggtgtagagcatctgccgctgcctgaaccgccgcatcgccatccgcttcctcgccgtcatggccatggtcgaggagtactcgtcgctctccatgaggtcctcctccgccgcggcgcacctgtcctggtcgtcggcggtggtggcgaggcggatgtcggagcgggcggtgcagccgcggaggacgaggtcggagaagacggcggtgaagggcccgcgcttgtagttgaccttgtacttgccgttgtcggtggcccaggtggagccgtcccagatggtgacgtagagcgccatgggcttggaggggtagtcggcgcccatggcggcggtgcgcgggacctcgcggatggggacgccgtcgacgtagaagacgatgaggcgggagtgccagaggatggagaagcggtgggcgtcggcggttgggtcgaacggcatcagatacctctcctcccgcccacggtccgtgctgccattgccgtacacgttcgtctgcatcttccactcgtgcctgtacctgttgcccaagaactcgaagtccagctcgtcgtgcgtcttctcgaacacatctccattagacagctgcatgcatcaccagcaatcaatacatatatcgtgatcaattcatgcatggtttgatcgatcaccgagctagaatgaatgctagtaatacgtacgtagaaggcgacgactacgccggcggtgtggtccttggggagcttgatggaggcgctgaagaagccatggtggtagtagtcggaggagatgaagccggagccggtgtagcggttgagggtgatgctcaccgtgcgcccgtcggccgacttcaccatgttgtcctccccgaacagcggcgagaacccctcgtcgaacgcgatcgtcggcacctcctcgaaccccgacgccgccaagctcgccggagctaggctcatcatcatcatgcacgcccacagcaccgccagcaccgccgccgccatggaggatcgatcgattgaggtgcgtgggtggatggagtggagaggaaagctagctagctaggtagctaagcaacaagagtagagggcggtatgaagtggcgggcggaaagagaaggaagacgacgtcgccaattggagttggtcggatgccatccatctatatatgctgcgtctctgtcatgcccaccgtcgcaagagaaagaaaaatatgcgtcttctttataccatttctggttaacaatgatccaatggtataattagtcaagtttatcataccatacatacatatgcacatgtatattcttccttcctccacttcaagagtagctagctacgctagctttggttgcgtcatataatatttgtgagctcatgagatgcatgattaattacttgtttggcttaaagtttcatgaggtttgttcaccaggagttactatttgtataactgaataacttggatacaggctatgtctctatcatatcatatcgtttaattttgggattcaaaaatcgatccatcagagattactcttcagtcaatataatcgatcgatcgccagcgaggcttttaaatacatactccatcaattcatctgttgtgcagtcgccgtctttcgtctctccatcgctccctgtcacgtacttacgtgtactgcacttatctatataattcaagcttaattagctagctcctctcctctgctttttcttttcatctcaaatcatttatgagaaaatacgtatacacactacgcacaggttagttattagctagcacggcagtgactgctctgctcatcacaaaatttgatcgataaaaatctatatatgcaagcagacatgatagtcgaaaactaacactcaaaacacacaaaaagatcatatgtttaatttcacccatagagttggtaagctacctacttgctgtagtcctcatgaactagttaatttaatttggactaaacatatgctatacttgggtacctgatcttaattagcggtacctgatcttaattagctggacacatattgtgaaccaattaatttgtggtggtggcttatataattccctaataactgaactgtgtgatgaattagttggactgatggattaaaggcaagtgctagcaaagtgtacatattcttggatccttgaattccctggatgaaaggaagggaaagcagattgatcgattgacaaggaaagaaagggaaccttacctaccgtcacgggccacgtactgacgtactcctactcactcatggaactagcttaatttgcttgatagttcagtacattattaattattaacaactaattaggtggtgtttggaacggctgtgcgaatactacacatacaagttaattaatctttctttcttgcttgcattgacccactgccatagcagccatgcaaggcgattgattacgatttcagagttgttatccatatatatctgcagtttgaactagtagtttctatgtcacggctacgaaacatatctgttgtctgaacatggcaagg

SEQ ID NO: 48654 - DNA, 2593 bp, Oryza sativa
aaaatataacgacttctgaagactcaacatacccaacctcacaagtagttaatttatcccgctggcctcaccttatctgttggtgataattaatctaggagcatttggttgcaacctgcgcaatcagataaaaattaaaccacttattcatatggcatgtgggttcgttagccaaataaccagccagcaattaagccttctaatgagaggacaaaattatgaacagattttatttttcccctcatttatatgtgtatgtatgtatgaaacaaactaatcatacacggattgtaatgcagctagctagctaagctagtgcttgtttatcattaagctgcatgtgcggttagttcagtctataaatattagtcacaactcttccttcatgtagttcttccttcggtatacatgtatgaattaatgctcatccaaggctcagattaactaacaaatatatgtttcagtttccttctcggcgagcgagcatataaattatttattccatgtcaatatgtatatccacttcaaatggctcggcagatgaagagatcatatgtatggcatcaatgtaaagaggatatataaattgaaggaggaagtagaagccagcataaatatatgactatggccctgtttagttccccacaaaaattttataccctatcaaatcgaatgtttgaacacctacataaagtattaaatataggctaaaaaataactaattacacagattgtgactaatttacgagttgaatcttttaagcctaattgctctatgatttgataatgtggtgctacagtaaacatttactaatgacggattaattatgcttaataaattcgtctcgctatttacttatagattctgcaattagtttttttattagtgtccgaacaacccatacgacactctatactatataatacccgatgtgacacgtctaaattttacaccctggatttaaacaccccctgtacagcagtacatgcatacacctataaaatgcagctgaggcaacaattgacggtcgtacagtagtagaggccagtgtatatatgctggcatttcacatgcgcaggcatgtagtaggagtttgcatacgtacgtacggtggctgtataataacggatgtgacggtgcaaccatcgacctgattagctgattggttagggttaggtatacctgcagactagtactagcattgtaagctctaggttgtcccatacttacatatatgcatatatataaggatcgatataaatttatatgttttttgacgaaatatatatgttcaataattcagccaaatccacctctaaatttgatcagctcaccgaaattatatacagtactagctaggtgctccagcacaaaaacattcccctgacatgctcaagttgagaatatataattcacattttgttagttggttgcggatgcgcatgtggactggttcgcggttctatccattaacagacatatcatttgatcaggtgataatttataaactttgaattatactacctctgttctaaaataagtgcagccgtggatatccgtatccaacatttaaccgtccgttttatttgaaaaaattatgaaaaaattaaaaaaaatagtcacacataaaggttctcatatctgcaactcgcgattttcgcgagagaaccaaatccaagttggtgaagatcatgatttacgctggcatagtagtgattacctttgcaattgcggttcgaatctatccgatctttatctttttgctcaaagaacgaatagaaccccttgtcgaagccctttatgataagcttccctggatctgggaagtttctctttcacggtattgggatcgtttgatcgatttccttgatcgctacttatgggcgtgcgctcaaaggatacaaacagggattcgcaaacaaaaaggggaattcgtagtcactttttcctctcgcgtaaaaaaaaggctttacgcgagagcaatagaggttgggatacatctatctcttctgagcaacctcttttggattcttaagaccacccttgcagtaggataccgtctgctttgggttctttattatattatctccttcgagggatttttaggatcgttcaggctatatttagtctattttggcttttactgtctccttttctcagggaagtggttaaggacctcagaagatagaggagagcgccaggcgcagatttccggaatacttctacggggaatgctcattgaatggcattctccgtattatgccttgaagaggactcgaacctccacgctctttagcacgagattttgagtctcgcgtgtctaccatttcaccatcaatgcatcttgaaagtgaatcatattccatgaatatgatatctatctaatgtgatatcttgaaagtgaatcgtattccatgaatatgatatctatctaatgtgatatatggaatatatgacaaaggtggagtcttggagtatttcgatcggtcatataggcctgagtcagacatcaaatagcttcgatttgcattatccgtaggacaccttatatgtatcaaaatcaaaaagatatacaatccaatttctcgattc

SEQ ID NO: 48655 - DNA, 2889 bp, Oryza sativa
ggggatttttatgtaacagagtatcctatttccataggctcgaatgaccacttcttataataagaatgtgcacggtctggtccggtatggaatgaacttataatctgatgatcgagtcgattccatgattataagttcataaccctagcgcccattcccattttgggcggaacagatctactaattcttttattccagttattaagagggatcttgaactaagaaatagacctagcagctaaaagagggtatcctgagcaattgcaagaatggggttcattgatattcctgatatagtagatgctatcacacatacagtcatactcaattcgatggaattgtttgatcttaaaggggatcttctataatttcgtacataaggggttattttttggtttcgtctagtcattaataacttgactatttttagataatagtagatagaaagaacgctcgtaaggagtcctattgaaaccaatattatttatgttttatcatctaataacaataaaaatactaattataattttttttaaataaaacgaacggtccaatgttgaatatgaatagtgcaaaactacacttattttgaaacacagggagtatataaaacagccttgaattttatatatatatatatatatataactaattttctgtcttctggaacgcttgttttacagctgacaaagtcaaagaaaaaataaacgaagcaactaaaaataatttatacataaaactcttatataatatccttagtgatttgactcggtttaaaacagattattcatcagattgtagttgtaaattatctactaaattgtatagataaattaaatattttaatatataaacttaacaaataactcaaaacaaatagtaaaaaaaaataagaatatgtatttttcgaatggtatagtaaataatctgtttcaatagtctaagtatataatctaaaaagcctaatactaatagaatataaactgcgttaaagaaaaccttaaattaacttaaaatcaagttttaaaatttaaattctagttgcagctaataagccaaaacgcaaacaatggatgtgggtagcatcagatcagcccatacaagtttttgtcaaagatttctgcttgcgtggtaggtgcatgaccaaggctgtggtaggtacatgatcaaggctagctagggttaaccaaacaagattacctcacctcacggttaccatgacaacagcgtggtaggtatatcggggtttcaaaaactaaaaagctcaccacatatgataaccacgataaccgagcggttttgtaaacctagatcaaggctcaagtggtggcttccatttcatggaacatgctgcaactactacctagcattactaagttcaagcgaggccaccccaggatcagaatgaaggcaatggtgtacacaagctgcaagaaacgggaaggaaatatccacaggagatattgatgaattcaagccgcagctacatttgacggcggaaaaaacaacactacagccggtagtcgagaataccatgcatggttatacaaccaaacaacatgttgtcaacaaggaagtttagactagttttgtttgtcaagagttaaagtctgtgcattacggcacaaacgttttacacacatttccttgagctctctttgctcaacccgactcctccacagcttgttatgtcggcaaactgtcatttttaattacggactagcacctcctccccttccaggtgctcttggcgcttgttcagttgctgccatgggtggcaactgcggcaggtatcaatagtaagtaaaaacatatgtttgaataatatagtggaaattagtaaatggtaaactcaaacattagacggtatgaaacaatgctacggattccatgctgcatactaagcatgatatgtggtcctttggggaaaaaaatcaattagctgattgcataattccatgtaccacgcttcctcaaatatacacagcaggcttcacattgagtgaggatggaggacttcaaatcctaagtgaactgtatacaaagagttagcacagtaaaaaagaagtaccttctgctgaagtctcactactgtagaaaccaaaagcttgtcaccaacaatctgtctcagctgcttcactaggtcaggcctgcttatctttctcctctattttaacatcaaaaaccataccataattagcatgccagcaaacaaatattgcatgtagctgaaaatttccaaaggaaggacaaataaccttgaattcttcataatatttatgcaccagatccatgtccgaacggggtactttagcggaaatagcagcaaaaagcattgaaaagggcatccaaggtgaactaggagaccttggacttggagcacgcccaagcatacatgcttgttgttcatcacctgaagacgcaatggtctgtagactgtcatcctgctcacaacaagcaagcaacaaattaacaagatgaaatttttcctaaaactgtcatcaaaatcaaggtcaactaagctcgcccattaagtgccaattatcaatcattcaattgtgaaccagtttttcttttagaaaaatcaaccggattagtttctgcaaattatgaaaagcagaggaattgggccaacagaacctgaatccatttcagtaaatttcatttacatccaaagagcatcagcaagaaggaaacacataactaagcaaagttctttgatcttcccgcccccatcctacaccactaccatatatgatcagacattaaaaggtactaatcaacaacaaaaatgaagaaaaatatgaaattccatcaccatcaagtcaagaaatacaagagtggaattcaataaggatctgccataggccataaccaaaatataaagag

SEQ ID NO: 48656 - DNA, 17706 bp, Oryza sativa
attggcttgcttatggccatcacagaatttaaacaaaccatctgcatgaagtccaacaggatgtgcctgttctggaatactgcactagtaattggcctcttcaactggaagctctgctgtaccgaattgacacatcctctgggaagtctctccatccaccatgttggtgagacatcacacgaacaggcatcccgcttatcttgaagttattgtacctctccagaatgtcatcggcagagcacatcatcttggacttcttatgtccagtcgaatcaggaaataaagcgagattctgttttggaccattctgagagaggttgggggcgtcattggcctcagcacattgagtagcacccacacgcttcctcttgcggatagtagaatccagcacatgttcatccagtgcaattgcattctttggttccattttttttttttacaaaagactcaactaagactgggtattcattttctttacagactaacaccactaagtgaaaacagttaagttaatctagctaatgagacctagacaatgttagcatagaggtagttccgatataagccatgctatccaaaagagtaagtgaaatacacctgagaccaagaggaaaaaaaaaggaataaagatggcataaagatgtatatataaagagtacaagagacaggcaatatttaatttatgtctggaacaattatatattcttgcacatatcattcatagccaacccacgagattctagctaaaacctttgtaccacaggtgaataaatttgacgcaggccatacacctcctcagatatcaacagaaaagtataggccgtttattttccaaaaaggatacgacaaactatgcttgtaaggctaaaatgttgactaactaaaacaaaagataagagaagatatataaatcttagcatcaattatagaaaaaaaatacgagtcctgttatactagatggacatcatgttaaactactgtgaccacctagcctacgagaacactagtcttagagatcagaaagcactccagactgaaagcaattaagaacatggaaatcttgtcagccatagtttattttctttaacaaaaaaaaagtttgatggatggctattttaactgaaaaaaatgtttcttcaggacccaactcatcaagaaatatgataatagtgcatcaggcgttttacatggcaatcatgttatatttcttaaagcatacatcctggttgagtgatgcgaacgttaactataaaatcaattcgtttaaaaataagcccccatggagggcataaaattaaactcctttgttagtaactcgctattaaaggagctatacgattagcatgtatggtactcatcattgttggcagtaagtataaatctgaagaggggaaggagatttttcggcatgctctgaaatgaagggcacaattaattgtgcttcccgccaccatcagtcgaagcacaacttctgctggtgtggctggttggcacagaagaaggcggcaacagaaaataataggagaagaagataacggtgctccagcaacaagaagaacataattccattgttggccatggttcctccccacggacattggtggagaaaccaagatgaaggccacaatacgatcccatggcactggaaagcacgtaagcacatccatcacacgagttgtgaatatagtagctggatgatgaccgatgaaccctgacgcacaaagcttgttatgccaattagataagcaccatccataacattgagtaaatcaaactcagtttgcaatggtttgtttagcaagtgatgaatgcggatttggtttatttatggcaccagcagtacaataggtgcagtaatgggggggggggggaagatataatttttattagggcatgtatgatgatttttagtataagaacgctccctaaaccgccgaaacatgaaacatgtaccttttagatgacatgtaatgagtgaaggatgaagagaacatactagcaacacagggaactagcagttaacatccaccaatcgaggttagatcctagagtcacacaagaaattaaattaattgtgcctagaaaaagatattggatgcatatgcctgtgcagtctagagccccaatcaacatggatcatttcggaccatacaagaacaacaccaagagtatatataaagaaaagaaaagaaaagaaaaacctagaacgaatcgaagccaagccctgaagatgatagtagtaaaataacaagagatggagcgcacaagagagagaggaaggtgggatcgggattagcaagcagtaccggtaggaggtggtcatcgcgtcgcgggtagagatagaatcgatttcgatgtggttgaatcaaatcgaaaggtaaaggaaaccagatagagatcgataagggtggtagtagagagggcaggataggccttgtaaagaggcgaatccaatcccgtgggccggcgggagggcggcggcggtgggggagatattccggcgggcggcaatcctagccttgccttgcctaggggcggaggaggaggattccggtgggcgagaggaaaggagaggaggggagggggaaggcgttgtgtacgaggctggggtacgtatagcaactgcgccgaataggggaggccgcgttcccgttcccaccgtggtgtgggctgtgggcggtggagatcggacggtggaggacgcgtggtgtgtgggtgggggggtgcgtgaagcaattttggaattttctttcctctttcttgcacaagggggccgtggacttcagttgcagccccagcagcatcatgtgatgtgatgtgatgcgaccctctctctctctctctcatcttgtgacgtggcgtccgtttcctcctcctttcccaaccttatcgcctccttttctttttcacacccctagcactctcaaaacagtcggtaaaaaagaaaaaaaaatagcataaaaattcctcccctcttcgctagaaggcagcaagtgtcactagtttttcttcgatatgtaacaccctcgttacgatgctatatagagagaagcaagagcaaatagtcttttttgcttttcatcccaacttacatgtataaatggtaaatgtgacgagggtgttacatatcgtcctcgtcctccgtcgccaaaagttccatgttagccaccaagtcctctttgccctcgccagctacgtctccgcctgccaatctcgacacctcctctctatcatttatgtctacacagacggctggatctacgaccctcgtcaccaacaccgatgctctcgcccctatcatcggtctccacctgcagccccatggacctcagctcctccctctcgcctctgggtggtgctttcgtgctcgaaaccgttggcaccgctccggggcatcaatctctaacggcttggttgacaacgatgactactgcttgtgaggcgcggtggggctacaactgcagcgccagcttgcaagtagcttgaccgagcgtgacagcaaagcacagcgactactgctcatgggttgcttattgcgcgagggctgcaaggcgctacggcttggtcattagcggcaatgactagcttgaccgtgtgcaacctatcaacatgcacgagggctgagaggctcagcgggtgacaacagcgactgcttggtcgacggtgcatagagcgagggctgcaaaggtagagcagaatggtcgttagcggaaaagactggcttgacgtgtgcaacctatcaacacaagggctgagagactcaatggggtgacgacggctgctacttgctcgacggtgcacagagcgagggatgcaaggcatagcagcttggtcgatgacctggtcatgtaagaggaaaacgaagggtaaaataattcgaggataaatttctttactctaatctaacaccgttagcttaaaatgtgatgaaagtgctacgtatcgaagaaaaaccggtggtctatgcttctagttgaagcaggaaacttaatgcgagtatattttttaccaggttgtttagttgctatggatcgaattttttcgtttttctttttcctttttcagtcccactatactatagtaagccagcccacttatgcagagcagatggaaggattaattgttgggccggaccatctcatagaaagaaagaaattccagcccatcctaggtcgatccgcttgcctagcttgtgtccctgcctgccaatcaacacaagatagctcaacatatattgtgaatgaagtcaagtggacagtccttcaaaatgatatatcgatcggcttcgcaagttgtttggcttatggaagtcgttgttcatgcatctaccgatcgatcgagatccatgattgcttggatctgtcagatatatggtagatctcttcaggatcgatatgatatatatacaaacaaacatactccatatgcatgcatgcatgatgcatgagcggatcagtcatcagtggtaacaaatcaaactctgccactttgccagctagctgctggccgcgctgcatgcctgacacccaaaactttttagattgttgtactatataattgtggtcagagaagttaaataaaaatttctcttagaaaaataaattaattttaaaagactgaaggcttaaactgaaaagccaccactctcttaactaaactaatacggatcggagtattagtcatcagatccaatgtgaaattagtacggggctactcgtcatatcactgccctcactacgcttgtgcgatcgagatcagtaaattaaagctttgaagtcagtattgttagttgtgccatctgcattatgttgggggtttgcagtaaaatcgaaatgaatttgtttttgataaatcttatgttagattatatatgcaagtactttttataggtgaccatgcatattggtcttttgcggttctagctagctaggccgtgttgcaaaggtgtgaagggaactagcaaagaatgtaagatatatatgccgttatttagagataatggtcatgcaatttttgccaatcatggatacaaatttaataacaggattttctttaataatatattgttatatgaataatgtcgggattatattctttaaatttgtgatgcagcggatatggcaggactttcacattatttttttttaaaaaaaacactaactagctagctagcgtatgaaatgagccgacagcgctaagtgttaattactttctcaatagtagtacgtgttgcgtgtgcatagagacgaagttgtccttgtacatcctttcattttattttatttttgaaaaattaagatgaaaaacgtcctctgatcctgtagaaacagtagtcgatccccatggtgtatttttagcaaaaaggatccccacgtacgcatggtgtgtagattgtggccatgcattattaacttagcactgcagactttcgtgttgtctcatacacatgatggtagaacagtgccatgccatgtactcgatccccaccataaatatatgtatgcatcttgcattgttttgtttttacccacatggctttatatatatatcttccttgatatatatatatatatataatctagggatgatgcctggtacggacatatatggaaatgatagtaaagctctgtatacattgtgataaaagaattactggacatatgtttgcaacaatatcgctatagtttctacaggaaattgtgcagtgctcgtgagggggaaaaccagggggcccttgctaatagacgaccgattattaaaatcggaatttctagtatatgcgtctacatactttcaaagtactgtttggtctccgttgaatagattcatattggttgtgaaaaattaagggacaatatataagtgggtgagcccctcgctaccttttagggtgagaaagaccatttacgatcctataatgggtatcagagcctggctagtttaacatctctggctcgagggacatacgtgtaaagtcctgatggaccgtgtgcctgcgggacctgtatacctgagggaccataggaaaacggtgaagggttgagagacactaatgtgtaaagggaaagattgttgaataatcccgcattggttgtgaaaagtgggggagcccctcacctcaaccctttacgatcctatacgatcctatactttacaatcctatactttcttcgttctaaaagattttttttaagttagtctaatgcgtattagaatgggtcgaatgtgcgaatatgcctttcattaagaattaatggttctcctgtgctttgatatgctcgcctagatttttgacatgcctaagctctaactaattaatgatgtttacgcctgacggtttgaggtaggtgatggtgtgttctctatctaagagaagagaaatgaggataacacaaagagggcgaatgcagacctcatacctaaaattaatgtcattctaggacaaacgtttgagtcgtgaaatgaggtatttgtggctccgaaagggatcgtaacactacttacacttacttctcgagtaaaatacatggccggtccctaaacttgtgtggtggtgtcacttaggtctgtaaacttgaaaattgcacgtttaggtccgtgaacttggtttaatgtaccaccccggtcgaaacatcctttgactatgtttgaccgccaacgtggcatgccacgtaggcaacacttttgctctcaactccctccacatcacaacacgtcgcatatatctccttgtagctattcagtgacaccaaaatcccccccccccaaaaaaaatccttaaattgttcttcactctcaattttctccttgtatgtatagaaaatgtggtcctgattatcaattgccattgctctgcgctccaaaatgacattatccttacacaacgggcacttggtcaacaacaccttcttccgacgacttcaagacaaggacgagcttggagaatccatggggatgcgtagtgtgcaagcggcattgcactacctccggccgctaatccgaccgcactgtgccaccgctaaccccgctgcaccacgctgcctcctgccgctaatctcaccgtcgagtccgccacagccactacctctcgacctccttccactaacctcaccgtcgaaaccttagccgatttagggatattttaggggatttgggttgaaatgcactgattagggaaagttatgtacgaagatatatgtggagggggctgagcacaaaagtgttgcctatgtggcatgccacgttggcggtcaaacgtggtcaaaggatgattggaccaggtgtggttcattaaactaagttcacggaactaaacgtgcaattttcaagttcacggatctaagtgacaccaccccacaagtttaaggaccggccatgtatttcactccttacttctatgtagttaagacaatattattttctgttttggatgttttcgggctatttaacaggacccatcccctgaatcattgtctagtgaagctaaagccaaactaaacaccattaaatttttaatatttttaaagagcggtgtaggtgaatctactgggaaaaatacatggaaaagtaaatcacgaccttttcctagcttcacaactccatatccattttttatttggagctctatcaaacatatcctttctttgaaaaatactgagcaagacgtacatactcatcaattaaccctacttattaattgtataaggtttttaagtaaattaagaatgaaaataatcttgattgattaattatgggagtaatatttaggttgtgttcgttctagtagattgagatttacctcatttttcctgctcacgttttccgaactattaaatagtgcttaatttgcaaaaattactttagagaagttgctttaaaaactcatatcaattaatttttaaaatttaaaagaattaatactcaattaattatgcgctagcttatcttctcaatcttttcttttcccctactcacaaacactctcttagtggcaggagggtttcggtagggcccccttgaatcgcatgaataagaaaacataggaataggaaaaacgttggattttgataggaacgtaagtgtaaaatagagatagcaaaacacaggaaaaacatagaaattattgtttgattggaccgcaggaaaaacataggaattagaggagagataaagactcgaaggaaagtttccataaggttctacctcatgttaaaattcctccaaaacttgcatggcattaggcactccataggaatttcataggattctataagatctattcctttgattcagagggctatataggaaaaatttctataggaatgaaatcctctaaaatttctatgaatttcctttgaatcaaagggggcctagcgcgcgcccacacacacactgttggaattaatatatgggctaaggcccattcgaagattaattctttagaaaatcacaaaagcccacctcatgggatggcatgcatgtggagtttagtaccaccttgcttattctaggagagggggacctccttaaaagggaggatgccctcctagccacttgaagcatgtgtggtggagagaagagggggaacacgcgctcgctcgcctcgcctagcctggcagggcaggtggcgcgcgtgcacgacgtacgcgtcgaatggtccgcaaaattggctcctcacccttgcgcagatgcagcctccttttgcagttttgttttgctgcaggaaaattcggatttgttttgttttggaaacactccgaaaaatccggtgcgtgaaaatggcgtggagtccggataagttacgcgtgacttatccggttcggttgtgcggagtggagatcgtgcgggcgccctgatcaagcgacctatctctatataaactgagccgccgccttcacgcaaaacacacgaaatcaatctagggtttgcctcctcctctgtgctgcgccgtcgctcgtagactactccaccccgctcgctggcgtgcacctgcgatcgggagagcaggtctcaggaacctctgccttcgacgtcctgcaccgggagaaggcggcaataaggtttttgggaagcgcttcgcgcgactgctcactgttcgtccacgacggctcgccttcctctccgctcgcgtgctgcgcgccttcgtcgacgctcgcaaccgcgagtagttcctgccgagcaatcggtctttccgccacctcggtacgtgttcgacatgttgcgcatatttgatctgttcatgttttactgcttagtttacatgtgtagatctaatgatgcgttaatgctagtatacatctgtaatgtcatgatttatttatagaatatattaaatcattatatgtctatattctcaacaatccaaaaaccttattatacgcactgtgattttactatggctggttttgccgatgcactgaggccagataaatttaccggtgtgcactttaagagatggcagatcagggtcactctgtggctgacagctatgaaatgcttctgggtgagtactggcaagcctatgggcgttcttaatgctgatcagcagaaagaattcgatgaggccactactctctttgtgggatgcattcttagcgtgcttggcgattgtctggtcgaggtgtatatgtatatgaccgacgctaaggagttgtgggatgcactgaatactaaattcggtgctactgatgctagcaatgatctgtatatcatggagcagtttcatgactacaagatgtctgacaaccattctgtagtcgaacaggctcatgagatacaaaccatggctaaggaaatcgaactccttaagtgtgtcttacccgacaaatttgtggccgggtgtattattgcgaaactacctccatcttggagagatttcggtactgcactcaaacacaagagacaggaatactcctttgaggggttgatagcatctcttgatgttgaggagaaagctcaggaaaaagatgccgcgtctaagggcgatggtgggcagtccactgccaaagttgtgcacaaggcctaggacaagagcaaggggaaatacaaagcttagaagaccaccaacttcaagaagaagaacaacaacaacaatcctaatcaggatgagaggagttgctttgtgtgtggtcaacctggccatctggccagaaagtgtccacaacgcaaggggatgaagacacctgcagggcagacctctaagtttgctaatgtgaccattggcaacactggagatggaagcgggtatggtaatttacctactgttttttcagttaatcagtctactaattggtgggttgatacaggggccaatgtacatgtttgtgctgacatctcattgttttcttcttatcaggtcgcacggggttccaccgtcctaatggggaatgggtcacatgcttctgttcatggtgttggcacggtagatctgaagtttacttcgggaaagatcgtgcagctgaagaatgtgcagcatgtcccttctatcgacaagaatcttgttagtggctcccgtctgactagagacggatttaagttggtttttgagtctaataaagtagtcgtgttttaacatggatattttattggtaaaggttatgagtgcggaggtctgttccgcttttccctttctgatttctgcaataagtctgtgaaccatatttgtggcagtgtggatgatgaggctaatgtatggcactcacgtttatgtcatattaattttggcttgatgtctcggctttccagcatgtgtttaattcctaagttttccattgtcaaaggttctaagtgccatagttgtgtgcaatcaaagcaacctcgcaagcctcacaaggctgctgaggagagaaacttggcacctctagaactcctacactcagatctctatgaaatgaatggggtgttgacgaagggtagaaaacgatatttcatgacgttgattgatgatgctactagattttgctatgtgtacttgttgaaaacgaaagacgaggctctatactattttaaaatttgtaaggcagaagttgaaaatcaacttgacagaaagataaaaagacttaggtctgatcgtggtggagagttttttctcaaacgagtttgacttattctgtgaggaacatggcattatacatgagaggacgcctccctattctccctagtctaatggggttgctaaaaggaagaaccgcacactgaccgacttggtgaatgccatgttggacaccgcgggattacctaaggcatggtgggggaggcattgttgacctcgaatcatgtgttaaacagagttcctaatagaaataaggacaaaacaccatatgagatatggattgggagaaaaccatcactttcttacttgcgcacatgggggtgcttggcgaaagtcaatgtaccaataacgaagaagcgcaaacttggacctaagactgtggactgtgtctttctgggatatgctcaccacagcattgcctatagatttttaatagttaaatctgaggtacctgacatgcatgttggtacaattatggagtctcgtgatgttaccttctttgagagctttttcccaatgaaggatacacatagtagctctagccaaccctctgaaataattcccagttcaatcacaccaccagaaccaactgaacatacacatgaacattttactaaggaggatgacagtgaagcttctcgaaggagcaaaagacaaaggacggttaagtatttttggtgatgattcactgtgtacctcgtggatgacactcctaagtcaatttcagaagcataagcatctcctgatgcagactactggaagaggctgtccgtagtgaaatggattccattatcgctaacgggacttaggaggtgacagagcgaccctatgggtgtaaacctgtggggtgcaagtgggtgttcaagaagaagctcaagcctgacggtactattgaaaagtacaaggctcggcttgttgctaagggttatactcagaaagaaggtgaagatttctttgacacttactcacctgttgctagattgaccacaattcgtgtgctactttccctagcagcctcacatggtcttcttgtttatcaaatggacattaagctaattagaggtgagaatgggattacactcttgcagtcccattatgtggagaagatcttgaatcgttttggctacattgatagtaagccttctccaacaccttatgatcctagcttgttgcttcgcaagaacaagagaattattaggaatcaactggaatactcccaaatcattggctcgctgatgtacctggctagtgcaactaggcctgatatctcctttgctgtgagcaagttgagccggtttacctctaatccgggagatgatcactggcatgcgcttgagcgagtaatgcgttatctgaaatgtactatggaattggggcttcactattctgggtatcctgcagtactggagggatatagtgattctaactggatctctgatgtggatgagatcaaagccactagtggatatgtcttcacactgggtggtggtactgtttcgtggaggtcttgcaaacagactattttgacgaggtcaaccatggaagcagaactgacggcactggatactgctactgttgaggcagaatggctgcgtgatctattaatggatctgcttattgttgaaaaaccagtgccggctatccttattgtcggtgatatgggaccgggagtatcatgaccagaggcttgaggcagacgcaatcgcccacgtggcctggcaccttcggggacgtcgggcccgagggtgaggtgtccgccctcctcctgatttcccccgagggggggtcgggttgcgcttgccccggccccgagggccgagggaccccgaccccttaaggaagtctgcgccacatatatgggataagtgagcacagctgtgctcacctaacagcatttattgcagtctggtcaagcgtgtcacgctgcatgcaacgcagtacagcgcgttcctttatccggtctgtgaccagtcacagaccggtcagatcacgggttaggtggcggctggcggtctgacgcacgccttgccccatcccgtcaagacgaaagcctctaggcactcgtctcaagccggagctagggtgttatctcttagagatggcacgttagccctggtcagatttataccaggcttcatcctaaccattacaggcaaggtgttacacgaagaagggcaaacatgcacgttgttaagctgacgcgtggtggacaagaatgaccggtctggcactggtcgcgtcatcgacagacagccacggtcccgcgtcatctctgtcttcgggggaggtgggggtaggtgtgggttgtcccatcagaagggctcccggatggaaaccgtaccgatctccgcccattaaagagaaaaagaacagtccagtttggaaagagaaaggtgcatgtggtatccccttgagatataaaaggaggaccttgcccatttagagggggactttttcccttttggaaggctgaggggaaagggagttaatcctttgtaacttgtccatacacaaatccacaaaaacacaggagtagggtattacgcttcgcagcggcccgaacctgtatagatcgccgtgtctcgcgtttcttcctagcaagcgatctttccacatacagagagagcttgagatctcaccctaagcccccggccgaaccggcaaaggggggcctgcgcggtctcccggtgaggggccacgagctccgtcatctggcgcgccaggtagggggctcagcgtgtgttttctgagctctcatactcttccgtgtgcgccaagtttcccttgttctgcctaatggccgagcaagcaaaggcgcacgacctctctccgagtgtgagcggcgacgacggggagccaaacccacgccgtcgagctcgtactcccccacctcctccacaccaaaatcctaagcagggggaggcactcgagagagtcgaaaaatccgcagcatcgctagtcgcgggtggtgcaggagaacggcgagatggggagcgtcgcctcctcgtctacggtgacggcagcacgcctcagggcgcgctccaggctgttggcgcgctcctacgtcacccgcctgtcgtccctgacccggagtctccagcccagcgatggctggacgacgtggccaacttggtcatgacggcacagcagcgcctgggtgctggtggacggtccgccaccaccaagacctccggcgccgccaccaccggttccgtgtcatcaaggcggagggcgcggcgagcggcggcggctgcacgtcattcggctgccactccctcgtcgacgccttcgactcgggaggatcagcatggggagccggatgcccgcctcaacatcgagcgccggcgtaacggccggcgtactccccgtgcaacggagggcgcctcctcgtccagagtgtcacctccacatggacgtaaggaccagccctccgtgcccccggttggtggtgttggctgtagagcctttgtggcgagtcttcggaatgtccgttggcccccaaggttccggcccaccatcaccgagaagtatgatgggagcgtcaaccccaccgagtttctccaggtctatacgaccgggatcgaggccgctgggggagacgacagggtcatggcgaatttctttcccatggccctgaagggacaggcgcggggttggctaatgaacctgccacccgcgtcggtccactcctgggaggatctgtgccagcagttcaccatgaactttcaaggcacttatccacgcccaggtgaagaagcggacttgcacgcagtacagcgaggggatgatgaatcccttcgctcgtacattcagcgtttctgccaagtccgcaatactataccttgcatccctgcacacgcggtgatctacgcgttcagggggggtgtgcggcataaccgcatgctcgaaaagattgcctccaaagagccccagactaccgcagagctttttcagctcgcggaccgagtggctcgtaaggaggaggcctggacctggaacccctccggttccggtgtggcagcttcggccgcccccggatccgccgctcagacagggcggcgtgacaggaggaggaagaaaaggtcggtccattccggcgacgagggtcacgtcctcgccgtcgagggcgttccgcgggccacccgaaaggggaggcctgcgagcgacaaaaagaaagaggctggtactcccagcagggagcgcccagccagcaagtggtgctccgtccacaacacctccctccacgatctcgcggattgtcgcgcagtcaaaaacttggctgagcgaacgaggaagtgggaggaggacaggaggcaggaacgccgtgagggcaagtccgcggcagttccctccggtaaacggcgaagtgaggccaaacagaaggcccccgccgttgacattgatgacggtgatgatgacctaggtttccaggaacccggggccaccattgccactgtcgacgggggagcgtgtgctcacgtttctcgccggagttttaaggccatgaggcgagagcttctggccgcggcccctactcatgaggcgacgcgccaggcgcggtggtcggaggttgccctcactttcgaccagaccgaccacccaccgtgcgttgcccggggagggcaagattgcgatggtggtttccccccccatctgcaatgtgaagttggggcgtgtcctcatagatggaggagcggctctcaacatcctttcccccgcggcctttgatgctatcaaggccccggggatggtgctccagccgtctcaaccgatcatcggtgtgacgccggggcacacatggccgttaggtcacatcgacctaccggtcacctttggtggatcagccaccttcccacggagcgggtgaacttcgatgtggcgaaactcagtctgccctacaacgcggtcctggggaggcccgcgttggtgaagtttatggcggcggtccactacgcctacctccagatgaagatgccgggccccggtggccccatctctgtccgtggcgaccttaaagtcgcgctcgcttgcatggagcagcgcgcggaccacctcgctgctgcgaccaagcccgagggtggtgacgagaggcttggcacctccgcccccaccgccccgaggcagcggattgccacatgcgacgaggtcccggtcaaggaggttgccttgggcgacggcccatccaagaccacacggatcggtggtcttctggatggcaaataggaagacgcgctcgtctccttcctgcgggcaaacgctgacgtcttcgcatggagaccagcggacatgcccggggtccccagggaggtgattgagcaccgtctcgccgtgcggccgggcgcaaggccggtccggcagaaagtgcggcggcaggccccggaacgtcaagccttcatccgcgaggaggtggcgagacttctggaggccggattcatccgtgaagtcatccatccggagtggctggcgaacccggtggtcgttcccaaggcgaacggcaagcttcggatgtgcatcgactacaccgaccttaacaaggcatgtcctaaggatccttaccccttgcctcgcatagatcagatcgtcgactccactgcggggtgcgaccttttgtgttttctagacgcatactctggttaccatcagattcgcgtggctagggaggatgaggaaaaaactgcgttcattacccccgtaggaacctattgttatacatcaatgcccttcgggttaaagaatgcaggtcctacttttcaacgtactactcgaatttctttgggtagccaaataggacgtaatgttgaggcttatgttgatgatttggttgtaaaaacgcgcaaccaagaaactttactttcagatctggcggaaacttttgagaacctccgctccgcccgcataaagctgaaccccgataagtgtgtgtttggtgtacctgcgggcaagcttctcgggttcttggtctctgcccgaggcattgaggccaaccccgagaagattcgagctatcgagcggatgcgcccccccagcaaacttagggatgtgcaatgcgtcgccggttgcatggccgccctaagtcgtttcatatcaaggctgggagagaaggcgctacccttgtttaagctcctcaagcgctcggggccgtttacttggacggaggaagctgagcatgcccttactcagttaaaggcatatctcagctctcccccggttctagtcgccccggagccaaatgagcccctgctactttacttagcggcgaccccccaagtagttagtgcagcgttggttgtggagcgcgatgaagacaatcctcatttcgcgcacccccgccctgtgctgacttggcccgggagcgagcagggaggagaagcccccgagtcgaacggtggcctaaggcccctgacgaccggagtcggccctctgcccgcttgtcagacggtgctggatgcccccgaccctcaggaaggccccgaggccactgcgggaaggccgcacctatcgccctttggccccgaggctaaccctgtgctgactcgacccgggagaaagcagggagaagaggcccccgagccgaacggaggcctgaggcccctgacgaccggagtaggccctttacccgcttgtccgacgacgccaggagcccccgacccccagga

SEQ ID NO: 48657 - DNA, 6657 bp, Oryza sativa
gcctgtctactttgttagtgaggccctccgggacgccaagacccgataccctcaggcccagaagatgctttacgctattctgatggcctcgaggaaactgcgccattatttccaggcgcatcgggtcactgtggttacgtcttaccccctcgggcaaatcttgcataatcgagagggtacaggacgagtggtaaaatgggcaatcgagctttctgagttcgatctgcactttgaaccacgccacgctatcaagagccaggccctcgccgattttgtggcagagtggaccccggctccagagaccgtctcaatacccgaggccagcacggacccctctcagctgcctcgcaccacccactgggtgatgcagttcgacggttctctgtctctccagggcgctggtgcgggggtcacgttgacctctccaaacggagacgtcctcagatacctggtccgcctcgactttcgagcgaccaataatatggcagagtacgagggactccttgccggactcagagtggcagccgggctggggatccgccgcctcctggtgttaggcgactctcagctggttgttaaccaagtctgtaaggagtaccggtgctctgacccacagatggacgcctacgtacgccaagtacggcgtatggagcgccattttgacgggatagagcttcggcatgtgcccagacgggataacatgatagccgacgaactctcacggctggcgtcctcgcgagcccagaccccaccgggcgcctttgaagaaaggcttacccagccgtcggcgcgacccgaccccttaggggagacggatgcgcctgaccggccccccaggcccgtcggagtccaggcctcgggacccgaagggagcgctccaagctcccttagattgattgcttggatctctgagatccaaacatacctcacagataagactctacctgaggactgcgaagggagtgaacgcgtacaacgcatttccaaacgctacgtgttggtagaagggaccctctatcggcgcgcggctaacggaatcctcctgaagtgcattcctcaggaacaaggcgttgagcttcttgctgacatccatgagggcgagtgcggagcccattccgcctcgcgcaccctggttggcaaggcctttcgtcaaggattttattggccgacagctctcaatgatgcagtcgatctggtccggcgatgcagagcgtgtcagttccacgccaagcaaatccatcagccggcccaggccctgcagatcataccactgtcatggccatttgctgtctgggggcttgatatcctgggaccgttcaaacgggccccgggcgggtttgagtatctgtatgttgcggtcgacaagttcactaagtggcccgaggcttatccggttgtcaagatcgataagcactctgctcttaaattcattaagggcatcacggcccgttttggagtgcctaaccgtattattacggataatggcacccaattcactagtgaactcttcggcgactactgcgaagacatgggcatcaagctctgcttcgcctcacctgcccaccccagaagcaatggccaagtggagcgcgccaatgcagaaatcctcaaaggccttaaaaccaagaccttcaatattctcaagaagcacggcgattcatggatcgaggagttaccagcggtgctctgggcaaaccgaaccacaccaagccgagcgaccggggaaacgcctttcttcctcgtctacggcgcagaagcggttctcccatccgagctcaccctgaggtctcctcgggccaccatgtactgcgaggctgatcaagatcagcttcgtagagatgacctcgactacttagaagagcgaaggcggcgcgcggccctccgagccgcgcgctaccagcagagcctgcggcgctaccatcagcgccacgtccgggcccgatcactctgcgtcgacgacctcgtcctacgccgcgtccaaacgcgtgctggactgagcaagctctcaccaatgtgggagggtccgtatcgagtgatcggtgtcccccggccgggctccgtacggctggccacgggcgacggcactgagctgccaaacccgtggaacatcgaacaccttcgtcgcttctacccctgacgggggggatcgggtgtcaggtttcgggctcgggctaaccccgcacccccctcgggtgtgcagggttagccgggggctaccacacatgcacagccttacttttcttatttcagcatttcaataaaagcagtttcaatttcctaaaggttgtgtctgtgccgtttttccttctgaagaatcttaacttgaaataaggtcactcgtgctcaaccttaccctcgggggctcggttcggtcagctaaaatcgccaagcggggcccagaaccgagccgtgccccggggcgtggtgaactccgggggggaatcggcaaaaacccacaatcgggtcacccataaccctcggtcaccatgttcccggcctggccagtctcgacatgtggatctccccaggcactagccccgacccgagccatttgaggatcgggacttgagcacgagcccttaaatcaagctaaaatgcaaaaggaccacggcacaaatcatcctcaactcatatgcatagcaaaataaagttaacataagaaatttttcatcatttttgattgcagattaagttgatctatacaaaaagaagaaagaaaaagaaaaaattggagattggcgggggcctgggggctcattccaacgcgcccgggtcgccggcctcgtcgccaccgtcgtcctcaccgctggcgtcgccctcctcgtcggagctgggggcgaacgcgagccgaggggccgacccctcgaagctttggacgatgtggttggcggcatcccggacccgcgcgcgcgcatcgtcctcggtcccgggggggaactcctccagcgccatccatggagagaagttggggtcccgggcctggtaactcgccagcacgagttcgaccgctccccgcgcgaggtccctcgaggatgacttgatggtcttctcaagctcctcggggagttgttcgagaacccaggccatcctgttgaggtgcggagcgaggccttccagattggtggggggcaccgtcgtctggcctttccagaggcccgcttgccgaccggcgcgcttcaggcgggagaccgcatcccaaagcatgccgggcccaatctcgcccgccaagcgaagggcctcggcctccccggtggaggagtccagcgctcgctgcatatcggcgacggtgtgttcggcagctgcgaggcgggcggctaagtcgctttcgcctgcggccgccccaccgatatgcgccctcgcgtccagctccttttcccgagcctcgaggtcagcagcccgctgttccagtgcggctctctcggcgcggacgcattcaagattgcggcgcgcctgctcctcctgcgccacctcgcgaagggacaggctgtccgccagccatttggtcgtggcctcagcctcctcgagagctcgctcccgctcagcgagtgcgtcctcgcggaggcggagcgcgcactcctcctcggcgcaggcggcctcgtgcgccgccagcgtcgcctcccggagagcagcggcggcctcgcggtccgtcaagcctttctccacggcgccggcgtgttcttccagcgccatagcacgggcctcaagggactcctcgcgccgccgggacgccgcctcagcctttgttacccgccgctctcgggcagcggtggagtcaaggactccctgggcggcgtcgagcttttctttcagctccgcctcccggctggcgttttgaaggcggagggcgtcttgcgcctcaatcatcgtggtggtagcgatgagggcggccgctcgctcctcctccacctcacgagcgatctccgtcagcgccgccttccgggcttcaagctccgagacgtgacggcggtgagctttacggcccacctccaccatggcgtccaccgagcgccgcccctcctcaacgcgtgcccatgcggcctcgagctccgctcgttccgcgcgcagggcctccacttgggcgctgaacccatctagcaccgcggtgtttgcggcggccaaggcctgcagaatgggctcggcgctcagcggggcgacggaagatgaggagaagagccgccttggagagaaggcgatgcggctcggccccccggaggacgtgctgggctcggggatgtcccccggacccgtttgatcctgggcgtcgcccggggaggtgggcccaggcgatgtgcccgcggcctcgtcgcgagcctccccggaggctgtcgcctgagggttgcccgaaggagtgggcccagttgacgcgccagcagcagctgttgcctcagcctggcgagcccgggcggcctcctccttagcggcttcctcagcccgggcggcctcctcccgagcagcttcctccgcttggcgaatccgggcggcctcccgggcggcctcttcagcttcccgaaggcggtctgcggcttcacgccggtcagattcttgcctccgctcctccgcggccgcaggatcttcggcctcggactggccggacttggggtggcgggaggaatgcgacgggacatcgctgaagcacaagaaaaaaccagaagaccaacaaaatgagtaagaaaaagcttccttttgggagaaagatggttgcaatgagagtgagacgaacctgcgagggggtcggttgaatgaccaccttggaggggaaatcaggtttccccggcatggttccgtctcccccgtcttgcgaagccgtttctttttgcgctccccctcgggctgcgacgtcggcgcggccccctccgggcgccgactgctggcacgcgccgccccgccccctcggggaggagatgggggaggtgttcctcccaacttcctcttcccctgggcgtcggcagggcggctgctccccgagcccccgacgcggggcccagaagcacgaccccctcctggggcagattgttccccccggcggcgctcgcccgcgccgtcgtggcccttaggggctctctcctctgaggccccgacccccatcataatggttagaatggaggcgcggtcgggatcgctgcagagggggaggatctcctgaggaatgcgagacgcctccacggagctaagattcagcaccctttggaccacgatcttgaagtcctcgggagcccaatcccatctggctccctggtgggtccgcatgtagtcttcaggcccagtgtactcccaggcgctccgggcgcgccgttggagcggcgcaatccggcgacggaggtaatcgccgtacaccatggccccggtgagcccctgggatcgcaggcccgccaggcggtcgaggacggcgtcgtagtcctcccccagatctaccggcgcccgccagctggagacgtgcgccgggggctggcttggaagtcggaggcgcgcttcgttggagagaggggtgtagaaccagtcgctattccagtggtcccactcttcggaggacgcaggggatgtagcggttcaacaccggcccccgcggctggaagtagcagcccccaaccacggacggcggtgacacagactgcacggtgaagaaccaccggaacagctgaagagaggggcgcaccccaatgaacatctcgcacaggtgcgcgaagatggccaatgtcatcaccgcattgggggtgaggtgcgccatctggagatcgtagaactccaggacatccatgaagaaagaagaaaatggcgggaccagcccagccattgcgaaggggaggaagaagatggaccgccccgggtagtctggtgccgggcgcccctcgcccagcatcactatctcccgaccggtggcggactccggcatgaagcggcgtggcagtccggcgtgcctctcgctcacgatgcgggaaggcggtagtacactgccgtcgagcagagcagagccccgtgccatggcggtggaggaagagatgattgagaacgagcgcgtgtggcgaaagtagggcgtagcagagaaagagttagagctcaggcggcgaaggcaagaggaacaatggcgaaaggaaggaagcaaatccttttctcgatgcttttatacccttgccatcgctgggcctggctcctcgtttctcgcgcccactacctcgctccctcgtatctcgctatctcgctccctcgtttcccgtgcccacgcttccactaatcccattcgcccgcttacggcgcatgaagtggatatgcggttgtggcaatcgaaatggattgtatcgtgtgcgcgttaattacgctcgccgaccgaagcggcgttaccgtatctccgggcgagaccaatctgctcacccagattcgcgcgctgctcaagtggtgtggcagtcttgaatagaccgcccattatggacaaccaaagttaccaataccaatgtgcatggattgagaccgttgggtattttgcccaactacggagaccggtcccacctgtcaccaggctttaggggtggcgtcacacctgaccgcttcccttgggaagggaaattgctctggcataacgccgggggctactgtcggtgatatgggaccgggagtatcatgaccagaggcttgaggcagacgcaatcgcccacgtggcctggc

SEQ ID NO: 48658 - DNA, 2099 bp, Oryza sativa
tgtcttcgggggaggtgggggtaggtgtgggttgcccatcagaagggctcccggatggaaaccgtaccgatctccgcccattaaagagaaaaagaacagtccagtttggaaagagaaaggtgcatgtggtatccccttgagatataaaaggaggaccttgcccatttagagggggactttttcccttttggaaggctgaggggaaagggagttaatcctttgtaacttgtccatacacaaatccacaaaaacacaggagtagggtattacgcttcgcagcggcccgaacctgtatagatcgccgtgtctcgcgtttcttcctagcaagcgatctttccacatacagagagagcttgagatctcaccctaagcccccggccgaaccggcaaaggggggcctgcgcggtctcccggtgaggggccacgagctccgtcacttatgaactgtgacaatcaaacggtaattgtcaaagtgaatagttctaaggataatatgaaatcgtctagacatgtgaaaagacgattgaagtctgtcagtaaattgagaaactctggagttatagcgttggattacatccaaacagctagaaacctagcagatcctttcacgaagggactatcacgaaatatgatagataatgcatcgaaggagatgggtttgagacccatgtgagttatactatggtggtaacccagtctatgtgatcggaaatcccgtgaattagaacctgggaagaacaaaccattagtaaactagaggagagtaccaatctatatgtaacatcccggcctagggcttaataggattaatagaatactcatatcaacaagttgcaacttcttttccggaagccaatctccaaagaactccagggttaagcgtgctgcgctggcactggacacatggacgtggccaagagaggacgttcctagcctagggttgatcgacgggggcgtcgatctctcttaagggggtgagggtgtaacatcccggcctagggcttaataggattaatagaatactcatatcaacaagttgcaacttcttttcctagggcttaataggattaatagaatactcatatcaacaagttgcaacttcttttccggaagccaatctccaaagaactccagggttaagcgtgcttggcctggagcaatttgggatgggtgaccgaccgggaagaatttcccgggtgcacacgagtgaggacaaagtgtgcagaaaagacatgtgttggtcctctaagtgaagatgcatgtactctcatgagctggaaggcaggttggctatgccttaatgagttctgttggctttaattagcgaagatgctgtcttgcagagcattcttgaaagaactcacctttgtaagcttgactgttggtcgcagtctatgaagattttgggtgaatcttttaggaagcttattaaagacctaggagtatgacttatacgctccacccgaggggtagtctacagacggtctagtaccagataagactctgagtgaaacttgcttgcataagacttgtaattcaagacgtagtccattgttcaagttgtgagtaagtgtagcttggagttctaggtggatgttcaaccttgatcggtctccatcgaaccgctggtatataaaagtacattggaaaaggcaaatcttagtgggattttgagatttggtgggggattgttagaattaatagatgggctaaggcccattcgaagattaattctttgaaaaatcacaaaagcccacctcatgggatggcatgcatgtggagtttagtaccaccttgcttattctaggagagggggacctccttaaaagggaggatgccctcctagcttcttgaagcatgtgtggtggagagaagagggggaacacgcgctcgctcgcctcgcctcgcctcacctggcctggtagggcaggggcagggcaggcggcgcgcgtgcacgacatacgcgtcgaatggtccgcaaaattggctcctcacccttgcacagatgcagcctccttttgcagttttgttttgctgtaggaaaattcggatttgttttgttttggaaacattccgaaaaatccgctgcgtgaaaacgg

SEQ ID NO: 48659 - DNA, 6398 bp, Oryza sativa
gaaataggcttattttagaagagcttagtttcaaccaagacagcctccatgaagagtctatgtccatgtatgccagcttgaatgatgaccagaagaagatatatgacaaggtctttgacaggctagctcataaggaaaaatgtattttctttatatctagacatggtggaacagaaaagacattcttgtggaatgctattatggcaaggctgaggtcaagaggcgagatcgttcttgcagttgcttcttctggagtcgcagctctgctcatgcctggtggaaggacagctcattcacgctttcgaatacctatagatatacatgatcagtccatgtgtggtgttcgtagaggtacaatacttggagatcttattaagaaggcatcattgattatatgggatgaggtgcctatgacaaacaagctatgcttcgaggtgctggatagaactcttcgggatattcagtccactgatgatgcaagtaatgcgcataagccatttggaggtaaagcaattttgcttggtggtgattttaggcaggtcttgccagtgattcagcaaggtacaagagctgatgtggtgcctgcttccttggttaaatctgcattgtggaaccatgttgaagtcttacacctcaccattaacatgaggctacataatccatcgctctcgcagcaagccaaggatgagctagcagagttcgctaaatgggttcttgacattggtgagggacgtgttccaatggatagacgacagggtgaggttgaaaagacattgtcacgcccagaaattcccgaatagaattccaagcagaatgtgcattaaaatccccgtccaggaccggccggggtacacaaacgacaatgttgacattcagatccacgtcttacaaacatcataaaagtctacataaatgcagcggaaaaacgaaagacaacaggagctaagccttgactagaactgcagcgggaacaccactccacaggcatcctcaacggcacggacgaagcctactcctcggagaaacctccatctgacacatactcatactctggggttgggaaaaatagagcaagactgagtactacccactgtactcagcaagtcataccggaataggggtatgatgcagggaattatcaaaggagagctagagtggttcatttgcataaagcgagtatttataaacagaagtttaaagaagaaaacagtcgtaataattaatcaatattaatcatccactgtccaacgctataccacgttgcgacaggcccaaccatccacctatactatctaatttcaaaagactaaactagggtgagtctaatcacggtgaatctggttgaccgcccataaccgcgggcacggctattcgaatagttttactctgatcagaggtgtacaattgtacccacaagacagccccacgacacgtttccgtgcgccgacatgccaccacgacataccggaaagaggccgtgataggacccttcgcataaccccctctagcaagcacaccacacctcaggtttcacccccgtccccagcgggcgatgggcagtcccctctcgtgcctaggtgaatccggaagccgcataggccgtcgcagggcccatccaaactccatcacgcccacccttgcctggatgcgtcagctagagaaaagctacactacaagcccagccgttgcccacgctggcttgtggtaagcacgataaattcttccagggtttcccgcgaaccggtccttaattgctatgggtgggacaagcaaaaccatgcacccacagcccaccatgtgattcattttaattaaccaacaccaaagcggtggtactaaaccaacattatcatatgaacctacagtctatattttaaatgagatttccccattgtgtgctagttgaactaagcatggctaagcaactcctagtccaacgtctattcatgttataacccgagctaacaaaggagcagggtaccaaaatagcatggctgtaacaataggtaaacatcccatagtaacattataaaacgatgcagtatttgaagaaaaacaatagagcatttgcaatataggatcaacatgttcaagtgacaggcatgacttgccttgctctgcagctggaggaacctcggcgactatctcgaagtacaccggagcgtcggaagaaccggaatctaggcgacatacaaagcaaacaatacaaacaggctataaaactactgaaacagagaacaaaaccatttttagtggattctacgcatttttcttgatttactgagacttgaatgggcttaaacggagctcggatgaattagttatgaattttagaagattcactgtgtttattactataacaaaaagtccttaaatcatttattgcgcaataattcccagggctgacgtcatcaagggggggcgccgacatgcggggcccaccggtcagcggctcgggagagagggaaaaggggccccggcacgcgggccccactcggcagcggctcaaggggggcacggctggcaagcgggccccacggccccagctccacgggccgatgtaccggccaggcccggcatcaagccgaccagccggccatggcaaagcggcggcgcgcgcatgcgaccgccggcgacggcaaacggcggcacggacggcggcggcggcgcgagcggcgacgaccgaacgcgacggcgagcgcacgaagagggcggcggcgcacgggaaaaaaagggaaggaaaggaaggggagggagacctcaccggaggggcggcaacggccggcggtggaaaacgagggaggcggcgaagaccggcgatgccgaggtgcggacaagcgacggcgacacctagggaaaaagagaggaggaattaagacagagggaaaccctcacggcgaccatccacgccggccggagtcggaggggagagagaactaactggcgacacgagggagatggggtttcggtgggattccggcgacgcaaagcggcggccgggaaaggtcttgcggcggcgaagctaggggtggcggtggcttagcgcggcgacggctctagcggcggcagcacacggccggagtgcggcggcgggcggcggcgcaagcggcggcggcgcgagctcggtagggggcacgggatggagcggtgagagcggaaaacgagagagaagggcatggggagcattttataggtggagggggaggcggacgtggccgggaggcgccccgatttcgccggcgacgtgggggaggagagagagaaggtggggggcgattcaaaatcgaatcccgcccctctcgtgcgcaggcgcggccggaagacgcggggagagggggcggcgacgtggcgtgggcacgggcgacgcggcgtggggcgcggggaaagcggaggagtgggtgcggcgatggcggttgcgaggtaggagacgggcccgacaggtagggcccacctgtcggcgtcccgggtgggaggaggtaggcggccggcccagcggaggggagaggaggaaggagaatgggccggcggcccactcgaaaagaaaagggggaaaaagaaaaagaaaaaggaagaaaaggattttccctggaattaaaatattgcttgctcaattttaattggttaaaattatttctagggctctgaaaattcactaaaaatcttgttagcgaatttcgacatgtagaactcaaaagttccacatgtcagttccgattattatttgcattaatttattaaggtttactcttgctttacacaagtattctcttgagaccatttataacttcaatttaggcttgggaaagaactttggggtgtgacagacatagatacagatacctgaggaattgttgcttactccacatggtgacaagattacagctataattgatgctgtctacccagattttcagaccaactatgactgcatcccatatcttgctcagcgcgcaatagtctgtctagtaaatgcagttgttgatgaggttaatgatatgatgcttgccaaagtacctggagaagcaaaggactatcttagcagcgacactattgcaaatacacttgagaaagctgcggattttgatctgttgtatcccatagaatttctaaactcgatatccataaacaacttcccggaacatcacatatccctgaaaattggttcagcagttgtcctacttcgcaacatcaaccaatcacttggcgtttgcaatgggacaagattactggttactcgacttggtgattttatttttgagggcaaaatcatgactgggacaaatattggccagctggtctgtattccacggattgtcctaagtggaaatagtccgaagtggcctttcacgctccagcgcaggcaatttcctatcagactatgttatgcaatgataataaacaaatgccaagggcagacattaggaaatgttggtgtatacctcaagaaccctatcttcacacatggatagctatatgttgctgtttcgcgagctacatcaaaggaaggactcaagttattgatagaagatgatgatggaaatccttgttccaccaccaagaacatcgtctacaacgaaatattatcgttgctgtagattagttttattgtggctatctctgcagcactgtgatggctcttttgtgaagctctttgttctgtgatcccatttgtcggtgcagctttcctattttgttgttcccttttgtttagcctttactgccagcttgtgttcgtatatgtgttgttcctgtttgatcacttgcttgttccagtgcctttcatgcgtgcttatcgattcttctttcttaatttccatatttctctcttgttactatcagctgcttttagacatgatttattaaaatgccctgcactgaaaataattctcagctccaaaactaaaaaacttatatgctccaccatagtcccttcagcaattacagctttgcgccttcatatcatgcagaacattgtttgtataattcccctctaacctgcatgatgtgttttctatgccctgcagatggattacagtctcctaaaggatgtcacacaggaatcacaccgttggcgcgtacgagtgcgggcaacccgcttctcggagttcaccacagctaatgagcctgacaagattttgcgccttgatttagtcctgcttgatgagcaggcatagcaccgagtacatgctttctttctctgcacactatttgcctccgcaccctcttacatattgaaacatcaacagggcgacatgatggatgcgcaaatcccaggacgccgcgttgttcaattcaagcctttgctaaaggaaggcgctgtgtattacatcaaatacttcgaagtcgccgaggcacgcccccagtataggcctgttgatcgactgttgatggcaaagttcactgctcacacaaccgttacagaagatactggaccaccatccacgttcccatcttatgcctgcaaaattctttcttttgatgaactcagagctcgggcttacaagaaagatattatttcaggtaagtctccttggcccagatcaatctatattattgcttattaatcttctccatttctagcttgctgccctcatttactcatatacagttttcctccctcatattcccatgtagatgctataggcataatgacagccatcgggccagtgcagactgtttcttatgcaggtgttatgaaagctgtgcttaatgaccatataaccaatggaaggtatgtgcgtatcgatacgttacctattccaaacatatttctgttctgggtgagtgaaagctaccatccaaaatgagcaacctatgcacggatagatcattattgcttttttcatgtgcatcatcgatttcttggaaacatatatgtttctccttttttttctagacgaacattctctggcatcttgattagtagcaaatatggatggttaaaaagtcatctgcattattttccacttcttagttcttttatgtgcttgcagagaaactgtcgtcgtggcgttatggggtccccatgctacacaattccacgctgaaaacttgcagcagcaagcagacaatggacatgttgtcatgttatttgttggtttaactgttaaatttcgagaccgtaagaaataaattcctgttctattatccctcctatctcatttgcatattttcactgttctaactcacatgatgtgttctttcgtctttgacaggccagctagccctacagggtagcactgtctgtagatggtatcctaacgcaccaatccaggaaacaatctccctcataagcaggtgccacttagctctgctcttttcatacacatagacatccttctactttattcaacatattttttcgctaccttatgtgtcatgtagatcaatgcttttcc

SEQ ID NO: 48660 - DNA, 11730 bp, Oryza sativa
  unsure (1)..(11730): unsure at all n locations
acaaacgaatggattattaacactttatagggtccctttgaaatgaaggattgccatagaaattttggaggattcagttttctatgaaatttttaagtatggaatcatttaattcataggaaatggtaagaaatgtttcggaggatggtgtgtgtgtgtatcttaattaatttcatatatataaataagaagacgtcatatctgttggaaacttttctcttcttccttttgttttctgtgatgctatcggaaggctccccttctctctcttatctttttcgtttatgtaggattaggataagagaaacatgccgttccaattaatttctatgtttttttttatttttgtgttttcatatacaacatttcaaagagcgttaagtttatcaaaacatgcttcggtagagatcgaatgctacataattcacataagtagtcatctagtctgattcatcactatactagcttagatagctgttgaaaattaaagagcatatatagaagagaatggcgctattcctagtaggtaggtagctgtgctgtctagtgatatagagtacttcatccgttccataaaaaatcaacctagtattagatgtaacatattatagttagtattagatgtaacatattatagtactacgaatctgaatataactttgtccagaataatgtatcatatctaattctatatttgtttttttatgaaaggagtatgtatttgcttcatttcttgatttgtatttttttcgttccaaaatagtttaatctaggattgttatccatgcacaatgaagttggataaattttcatatagattcgttatattaaaataggtcatatcatattctacattgagttatacaggaacggaaaaagtactgtcatatggtagccgctaacgaagatatattttcgttggtatctgacttaagccggctgtcatagtgactggacccagcgaaaacatattttggcccaaaaaaacccatttccgttccttgttgtgtgcccggccagcctctcgatgcgatgcatacatagttttattttcttctctttgtttattaaccgagcgtacccctcacattattggatctccaacaataattggtactactgacattcatatatatgctaatatataaagctatttgcatttaatttaattatatgactagctagtgctacgacattctgattcatgaatacataactgcaattagcgcagacaaatttaggtaattaatatatcctaattggatatatctaagctataaaaacagccggccatcccgtccatgcaacactgactactgactagctatagcagcagcactactgttcttcataattccaaggtaattaagctagcaagcaagcaacagagatcgatcgatcgatcgatcaatggcggcgtcgtggagcgagagtgaaaacgcgaggttcgagcaggcgctggcgacgtacgacagcgacaatcccaaccggtgggagctcatcgccacggcggtcggcggcggcaagacggccgacgacgtcaggcgccactacgaccacctccaacacgacgtcaccaccatcgacgacgaccactcccacgccgccggcgaagccctccccaacggcaacaacaacaataatactaacaagtaccgatacatacctcacttccttccttccttccttcttaattctatttattcattcaaatatatatactcctgtatagagtaatttcctagctaattattattaacatatatgcatatacgtagattgatttattaattatcgatggattatatatgtttgcagaggaaaccgaaaccaggcatgatcgatcgatcgacgacggccggtgatggtgcacgcaattgcttaagctttcatggttaaatattttttttcacataaaagtaaaaaaaaaaacatgatcgatcgatgcggaccttatattgatccatgcatattggcctaaatatatatgtatgagccaatgttgcatctggccacgtacctgcgccaatattggagtatttggtatttatacggtacgtatgacaactttgtgcttgcatctccatcaatatattattactagtggagaataaatttatgtgtattcagagggtgtgtttggataataggaaatagggggtgggattgagattgggaaatgaatgaagcattaggattaaataaaagagtgagaatgaatggttaggattgaaagatgccttttggtgggttggaaatcatttccatttcctattagccaaacattgtagagtgtgatgcatgctttaccacctaaacattatatgcagctaacgggcgattgatcgctgccagcgatcgtttttttttccttttcctcttttagtaagtttatacacctaaagtttgtagatcgaatgtttataagtcaaatgtttatatacccgattcaaattcaaattcaaattcaaatattttatatttttatcttttagtaaatttatacacctaaagtttacacatctaaagtttatccacctaaagtttgtagagcgaatatttataaatcaaaagtttatatacccgattcaaattcaaattcggattcaaatattttatatataaaatatttctatacacaaagtttatgcgtgcaaagtttacggtataaagtttatgcatatgaataagagtattagatttttttcgaattttcttttactatttttttaaaaaaaatataatgtaatataaaagtaaaaaagagatatgaaagaagagtattaggggcaaaggacgggtgatcgctaggaggagagggaagcgatcacccgcccactagcaataccctcatctttattctcacttcccctcgaccaatatatctccatgcaaatgagtagatctaatgggcgagtgttcacatagcttgggtgcgccaaacatgttcggtctagcccacatgggtccaacccatcacgagacattatcccaaaagtttatgcatagaaattttattcatttcagaactttgtttgaattcaccggattcactatgattggcctataaatgcagccatagaagcaagttgtcgataagctcattattattaatagaaatctgtaagatttcatccccaagtttcattcgaatgccatataacaatcccgttattattagtagaaattttaggccataaaacatgttatgttactctcaggctcccactaagtcaaccagaaataaacttatcgactaataaaaataacatagacgaggtgaaggactggaagtggcccccacaagcacgtctagtagaagctaatgtggatggtgaaaacagagcaaagagcaaattgtttatggaccgatccgctccgagtttgactaaagtaaagatatggtaagcgttagcatccgaccacagatctaggatttaccaagggctgtgagtgtaaacggggtgtgtccgggtgtgcagtgtgctcgggagcgaaaaggaacatgatcgtgtatacaggtttgagcctttcgaaggataatacttactcatgttcttggtcggtatcaaagaagtttgtataaattaccaggtgccctcaggctagtctaggaagccggatgtttttgccaatgacatatggcatattaccaaaatcccacggtcgaatatccgatttcttatgtgggtcattcaagaaagggctatttggaagaaaagatgtaccatcacccgatacatgtatcatcatgttccattcaaatggcttatctattatttttaacttgaagactctatcgtgagtttgggagcctatctgtcggcttctttttgttctatattgtttatgtgagcaattcaactgtgtaaatttttaatacctcatggtaccttctcaagaaacataaaattgctctgtttatgtatgtatgttttatacgataattttgatccattcttaagccgtatctgttttgactctgtatcatttccgtcatccgcattgataccaaaattgaacccgctaaaagattgttgtgtaggatatcatatgagctctttatgtccgaatccactttatttgcataattgcatcgcgtcactggatctaggagcttcggcaagaagatgtcatgattatacggaaaacggctcaaaaaatacatccgtcctaaaaaaaattaatttttcatcaatgccaaaaaaaccaatataaaacaaaaagattaaaacaccctcactttatgaaatcctaatactattatcagatttgctagacaactgcatttatccactacttttaccaacttcaatcatttgcaacttgttttgagagacaaacaggagagacaaaaatgatcttattcattcagagaccataaagcagtaagagatgatttataagataaggattaagagaagttagggagtgcatttttaagacggattcgtccgacgtttatgtgagggtgaccagctagctgatagctgagtcaatttgtgtgacttaatttgcgaccacgtagcagtatatgtatagtattagtatagccccgaagttagttgaagacctcttggagtagagatcgaggaagaagaaataatcaatggagtgttgggagaagaagccaaggaatctgggtggctcgctgccggtgcccaacgtgcaagacctcgccgcccgcccggaccacctcacgcccaccctcctccgccgctatcttcgcccgcaccacctgtccctgcccgccgacgaccaccatgccatggctatgatacctgtcgttgactttgccaggctcatcgatcaccatgaggaggccgccaagctgaggcacgcctgcgaggagtggggtttcttccaggtgatcaaccacggaatcgccgacgagacggtggaggagatgaagcgcgacgtcatggccttcttcaacctcccgctggccgacaaggcggcgttcgcgcagcagccggaatggatcgagggctacggccaggcgttcgtcacgtcggaggaccagacgctggactggtccgacctctacttcctcaccacgcagccgcccagctaccgcgatctccgcttctggccaccggagacatcctccaccttccgccgctccatggaccgctactccctcgagacgcagcgggtggccaccgagctcctccgagccatggcgcgcaacctgggcctgcgcgacgccgacaagatgacaaggctcgccgcggcgcagtccatgcggatgaactctacccgccatgcccggccaaggagagggacagggtcctgggcgtgtcgccgcactcggacgccgtggggctgacgctgctgctgcaggtgagcccggtgaaggggctgcagatcaggaggggcgacgactggatccccgtcgaccccatccccggcgcactggtggcgaacgtcggcgacgtggtcgagatggtgacgaacggcaggtacaagagcatcgagcaccgggtggtggtggacgcggcgcaggagcgggtgtccgtggcggcgttccacaacgccacgttcgggtcgacgtacggaccactggaggagatggtgggaggcggcgaggcgcgctaccggagcatcagcgtggaggactacgtcaggctcgtcgtctccagcaagctccagggcaagaacatcttggacgctgtcaagattattactacgacttaatttctcatcttatcatgcctgctgattaatcaatcaatcaatctccctggttgttggttgctgccgagtaaactattcatgccacttcaattattagtaggtaaaaaggatctatcatgcatactactttccgtttttattggagtaaggtttatataggagtacctttgaataaacaaacaaatctcgtctactttgatgtaaaggtttgttgtatatgaggtttgcttcattgtacgctacagttgcctgagtatacggctaatgtacatgtgtcttgctacataaacaattagtaattacaaggtacacaagctttagcaaagatgtgtgtaaatcatatcatgcgtgctcatccatcgatcaaacaatccctccatatatcactggccgggtgccgggtaaattttccatgccacttcaattaggtagaaaggatctatcatactttctgtttgtactgaactgggtccctactttgaataaacaaaaaacctcgatcgtgtactttgatgtaataaagatattgatgggccgggttgctatgggagtatctatatatctttcaaaagatttttatgatcgtatcatacagatttttaatctttagagtaaaagacaaaaagtaactaaaaaacatcataatggacattaatattaccatatctttaaagaaaaagaccaaatccattataaatttcaaaacttacatgtaaagattcaaaaattacactgtaacatacaaaagttacaatataagttttataaattacactgtaacttacaagaaaatacactgtaaatttaagtgagaaaatcgagtgagagataagaaagaaatctttcgagtgatatatagcaaaatcacgctacagttcattttttcttttacaccagattacgctacagtttgccaaacgtttagggagaatagccaatatgttccctaaagttttgctcttggatcattttagttcttaatattttatagtgttcaaacaagtcatatcacgtggtttaacatagcacttggtgccaccaaaatcaccacatagacatgccatatcaccctcaatttacctatataatagaaacataaacataaggaaatgaaaacattgagttggactacaggaagcaaatctctactattataaaaattgaagatgtttttgccggtattttggtatgtcattcgtgtatgagtcggttttaagtttgtttgcttttggaaatatatatccgtatttgagtcggtttttaagattgttcacttttggtaatacagaaggaatcatataagaattctatttaaaaaactcaaatgctaagctgagatgatcggactcctaactgcaactcatgattttctaaaaaaaatatatatccaagggaactccaatagtgaatttcatcttaactaaaccatataataataataagattaaaataaacttcacccgttgtaacgcacgggcattttttcttatatgattaaaaaattaaaaattatataactctaaatttgccattactttatatagcaatacgtcatattctatcttcatggtattctcagactagaaactttcggcccgtcattctcatattttcgaagaatttctcttttcaattgaatcgaaaatgttctctagcaaattatcaaattttaaaagtgtttttcagccgtgatatgtttttgtgatgtttatcattttagcaaaattttccttgtttttaggttgaccatctgttttatgataagaattaccaaattttggtacatgaatatgtttagtttgtaaccaatgtttagcaacatcaaaatttaataggattggcgaagtgggcatagctcaacccattaagttactaatggtggaacaaacccatccaagttcgaattctatacggacatgggtactcgtatttacgattatttatttatcacatatatagtagacgacgtacccgtcgacaacgatacgctcatggtagcttcatcaatcttaagaaataccgagacgttcgtggtggcttagccaatcttaagatatgtcattacagtttcttggaggtgatcatagaggtaggatgtgtgtttgtgcgttcttagatatgagtgtgcgcgtgttatgagcatatatgtttgtaacgtgttttaaaaacttttaataggattaaaagtggtaataaagcaaactgaacatactcgtatatcgaactgtcataacttctaaaattagcttgtacctcgtaattgtcgttgtttacaccataaaattcccaagagaaaagtgaatctacacaatatgtttacaccataagtttggaaaaaaaatcaacgcaagtcattttttcatcttcagtccgaaagtataagcggatatttttgcagatattttgttagacagacagacgaagaagggaaaagagacaaagcgcgcgtgaaaaaaagaaaagaaaaggagagaaaatgttttaagctgagaaaacaaacccaatccaaagcgataggcaaatcacatccatccatccattgccattgccacccatggcgccactccccgccgccgccgccgcgccggccttcctcttcctctcccctcccggcaaactgcccggcggcaaacccaggctgaaaccctcctgtgccgcctccacctcgtcttcgtcgtcgtcgtcaccctcgctcgccgagcagctggagcccctgtcccgcaggctcctccacgggaagcccacgcccacccagcacgcgccggagccaacctgggtgaacccctccaagcccaagcccaccgtcctctccctccgccgccaccgccgccgctccccttcctcccacccctcctccgcccctctccagccgctcctccgcgccatccgcgccctccccgacgctgccgacctcgcccccaccctccacgacttcttccccccggcctcgccgccctccacctgcgacgcgctcctcctcctcaactacctccacccctcctggcgcaagtccctctccctcctctgctggctccgggccctccccgatggcgccttcccacttgacaccatcgtcttcaatgtcgccctcaagtccctccgcgccgcccgccagtggccccagccgagcgcctcgccctcgacatgctcgcctccggtgtccccctcgacaacatcacctactccaccctcatcaccgccgcccgccgctgccgccagttcgacaaggccgtcgagtggttcgagcgcatgtacgcctccgacggcgtcctccccgacgaggtcacctactccgccatcctcgacgtctacgcgcagctcggcatgaaggaggaggtcctcgcgctcttcgaccgcgcgcgcggcagcggctggaagcccgaccatgtcgctttcgccgtcctcgccaagatgttcggcgaggccggcgactacgacggcatccagttcgtcttcaaggagatgcgcgaggtaggcatcaagcccaacatcttcgtctacaacgcgctgctggaggcgctgggcaagaccggcaagccaggcctggcacgcaacctgttcgaggaaatgacggccgagggcgtcgagcccaacgcgcgcacgctcacggcgctcgcaaagatctacgggagggcgcgctgggggcgcgacgcgctgcagctctgggagcagatgcgggagaagaagctgcccgccgacaacatcctctgcaacacgcttctgagcatgtgtgccgacgtggggctggtgggcgaggccgagcagctcttcagcgagatgaaggacccggacctgggcgacgtgccgaagccagacaagtggagctacacggccatgatcaacatctatgggagcagcggggatgcggaccgcgcactccagctgtttgcggaaatggtggagagcggaatcgagcccaacatcatgagctataccattgtgatccagtgcctgggaaaggcagggaggatacaggaggcggtggacgtgctagaggctgggatggccaagggcctcaagcccgatgaccgactctgcgggtgcctgctctccgtggtcgcgctgagcagcggggacgagacggaggtgattctggcttgcctggagaaggtgaggagtaatctggtgaagctgatcaggatgctcggggatgcccgggtgggagtggaggacctgagggtggagctgaagggcatactgaacagcgcggcccctgaggtgcggcggccctactgcaactgcctgatcgacatatgccgcaaccatgggtaccctagtgagagggcagtggagctgttccgcctcgcccggcactatggcctgtactcgaagatccatacgaggaaggaggaggagtggtcgctggacctgcggtcgctgtcggtaggcgcggccaagacggcgttcgacgactggatgaagaccatccgggaacacgaggaggaggaggctctgccacagacgtttagcgtgtacaccggctccagcacccacaaattcgcgcaggggctggcgaccgcggtggcctctcatcttgagcaggtgggggcgccgttccgtgccagcgactcccagcttgggagcttcatcagcagcagggatgatctgctctcctggttgcacaccaccatgtcatcgccggatgttgccgtatgatcgccggttggttgcatcatgcagtcttgcagacaggacaggagggacgacggccgtgccgtcacattaaaatgctcgtcattgtttggttttggttggctgcaaattaaaatgctcccaaagaataggattgcgaggaggatggatggatggtgctgtacatgcgcaaacactccggataattgtcatttctctgccttttttatactagtccagtttgtaggaagctggacaagtgataagcagataagctagtactagtgtggttttctcacctcttttatttatactcctactagattactcacagttgttagggatgaggtgagggcactctgaagatgagagagagctcacagtttatggtttttgtacgacgaaattattattacatatctgggtctgggtgccagccgcccgcttctcaaattgtacttggttgattttcatgtgtggatccatggggatggtcatagatagggcgccataggaaggagttttgcaagaaaagaaaaaacaaaaacaccttgaatttatgggctgtcgaaatgtaaaaaggccgagtccacatgcagcccatcagagacggcccatcaagaatcttttcttacagatgcatgatgtcccatgcagccccaaccactcctcctcctcatcggaggggttcttcttccgaaatccgaatcgatcaatcgagcaagggacgggacagggacgaatcgtcgccggagaagaggagagggagagagagagagaacagaggggcagaaggcgagacaagatgatactagcggtgctcttctccaactccgacggcaacatcctcatcgagcggtacttacctcccccatcttcttcttctcccctccaagaaagccctttttctcgggggatctcgcctcctgaggcagatctgcccatctcttccacgctcccccgctacctatggccaacaaattccacctcaaccatttccctccaaaactaatccatctctactccccgtacttaccgctgatagaaactgatttatcacttgcgggttggtaaacgtttgcagcttccatggtgttcccgcggaggaaaggctgcactggcgttctttcctcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 48661 - DNA, 1043 bp, Oryza sativa
cagtagttatgaagctcatgaacatgatgggatgtctgcagctgaaagctcaagttcagcgtcttttgatgcagtgctttctgatgttcaggaggtcaataatgtagtggaggacaaacagaaggtactcaatgaaagtggtgaagtttctggggaaaataaaaagggccatttaagccatatgaatgaaactgctgatggggccatgcaagctcctcgtaataatcaaagtgtccagcgtgctgattcagctgttcggaatttgttgtttcaaggatcaggccatctatttactgaaaaagacatcatcggtatttatagaaccccaatgctagatcaacttgggaggtcccgttatagtcttttccagaaggaggtacaagtcacaaaaaatcaacggggaaatgcaaatgagcgttatgcatggcttgcttgcactaagggtactatggaggagatgatgatgaatggtgctttggaaatagcaaaacctctgcagggtccaatgtatggtgttggggctcatcttgctccagcaaactcctccaatatctggtaaataccttttgtttctgatttatttgttctatgtgctcttacgcctctggtgttactgcttttgttttggatgtatagtagcctatgtcttacttgaagtttgtccacagtgttggtttatctgatattgacgaaaatggaatcataaggatgatgttgtgccgtgttataatggggaatgttgaggtggttttccctggatcaaatcaatgccagccaaccagtgaaagttttgacagtggtgtggatgatctccaaaggccaaagcattacatcatatgggatgctaatgtgcataagcacatttatgctgaatatgctgttattatcaaagtaccttacatgaacaatggtactataccatgttttttcccctctcttttttaccttgtgtcgttattttccatttgccctagataacttattttatattactgtatgctatttcgttacaggagatactgcatccaatatctctgagataa

SEQ ID NO: 48662 - DNA, 742 bp, Oryza sativa
gatgcatgagaggaagcaactaagggtatttttgctagcctttaggtgattgaaatcgcttgtctgggcatccaacagccaggggtagttctttcagtgattggaagctcttcctcttctccgatacctgctatgaataaagggaggggtaaggaagaaggggtaactaatcaacaacgatgataattgcaatagcaaccaggtttggtgggagtattcttgcccgcagctgcaggggattacaacaggaaagggttcgactcccttgtcctccttgttacatggcacttgtggttgaaaagaaatgctcgtgttttcaaggagatacttttcatggtggagatggtggtgttcatcgtatcgttcaataaggaaagctttgggttgtggcgttatctagtcccctaaaagttcttcttggcgtttagatacaagctctttctctttttttgttttcaggaatttggttgtctttcctagttaatctagtgtgcccgccatctctcctgtaaccccccatgacctgcatcagctagtcgtggttgtaaaatctcctttccccctattaatatatcgatgtgcaaggcttttgcacgtttgaaaaaaatgatagcaatattctttcagtgattaattgtgagctcttcttcttctctgatgcccttttgatgattgccatggattggattaggtttcaagagggtggttaggtgggagggggggttaaaaaagaggggaaggg

SEQ ID NO: 48663 - DNA, 6270 bp, Oryza sativa
  unsure (1)..(6270): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaacagatgaagctgctaattaactattagcgccaaccttaattaaatagtagtagctacctaatcagtccaacgtcgtccatgtatctctatcacttttctcttttcttctttaatcgatcgatcgatcggatgaatactatagtatactaacacctggtggccggtcatctgccaaaaagaaacgcatctcacttctctccatctctttcggcgaattgaagctttagctgagcatgacactgacgctagctagctatctttgtgccaaagtcgatcaattcttctttctcttttctctttttgttattattatgcttgtctactagaaacagaatactggaagctcacctgatcaatcatccggccagtacctgcctttaacttcaaagcaagtttcgcgccttttttgccccggcctcttcacgaccgttgttgcatgatccatcgccatttcaccaatgctttcccagctctcccaatctgaaacttttcagagtagcatatcacaagttagcttgcagtagatgcctgattcaatttaaccaatcacccgtttcacccatctgatcaaactaatccatgctttggcatcaatgtgaaaccagaaaagatgtgccccatttagtcctgatcaacatttgttttcacatttggacttgctttgaatccaatgttttcacatccatactttctgtaaggataataccgctaccggtctaccatatgaaaatctgaaattagatcagataggactagatatattgtttttaattagctattcccatagatgtagcagccagatggacactgcacttcatattatttaagctaactgaacacagttactaatatttgagtgatgtggatacagttagttagatactgtatatatgttcaaactgaaactgaagcgggcaacgagatggtcaaaatgaggggacaggtagcgtagtgtaggctgtggctgccctggttggtggatgatcacctttcactttgtgtcgtttccttggggagagatcctggaacaaattaaagcaaagcacatagtatgcgtcatctacatatgtctattgtttctttctttcattcctcccccacaaagagtggccatggactattcccttgttcttttgtgacaaagaagctttgtgccccaacttcccatagctatgtgtccatgtcttttgcttctcattttctctcttttttcaacaccaaagtatatgtagtataaggtatgctcagagcttcagatgagatattgatataaggatggggctccagcatgctttctttctcaaaaggagagattgagagagtggcactagtgcactgccatgcaaataaagagatcccctggttggatggatggatggggatgttgcactgcatctgcattgctgcttgcatgcttcagttgttatcagtaccacggcaagaatctatgtgcggggatgtccattgtactagtacatgtttttaacaataacaatacataaaagagaccagtcctaaagtgatgcttgatatcatgaaaggggaaaacaaactgtagatgaaacatacaggcgcatggacagtagtggctagtaatggagttaaatagctaggaagaaaatgtaaatatagtatatacttgtatgagataaaaacatacatatccttgtttcaggttgtgctgctttatatatttacctcatggtagaataagaatttactaccacttactgtgtgaagtgtggaacaggtcgtatttactttcttcttcagtcttgatgaggtagcaatgcaagatggcattgtgcagtctgagctgaataaagattacaaattgattggctataggtcaaatagtggatcctagagtgtaagatagtctttgaaaatgtcattccctgacccctaaaggggaagcagcttcattatctagcattcatatttgaccggagccttcaatggattcactagctgcactgccaatagtaccccaatataaaatcgcccatttgaatgctgcagacagatttgtcgacaactagtggctattagtgcagatagttgcaagatgatgcgttaagcaataacttactagtagctattagctctagacctctagtttccagaaattctggttgtagaaccaaataccttgacaataatgcagataggaacatggatgatatactaggtagtaggactagtacctggcccaaagctgcagtcgtatgaatgagtccaaatcaagagctgaacttccctggaaatcagccagttggaagagtatacaacttattcagcaaatcatgatgccttttaagttgtaaccaagagtaatgcatccagatggaagcttaatgactgacacatacccagaatgagcacaaatgcgtcctgaattatgattcaatatattcagcaaaccatgatccaggtataatcttaacggaaggaaataacatccagaatcagcacaaatgtatgattcattatagttcttttcaggactataatgtgatcgaatagcacaagttcgatttgcattgcttggagaaagcgtttacaatttcttttactacttgttttacctgcagtgtagctatctgctgaatgcagaggcaaccatcaagggctaaatatctcatttcaatgcacctaatgaaccctgatgaagttgacgcaatgtcattttcgtcatcataggacaaaatcttgcatctgatcacattgatatttaagtatcatcctagtgttgatcatcgatgatcccatgaatccaattaggagatgatggatgatggatcatcaaaaattaaatgtgttattaattgttggtgtatgcagctcaaggacatggtgatgaagctgtccggcacgagccgtcatcacggtcagcagaggcgtggcgggtcgccgccgccgaggggccggacgacgtcggtgtaccggagcgggtactaccggccgggcatggtccaggacgacatggcggtgccgccggcgacgtacctgggcggcggcgggacgtcgatgagctcggcgagctcgacgccggcgtgggacttcgcgcggccggcggagggcgaggctcgggagtgggtggcgcaggtggagcccggggtgcagatcacgttcgtgtccctcgccggcggcggcggcaacgacctgaaacgcatcaggttcagccgggagatgtacgacaagtggcaggcgcagaagtggtggggcgagaacaacgagcggatcatggagctctacaacgtccgccgcttcagccgccaggtcctccccacgccgccgcgctccgacgacggcgaggtcacttcacttgttctttcctgactactactagtacaaatgtcatggtccccatgcatgatgtggccggcgaggcggcgacaaggcaacagcacacggccacgacggcgacgttgcctagcctagcctgtcccgttcttggcttggcatcatgcagtgatagatgctgatacgttcttgcctgcatctgcaactctgcatatggcgatgcttttacagaatattgctttcgtcgttgctagctagtagcttgcatcaaaagatgcaacgacgatttgctagctgctgctagtgctgcagagtgcagagcatgcatgcaacgattaaagctggtgatctatggatatcatattcatatatggccatttctctctctctctctctgcatttgcatgaattaaaattaattatttgagcagagggaatcgttctactctcaagtggggtcgacgagggggagccccgccgccacgccgtcgccggcgccgctcaccccggaccgcgtcaccagctggagcgccttcgtccggccgccgtcggcctcgcgccagcagcagcagcacagcttccggccgctgtcgccgccgccgccgtcgtcgtccaacccgtcggagcgggcctggcagcagcagcagcagccgcagcgcgctggcaagagccccgcggcggcgtcggacgccatggacgcggcgagaacgaccagctgctcgtcgagggacgaggtgtccatcagcaacgccagcgagctggaggtgacggagtgggtcatacaggacgagcccggcgtctacatcaccgtcagggagctcgccgacggcaccagggagctccgccgcgtccgtttcaggtcacaaccttcatttttctactactctagctacctatccctgatgtagtatctattaattacttcctgaatgatcagatgatctgctaattactatagatgattgattaaatgcgtttttgagtattgctgatgattttgttcttgcagccgggagaggtttgcagagctgaatgctaagctatggtgggaggagaacaaggagaggatacaggcgcagtacctctagatgatcactttgcattattggtaaatctgggaattactactagctaagctacaagttggatgcttccattttgcaaggaggaattaaactacataaagtttattttacaagtaaatagagtttgtgttccaagttggagctgggaaagattaagataggaggtgggaggtgaggggaaaagaaagggaaaagtttagggcattagtacctgccccaggtaatctgtgactggtgtaccataagttccacacatcaacatccttcagctttgttcaatccaatttctcttgagtatgcctagcaacttatttcacagcagaaaaaaatgtgtgcattttcctttcttaatttaccacctgtaaatgcaatatagatatagtgaagctacgaatcacacatgatagtttcatacaacagccaaagtgatccagcatttacaccgcatgttggcccaacgatcaaaaaaattacaatgtacataaatcggtaaatgtaagctagcaagattaatacagactagagcatttatcagaggcataagcataaacctgtacaattactaaccaaatgaactgcggtaatgcacattgacaccgccaactgatcgatgtctatgtgcaaactaatgtagggcatctgtagtacacactgtgaatgctccacttcatgcaagttcgcgcacacccttgtccagtggaatcctcaacagcaatttggataaatgtgaagaaaagtgatctaggacacgaccaatttgtgtcaaaacatgtaaccggcaaggagaggagaaaaactctggataggaagttaaaatagacatcctaaaccaatcttttgtttctcctttggttcaaaagaaatcagtgaaaatatcagtatggtctaagatcacttctcttcataccttccaatgtttgcaagaatacctattaagacccaagggtatctgcgatttcacatgctgaacttcatccatactttacctgatgaagatgaattaatgtgccgaccagagtgctctaagattatcatcgaacagctgatgcgtagggagacaaaaagtactcccttatgcgtgatgccccgtcccttgctaacatgccctcaaggtctcccagaattcttgccaaccaaatctctaggctacgctgaatttccttgaagttgttccgaattgaactcagtgctcttcttgtgctcattttggcttctgctgtcagttcatcaccaaaacttccttttgcagtctctgcttgcagtgcactgagcttctgcctagtttcagttgctcggtgctgaaggtggaatgcttccagcaagtattctgtttgcctctgtgttctaaactctgagctcagtgttgaatcacaggggtcacttgtttgctgagcaaaattccaaataaatagaagttagtagtttcccactcctgctgcagctgtctaatacagataaggacaggaccagtaaaaaagatatcatgcataacaggaaacaatatatcggcatagtgagtgaagtagtgtacattcgttttcagaatttatgaatcaccttaagtgagccagcataatgtcattgagtgaagcacaattttaaccaacatagg

SEQ ID NO: 48664 - DNA, 1766 bp, Oryza sativa
taaaagactagatacagtatcaaaagatgatgcttaccattcttttgcaaagatcatcaatcttcccagcaagagtttggtatcttttcacttgctttctcatcaccaatggtatcttggataagtctccatttccaatcttttccaggttaattaattcctgctcaagcagttgaagctttgcaggaactcctgacgatccacatccaccttccaaggtgattctctcctgttaatggaagatgtttagagagtaaacattaactagcgtttattcatttgcaagttcaggaaaccatgtgcctcaattgaaaagtgccaacctaccgtggtacagcatgttttgtgttatacatcggctcagccgtttcatacttcaggtcctacaagatgaacattaaaaattgaaccacaaacataaaaatttaaaaagggtactagtctaacaatgctcagactgacaccaacaatcaaacattgatacctaggatttgtgtccatatataacatgaacataattacgtagaacaatgataataagattatatataccatttacgtaccactggtattgaaaaaaatatatattaatgcaaatcaatcattgcattaagtggcaacaccattacaacatttcaatttatgtaacactgtgtatctagaaaaaaaatacatatatgcaaattagtggtcgcttaagtgccaataacaaaagcatagattcttgcttaaatcaaaatgtgtcttttaagtatcactgtactgagccaaaaagacagctgtttcaagtcgaccaaggcatgaaaactgcacttcatagtatcattacaattaacatatgagcgtcatgtctgagtgtttgtatgcagcagtcttgttggacgtgcaggctccagcaaccctaatagatcttaaattactgcgtataacaatgctgccagatgccagtaaccagacacccaggagcagtaatcagcaccaacatcacctattatggactcccacatatcaatcctatattgctactcactagaagatgagcatatggccatgggctaatgaacaaggctgtagcttccactaacccacccagctaagcttcccttcactgtaagtaataagcgatgctcccaacagggccctacccttccaagaatttgctatttatacattttagaaaagagcaactaaacaatggtgttagttgaaaccgaacagtttctaatggtttaattaaaactgtttccattttagaatacacagaatgaagtacatatagaacccatgaaatcaaccttcctgaccttcaaactgattcctacttaatgcaaaacttgattttttttctttaaattcttgtgctttttcaggccataaaggttaacaataaactatcatctttaactttgattatcctgcaacacagatctgaagacagaaaatcaaagaaaggagagaaaatacaggttgcaatcatatgaatcaaaaaagaaaaatgtgtactcaatgtggtaacgaatatgaacaaaagaaactgagtgggcatgtgcggtatgttaggttagggattagttttactagtgtgagatggatttatgtgaaccactcaattatgctaacgagaggtacatatttgttcagttataaagcacaaaagctttgctgattatcaagtgtgatctataaaatcttcttactgtaattatgtgcatctctcctgtgagttccagaaaaatgtgtgctctataataaatatcaaatgatgc

SEQ ID NO: 48665 - DNA, 1670 bp, Oryza sativa
aattatgtcatgatttaacaatatggcgctacataaacacttgctaatgatagatggattaggcttaataaactcgtctcacaattttctggcgaaatctgtaatttgttttattattagtctacgtttaatacttcaaatgtgtgtctatatatctgatgtgacgatcaaatccaaaaattttccccaactaaaccagaccttatatggtgtattttgagataaagtgattacttctagatttcatagaagattctcatattctagaatgaagaaagtataggatctctttgaattaaaggaactatgaaggaattttataggattgaaatctatcaaaaatttttctatttagcccttggtttaaaggattgaagttttttcaaatcctacaaaattcttatgggatggcttattgcataggataggttttggaggaaacttagcaaaaaaaatcctttgagtctatctctctcatccgattattgtatttttcctgtgatccaatcaaacgatcattgttgtgtttttcctgtacttagcaattcgctattttacacttacattcctgttagaattatatgttttttctattcttctgtttttttttgttactacgattcaaaggggtagctacattcgttattaaggagcaatgtaagtggtgacatctaccgagattgtaatctattggtgaagtctaattcaaccggtaaggttcttgtattgaaatctacccaccacattagagttaaaagtgaagattactggtatttacatttaataattcttttaaaatttaatactccctccgtttcaaaatgtttgacaccgttgactttttagcacatgtttgaccgttcgtcttattaaaaaaaataaaatatgtcaaactatatgtgtatatgaaagtatatttaacagtgaatcaaatgatatgaaaagaataaacaattacttaattttttttaataagacgaatggtcaaacacgtataaaaagttaatggtgtcaaacattttgaaacggagggagtagttcttttaaaggtacatgtatttgatacccgtcgataacaagatgatttgcctataggctatatatagtggttacgttaatctcaatacacgccccgtccaagcttctaattcgtcaacctcaacttttgccaatatggtctctcgaaggagcccactggcgtttcgatcttgggggtaaaaatattgttatcactgggtaagaaaaaactcacaacaaagtgtcaaaacagttactataatagagggtgattaataagggtagtagtttgagctgtggtagagtagtagagtgtggccggcgagcgacgatgcatgcgtacatgcattacgcggggcggggctgtgtggtccgatgaggcaactacttttccctgcttatctcatctcatctgacacaacaaagcgaaatgccaatcaatcagccaaatgaaaaggtggttaccgtgcgatgcggacaatgacatgtgggccccgggcgttacttcccgtgaccatcgctgtcaaatctcgctgaattaattaacgtaaggctgccccctccttctttgctgtcattgtctccaccatctgcgaagctaagggggctgtttagtttccagttacttattcaagtacctgtcacatcggatg

SEQ ID NO: 48666 - DNA, 20893 bp, Oryza sativa
cgatgtgacatgggctaaaaagtttttagtcccgtctaaacaccccctaagctaaacaacagatcagatcaccaaacaaagaaagagcagatgagtagactcgtgcagtcgtgctaagctgaaaccaaattactgttgctgcctgtgctactacagatagacaaacacagccaacggctcttgatgacgctttgtcctttgcatattacgctgcctgcccgctctgtagtctgtagtctgtaccctccactggctgcggctggcccccctgcatcgccaccatgaccagcccacagctagcacacacacaccagccttacatgatgcacaaacgaaaaggaagagctataatgtgcaaaatctgaattgatcagggacatgaatgaccctattcaacattataagatgcagaaaatccagacatatgctaataacatgcacaatggcagctgtatcaaaatcactttgcattcacaagttttcatagttgctatcattcatgcacgaggcattgtacctttgattggaagatcctgctggtctcatatgtcagtgaagtcagcaagggtcatttatcacctacagtgccatgttcaatgtagcaagatcacagtacctcatttatcactacatgagcaccatccaagccaactagtagtaggtaagtattttgcagatacagatcgggaaccaacatgaagatctagtggaataatgttgaagccttcagaaagaaaaaacaagaacccacattactggaagttcctctcagaatcacacaattcaagagcacctggacttcatacgcagcaagggtttgcaggaatcatgtttctgcatcagtgcttggtgaatctgagactgaaccaacaccaacaaggattctacataattcccagcgtagggttgtggcaagtcatatattatgtgatataaacagcagcatctgaatacacagaatggaatctgcaccaaatgtgactggctccaactacatgttacctgatccaactgcaaacattatttacagtataatagttgaggtaaggcagtcatccgtgcaaaacaaacatcagacatgcttgcaggttgtactaaaaaaaaaaactccctatttatttgaaatgccaacagtaccttccaaaccacaaaacacatatccttattcattgccttcaggaatctcaatggttttggagttcgcttatggggcacaaaatattggcagtcatatatttggagcacaaactctcggctaaaactgaaacattatgtattgatattcaacatgtttcgaaatcctcagcaggcgacagataatctctgagacaatatgtatattctaagggcattcgtttagcatattaatggttgacaaaaaaaaacttgcttcctatcaatactgtttgtgacaaagtgttttttaggaacaaaaaagataattaacaatgaacactaatctaaacagagaagaggacataatgtagctgtagaatcttggtgcaacacagaacagatgctcagattcagagtttttctttttatacacagaggctgcagatttgcattgttttcttggtaatttactttttcatcactatttagaactaagctattcactttcttccctgctccaggtaatatacagtacgctaggacagtcaatgtgtgcatcagctataaaagcctaacatcatgaataatagaaacaactagcaaaaaagtgctggattatgggattgattgatggaaactggcatgaaaagtttcaggtcggtcaaacagaaacattttgcattggaagaatggtccacaagacatacgtaagaaaggcctaagatgtttacaatttccattggacataaatccaggacagaatgacagaaagacaatattatattttgtataattccatagacctggatgtactggtatcacttaaaaaaatacaataatcccagttattcaattatgttgtcacccttcgtgaagaataatggaaggaagaatagggaaagcgcacatgaagaaaacagagtagacacgaatacaaacaaagctgagaagcttaactggtagtgtaagttatagatatcaaacataatcttaaatagaagcgttcatgcaatatttagacaccttgcatctttcaaaaaatacattgtcagttagctaaatgtaaaaaatggtctgctgatgcaaacagcaaagacattctgctcaaggcctcaaaatatagtaaaattaaccatacagacacgctcaaactgtcatacaatatgtctataacacagaaaagtgctagaaagatatatatttgcagacagttaattagcattggtaaatggtaattaaaaatgaccataatttctgaattgagaagcccccataaaatttgtatggataacatcatgcaggattgaacgaggaactcatgatcatttaatgtacagaaaacctgatgaagttacaacatttcctaaagcagaaggattaagaacctgtatcacagtcaaaactggaattcttgtggtatgccgaataagagctaaagggcttctctgatctgaaaagtcttcaaaatagctctagctttatcatattcattcagttctaccaatatgtctttcaaacgacgagccagcccacgtgtctcttcctcacttatgcctgacatgtgtcgcctctccaacttgtttcctagttctaccacgagatctatgaaaggctgcaacttttggcttggtgaagaccacactcctttaagtaatgcagatatccgctcagccctagcaattgcatcatgggcatccaaaatgatactcttcatatgaggaagaattttccccttcaacaattcttccagagcaagcttctctaaaacaggttttgcaaaaatatccttccacaaacacacatttttaagaagacgtatcgcaactccaaatctatgagcagcatactgcgaagcacctggaacagtccttgtcaccattgatccccaagctggcactgaaatgtcagcaatggcctcagtcagacgactattgacagcggccaatagttgatgcaatgccttgcttgaggttggtaaatagctaatgaccatattaattgcatccacagcgtttttggttctttgggtgcttaaaatatcccaacagtgcataatacggtggtgcaaaataggaagagccaccttctctactaatactggaatgaggtccttgtccacattgttagggtcagtgccactttcactgttttgctcaccataatcaaaaagaatcttgtgccactccatgccaaagaaatcagttgtttcatggagaggatcccacttcaaaagctccagtctgacataaggggtgaacacagatggcgcactcagagctacatgagcatctcggtaagccagaggatactgagttttccatccttcaaacttgtccttaacaattctaaggcttgagtattcctcggcagcatcactgaatacaagatcagcagtcttgagcaactcatcacggctggacagataggcactgctctcactatcactctcatcagtgcttagttccccttcgatatgttcattatttgcactcctcccttcagatgacaaccttttagattctgatcgaatttttcttcgcctcctgtcttcttccctacgcttaagatccattcgcttctgcatattgatatctctgccgaattcatccagctcaggtggtaggtttgaactttccctagcagcagctgccgccgcttgtgcagcattagatgcagcagatagataagctgagcttgatcctttgctaaggacagatactgctgcattgacggcagcttcgataacacttgattcatcagctagatcagctgccctcctctctgagacagcagtcactcgattctcatgcagcttctgcatgtgctcctccaattcctctatatagaatgccttatcattcaagaaatcacacatgacagaaatgtaatttcggagctcctgcatgtacacaaacttcctttctgcatcttgtaaaccactctcaaggctagatatctctgaaagagcttcagtaagatgtgtgtcagtcttgactaaagcatccactgttgtcttatgggtctccttaagcttcctgatgttctcctgcagggctttgcttgctacatcagcttgttgagcgattgacaggaactctgcactcccagatgcaaaaatagaagtcccaggcaaaaccccgctaaaggaaggctggtaacggggatcgattgagtatccggatggttgcggctggacctgcacaggagctggtccaccattcgctgctctctgagcagaagcatcatccaccctcctaccaagccccttcctgaactgctcctcctcccatttcctctcttcctcatcctcatcgtcatccttttcatcctcaacctccctgaaaccatcattgataacccccaaactggcagcaggacctctattattgatcacgccaaatacacctttcgtgctcctctggctatctgacttctcagcgtacattgcaatacggccgcgtgtctcatcatcatcctcgtcgctggatccaccagcagcttcacgactgctaagcacaccacctccatcaagggagatgtaatccggtgctgcatgcctcggctgttgaagctgctgccgctttgctcggatagcttcaattgttgcgcggtcaggtatgactggtccttcttcctcctcctcctcttcctctgactcatcttcgtctttgtcctcgttctgcgatggattccttggtccaatgctagcttgtgacataggttttaccagacctttgagaatcaccacgggctctacagcagcagcagtggtgtttgtagcaggagcaggactggcggcagctccaggcaaacgctgtcgtggggcttcagcggttggagggggagggggcggcggtgcacgcatgaggctcccagggagtgggcgggcgttcttctggagctcacggaggcgctccggcgtgtactctccagcatgcgactggaagttggacggcttcggcgcgggaaccgccgctgccacggccgtagagctcttgaggcggtccctggcgggcgtgagccggtggagagtcgccgcagctggcgatgccgtgcgggcctgccggaccgtagcagccgggcggcggcgctgcgacaaaggtccctcctcggcgtcatcgtcgtcctcgtcctcgacgaagctgaggcggctcgcgccctgacgtctcggcgacctgggcttgggaacgggaggggtttgggtcttggtggctgtgggcttggagttgctcgagtcgtccccgtaggcgtcctcggcgtcgtccgtgcggcggcggaagttcttccggtggctgctcatcccgcccgctcgccacgacggagcggcgaccaggggtaaaaaaaatctgcctagtttggggaactctattagggtttgtgcctagaaaaaaccttgggttcgagtagtgaggtaataatcaggtaagagaagaagggaatctcaccggcggcgacgggcggcggctagggttccggcggtgcggagtgtggagatccgcgtgcaaagagagagaaagatgggaggaaggcgaagaggtttctggatccggatccaataagaaaccgcctcccagctaaggcctggcccatatcggcccatgtggtgtaagtttaggcccgctccgcttcgtctcctcttggcctctcctccatcccttcggaaaaaccctagcaaatccccgcctcgatcggaaggagaccatggcgacggcgaggctccgatccgcctcctccctccgcggggtcctcctccgccactgctccgtgggaaccacctcgccgccgcaagttttctcccgcgtctcaggttcgcctcatgcttcgaatctctccccccgtggttctctccatagttaaatctgatccgcgtggtagtgcccagctatgagctgcgaaattgttgtgagaacgggcatacgattccatggtgcacaagttcggttctagtttgattaggtcctgggctcctggaggtgctgtgccctctatgtagtgctaatgttatctgactgactagctatatgttcttctatgttgtgagtaatctcggaatttccaagttagattgtagttggtggttagacttcggtgagagtgcatgtgtcaatgaaaaggtagtttaaatgacagtcctccacatctatttcagggatgattttttctaactccacccacaatccaacataatctgtggattcaagcttctaccttgaatttcatgatttattatctgctattctctacatattactctcgtgagcccccaatacctctttcggtttcacatgatttagttttgccagttacatgtgtctaattgtactgtattgaggtgcatttgttaggaagatgtgttatagtaattcaacagggcgcatggttgaagtccaatttaccactgtatgttacctcaaaatgcttaatagcgtaatgatcttcctttctgaaagcaacatgctcctttgctaacttaatggtttctgaaccattatcttggatagccgaagtatatagatttgcattcttattttttttataggtgtcaaaaatccgattaaagtcagctaactgtcctttacattatcagatcttcaggctcctggatgtattgcatggaagcatttctcaacattcaagcctaatcctcttccaaaacttgatggccttggttcagtcacttgtttgtacagtcaggcaagatgggcttctcaagctgctgctgttaaagaaactgaaaatagtggcagcaagataagcattgggccaaaatccaagcagatcaaggaagatgacaaagatgacaggctagtttaccagggacctatatcatcgaccataagaaaagtgaagcttctttctctgtccacctgctgtctctctgtgtcgcttggccctgtgataacattcatgacatccccagatatgaatgtaatcctcaagggcgctgttgcatccactgtcattttcctcagtgctaccacaacggcagccttacactggtttgtgagcccgtacattcacaagctcaggtggcgaccaggttcagatagctttgaagcagagattatgtcatggctggctacacccctcacaaggacaatcaagtttgctgatgtcaggcctccagagaccaacagaccttttgtcacttttagggctgaagggaacttctattttgttgatgccgagcacttcccgaacaaggctttgttggcgaggcttactcccaagcaccctaatgagtctgcattcaagaacttgtgattgaaggttgcccaatgacctcatggctgcactcgcgttcatgatcatttgttggcagtttacatttttattgtgatacctccctgctaatacttccagaagaagtagtatactatgttattagcgttcctttaaatccatgtggaaatcagtaaatgctggtgtcatactacgattttagttaagacactgagatggcgtgctgactgttcttaataagtagcggggacttttgcttaggacacctcccaacattctgttgtttatgatgttgcaatgctacacgcccgtgtgtgcttggcagtttaattacgtgatgctcttgttttggcttagagatatgatatatttgcaaccattgttcaaatttcatctggaacaccgagcgattggtcgctggttgtttttgttcagctatccatgttttcagagactttgcaaggcatgactaatgtcctctgaccttaaggacgcagatgcctatgccttcagaagagatgcggttgttatgcacagggcacagtttcgtcacacgtttctacctcatggcaaaaacaatcatagacagttgactttgaccacagtgtgatgtatatcgatcaaacaaactcccagctaaaatgtggtgcgtatgggctgagaaagaccatgtcttcgagcaaccaaaaaagtccttcaaaatctcttgatatcagtataagggaagttcataattgatttcctcttacacatgaatttctcttctactatggcaatgctagcaattcaattagggctttgcactcacaaacttagcgtccgcgcttactagggacactaacaagcaatagcaagagaagatatggaggttccaatatcatgtggacagcagcaaaattccacacgacctacaatgcgtggagagaactattcagatagtagatcctccaacttctttcggaacttcggaattgcttcagctttgacggccatcactaagcccatctccttgtaattcttcatctgaaagggtagacagggagtccattcaatttaggtgtacacaacatcaaacttagaatgatgcatgttcagattctgcttgaaatggtgagctaatgatcatcagaagaagaaagatataacgaaagcataacacaaaggaacgaatgttcctacttcacatgattgggatttggtcatttggctactactacctctgttcctaaatatacagcgtttgttgattttttggacatatgtttgactatttgttttatcaaaaaaattatgcaaatatgtaaaaactcgtgcttaaagtatttttaattataaaacaaaataaatgatacttacatatttattaaaacgaatagtcaaacagatgtccaaaagataacaatatcaatccaggtaccaaaggaaatttgtagtgccagtgccacaagtgaaccagttccagatgctgaaagtaactatgaaaatatgaataaaagaacagcataataaagcctgaagtacttatacacaactaacctcttgctgagccgattgttcagaacgtattgggaaagtgaacgaccatgaagaaagctgaggaagaaagttttgttaccacatcaaacagaactgcacaaagaaaaattaatctcagattgtcagtagcatgtcctgcttgatacctcgcgaaaaatttcgtcttctaacttaggatagataataggctcatcctcttctgtactgttctttgccttttgctttgctggagttttcctctacaccagatggcaaagacgtgttattcatacagctgaagcagttacaacaagacaggaactttcatatacagagcacaattacacttgaaaaatgatctatacaacatcttacacggaaatactgagcaacaaaacaagtcgctttgaatatcaatgggcaaaacaaacatggaaacaaattgcattgctcacctcaagtactctgacaaccattaggtactgcttgaaccggaaggagtcccggagttcttgtgttggcttcagatatgcgaggacagttgaaaacacgttataagaaagtagagaaaagaatgtgtttcacactatctgagctcgacgttcataaaagaaggtgcttgacaaacctcgtcttctgtggcccatgaaacttcgtcaaataacgattcatacatcttgggcacaagttcatatgggaaattcacaaaacggcggcacacaagcagacccacatcaggtgctttgtcccccagcatttgcttgagcttcttcttggtatccttgtcaccacaaacagcaagcaggtaatccttaagatccttcatacagcggtgctcctacaagacaacaccagcaagttgattaatcagaagccaccagtgcagcaagacctatgtatcttgtggatgaagcagtgagtaggttgaacatacactgtatcttccaagattaagcacgctaatgagaccaaacagatcgtcattgccaccagtgctgcttccatcagcaccatttccttcaccatcctcttcatcgtcagcaatcttgacaaccgtacccaccgtggtctgctcaaggatgaggtcgacgaagccagtgagatcccacggcttggagtcgaggtaggtcttgagcagcagcttgacgccatggaagtcgccgggcttggggtcgtagaaggcgaagtccgcttgcaccgtatcgagctaggagcaccaatccgaagagcaactcgcatcaatcgatgagtaggaactccagagaggctagaaccaaggtagaggtaggcactcacctcctccgacgcgtcgtcgctgtcgtcggagtcgctgctgtagctctcgtcgtcactgctgtagcgctcctcgtcgctggaaggctcggcccgcttggcgcgcttgggcggcggcatatcgcgactggagccggcgattcctggagagcggcgaggcgtgagaaggaggtagcgaggccccggcgacggcgttgccaattaagtgtaagcacgcgtacctgaagggatttcgtcggcggcggcggcgggtggatcctcggggggaggtagtggtttagaggaggaggcggagaagaggagggagcgagcgaacggggagaatccggcgaagggagccgggcgctttcggtcgccgaccatgatcgccgagcagtcggcggcggcggcggcggcggctggttcggagagggaggagaggcttgccttctccaatggaagtagaacgaggcccatgcatcaaggccctgtttgttgggccgcaaggtgagtcgagctccgtgcagcccatattgttaatgggctggaaggctaatgcgacaaatgtgagaggctgggcccacgcgacatcgacgaagcgggcccccctctctcgataaataagccgacccaagcctcaaaacaccaaccaaccaaccaaagaaagaaaagctcgactcgagctcgccgcgattgaatcgcgcatgggcacggcggcgggcgacgcggcggagcagccaccggcggcgccggaggcgaaaagggcggcggctccacggacgctggtgttcacgtacggcacgctgaagaggggcttctccaaccacggcctcctccaggacctggcccgggacggcgacgcctccttcgtgggcgccgccaccaccgcgccgggcctcccgctggtttgcgggccctaccgcgtccccttcctcctcaacctccccggcgccggacaccgcgtctccggcgagctctacgccgtcacgccgcgcgggctcgaccgcctcgacgagctggagggcgtttcccgcgcgcactacgagcgcctccccatttccgtcctcctcgccgagggcgcccaggtcgacgccgtcgcctactacgcgcaccgcggctacgccgacgacctgtgggcgcgcagcggcaagaaggggtacccggagtactcgccggccgtcgccgacggctacatccgccgcaaggatcggccgcagcagctcaccttcctggagcagattcgggtgttcgtctcatcgcagtcatcgtagaacccatcaattaatctcttttcttttcttaatctatttttcttctctttgcaatcactcctcctatttgtgcgatagcgtgcatgggccatgtgacaatctcttgtgatgaatggatgatcacgcgtgctacctaacctaccagatcgccatatcaggctatcgctgatcgcgtgatctgtagtatcacatccgtttgtgtgggggtaaaatcagccatcttcctgtaataaaatagaatgattttccattagactcactgatcattggctgtgaaatttgccggccgcctgttcatcagttatctcgatcaaggcttcaacttttactgtggtatgccggctcctagctggaaaatgttgaggacaaaaactcttcttcaacccaaagataacacaaccatcctgaatttggttgtaggggacgcaaattcaaaaccataattttctggtcacaataattgatgtgttcaagataacctgctctgctctgaattttctgtcatcttaattaattacagctgccttgaatcgttcagacaatacacgatatcttagttgactcggaaataaaatgaacgaatgaatctaaagacgagccttgcgtggattgcaaattggcaaaggcagcacagatgctcccgtcactcgcttagaataacaagccacaaacacaacacaagaacaaagagaatttgctttgtgcaagattcttctaatgcgattacatcaagaatctgttactgtcagtgtcactgtcaaccatttgcacaacgggcgggccttgacgttccagcatttttgacgacgaaaaagtggagaaaagagaggagacaaaataacagtcttgcgtggcaccgcctggagtccacgtcactttgaacggctctgctacaacgatacacccggcaagacagcaacttgcattgtgtttatcattggtggctcaaaatcacagcaaaacaagccattgcaatatataatatgatgtcgacagacggctgttcgcaaagtaccatttttcccacgataagctgaatctatcatactcgactgccagtatttggtcagtttccatacacggttagctgaatcttgccttcacaaattaacagtttttttccaccctgcaagattgcattataataaacctgtaacatttaagctatcgacagagacgtcagtaaaaggaacaaccagccagtttgcaatagcttatctgcttataataggaagatgaactctaactggcagtggcacagatcactgtgagaaataagaaataacatgactggttccatttagcacaggcacatcaaagtataccttttcttcccagctataccactaactggaatgaataccatcgtatgtttcaatcttgtcaagaaacgaataaaaatatcttcatgcggacagggttccaacaatagtaaaaaaggaaaaaagaatacagacgcataattgccaatcctctactttcatctacatagctgtgcaacaaatgcttctctgagctgcaccacattttaaactcaatacggtattctgtgcaggtttgccaaaacaaaaaatgctaatgatctcgccccatcaaccactcaaaggattctgtcgaggtcgctgataaaattggaggctatagatgtcagcttctttccagtttctccagccatattcttgagggaagacagatcttgagatgcctgcacaacaatcccagcaggtaagatatttgtgcgtttcaaggatcaatctttgtactgaataattcagtagtaactcagtgtagtaatgatttgcatgctcggttgcttaaaaactaaatatgcaagaggtgacaaaaggctggcaattatttacagaataactacctggaatgatattctgttgatgagatccgcagcacttaaatccagattcgagtcatccatgtcgcggcggccaaaaagatcagcacttgaaatggacgaagaaccctgaattaaagggggaaaaaaaaggagaaccgtaagggaaaaaaaagatgcaaacttctacagaatattcaaatgaagtactagcacaaacataaacaatagacaagaaatttcaagtctggaatgaagttaagaatgcttcgacaagttcgaaggagatgcaatgtaatggtcctcggacaaagagatgctaaactaatacgcaccgcaaacttttgaagggacatttgagcgtctttctcttctctgctttgattgccaaaaaactgagatgatgaaattgcctttgcattagagaattttttccttgcttcgtcagtctcctgaatctgaaaggtattcacgtccagtgtcagtacttattaacataacaaaaatctacaagcggaaaactatttgatataataagaacatgctagcaataacaacagcttgcatagagagaactgacttttccaaagttcaaaaggtaattattctgtgaaatttgtagatgttcactgatgattaaacagcagaatgcaagcatgcagcaaataaaggaaggggaaatgacatcatgaaatcaaaacaagtcaagctagtggatgcagcaaaatctagtgcagtgtttacattatcatagaaagtaaactttgcaaacttatgtattgatcagaaaagtcaatctatttattatttacttattgacatagcacaaacattggttcaatatttacctgggtctttgtggcagctgtgcttgttttcttttggaacccattatccattccgtactcttgaaagaagtttgatgattttggtggtgctacgtggccagtcatttgagttcctccatttcttgaatcaactgctggctcattctccacatattcaaaacgtgaatgcaaggacgggccactttttgtggtggaagtagtcattactggggcagcaggttttggctcttcaggtttctgatcatacaggctttcacttggctgcaacataaaggcaaaggtcagtccttaatgttcacatcatatagatagaagagaggaggtatattaaatattaactgtgggaaggaaccaaacacatgcatacatagcgctaatgatccacagtgttacctttgtggtgagctttttaacaccaagccctccagtcttgcctccaatcttcttcgcaccaatggacttctttacagaagtggcaaaagtgggatgagtaggggcttttggtgtctgcgtaggtgctttttgcgaattggtgacatcaggttcctgcttcccattggtattctctgctggtgcctctggtagcttgaactcagggaagtcatcggatggattttgtggttgagacgctgcaactggcgacgatggcaagacgttatcagcagaactcttggcaacttccttttgcagtatctgcctgtacagctcagcagcccttgacgtgtactttgcgtcgaccttgccaccatctgtccacccgtgctgtttaaagaaagcatgggcacgattgttgcctccaaaagccatcatcttcagttgatctggagtccatgaatctaggtttgttgacctatagaaaatacatacggattgtataagagaaagtgaaaataaaatgggtacagttttgacatttggcaggcacaatactagtacttttgcggagtatcaaagcaaggcattttatgatttttttttttgtgtggtagaaacaacacaataagacaaacgtgcagcatcatgagatgggtagcaatgtagcatagccatagtagtgatcatagatatagcagccagcaatgaagttcaatatgttcattgcagaaaaatataacgaagtagtaggtgatttactgtgaatgcgcatatggatctgttagaccaaaatgtgtaacttgtgaatgcaaatgccgatgggatgaaggtgtaaagcaggtattgacgttgatggcccaagaacctagatctccggctgcattccccaccagatgggctgtaccaaaaataggaccttttttttttctttttgatgaaaggctcggccagatccaccaaacccagcaaccacaggcacctatgcgctgtaccatatcccttttttggggggtaaagaagaaaaagggaagtattattgagatcgttgagctggtctgcgctagttcctaggagtcgtgatgggcttagagttggttggtgatggaaagatgaggaaaggaatcggatgtgatggcgtgggcggattgcaaatcttgtgaggggagggggcgtggatcgggatgggaagggggggtagaaagaaacctgacgaaggtgatgtggacgccgaggctgcggtggacggcggagcagtcgaggcagaggaagatgccgtaggtgacggaggcccaggtggggttcttggcgctgcagtcgaagcacatctgggaaattaacaagcacacgacaatactagtacatgagatctgactcttgaggcgaagaagaagaagaagaagatctgagaggaggaagttaccttgttaatttcccagatgtgcttcgactaattggattcatatttcgatcactcctcttcttccttaatgtatacacatcttggtccttccttcaattgatgatttgcatccctctgatcgatcccggctttgtgttaccgcttctttttatcactttgatctttttattagttcatgcatgtgtgtgtgtgcagatatctttggctctcattttcagcattcctttcgatccattacatatactgacagattatatatatatgagtcgtcattaattctgacttcatcacctttaagcaagctagcaggatttcatggattggcatttgatgcttgcaccccctacccatatcgccaaattaatattaactcgatcttactcttctcagagttttactcctcgcatatggccgttttcagtattaatgctcatatctagcaactgtacatgtacacataactctttgacaggtttggaactaaatcatacttgacttcagttcctcctaatttgcttttcacgtttctctaatgagcgaggaatacttacatcaatcgatttccaattaatcaaaagtcttaactatttagtgttagtttattttcaagcaattaattaattacttgcttgcatcctttggcatatatactacaggaagaatgaggtgaagaaagtggtgtgcatcccggcgccgccagcgacgagtagccgtggaggtggaggagaggtgatcccgtctgatctatgggcatggaggaagtacggccagaaacccatcaaaggctctccttatccacggtaaaccggccacattttcatctgtttcttcccctctttttttttttaacacgcgctcacttaatcgatctgttcatatatatcttgtacctaatgacccgattcatacatgaagtttatttgcatcaagatctcatcaaatatctttcaatcattcctattcctcccattcttgataaacaattaatcactttctgcataaatatttttatacttaatgaccgatccaatttatacgaagtttattggaatcaagagatatctcatcagatatatatgtttcgttcattcctattgtgtgcttactgcttagttatattatgttccctctaggtattaattatattcattttatattatgtaagttcattaatatttattgctcatatctctgcaggtactgtatctctgggcaaaagcatcaaaatcatggccatccttttttataagctaattaactaaaaaacaagcagcttccatatttcttgtttagacaatttcaattggtttgtcataattaaacaacttttgaaatatatatatactgatcccctatgagtccaagtgtaagccatcttagccttttttaaactctaaaagtatgttgtttcaaaatttgcaggcatcttttaatttcaacttatatttatggtttcggtgtaaaaaaacttatatttatggtttctcttgccaaataaattatatttttctcataaataaactaccaatattttccaaaacaatataaataaagggtaacaaaagtcgcttgagctatttttttttaattcttgcacataagttttaaatggcttacatatggaataaggaagtacatatatatctgtacaccccccccccccccccaattttcaattcaaacaacattttttgttagtaagccacaactttgggtttattacttagctagattacatgaagttccccattatttgcttgttggcttataagtcattgacacaatttaaattgagttaattgcactttggtccatcttttattaccaaagtttcactttttgggctaccctctagctaatattttcactttagactaggtaagattatctttgttgcagtttggaccaccccaagtcacttttctagtgcatctaccctctaatcttgtgaataatagtctacatgtgagccaggaagttagcggtttatgggtgttgatgtggttaaagtcatttatgtgctcgagaaaagtttttgggatggttcaaagtgaaacaaaggcaaactaatctagtccaaagagaaaagatgttttaaagggtagttcaaagtgaaactttggtgataaaaggtcatttactcatttattttaaagttaattttaaattatcctccttttttattttaaacttatttccaaccttggctttttaccactaatggtataaatagtatataaaaggcctaacctaaaattattttcggttgcttcgtttacttttgtataacttatcagccaaagccaaccaacgtgaatagaacccaaaattaatttactgcacaatacacatttaatataccaaatctccaatgatccaaatcaagtatacaaaacatttcttttagaaaaataattcgacagcatcataatagacaatatgcttgtctattattgattaattatttgtgtagtgttgggtttcaaacttccaatggcacttgaacgacctaataagggtttggatggatatgtatggattaatcaaacgtatataatcacttcagattgtgtcggagtttcaacattgtaccgtctgaaggttatatatacacctatgcccaagcaatccctaaaatgtaaatctatcatcaatgaattcttccatatatacatggggatctaataagtgattcatcacaattatgacccaatgtagtgtcatttgtgagaaactaatactcccaattgcaaattgcgtaaatcaaacattattaattgttgaaatagtagatattgcaagactgccacaaattaagttgcttttacttttgaggcaaaaattggaacaaaatagctatgtttgccgttttcaaattaatttaaaaggtaaaaatgaaacttcaagtacagggatcgataagcttaatttactcacaattaattaaatttctcgatgaattaacaattattctggcttagtggactcagtttgacattactgtgccatcttcaaatttgatcaaaccattcatacactgcattctaagggtatatatatatctaggcacaataattttatatatatgcggttgatcaggaaattaattaaaaaataataattcactgatgagttgattttgtgggcggtgatgatgcaggggttactacagatgcagcagctcaaagggatgtatggcgaggaagcaggtggagcgcagccgcagcgaccccaacatgctggtgatcacctacgcggcggagcacaaccacccatggccgatgcaacgtaatgtgctcgccggatatgcccgttctcatcacagtactcatgctactgcctccagcagccgccacaagcaacagcagcagcagcagaccaaccagctgcagcctgcactgatcacaagctcatggtcttcttcctcctccccattcaatctctacgccgacgtcgtgctcggtggccaacaggccaacatgatgatgacgacggagggcgccggcgctggacttggcatccaaccttcagcagctgataggtctttgcagagctggaggagttggagcctgataatcctactatgatcaatgcaaacatgcaggtgtactccaccaccagcaggccaggggtaagcagctatgatcatcagtggcacaagttctaataattaaaccatgcagtacctatatatatatatatcagaacttcaatattcgagagaggagatcagaggaaattgaattctagcacgtacaattaatacatcatgactatgcaaaatttacatatatatgatatgatggtcgcctgtgcgattattagtgaccaaattaaagattgtcagagatataggcgtgtacttacgcttatatgtatcacgctgaggtatactgtatttacaagaagataaataaaatatccatatccctctagatgcttttgattggtatcctgtatcgactgatccatatatatgtgcaatatattagctaatttatgtcattagtacatgcgtgctatattaagaagagatagatggcaaaaaggagtcacgtaccacatctttttctggatggcttaaaaattatcacattgataggataaaaggatctatattaatttgcatcatttggttgtcatgctaagtgggctggaaacactaaaaaatctatgttggagggggcaatagtgttagtttttttcttcaaaatttcctcgagctagctataaaattcaatgtaaaatttgaagacaaggggaggccgagttggccccttcgccgtctccgtctccgtctctaggtctagattagattataacgggatagatcgatcaagatagttatagatgtatacatgtaaacagatagagatgtatattaaatacagtacgttctacttttaaatctagttctttctgcacaaaatctcgcatgggaggttaattagttaaaaaaaaacgtgtacatatatttgtgctttcatgttcggatatttgaaatacctataccactttaaaagaaggcaatggtgcatggtggcaaccaccgcccctatcaatgacatgcaggttctcaaatgtactctacaataagaagactactagaaacagcttgattcaactagatagagaagtggatatattattgtatatcgtctatatatttttcccacgtgaatatgtaataccgtaccatatgattctctttttaatccgtaacaaaatacgggcatattctagctactaatatgtacatatatgaactgcatgcagtccccattagtagtacttaatttgggaggtagttatattccatctgctgcaagttttcatactttgcacatgagaaaaatgaatgaattagtctggtgaaaaataagatgaagaaaatgctttaatgtggtggtttaattttttgctttgcttggttttatggtggtttgtagtttctagggttggctcacactggtggagaacgggg

SEQ ID NO: 48667 - DNA, 6713 bp, Oryza sativa
catcatagatcccagtgggtgcgattccaagaccggctaccaaacttcactcttcggctttggtcctttgcctctctaccgtctctctctcatcaaccatgcaccttccaactcatcactactatcagctgctcctaccagctactccttcgtcccaaaatgttgctacctacccatcttaaaacaaggaatcgggacagaggatgggaggtctatccagattggttatcctaggatgggggtagcaacattttagacagatgtagtagtactaggattcagcactgtaatacgggggaataataatcatattctcacacacttgtttctttcctaatcctaaacatattccattataaaactgtgatttgaatcaactaaaagcgatgaattcttcctctcatgtatggctcaccttcatcataaacagggcgaccaaaaatgtgcagcaacatggcaaagtggtttgttacacaactgctttgacttcttcctgagttacaaaaaggcatttcttccttgctcatctaaacaaacgacagttccctcgctactagtactacaaacgaactcactagtcactaccaaagcagctcaacattcacaaaaaatgcgaacaaggcgctacatatttcctgccggatcgctccaccatccatgcacatctatgagccaatttcaaacatcaataatgcaccaagagtccccacgcgtttcatattcaaaacatgagctgctacaaccttgtgcttctgcaatgttgaggcgttttctatcgcatgattgcctcctctcagacatctccaggtgcctgcttctgcaatgttgtcctcataaaatccgagatccgtgacgatgcagcaaggcccctctctatgcagctgaaataatcttcctctttacatgagacagaaaggggacatgtttagagccacaatatatgcatccctatatctataatgtccagaagaacacatcaagctgaggcacaagatataaccataccggacatcactccatgggtaatggaagttatcaatcctctctcagaatcctcctctttctggtttggttcttttgaactagcagacttgcgtgaattggggaacaccaaatgagcaaatgatttcaattgctgcagatgacagcaaacagtaacattaatgcatatgcactcctaaagatgttctcagcattaacttatttagattttcaacagttaagactatacacaatcaacataacatttcagaagatgatacctgacaactagacccacctagaaaccaatatgataactttccacagagtagagggattaaaaatgtacttgttgtccacaagtttaaagagcgaattatgaaccaatagtctaagatgttttttagggaagaaacgagataaaaattggttctttcctttcctagtgcagaggacttaatcaaaacgagaaatttctacctgctcttctgctttgtttgtgtccaaaatcacttcaccatcctccagtactccacaaccaattgcaactgcatcacaaaagcttatgagatatatttcatcaatgagcatacaaagattactaacttacctgcaagatgtttcaaggggatgccagcaaaaacaaggctgcgcagcaagcattaattgcacatggaagaagctagacttagtcaaggattgtgcttgattgaaatcttgaagaccgaaatactaagaatctggaatattacaaagaacatactacatgttgatatctgctatagcaggccatgcccattcatataaagcacgctgtatacagtatgttgattggaagactactcagaaaaagcatggaaccagggacttccatcaatacttggcattttctcatcacaagtcagttatattagccggccaaaacaaacattttgcgaggcaaagaattcaggaataaaacaacgaaccacttatcctaactgtagacaaccagctgaaattagcagttagcttatgagattcacagagatacaggaaattaaattcaaatgccaatctactgcagctagtagccaaaaatctgaaatcattcctatatcaagtacaatgttcataatccaaaaggcacccagaaacaatactaagtagtacattacggcaaaaggatacagaaccatcattgcccacaacctgcaaacaaaaggataactaaattaaaggcaaaacgatataaggcagtggcatgatgcactaaacctaaagtacgcttgatatggcacgctaagaaaatgaagtttgacaataagtcagcaataatatagcaagcttgaatcagtaagcaaactcaatgaagattttgtagcaatcagcgtccttaaagcagggacaagagagtacagacagtcaacttgcgtggcacaacacaagagcaatgattctaacacaatttgtcaataagtataggtagaacaaaacaaatgcaaagcaatagccatagcagcatgggaagggagtagatcttatacctgaagaatgacagaggtggtggtgtttggatgaacagtgagcaggcaaatgctctgcaatgtcctcttgagcgtcatctcatactccttctcttgcttccctgcaaataaaaaataaaaaataaaaatagcacaccatttgagcgattcaattgggcgagcagcgatagcaagcgtggagaggagagtagttaccaatctggccggtcatgggcttccagacgacctcaatggatgccttctcgggattctcccccttcctggttcccggctttggcccgtacacggcggcgagcacgatggtgtccccctgagcccaccgcgcggagccatgggcgcggtcgagagggttgcgtgtgcaggagaaggggcggagctggttcgggttccgcccgtccgcgcggctctcctccatcctctctccttcggcgatgggaaccagcgtgacggcggcggcggtcgtcgaactccagaaaccctagaaaaccccctcctcctcctgtcctccccttgttctaccatgccaccgcggctcgtgccaaggatacagacaaatcctagccgttcgatctgaatccaacggtcgagatcgccccagcctgtcccctatttgggcgagttccaactaggcgaaaccccgcaacaaaagagtttccccctccgcctccgaatcccaaccccaccgccgccgccgcaaaccgtctcgccgtcgcctcgcaccggcggcgagaatggcgaagaagaacaaggagcccgcgtccgacgacgccgcggccatccgcaccctcttctccgcagacaaccccttccgccgcaagccctccgacgaccagcccgctccaccggcgcccaccgccgcggcgccccgaggcaagcaccccgaacccgaggtcgctgagccgtccgcgaagtcgcgcagggatgagccccggcgcaagaggaagcgggacgaggtcgaggccggccacgagcggcggaggctcggcggcgcacccgcgcctcctcttccggtcgtcggggagaagaggaaggtgcccgaagaggtggctgcggcggcgggggcagggcaagaggaggaggaggcgttcgacgacgagagcaagctgctgaggacggtcttcgtggggaacctgccgctcaagaccaagaggaaggcgctcaccaaggagtttgcggcgttcggcgagatcgagtccgtcaggatacgctccgtgccactcaccgacgtgagcaccattgccctgtgcttcgtcttcatcttcgtcctcctcatgcttatctgtgctgatttgtgctttgctgcagaccaagattccaaggaaaggagccgtcataaaaggaaaaatcaatgattctgtcgacaagtgagtgcattcttgcctgtctagtatcaactacgattgtttatgccattgcttaaatagatggcagagatagctacgaaatgcattttttcccctatcctttatgcttgcaatttcaaatggattacatatgaacagattacagctggttgcaattaggacattagcattgaaacaccgattgaaatgggcttgctcacacttctttcttttcctatcctatctcctccccattagttatagctttacaattcgcttctatgccctgaacatttattaagttctctaccatttgttatacatggttaaatgccctgttttttcactctctttttttaccacatttcaccttaaagtgttttcctttaactactgtcttgatatatacaagttatctgtcctatttggattgctagttgaatgtagtataggaaacttctgaatctcaacagtgttgattgtggcacaacttttatttagtgatataacaaacaactttggtgtagcttaggagtcaatattctgcagtttgtttctaatagcgcgtgctttgtttttttactgatgtgcctatgtaattatttctgcgtgcatggaatactttcctcgatcaactaaaatcaccacagccctttactttgtcattttggtttctaccttctgtgctgtttgaagcaaaggaggagataagtgacatgattacccaaatatataatggtgtactaagccaaaaaggcgcgtgcttcgtatagttcctttaagagcattttgttgatatttcgtatttttcatgatctgatgccatcaactctgatattcaatatatatcccagttattagacgcccatcaatgcacaaggactatatattgattgtaaaatgtaattgattgtgctgagcagctgcatatgtcaaatgtattgtttgcctaatgtttctcagactcattttgtctgtaccttttcaccctttgcagtgtacatgcctatattgtgttcaaagatgagcagggtgcacgtgctgctttatctcataatatggccctggtgagttggctttcttagaactgaaaacatgattagtttatatatctggtatataattcaaaaacttctatgttgtgcctgataagatagtttttcttgattttgatactttctagtttgatggcaatcatgtccgtgtcgatatggcatgtccacctcgtaagaaacttaaaggcgaaggacctctttatgacagaaagcggacagtttttgttggtaatcttccgtttgatataaaggtgagtatcatgtggtcagtattgtatatggtctgtgtaattcttttgaagaaaaggtcagatttattttttttactggcatgtcaggatgaagaggtgtaccaaaagttctgtggttccagtggttcagaaggtgatgttgaagctatacgtgttgttcgagatccagatacaagtctaggaaagggtatcgcctatgttttgttcaagacaagggtacaatcttttaccttcctatttcatctggtgcagtgtgacccactaaataagtcaaaacccagaagtccatttgatgtataatatgtttgtcgataaatggctttactatgtactacgtgattttgaacatcatttattgaagatggtagcattaaccatgccatacaattaaatgctagtactggaggaagacgataacagaaagacttccttgctgaattatgtattcagaaccaagatagccagttgacgactcaatcatacacttttatgctgaccattttaatatctgccatgcaggaggctgcaaacactgtcgtaagaaaacaggatttcaagattagagatcgccttctgaggcttgcacatgcaaaatcagctgatgcaacaccaaagaagacgacggatgctggcaaaacaaagggtggatcgaaacacaagacagctttaacaccaagcagcaaatcccatgaaggcagtgacaagaccaaacggaaggcgtcaactttgtcataccaaggccttagggcaagcaaatctggtgtggtgaagaaggcgaaggtgagccagcgtccaagttaccaggggaagcagcaaggcaggactagtgagacaggacatgatgctagttctcaaaaagccaagcgccctgctgttgcagcaaggaaggcaaagcaactagccaagaaacgcaagttggatgctcaaactcctgaaaatacacatcggagcaaaaaagcaaagaagtaaccatccttaacttgaagattgtcatcctgtctttgtacaagggggttgagtcagattttggacaaaatgagctcctgacattgttaaaccccatgcaagagtgatcttgaaatgcaaggctgatacaaattcgtagtactgtattacttaaattaaagtttgcgctcatgtatactgacattaatgttgttttttccctgtaacatcgtgcactgatatcattcattctgcttttgattgaaatatttgcattttagctttggttgctgcatatgtgccaaccttgtccagttgtccctgtgagagcatcaatatgcttggacatgagctttctacagcattccagttaaattgtcaaattatttgatgttaggtacgtaccattttgtgtataagtgctgctaaatgcaaacttggaacatccactgtaaacccgatgatgcagcgcttacaggtgctgataaaaatgcagtcatgttccatgattcatctcatatattccagacaataactcgagtatgtaagcagatgcacattcgtggactggatattaggatgcataataccaacttacataatctaatatac

SEQ ID NO: 48668 - DNA, 15011 bp, Oryza sativa
  unsure (1)..(15011): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgggtgaaatgactcaataatacttcttcgatttgtcatttttgtactggtgtgtacttaacctaccctagctagcttgatttaattaggcgcagcggcatgcatgtggttttgtgttcttagatcctatattttatggcagacatggtactggcagaatagagctaatgtccccttgccatgggctagagttcagcatgtgatttgattatgtacgtttgtcagtatagtttggaagaagatgagaaatgcgtttcaaatgtgcaattcatcaacaaccagcagcattgatggttggttggtacttggtttttgatggatggattcgtgtgatgctaagtgaagcaccaaggagagcgcgatgctgaacatggtgatcacggtgttccacctgctcttcttcgtgttcatcatcctggccggcctgtggaacggcagcgcgcggaacctggtgtcgccgcacggcctggcgccctacggcgtccgcggcgtcctcgacggcgccgccatcgtctacttcagctacatcggctacgactcggcgtccaccatggccgaggaaatccgcgaccccgcccgcgccctccccgtcggcatcgccggctcagtcctcgtcgtctccgcgctctactgcctcatgtccctcgccctctgcgccatgcttccctacaccgaggtagacacacattgtcactcacattgacacattactagctcatcatcattctgatggtgacatggggtgtacgtgtgtatgtgtgtagatagcggagagcgcgccgttctcggcggtgttcagggagaaggcggggtgggagtgggcggggagcgtcgtcggggccggggcgagcctggggatcgtggcgtcgctgctggtggcgatgctggggcaggcgaggtacctgtgcgtcatcgccagagcgcggctggtgccggcgtggctggccaaggtgcacccttccaccggcactcctatgaacgccaccatctttctaggtacctcaaaacacagtacaaggttgttgttaacttgtagatttgtagttaatctatatatataacggatcgattgatttcaacttttggagtacgtactggtatttatgtgttcataaggttgtatgtttttatttttaagaaaagttttgcaaggttttgtagaattgtggttgagttgttgtttatctcttctggttgaaagaggttgagaggttgtagatagagtgattagtgttaatacatctgcagtttatgccatttcacaattggagtttagaagtggagggttaaaatttgtggagattgtgagcttgctatagatactatcttctttctcttttacttgctgccaacattcaacgattttaccagttatatttttaattttgacataaaccagttatatgtttgaaaccctaaattagttaatgaagattgtattcacagtttttttgggaaaaagattgtatcgttcgttagttttgccactagaaatgcctatatgatattataatgttaaatgtactgtgataagattacgagaactattggtcaaagttatgtctcgaaggccgtgaaatgtcaaaaatgtaaatagaaaagttgaaggcagtacagctttgcaaagatctgacaaatgaggtaaactagtagtgaactgatgggtttatgtgatgttagaccccctgcaacctacataataaacctaatttagatagagcaaacggaagcataaaatacactaataacttcaccgaagtcaaggtccttaccactgtatcagatcatgaaaactgcaatgcaggtacctttttttagataatgtcattgcaggttacaacttatcataattcataactagcagcaatactatttctggcatttcttgaactgctcttacaaatatcatcaccattatctatgcgcaggattgtgcacagcatcaatcgcactcttcacagagctgcaggtagtgttcgagatgatatcaatcggaacactcctggtcttctacctggtcgccaacgcgctcatctaccaccgatacgcgaagctgggtgccaaccgatctctgcatgtcctcctcttcctgctcatccttacactgagctcccttggcttctccctctcgaggaggatccatgggcaatgccgatggggaatggctttgttcggcgccacctccgtgacgattaccgccatgttccactgcgcggtacggcgagacatgccagagccaccatcagagtggatggtccctctgatgccatggccggcggctgcatccgtcttcctgaatgtgttcctgatgaccactctcaaggtgatgtcatttcagaggtttggcctctggagctttgtgatcatagtcttctatgtctgctatggggtgcactccacatactctgcagaagaaaatgaggctgtcaatgctatgattcatcatgccaatatggacatatcttagcaatagcagcacataatacattgatctaggagttactttggagctaactagcttggcaattaggctgtctccagaatggtcccgaatctaaagaggatggagggcaaaagagaagctgcttttgcattaggttagactcttcttttcctgcttttgtgcttgcaaattggcttgtaacttttttttttctcaaagtgtacatgcaggactgtgaatggcatgttttccttttgatcaaagaccagaaattttgtctactttaaacatagaaggtgaccatttccgtagaaagtaccaagtgacagcagaagagtaatttttaacagctagatttaagtatctgtttttccgttcttttagaagtactgattaaatttacaggtgcaacaggaaatgccagtgcaaaagaagacaatcaaatgctggtttactggcttccatgtccaaagcaatgcacaaaatgcaacctcgatagttatattttttgtaagtgtagccatgaaaagcaacataacgaatctggagaacatactgatttcgttataactgaaagtagttgaatgtatcacatgaatataccagatataaatttcacaatataggcaaaaagaaaaccctgcagatggcagatacaccttcagtataaaagctaatgttttgatatatttgaaacagagaaccaaaaagtgctattttcctgagcattcaagaacattgcactcagatgtatcaaccattaaaaatactccaagtctggaccaatacagaaagatccttaaatttaccttcctgtgcccagaatatcgtaccaacacggttcaagagaacacaccgaagtcctataaacaacataacagaaatgttcttatcaaataactaatatttgcatatgcaataaaaagatacagctgaattatttcaaaagatggctctagttctttgaaagccatgggaattttcaaggaatattccacacaaagcaactctcaccagtcgcaactctaccttcgaaatgatttctgataaatgtaactgcttattatacataaccttatcaagaattcaaggaccacacatggtggaacacggaagtaaagccgagcatcatggagaaatttcgcgctttcaaaatcaacatgctacattgagtcaatgagcatacctgaattttcatttgctgatgctcatctcaagtggttgcccattgatgagcatgccagttagctaaagggtaagcaaaaacatgttaaaggaccactcactttgattgtggtccaacatcctacttaagtggcacttgccttcatctgcagaaaattggctgacacataaagggaacactagatttcactgttatattatactcaaaaaagtttcaaggagtcatgtggagttctcattggataggaagattctaggcaataacgaggtaactatagcatattgatcaacaatatcctgatgtttttcacctaaagcaactaaacttccagctcagctgagagcatgagacttggcatgacacaaacagataaatcgataaattagaatatcaagcaaagggaatatgtcagttgtaaaaggatggtgggcgtatttcagtaatttactcacagatgcctctaaaatctgtgtcacaagcgtggctcgatttttatcaaaaagacaaaaacacagacaaaatagatacaattaccatcaatgatctgaaaaccctgtggcaaaataaaagttctaatcaagcgtagaattgtctcaagttggttcagtcaagaaaataatggttgcaggcagtgttcaaattttaaaaaagagaacaacttatgagcaccgcaatattttcaaaaagaagagcaccacagaatctcactgaagcaatctatgtattaatgtatataagcaagtttaaacaatttcaagtgggaagagaataaatttacctttaatggcaagaagtaagacggccaacaatttctgagtagaacatgccctaaagaaaggcctcatggtatcttgatatgaaaaacagtatgctcaacattacagttgttctacaaaaaagagaattttctgttttctctgttttctgttttgcaatagatcaacttgattatcaaaaaagcaaaatttgattatcaaaaacagtatgctcaaaatttgattgcagtatgtttttctttgtttcctggtatctattgcttttgatcactctgtagtcaaattttgcatggaattttctggaggcattcaacataggtgctatttattattttctaatgtatgaatttatttagtgcacactatcaggaaacaaagaaaaacattatatgtaatttgaacatcactactgctttttccttccgcaactgcttgaaataaccacttagagagttatagaatgaagacatacaacaaatgacacaacagaacaatgtgtacaactgtgccatgtaatggtcaactggctactggatattcagatctatccaacaaaatgacatccagaacaaagattatgctctgcttaactataaatatgagaccacgacatgagaacttgcttgggctaaaaaaatttagattgtagttctgcctctcggtttacaaagttagtatcagccccaacccagtaaggatggacgaattagcaaatgaattctaaatccaagtcgctggaaaaattttctgctatgaaaagcgaaatctggtacaatcaggatacccccaaagctcaacaacatcaatatttccagtgaattcctttttcttccgcttacataatctgctgttagggcatgtaagtttttatcttgaccattcattcatctcacctcattttatctcaaccctctattcatttccatttcccaatcccacccctcataacccttaacccattatccaaacacctccttagggcttcaattgactacttgggcagttgtcacaaaggtatcaaccatgtcgacaagctgcaaaagaacaggaataactgatttttggcggtcagaaactgcaagtctggggggagatgcagttaaattctactatattctagagttcagatatcttcaaattaggttgccacacacaattgaacaaattaaagcttgagacaaaacaataaacacagaacaggctaagttattattttccatacgccatacaagatagatagaaaggttactacgatttccaagctacgcctacatcagacatccatcacagtacatatgaacaactctaattaactcctaaactcgcaagccaagccagtgggcaatcaggacaagcaagaaaaccttgacaggagacacctttgcgccaccgagatttactctagggagtcaatgatgcggtcgacgagcgcttccatgagcctccgctgcgaatcgaggtgccggagtgccatctccatgcgcatctgctgcgtcttcctcgccgcctccatccgcctctgctccgcccgcaggaaaccctccccgatcgccctcagcgccttcaccacgtcgctctccccgtcatcctccgcatcggcatcggcatcgccatcaggcagcctcctcttcttgggaggcggggaggagggagcgggaggaagaggcggcggcgaggctggcggcggcggggagggggattgcgacggggacgcggaaggggaaggcccgtcgaggagatcgatcgcgtcgaggagcgggcaggggcggcggcgcttagatcggaggcggcggcggagcttctcgaccttgtggcggcactggcgcgcggtcttggtcggggtggccgcgtcggcgacggccgcccagtcggcggaggtcaggtgcgcccgtcccaccgcgaggcgtcgcgcggtgtaggcgcgggcgagcgcgagggtctcgtcgggggtccagcacggcggcggcacgcggcgggcggcggccgcggcgttggtgggggaagaagaagccatcgcaacggtggtgaggaggaggcggaggcggaggcggaggcggtggtggtggtgtggggcggaggttgggggaagggacggtgaggggggattataacggaggagtctttttagggcggcgacaggtggcggtgggcgcacgcgggcggcggtgggcggcgtcggcggcggcgccaaccgcgggttgtgggggttgacatcttgacccgacacccccgcgcggcgcagccgcgctcggcgttaaagtttcgtgtccgttttcttcttttctagctttcgtgtttcgactttttgcgtggctaaaagaagtgtttttttgttgagcccacaggttactctagccgtcagatcgaataggataattcgatttgtatcaaatcttaccatttccattctagaatatatagattttaaagttaaatacggttattatgaaaaccgataaaattaagtggtgaaaaattataataatttagtagaaaagatatatgaaaaaattaaataataaagaattataattggttgagaagaaaatatttgtgtagaagatattatatttaagataaattataaaaaggctaaaaattattatattttaggatggatatagtgttttttttaagaaaaatggtacaatttgttactgtttggccgtagttttgtgttccgccgtgacgcccgtgggggtgccgtttgccgggagcggcggcatgcggtgcgacttggtgtaacgccgtgcgcgaagggggtagcggtagcgtgcgggagcggcaaggtggcgcgcggtgcggcggcggcggcgcgcggcggtggggccccgtgtgtgcgtgtgaccgcgtggtttcgccgacgcggccgtgatgtgagacccccacatggcgatgacgccgcgagcggcgcggcgcgacccaccgctcgcgttctcgtgggcgacgcggccgggtcggaggatggagcggccgagacgtcacctcaccgtgcggcgcgtgcggtgggacggccgcaccgacggggcccgagtcgcggtcacgcggggtcgcgtgccgtgcgcggcagccggggcgcggcgcccgcgggttccgccgtggatggcgtgtaggcgcagctcgagtgaaaccgtgcaacggcgggcggcgtgttgacgcggccgcctcgatcaggatcgggatcggggcagagtcgagagacccacgccatcacggcgttgccgcccacgtcgtcgacgtgccttggggtagggtgtggctggtgcgggccgcgggcgtggagctccgcccacttgcccatcagtagcagtaggatgacggatgacaacaacacgaaaaattacaggtgatgccagggtggcagggttaacagaaccagccaaccatgtcacctgtcaccggggacaaacaacaagctatcatcggtaggatgacggatgacaacccgaaaaatcagagaagataccaggattaacacagaaccagtcacccaggtcttcgggacaaactacctagtagtgtcctaccatcagccccgtttttggccaggagctgattatatgctaaacaactttatttatgtttgtacgtccttgaagatttaaaagctaatgctaaaaaacctatgttaaaaacttgtaaaattaactctaaaattattttttaaaatttaaattttggcataagctaattttatataggatgaaaaattgaactagtaatactttcaacgaaagctaggtagctaattgttaaactctaaacgagagctaggtagctaatttgtggaattctaaggtcattcataatgcaagctaatcctacaagtgtcttgagaggtgagagaatatattctcaaattatgtggatatgcgccaatgtgttgactccgtccgcgcccctgctgagccgctcgccccttatctgggaggcgcgctcttcgaccgcctcgagtgcgcgtgccgcaaggaacttgaaccgcacatgcgctgtgaaggttgtggctctgagtcaccgccgcttcggagatggaatccccaaaatcaccttcccgccccactgattcgtgcctctcacgctcggatttggttgctcccacccttgcattctcgtccccatgttgcatgtagagctagatatgttggtgttgcacgaggagctcgggccgtcccatcaggagaagctacaacaggcgaaaatggcgctggagatggatgttttcccaccttccttcctcctcctcaccttagccaaattcgagcttctagcccagggccaacaatctccaatccacttcggagcctcatcgttgagcctcgaccgtgcgatggcagcgctgacagatggaggcgaagcgatgtgagggagaagagacgaagcaaccggagggagaagaaacagacacgaggggtacaaccgtacaatggaattatttgttgatgacacttgggctggggatacaatggtgtttaaatcttctgaagataaagatgaagattaagtgtttcacgtagaacgaggtggtaataacgtgtgattaattaagttttaattattacaaacttgaaaaatggattaatctgatattttaaaacaactttcgtatagaaagttttcgcacgaaaatgcaccgtttagcagtttgaaaaaagtgccactttaatccaaaatttaatccactattttaagtagattcgaacgggccacagaagaccactcagcactgtggcccgtgtagcccaagagtgtttcctcaacttaggttgggtccattttagtttggtttgttgagcctggatacgtgcgtatcaaagttaattttcttttttcattccgattctctatagcacagtgtgaccggcggtttaagtggtcctttaggcccatgttgcagttgctccaacacggctcacacgagccctttcccacgctcgagtggccttgccacggccgggccacccgtgccctcaacaagagtagcctcgtgagggtacgcccgtggctgataatctgatatgtagtagaatctccgatctagcaaccctcaaaccacacgccgcgctatgagtgtaggacatcgcagcgacacacgaacacagctgctctagaggggaatctccgagatggcaacccgaaactatacgccacattgtgaatggcctaaggccttaaagtcgtaagatgcattcctatatagaccttcaaatgatttaatgcattctaacgcagtaacatccccatgggggctgaagcatcatcagtacaaattcacattggccgtagctgagcctcaggacattcaagtaatcaacccccttcgacaaggctgtggcgacgcaaactacgttcccgatgaaactgtgaatatagcctataccacaagtccgcgatagcaagcaaaagatatacggagcacatcatcacagccagacacaaacaggcccaatcaagtatagtttttcatgcaatctcaacgcaaccatttcatacctgtacatgaaatccgttcccttgcttacaatgctcattacaaatctgaaaagtagaaaaaagaagggagaaaaaaggaactctgatctgcgtttagtatacctctcatgaagcagttccttccaggttatggacgaaatagtagtgcagcaacaagcagcatcttgtataacaactgcactatctactagtataaggtcaaagcacatcttctaaaacaaccaagccagtgctccgctacagtatcaaatcgatctcacaccacatgagaaaaaataaagtactccagtacttggccaagcaaacagcagaaaaataggcggataaaatgaatttattagacatgatttaactgagataaacatcaacaagagatacactatagcattcagaactaataaaatatatgtgccagttgattctactgaaactattcagatgtcaaaattagaagataccatcaccaaaaaagtagtactgaactaaatgaatgcaatgaaactttgtgaccataaggtataaaagatgcattgtattaaatattaataattcaatagatatgtagtagattaatatgtgtatttgttcttttctacttcaaatcagtatagttttgtagctaaagcagctgaaataatcaactaaactgtatggttaagttttctgttcaccaattcgaggccctcaaacaaatcgtttatgttgctttgcatttgctacttgaacaaaaatgcttccatagtctatcttgtaaaattatgatcatgctgttttctggctatcttcattccactaaattcaaccaactgtcccttccttcccctcctccccttctattttagacaggcacctaattatccaacaacatggtgctgattccctcagatttcaatccaatatccgaattcaccgataccttctctctgtgctggatagtgcaatcttccatccataaatgataaactaatgcagttcaccaagatctgaaataattgtgggttgcccttatgggatcctactccaacaaacacactaaacaggaagtgatagaaatattaaaacatttctagttactgcaagggctggcaaatgtagtacacacataaaaatttgaagtgtaaaaatgcaaactttgatctcaggatccaataatggttattatcacttatatgatgaatcgagtaaatttcagacaatgcagtcacttactgtattaactccttcctatacctcagagaatggttgtattaacactaacaagtttgctaggtttgttgcagctctctgtatactgtgtaattcgtatttggtagtattaaccatcaatttcaccaattcactagaacacacattgcatccgctactgcctatagctatcaacagagaacttgttccctaatgcgttaatatcttggtaaaattgtctatttacaaaaaattgttacaaaataaatttggttgtaagaaatttggcccaaatatatctccatctaatgggataaagggcccaaatataccataactatcatgttatcatgatggtaaatcaaacataggtgtcatagcaaaaccatatttatttttttctgaaacttatttagtcagtgcatcatgcttcatgcttcctgcaaatttcttcaaagtttgcaattgtccaattaccacttctttcccaaagatatattatccatgctccatgcagcacttgacagaaattacagaaacgagtagcaagtgaaatgttgtgctcaatgatggcattgcttgttagatatacctgggtgccctgaattctatgctgctgctaatcaacagcggcaatccaagaccataatcatagttctgtaactgcaggttctgttatcttaaacttattatggcaaggcctaggtaatcgcttggtgaaagaactactttgagccatataaatggtttctcccaatttcagcaaccaacaaatccaatttttcagcagttaccaaataactagtccagagtttcagtctgaccaatcatcttttggcacagcaaattaccaaaccactagagagcagatgccaaatgtttcagaagtaacagccttacacaaagcgcccccttctaaggcttcatttgtaagtctgatcttcagccagcacatcacaagagatcttcaaggcaccatgtatttcagggaactacctcataatactattttactgaaacactccatatctctcaaaaatgtttagaaacactggaagtaaacatgccaagataccatagctggcgattatgttcacaattcttgaccaaataaagcaaagccttacattaaagaaactagccagaacatccacaagactattgctttaaccaacttggtgtttctgacttctttgatcatgtctaattcaggagcaccacacacaattgccacttcttgtccaggtccgtaggccttaaattaaggagctccatacaatccggggcctacaccaacctcctacggtgccatgtgtgttccatagacgatatgatgcaaaatctgtaccatcaaaacaattcatggttgatcacggagggtgttccttgtttgatagaaggggaagcatttgccttctctgaagtgagcagttaagacgatgatggcagcgatggtggtggtggtggtgtgagacatcaatgaaaacttttatgcaggacaattttaaactcaaggagaaacagagcagattcagattgaacacgcacctcagtaatatgaactagaaccactaccgccatagtagccactgctgctacctacattacgccctgagtaaagtgatgaatatgaacttccaccaacctgcacaaagagaaatatgaataaattggggaaaccaacatgatagaaagcttgggccaacaaaaattgatatagataatgagctggagataacattttgatgaagactcacatcagacccacgagacatgtagctaccactgaaatttgatgagtacattccaccagcatcattactgcttgcggaacctgaaaaggtgaaacaccaaatggtgtgagaatagatatctaatatatattgagcacgtgagcacaggtaccctaacacaacagagcgttcaagagcatatacctccataactcatgccatgccgaccactactgtacactggatcatgaccagagacagatctgccaccactgtatcccgcatgtgatcgtccaagccttcaaaaacaagcaatgtacaggtaagatattaaaatatatatatatataagcaaagagaaggaacatttcaaaatgtacaccaacctctcgctatatgtatctgcataccgggcactgctgccaccaacatcatagtctaagcgtgccttagactgacgaacactaatgtcatgatatcgaggtggcacatcatcctgacataacaatagcaatgtcttagttggctgaggaatatgaggagaaagcatgaaacacaagagaacaataattaactgccctcaccatctcagcatatgagcgttttgaaccagacattgtatcataatcacgaccacggccctccctatatgttggtaaaggacggtcaatcttccctccataaccatcatcaatatatgctcgcctatcagaaaggcggggagcactacgaggacctaggtccgaataggctgacccccggggtgaataatcatccctataggggcgtctatccactggaactcttgaactatagtcaccaaaggtagctctgcttcttggcggaggaagttcatcacgccttccatattctctccttgggcttctctttgggtacacaggagctgtaaacagatgaagtatgaaaaagtgacctacagtggtttgcacagcaaaagaagagagagagagaatagattgcacataacatctgcacacctgggggccttctgtcatatgatctctcgggtggaggcaaacgcctaactctatctggtattgacataacagggcgcctatctctaatatctactggcctcttcagtgggcggctcctgaccggtggtggtaagcgactaacatcgggtcttaaaagacgaggtggaggccggcgaagtggaggaggacgatcatatgcaaaacgtccacctcgaggagcaccctgcccaaccctaaaatttcctcttaatccatgcttcattctaggaggtctctgcaatggtctcgacaatctggctctcacttttgcctgaaccatcaagtagcaaggtgttgtgtaatattagttcatgtccaacagaatgagtagacagtaaaaaagacccatcaaactcagttggggaaacagaccttgctgtcaccttcaccaatctcagaattagttatcccatcagcacatgcaacagcattatcatgtgtatcaaaagtaacaaacccaaaatcctttctcttggctgctggcatatttcgggctagttcaactttctcaatagctccatattttttaaggtacttcttgacacgatcttcatcccatgagggaggaaggccatcaataaatacagttctaacctgaaccaaagaaccagaataaggattcaacagatttaatcaaatttgcaacatcaacaaacaaaagcaccaaaataagtggttacctgtgccattatttcatcgtcaacttcggggtaggaatcagcaaaggaaacctttgcactacgatcaactccaaaaactacatccctcttctgcaatcgcctaaaagcatccattgcttcagggcgagtagaaaactcaagtaaagcatacccacgattcattcctggattattgctgtcctcaactaatagtagatcatcaaaattct

SEQ ID NO: 48669 - DNA, 60395 bp, Oryza sativa
  unsure (1)..(60395): unsure at all n locations
aaagaaaacctgtttcagcatcttacatgttctttagtccatgtcttgcagatattgcccacaaaaagagtatcgttgtcatgactaggagcaacaccacattgtttgcctctcacctacagcatttaatgaattatgagattattacttataataataacacaccataatataaaatatccatatctttagaccaaccgaaggattctttagctctgacaccgcccgccttgcttgttctacagtcgcatatcgcagaaaggcaaagcctttatttttctttgtaacagggttcatcatcaaacgaacttcagtgatctcgccaacttcaccaaaaaccttcctaagatcgctttctgttgcatctttatcaagcccaccaacaaaaacttcaaactccttccgcttgcgatgctctttcaccatttcatgatgctcttcatcctccacatccacattatgctcttcttcggcattttcatatccttcaccctccccatcgtccccaccatccaattcctcgtctaccatatccgtctcctcttcaatcacatcttcagtatattccaccattcatcaccatcctcgtattgctcttcatattgctccaagtccttctcatcgtagtccacagcagcctcctcttcatattctggttcatcttcaaattccaatcgttcacctttatcctcttcatatgtttcttttgtagttccctcatctaaaaatgaaataagtacaaccttactacatgggcaactgctatccaataaaaatatagccaaaaaaacagccatgagtataaagtataaacatacgatcttttatgttttgccataaacatatgatcttaatgttttattaagagtggttctcactatgttttgcttgcataaaactaggaaagatcaatgttgctgtttgttgaagggcaatgccatgtactcagactgaatcaaagaccaaccgttggaacagtactaaatgatctcatagatctaaattccaactgcaaaccatgcgaccataagcaatgctaaccaggattaaatggaaaacagtcaatataacaagacatccatgacatgctacttcggacgttcattgcaccccacataaaaatacactaatgcagcaatcatcttaatataccaaaaaactgacatagtacaacccaacataaacgatctataccaaaaaaaaaaaagaaagaagagaagaagcaagcaataccttcaccgtggctcgcgccgttcgctgcagcgcggacgaggccttctcctccgcggccggctgctgcagtggcggtgacggctggcgcttctgctcctccaccttcggggcctcctccgcagccttaacctcctcggcgggcacctcctccacggccgcctgcgccttcaccagcctgcccctcgtccctggccccttcctccccgccgccgcggcgcccctcctagccttcggcggcatctccccccactctcacaaacaaaaccaaaaaaaaaaggaaaaccacctgcagatcaccaaacaaagacgacggatttagatggaccaaggatcgaatcgaggagggaaggcgaggctatagaatccatgggcgtacgcacctcgcgtcgtcgaggatcgagggggcgaggaatcgaaaccctaggagagggccggagagccgaaacgagattgcggtgggaggcaacacggaaaggaacggaaccctttggcctaggtaatctccgggtcgaggcgtatatcctgcgatgacgctgggcgttcgggcgtatttacgctattgccatcaagacttgtctcacgcgttgaccggtctcctgcgaggcagagggcgttttggtcttttcgtgaactgtattttgtttttgccctgtaaattgaagtcggtgtcgatgaaattatggatgtgggaccggagactcggcagttgagtctttctttggagaaaataatatggaacacgaacaatataatactcaagattaatggtactagcaaaatactgcacttgcattgcaatgaataaaaacgaagtttaatggtatattaccctcccttcctcctttgtaagctaccttactcctcggcctcttctaattcaatactggaactttgatccttgaagcctagactcaacaggcgggagagctctctagtttcccctaatcaagctattgtaatcccttcttttgttcggcccctcttcctcctcttctcccgttcttcggcgacagcggagggaggccggagggaggaagaggggtctagtccctcctccctattagtatgtatagacctcggggaaggtgagccgaggggaatggcggcttcagggtcccatcccgtcggcactcccgcttcctccccttgccaattcaatcctgatggcgtcgtctcctcgtctcttctccctaatccgctagagtgaggaagggcgtcgcaagggcaccggcagctgccaggccaatcgcgccagggcggcggtagctacaggctacggcgaggctgaggcctccagcaacatgcggcaaggcaactggaactctggaagcagacaaatttagtcctatttgggggagcttgtcccagctgcagcttttcccaaaagctgcttctgctagaagctgccccaaatagtccacagcttctgagaatctgtagttacagattctgaaaaatgaactaagaagccagaagctggagaagctgggtttcagagcttttccagattctcagaagctggctaccaaacagctgtatctcagaatctaaagctccccaaacaggcccaaagcttctcactggagaaggcagtataaatccacgtattcagaggcctgatgcaaaaaaaaaaactagtagtcttgcaaaccagagctttgtttgcaaaccaattgcatcaaatatgcgctgaatcataattacttacaaaagggcttacgaaagagccttttcaagaacaatactccaataatcatctaaagaaggaacagggagcttgaagatcagccgtcctcaaaaagttctgaatacatgtctgatgtaaattcctaacaaatcctatgttccacaaacaagatctgaataagcattgtgtactacctgaatactacactaaagaaaatttagagttccacacttccacttcaggtgagtttcagaaggttcagagttccagaaacagactttggcacttctaaaatactgaagactcacttcatgcgagctactagggctgtgtttagttcacactgaagtttggaagtttggttaaaattggtacgatgtgatagaaaagttgtgtgtataaaaagtttgatgtgatgaaaagttggaagtttggaaaaaaaaaactttggaactaaacaaggcttagaataacaaaccactctgcatgctatggacatggcatgactgacaaagtgtggagcttaatttggatccgtactcactggtgctgtgtggagttggggcgaacacgatgaccaggagcaaagggggcggagatggctgaaagaggaaggcaacggtgccctgcagcggggagggtggagatggctagcagaagaagcggggaggctgtctttgtgaagcaacgacgccctggatcgatggccggcagtcccggcggcgcactggacggatggaggtggcgccttggatcgaaggccgcaacgatggacggacgcccgatggcaccctggaggaaaggcgaggccgcgccgtccgcggacgtcaccggtgcccagagcaaattaagacgaggatgcagagcgaagggttaccacacgtgttattccgatcgtatcctttgcaaacggatggatagacaaagttggtacctcttagtacctggtacctcgtggtacctcaagaatggtaaaaaattctcttccacgtgagaatagatccgctagaaaaccataatagaaaaaaaaatgattttttataaaaccattcattcgttttactctatatccccttgcaagtgcaacacatggaacatacatagtactagtaaagtatataacccgtgccaatgcacgtgttattgactatagtatttggagtctgaagaaatactctactagattagcttaggacgtgtacaaaggtagagtcagatatgaactctacattacctagagactagcatcttacaacagttagagacaacatagtctctaatcattaatgtatcaaaatactttttcttacttttttttcctttctttcaccgccatacaacaaaaattgctcttataaatgctaagagtcgactataagccgctgtcatgcataacaaccatactcgtttatctttcttcgatatattaaatttatttgcatggcaatagagagaccattaataaataccgttgtatatgcccttacctgcggcaggaatctgttttgctgtgataatttgggacatcatttatcctgtcctccgctcataaggcgccggtttttggaccgaacgacaagatagtcagccatgcaggtcaagatggacacagagtgaagcaaaaagtcaggacatagatagctcaccgagcaggccaacaacgacgtatccgggtcaatacgttgaagtacatcactgttcggcagtcaataattcttgtcaaccgggtgcagatttccaagaatgaaaaaagagaacgagagatgactagatgagcacaaagaggaagaaaaaaaaggatgttattagcaacatcaatgtagtgtgccgtgtgggatcatctagtcatcctctcgtggttcaggcagcggtcgagggagaggaggcggtggttgggacttgggagaaagccagagatgtggctgcggatatctttccgcatcctgtagtgttgatgatccaatggacgccgtaatgtttgaagtttgaacatttcaaacacccatgatgcttgcagaatgcagattagcaggaaaccgtgtgtgcgttctgcttgcttcgagcaaaagcaagaaggataaagaggttggcaggggaggtgactgagaactgactggttgagcactttgattcttcggagccggtcagccggatcacggtaggcagtacacagttcatggtccatgactgttgtatcaaacgattcggccatttggaggcatgtctcctcttgagcatctgctgccattgagtttcttgtgatcggcagctgtctactgttggatttctcttccatctggcagaaatctggctttgctggatttttcttctctgatcgattggttcttccttccactgtgttctctttgctcttggccttctcctggttggattttaatcacgtagaagtacagacaagtcattgtcgagcaacagaagaaatagaaaatgtctctgttttaatcaccaatgcgtgatctttttctctgcaacctctgagttcttgaagtacctgaaattgtggtagcagccgggcttcttcctccaagaaatgggctgcatgtgcctcttccaggacaagcgcaggagcaagagacggccggaggtggcggcgccggcgccggcaccggctccgccctccccgagtgccgctgccgccgtttccaccgatgcgtgctcgaacgtgtccgtgccagccgccgcgccgagcacgtgcacgtcgtcgtgggcgagcacgaggccgtcggcgagctcctcggcggtgagcaccccggagccgtacgaggcgaggcagggcgccccccgcgagctcgctctccgcgagctccgcggcgccacgggcgacttcagcccgctgctcatggtcggccggggcggcttcgggtgcgtctaccgcggcgtcctccgcctccccggcgagccgccccacggcacccccgtcgccgtcaagaggctcaaccccgacagccgccaggcacgcacacacatgacgacacgctcccggttgatctcgaccgcttccgccatttgtgacgactccattgtatcgtgctcgtgcaggggcacaaggagtggctcgccgaggtgcagctgctgggcgtcgtggagcaccccaacctcgtcaacctcctcggctactgcgcggcgcagacggagcgaggcccgcagcggctgctggtgtacgagttcgtgccgaataagacgctggacgaccacctgttcgaccgatcccaccccgtcctcccgtggggcgtcaggctgcagatcgcgctgggcgctgccgaggggttactgtacctccacgagggcctggagtttcaggtaatccacatcttctccgaaaaactgcgcgtcttcatcagaaaacacaccattttcacctgattttccttgtttgtcagatcatataccgtgatttcaaggctgcaaatgtgctgctggatgatgagttcagacccaaactgtcagatttcggattagcaagggaagggccatcagaaggtcagacacatgtctccacagcggtatgtgcaaacatcacagttcagaaaatgtgtcaactcaacacggatcatatcacttctgaattcttcagaaatgaatccgttttggctttggtggatcaggtgatggggacgtacggctacgcggcaccggactacgtccggacggggcacctcacgaccaagagcgacgtgtggagcttcggcgttgtgctgtacgagatcctcgccggccggcggtcgatcgacaagagtcggcccaaggacgagcagaagctcctcgagtgggtgcggcggcaccccgccgggagcccgcggttcggccggatcatggacgggaggctgcaggggaggtactccgtgagagcggccagggaggtcgccgagctcgccgccggctgcctcgcgaagcacggcaaggaccgccccgcgatggcggaggtggtcgagcggctgaggcgggcgacgcggcacgccgagctggacggcgaagtgtatgatgatgccggggaggagagctcgagctcgccggcggcggcggccgtggaggacgacgtggccgtggccgcggcggcggcgaggcggcggatgctccaccttgctgcgctcggggagaacgcgagcgcgagcgctcacgcgaggagaaggctcatgctcatgagggcggctgctgctgccactgccgcgacgtgacctgttcattctcttgtcggagttgacaatcacaatgcaggattgacttctgaaggattttttttttgtgctgagatgatatttttttgttacgggttttgagaaaaacaaattacaggactttgtgactacaacttgtacagcatggttaatccaaataatacaattttcagtagagacattgtgacaacaaattgaacaatgtggttcttttgtgtaaacgaccaaatcgaacagcacactaataacttcgtgaaactgaaagctgaaggaatcacatacacgcaggagcaggcatggaacgaattcagttatctgcaattggaaatgctgacccaattttgctgtttcccattcggtagcacttgatgtttactccgtacgggccaatctcaacgcggttatcttcccctcccataaagaagcagagcgtgtagagtgcaacctcaaactcagggctgacaccaatcagagtgctggataccgatttcagaacaccgtgccactcaaactgaatagtcaatagctgtgtctctgaatcaggctgccaaaaggagcattgcacattttagctccattactcataatcaagttcatcttgtctatcaattttaagactagatacttaccgattccccacgcctccttgggaatatgtaaccttggtaatccacattcccattggcttcttccaggtaaaactgcaattgtttcacgaaataccaatcagagtaatttttatgcaaggaatacaagaactgttgtaacattacaagaacttgcctgaatccaattatggaatcctgagacctcattctctccctgtcctcgtcgtcccttgatctcaccaacgaacacatgctcaaatgcagaagagctgctagaactgccacctcttccatacaaatcgaaccatagcgatgtcagcattctcttgaagtcctcatagtcttgagacgcgactcccttgagcactaaataccggtgtaagtacttgattggcgctgtcctggcaatctcttcaataaatgctacttcctcgtgcttgtcctgctgagtaacaacttctttgtacccttgatgtggattgtaattgtcaagaagcgcgcagaaacgagagtaggtgggctttctaagcacatcatcgcctagccagctgaacaaagtttcagatgccatatcacccttctgatataccttcttcccttcgccacattcgattctgtagtccttaccaggtgttaggcggttcatatcgagttcccacagccggctacaagctcttgataagctgttgagctcctccctggttggttctacatttaggccatggtggatctgaccagcatcctcacagtactgttgttcagatggtggccttctgtatgcattccatgcttcagactgtatagtatagtaattatgaaggtgctcagaattcagacaggataaggaagctcagaatatattaatacggcgatctcatattgtgaaatggaaactgacgatcagttcatttataaaagggtaactgactctgacagtggtagaacgatgcaaacactaaagttctcaaaaagtacaataaaccaaagtgcttgggctgatacataaagcttcaaagtattggtcaatggtattgctcaaaacctgaaagattgttggtcaactgtgcctgacacttggggctcattttgtcatataacagagagtgcaatagaatgcttgattacacattgtagatatctcaggggctcaaatcaacaagttaagaaaaggggtttggttgaacaaaatggaatagcttaggggccctttttgcatgctaaccagttcaaagacagcatcaactgacagacgttaaatatcttttagaaaataatatgtaataagtttattgactttattcagccaaacaagaacagtgatacggggtgtcggggtatttatagtagtcagttgaccttgagtataaacatgggctcaaattgactcaaaaacagatacctaaaaatctcagtaagttataacatttgcagatgttattgtatctaattgttagaaaaccaaaagcaaacctgctgtggccttccatgatgctttttctcaccaacagtctgccaccctccatcatttctctcatctccatcctgagtaccccaaaccaaacaggtaagcctccacaatatacactcaaaatacctgtcccatcttcaaactgatgctagaaaaaaaaactaaatagcagcaggaagaactgttaaataattgtaacttcgtttatgagattataagcatgtattttgcagtaaatattagcacattattaacttgatcaactcattagtcaagcgcaacgagcataggaaaaacacatccggaaatgagattatcaagctctatttagtattcactccaagcttccatctccttttgttttccttttgaaagctaatgagccaaggttgagatatacaagcttcaatcgagctgtaccattagaccaactctttatttttcaggaagaagcttaaacaagaagatcaaagaaataaagagtcattctacataacgcgcatatactactagacctgtacactctatatcactattctgtgactaaggaacaaactcaaaatgtgccacacacaaccaccaaagcaccaccaaggctacaacacgacaaacatataatatgtgaattgctcaaattcatgtacatatctgtattgcaaaaagaaaaaggaagaagataactgaatcgaacctgttgctgcctcctgtaagctggcgcttgctgatgctgctgtgggcgtcggctactactgtccctcctgtactcttcctcatactacagacgtggagcccagctacgtaagcagagtggcacacttacaatttttacagaaaatgtgtacacaaaatggaaaacctggttgtgctgatgctgcttccggccatccaccctctcccaatccccatcctccctcctctcttgcctcccatcctaaattcaaccagagaattaaattattaagcacttatgggtcttttggggtagagtggagctgtggagcagaaaaacccagctccacccccgtagtacaaatttgtggagtagctctgctaactccgctccgaaaaacaaaggatttggaccgcttggaacagctccagctccaaataagttggacttgggagccagagctgtgccaaacgggccttaactacgcccctactaccataacactaactgcaaactaccagaagaagattaactaaaaccgaattccggtctggattaatgttctcccagacaaaacagcaatcgtcactcacccgcctcgaattccgatggtccgggcgctcctccgcctcgccgcccttgtgatcggagaccacctgccacatccccaaaacactaagaagcttagaccgacaaacccaaccaattacatccctcacgatttcctttatcttcttccgcaatcgcgcgaacaggtggcgctcacctcggcccacgtcgaccgcgaccgctcgtcgccgcggccctcctcctcctcccgcgcggggcggtgcctcctcggcgcgtcgtcctcgccgccccgctcacctcgtccggcgccttcgacggcgtcgatcgccacgttgatcagccccttgatgagcccgtccatggcgaccgaggaaccgcgtctctcccctccctccggcttcgcccgtggccacggggcaatgggcgaggcgaataatggagtgggagatctgatcggctgttgggatctacctggatgaggaggaggaggagtgggggcgggatgatcgagtggtttagggaggatctgcatgtgatgtgggtgattgccatttcgacaattgggctggccggcgggtggagtaattgcgagggtgatggggacggagaggcggtggcacggtggcaggttgacttgttgctgccctcccgcctctgttaatttaaccgctgctgccgacgccgacgatccgacgtgtcgttccgatggcctgtacgcggttgcagcatgcgctgtaccgggccgaaccagcgcgtaatgggccgattaagcccatgaggttggtacgttgggctgatgtagtaggagcggttacagtttgggccttttcctgattcttgacggcatgatgggcttgatggcccagttatgggtctcgtgtctccaagttgttcatcgtgcccatgcaaccttttcgttatgtaggcttctacgaaagtttcgtagccttaaaatcttcttagcagagtagcagtaccaggaggaaagtagcgtcagtttcagatgcttttggttagttaagaacttttctagctcctttcagaagtccatactgccatacatggagctaactccaggcttgtttttggcaactaacgctaatactccgtatgacactcgttgcctttataggccgatgctgatgcagtgatgctctctatcacaacgaggccttgtcgatcgtccactctacgactctacagattgatttgggtcacggtgatctctatatgttatgcctgtttgacttgccatttagaaatgttagtgtatgtttcccctgttctgatgagatcatttctggcgagttgcatcagaggaattctactttaccttatctgttttctttattaaatttggaacgccatacacttgattcctgtaaaccatgagctcatgtggctaactggctatctctaatatgcatttgactttccaacagagttgcgctaggtttatattaaccgtaccagttaaatattagtccagtactccagtgtaaccaatagaatttctttaatactgatagaaaacccagctaatttaggacaatttgaatttgctaatggatgatgaattgttaactgagtttatgttaattacttgagtatacaaacgaataaattaatattacaaaaaatgcacttttaaaaaatgtttttaagaaatataggtgaggaaagtttttttttagaaaaatcttatcgtttgctacgtgctctttataatcaacattataatctcaaaagaagggcatttaatggtacgacttcagttccttttttttatactgatgcagaggctttatcacaatactgtgtcgcgcattgttcattctactacaaaccgttgcaaccggctgtactccaccaatattctaggaagaataataccccccaaacaaaaaaaaaaactacagtcaatgggaaatcttaattgaaaaatgagatggatgcaccggatttcttaacttaattacctgggtttcgtaatagctacagattgattgggggctcgagtgctcgacgatctctagcctatgctatttgactttcgatttggatatacagagtcattgttcatgtccaacttctgatcatatcattttctgattatatcatttctggcaagtagcctcataagaatgctactttaccttatctatttcttagtattaaatttcggaacaccatacactgaacaggcatgagttcatgcggccaactctattatgaatttgactttccaaaaacaatgaattaatttgcaattaaatatgccccctaaattttagtcagaaaaaagctggataccaggagtacaattttttcctttataattatatcaggactaacttgacatcaattgaattaagagtgacgtggaaccaccaagtgaggtggaacgcggttgagtgcacatgcacgataactatatttgcacagttaaaatttagttgagtataacacatagagggggtgttcggtagtaccaattgtgactgaaagcggggcagtaactataataccagagcaaagatatatatctacggtgtcagccgcactactacggctgtgtagcagcagcttaacacagtgaaacacctccaaaactcttagccccatcggttggcctaataattcaaagcaaaaaccaaattttaaaattttgaatttgattttaaaatattttgaacttaatttctttttagcgttggcttttaatcactatgaacaaatatataaaatttttacctataaattaatttttattctctaataagctattttggcttattagaaaatatggacaactgataaggctcttttttctattattattatagaaagatgcacactacactcgtgtgcctcaggaataagaggagcaacacacgtccagatgccaacgataaatctctggtctcgctaaattattgaatacggtgaataaatttatacaaactgcaactccaatatcacattttctttctcttttccacccataaaattctcttcacttctaacgtagaaaaattccagctcatttaatgatatcacttcactatctcttttgtcatgctttaaatcgtgtgccgattcgtggagacgggtatgagtatgacaaccaatgccatatattccatacctcagtcgcatgatactactactagtactatttacacgaaatcaagcgatactgaatctgttgcatctgtagcaatcatgcgactaggtacatgaggtttgcatttgcgtacacgaactcctcaaatattgcgaatgcttgtactacgactctagatcacacaaattaagatcgcgtagattgaaactggacaagcagtacatgtacaaaatccgagcatccgaccacggaaagaggggaaagaaaattgcaaagccatggggcacactcccatcaccagtttattcctgtatttccacacgtcgcgatccctcacccaaccatgcaaaagtcaagtgcacgggaggaagaagaagaagaagaggaggttgctgcaggtgcagggtccaaacgccaacccctcgttgctcttggaaaaaaaaatcgcacatcactgaccgaccccgccattttcgtcgccgtccgttccccttgtactgcacctctgaaaattctcccccccttctcttttttgtacttctcccccgcatccacacgtgtactggatacgtcgtgcagagggggtgcagtacagtgaaccgagctgcttctctcgttcagtcgttccccgcagttgacgcctatttaattgacccgcctgccgcctcctctcgttcccatccccggtgtggtggcgttcgtctgatcgtcgtctccgagcggtgctgctgttttcgcagggaggacagtacaggtgagaggtttctgcatgcggtgctcgttacaatttggtgttggattgtgcttttgctgcctttctggtttctgctcgtgatttgtggttcttttgttcgtcgccttgttggcctctgtcattactgacccccgtggagcagagtggcagatggccaaatgcctctggctttgctagaagccaattttataactaatcctgcccgtttcaattcaacggcgcttgtactcttctgtctaatgcaagggcgctgggcgcacatggatgggttgttggattgtgtcgccctggtacgcgtaaacaaatgtgctcacgattacatctctcccctgcagccgccgcggccaccggtgccgccgccgacgtctcggagctcgagctgctagtccccagggggggcgcctcgtcgggtgcggccggcagcatggaccgccacgcgctgggcggcggtggcgcgctggagatcgagaagacgccggaggcggcggaggacatggagtcggagcccgcgctggcggcggcgcgcgaggcggagcgcgtcccgccgtggcgggagcaggtgaccgcccgcgggatggtggcggcgctgctgatcggcgtggtgtacacggtgatcgtgatgaagctgagcctcaccacggggctcatccccacgctcaacgtctccgccgcgctgctcgccttcctcgcgctccggggatggacgcacgcgctcgaccgcctcggcattgcctcccgccccttcacccgccaggagaacaccgtcatccagacctgcgccgtcgcctgctacaccatcggctacggcggtagctctcctgtctcccctcccctctcatcaccccggccaatcttggcgtctcgttgcgctaaccgcgtcgcgcgttcgcgtggagcacaggtggattcgggtcgttcttgctggggctgaacaagaagacgtacgagctgtccggcgcgagcacgccggggaacgtgccggggagctacaaggagcccgggatcgggtggatgacggggttcctcctctccaccagcttcgtggggctcctcaccttgctccctctccgaaaggtacactactgactccctttgctcttctttgattttcccctttccatgccgtacctttcagcgtttaccgtttctgacagattccctgaattttccgagattgatctttactgtcatacgttctgaaaaaaatggcattggttgtacgatcgttcagcatcagagttgcaatcgttgaccacgattaacaaacattaaccatcgttttctccttttctcacttattaaggacctgttgtgtctttcagttatggtttggagtgctacagtacactactgataaagtctattctacacgtttattgtgtccttcagtctttttttttctgaacaaaaagtgggctaattatcgcaatcatgcaaaaatgaaggaatctgataaaaaccgatattttgcaggtgctggtcatcgactacaagctaacatatccaagtgggacagcgactgctgttctcataaacgggtttcacacgcctcaaggagataagaatgcgaagtaagctctttatttcagatttcagccaagtgctgatgaaatcatgattgagccgaccaaaaacgctgcagaaatagttgggattcactgacttgattcaatggtttcccctcaatgccagaaagcaagtccgtggattcctcaggtatttcggcatcagcttcttgtggagcttcttccagtggttctacaccggcggtgacgtctgcggattcctccagttccctacctttgggctgaaagcttggaaacatacgtaatttttttactgtttccatacaatttttatttactgtttctttttcactgatcattgtatgcttcagtggtaaagccgcaacaaaaacaactttttgctgagtaatttcttccatcaccagatttttcttcgacttcagtctcacgtatgttggtgccgggatgatctgttctcaccttgtcaacctctctctcttgttcggcgcgatcctctcctggggaataatgtggccgctcatcggcaagcagaaggggaattggtactctgctaaggcatctgaaagtagcatgtcgggcctgttcggttacaaggtgtgttcatcagttcacctgtcccaataatggtacatttgtagtactactagactagttcaggcagcacaatatatacacatttcctagctttttttttttttgaaaaaaaaaaactcaacatcgctacctgtgcagtccttcatctgcattgcacttctcgttggagatggcttctacaacttcgtcaaagtgatcgttgtcactctcaagagcgtacgcgaaagatcaaggcgcaggggtcttaacaacagaggtaaatgcaccgtaaaaaaagatttagatcgcctcgcgtattttcagttcaggctgaagcttacaggagtagttcattacgcatttgcagtggcggacgcggacaccatggcgatcgacgacatgcagcggaacgaggtgttcaaccgggacaacatcccgacctggatggcgtacaccgggtacacgctgctcagcgtcatcgccgtggtcctcatcccggtgatgttccggcaggtgaagtggtactacgtgatcatcgcgtacctgctggcgccggcgctggggttctgcaacgcctacggcacggggctcaccgacatgaacatggggtacaactacggcaagatcgcgctcttcatcttcgcggcgtgggccgggaaggacgacggcgtggtggccgggctcgtcgggtgcgggctggtgaagcagctggtgctcatctnnnnnnnnnnnnnnnnnnnnnnnnagacgggccacctgacgctgacctcgccgcggtcgatgctggtcgggcaggtggtgggcacgctgatggggtgcgtcgtcgcgccgctcaccttcttcctcttctacaaggcgttcgacgtcggcgaccccaacgggtactggaaggcgccgtacgcgctcatctaccggaacatggccatcatcggcgtggaggggttctcggcgctgccgaggcactgcctgcagctgtgcgcggggttcttcgcgttcgcggtgctcgccaacctggcgcgggacttcctgccgcgcaggtacgggcggtacatgccgctgcccatggccatggccgtgccgttcctcgtcggcgccagcttcgccatcgacatgtgcgccggcagcctcgtggtgttcctctggcacaggttcgacggcaagagggccgcgctgctcgtgccggccgtcgcgtccggcctcatctgcggcgacgggatttggacgttcccttcgtcgctgctcgcgctggccaaggtcaagccacccatctgcatgaagttcataccgggaaactagccaatgcatcgctgtaatttacagcgtcaatgcagacgtatagatcgtaaaaaaagagatcgtatagacgtatagcgtcaatgcagaaacactagaaaagagatcgtgtatcgagcgttttggacttagatttaagatttaggcgcagcgagaggaagaacgggtgtagctatgacggataaatccccaaaagcagaaatgctgttcataggggttggggttctgtactgtgtatatcagttgagaagaaaattagatgaaaacacaacaattagttgtgcttattgtcaagtgctacgatactgaaacacagtcgaggacaagtgctagcacagtagcgtcgtcgtgccatatctggcgagagaaatattggcatctcggcgtgccgtgccagttcccgtcagcccatcatgtccgcatcagcgacgatccctttttcgatcgcatttgcccaccgttgcggttccctcaacttatcaccaacagattctccggctcgcaccacaagttctttttttgtgaaggttggcacattgcctttttccctttcgtggcaatctcaccgtcactacttccacaaacagggtacttaactcgctgacacaaacacgatgaactggacactcattgacgctacgaccttttaagacttttagctctttttggttccactgcatgtcacctccgagcttggcctgcactgatttgttacatccctctgaagactgaagcataatagtgaaaaaaggttgcggatgtttatcatcgagagatcaataattcaaattcaatatggtgcgtttcaacgcgaagtttgcatcagcttttcgtcagtagaggttttgtgggtgtaactgtcactctgtcagataggctattccgttgccaaggccggataggttcgctgaataattggatggatgaattatacgatgatgagaaggaataaaaatctcggccattagtcgtgctccactttggttcgcgcctgcaacccacgcgaacattggcggatggaaacgatagaaacacgtgcgttcaggttactggcgcttcggttcagagcatccatccacagacagattgaagagcgctgctgactgttgctgtttttttttcctttcttcagaagaagatggtcgcctgttgtttctgcagcagaaaccactagctgattaaatctgtcctacagatcttcgaaaagactgaatcttttgtctggttttgttaatccaccactaaagaacgggtttattagcgggaaccaaagaatgtttccgcttttaggattctcaaaccattgtaaacagaacagcatagtgattagtagatgagttgaatgaggctcgcggtagtgacgatggaaccaacactctcctccgtcgagggagaagagaaagttacggggacgacgacggaggtgaggagggggtgagcacctgagtaaggaaatcacgcacccaattcgaccaatctttagaggcgagcggcgtcccctacgatggccggcgtgaaagcgctaggagtcattgcgataattagattaatcatgcacataagtacacatagacccggtacatctctatctctacaatctatttatagaaacagaatcgagagagaatcagagaaaaagggtaggagataggaatacaaaactatatctctaacaccccgatgaaactagaagggaaataacacagagctaggaagaccccttgatgaagatgttagcgtaaagtcagcacatgaataacccgaacagtaccaagaacgactttgtcccgaaaccctaacaattccgggctccagctataggcggtgggcttcagtaagaaacaattccgtccgcatcaaagcaaagttcagagctctgtttcctggtcgtcgtggttggaatgttggatatcagctttactgacgaataatctccattgctcgtgcccttgcgtccgtctgcatctgactgctacggattggaatttggaagaatcatgaagctttcttccttgcattgcagggcagtagggcatgcgagaatcgtgatatgatgcttcactgacgcggtcgatatggtttcaggtcggtctggtggttggcatctctttgttgactgttgaacatttgtggaaaatatcaggttggttaacgccagagttcaggttcttcgtagtacaaatgtacaatcgacagtacaaaagcaattcagtactaaaaaacttgcaaaaaaataccaatcatagtgaggttactcgactgtccaagaatatgcaagcacttgtaatggccacagcctaactttggactatgcaaaggtccacgtttactgacaagtaatgcttgtcaacttcaactacgaatacctgcaggcacctggtacgctaatttaataaagtaatcacacgaagactatagtacacgatcgtccaaattgaagtagtagtacaatgtactataccattatactccctccgtcccaaaatataacaacttttaactctcaagatttatccaaaaatataactttttcaccaacattctcttctcaaccaatcacaaccctccaccattcactttttccatcttaaccaatcacaaccctacatcaatcacttatatctactttcttaataaccatgttcaactttaaaaatggttatattctgggacggaggtagtacctctgattactccttgcagtacattctgtactgcagcagccttctcaaaacttcagagaatggcattgtgctcaacggaaagtgacccaactaagcacctaacaccaccaggaaaaattccaggccatgaaatgtgctctgctttcctcacgcctgcatggctgctgcccacgcaaaagaacaacgtgtggaaagggagaaattctcgtgggcattgcttgaagtatactatccatgaaagttactagggccacagcctattggtgaagtggtgcatgtacgacctgagatttgcgaatgatgttgcctggtacttctgcatcagaaaccaccagaagctagtagattgtttaaattagtccatcaggtgttcgaaaaggctaagctttcgtttttttttaattgatccatcaccaaaggcatacattttgcttttagcattcagagcatgatacgcaaaatagaatggcagagctttaatttgtgctccaaatcttcgacaaggtcagagcttttgattgtttaatccgtgatgatcaaagaagaaggtgctgcagtcgatgcaatcagcattgttctccttttgcttgtcgccggatattggatagtgtaggtacttttgattatataaagaaaggaaagaacattgagcacctataaaattcaggaataaattcacttcgtgaccctcaaaggtgatcgaaatctaatccgtgactctaaaccacaaaaccggttatctcgacccccaactcttaaaaccggtgcaatttgactccctcgacggttttggagggcggtttcaccaacatgacgcctacgtggcagtattaactcggtcttctttccacatggtgttggcgtggcgcttaggtagcattagaaataaaaaattcgtgtgggacccatttgttactcacacacaaatatattgtgggacccactgtggggcccacatgtcatcctctctctaccttcttcatcctcccctatctctctttccctccgcgagcatgggatagggccactggcggcggcggcggtgggcgagagggcgggcgggcgacggccggagaaggggccagatcttcggcggcagcggacagaggccggagcagcggtggccagcgcctactccaaccccatccacaacctcctccgcccttcccgcggcgtcgttgtcggcgccggcgttagtgaccccatctctctccctctcattccttctccacatggtacagcgacgaggagcggccacgcctactccctcgagctctgctgccgccgctccggcccctgtcagccgccgttgccaaacccgacccccgtctgtcgctactgctcccgtgaagagaaaacgggggagaaagagatgagggagggagagagagagagggaggaggaagatctggccccgccgccgtcgccgccctagtgtcgcctgcctgccgccgccgcttgccctaatgtgccggcctccctcgaccgccgccgcttgtgaagggaagataacacttgagaatggaagagagagagagaaaggatggcatatgggccctacatgttagtgggtcccacaatatattttttatgagaatgacaaatgagtcccacatacattttttatttctaacgccacctaagcgccatatcaacgccacgtggaaagaagaccgagtcaatactgccacgtaagcgccacatcagcgaaaccgcctagagagtcaaattgcaccggttttaagagttagggggtcgagatatccggttttgtggtttaggatcacggattaaattttgatcacttttgagggtcacgaagtgaacttattcctaaaattcatattctcactagcttgggctaatgcgctaggtcgatgcttacaatttcataaagggagtacctgtacatctttcgaaagatttttatgatcgtatcacacagttttttaatctttggattaaaatccgatagacacagtaaaaggcaaaaagcaactaagaaacaccataatggacactaaattaccatatcttcaagaaaaaaaccaaatccaatataaattttaaaacttacatgcgaagattcaaaaattacactgtaacttataaaagttacaatgtaagtttcataaattacactgtaacttacaagaaaatgcactgtaaatttaagtgagaaaatcgagtgagagattagaaaaaaatctttcgagtgagatatagcaaaatcgaggtagtaagggctgagcttgactactctgatcatgtaacgtcccactttttgcaaaacgttaaaaacctaaattaataaaaaccaattgaagtcgtactatggatctcaattcaaatatctccttattccctctcgtcgatataaaaaatcaacaccccagcatttcatgttccgaatcaagtctcaaaaagtcaaattccgaaattcgatcctccctcgtaattcttgccaaatattcctcccaattctaagaatgtcacatttctcactttgacttcttttgttgaatcctttatatttttgggttcacatatcaaacttgaaacacatcccaattcaattccaacatcaaatccttctccctcaaaaccctacagaaagtctagttcccctccttcctctttgggctgtttcttcttggccggcccaacccactccttcctctccccgcctgggccatgcgccactcctctcggtccagccaagcagcagcccacctcacccttgcacgcatgcgcacgtgccgtgggggagcgccgtctcgccgccttgctctctccttttgtcgccgcatgtggtgttgggtgttagttcgttggttttcgccgcctcagcttctgctattgctgttgctgcttcatgtcatctgctgcattctctggtttgcccaagagttgcaacttaagttaacgtaaataagttctctattttatttaatttaaagaatgcgatgatttataattgttactgtggataccaacgctttatcctgggactgtgtaacataccgaaaattaaccattttctaatcttgcatcatgccactttttatgttcttaataattttataaacctaggaaaatataattagagggaccttctaaaactaacttgcataaaatccttctctggtatttaatttcttttgtgtttttcatttaaaaatatatttggctaaattgaggtatttcttgatttggttttaatttaaaaccttttttcaactaaaattcttttattcaaatttagtttgaaaaccctttctatttttatgaattatggtccaagaaattccccactattgccctagaacctaaaccaagtaattccgattttaattggaattaattgtggacccatcctttgattataaacctatcctaattccctttccaaatttcaaatttctattttgatctagactcccattccagttcctataatctaagacttctcggcacaagaatagatatattataaatattagaatgattgctcttgtgctaagaagaatatatttccctcttccaaattaattccctatttaaccacaaataattctcctatccaaatctcttccaaatttaaagtctaaccatccaaatcccattcaaaatgtagaaaaacatttattttcagtttgggccaaagtccttcactttctcccttggcccatctccttttacccttccttgttgtgccagcccaactttggcacgcggcccagtcggcccaaccaaactccagccgtgccgctcctctcttctccctgttcggtgggcgccgccgccgctatcacgcgccgccaccaccgccgtgcacggctctgcttgcagctctgccgaccgccaacgtcctgccgtcgccgctaaggcatcgccgccgacgtcatctgccacctcacgccgccgacgtcagcctttggagcaaaccgccatctccaaccaatcacaagccacagccggcgccgtcgtcttccttctcacgtcgccgccaccaagaccaactccatcttctcctctacaaccgaccttcaaaaccgacgtccgacgcctataaatagaaggccagccctccccttttctccacatatgagccgagctcctcgagctctctctctcctgttatgtctagccaccaccggccaccgtcgatatcccttaccggagcgttgttggccaagcccttgcgccatcgggtttgcctagacgaggcgaatccatttcacccctttcccctttcccttcccctttgaaacaaaccatcacagccacttcctcttgttgccggagcaagctattgccgtcgccgttccggtctcctccctaagaccctaaccctctctaccggaaaccaccctccccgggtgcgcgtcgctcgggaacatgttttgccgccgacgtcgcagcctctcaaccaccagagtaccggcgcccctcctctccctcctctcaactcactcggcaacagaaaagaggaagagaacgggaggaagaagaaggaagaagaaagagagaagaaaaggaaaaggaaaactgacaggtgggcccctacagtactatttcacattttctagatttgattcaaaatccaaactttagaagcccatatctcctgaaccgtagatccgattccgatgaaacttggacctaaattcatctaaattcaaaagatatattttgatacccaatttgttattttataattttatttgaatttattcaaatattgtttgaatttatatttgcctttttaaatattttcttccgtcccaaattaccctttagccattaaaaagccgccggttgaaactttacgccttccatggggacgttcgcggtctactagccccgacgtcgaaccgttggttgtaaagcccggcaaaacccaaacccaaggtcgaagtgctgctcctggcaccttacacctcgacgcgtataacggtcggagcttcactattcccacgacctccacagcacgtcacacaattagctctcgggctctgtgtgatcttagctgctccgccgccactcacggttgtcggagtaacactttcgccccactgaattaacctgcacccacctcctagccgttatactgtccatcgacaccggctagagaagacaccaaatctaatcgttatgctgttcaacactagcatcgactagcacacaaccaaatcctagctgacaccttactagataaatcccacccgtcatccaaattccacacccaccagtatcgcctatccatcctactctcagccacctactctctaactacctagaacctatatataaaatatagagctagccgatatattgccctatccccaatcggcctaaatataaccaaatcctaggtattatactacctaaacctgccaccagccattattagccacatactcacttaaccagttatttctcttactctccaaacaaccaaagcccactcatgaaatataagcgacattagttgcttgatcccctctccaccttagcctccaaccctctaaaacctccacataaaatattagccaataatccctataccttataaaggagatatttataccccaaacccagcctttcttgcccttcatcgctttcttattattttgtgatttttattgaatttggttctttctcttctttagtagagtctattttggatggcagcctgtgatatttcaaggatcggataatcaggttgcctatcttggatttatttgcgttggagcaaggcaagttattattcctcccctttgagcataataatcctatattctatatctccggtatcttatgcattagccatacatgatttcgaatgcataacctgaatatatagcaaaccagatatatgctagattttgcttagccatgcctagttagattgcataaaatataataaacttagattggaacaatacggtagaaatggttgatttccgggtggctagtactgttccaaccgacataaaattgccaagtacatgtgaagaacatacgagtacgaccgcaattctcgtatgggcatagacctagctgattaagttatctagaaaaggtggtacctctgtatagtggttcttcttaagtcctcgcgcaggaggcaaacttacgccgagcagggcgattgtaatatttaccgaggtgcatgtaaatatttgagataaattgtgatatcacaaactgtgtgtgtattgtgaataccttggtataaacatggttgaatcaaatggtcacaagtgttgatctcgactcaagcttgaccccaagttggatgcgcaaggcaaatgtataatggagctaagaatgttttcttagtcttttcccggtcttggtgtttggtgtagaccggatttgctagataggcgccgtactatcaagaggggtctatgaagcgagcttgtggatgatcttgtgccatattagttcatatgcatgtaggtgtatttggtgggcttgtctagccaagtatggtgagttttctcaagtcctaaacaaagagagatgtgggcaaatcctataggtttgggtagcctcatgtggttatgtccggtggagtatcctttggagtgtgagccctttctcccagagaaaagttgtgtttcttggatggattgttcatgggttggatagccctttgaataagctttccatagagtccaagaacgccaaattccgagacccgagtcaagagatatcgccgttttattaacggtcggttgagctgaaaagtgacctgcggtctgaccgtgggccttaggccggtctgaccaggcctgttagccggtctgaccggcgtggtaaagccggtctgaccggcccactggtctgttgcactggtttggtttttggtggcgatacaaagccgccagagccgcaaccggtcagaccgagccgacggcggtctgaccgagccgttgacggtctgaccggccactacactgcggtcagaccgaccaggttgagtgggctcaatgattgccctgtaacggctagctttctagccgttacaaagtagtccggtctgaccggcctcacaacggcggtctgaccggcagggcacagagttggggatttcggttccaacgactagttttggtggttgggggtatatatacccactccccagcagcaagggtaaggttttggcactccattgcattatcttgaacccttgcaagagctctcacacccttgtgcactttgtttatctagtgaggtgttagagagtgagttaagccaatccaagtgcattgcttcattgttatagctagtgtgacacttgatcatcctcggcaagcatcctagacttgttactcttggaggttgccgcctcctagacggcttgtataggtgttgctcggtgacctctccgaggagattgtggaggaggcccggtgccgtttgtgagtggtttggagttcaccaccttcggagtgaaggaagaactaccccgagtgatcgaggcttgggtagtcctctccgtgggccggctcccgccttgcccaccccttgacgaagggggcgtgcggtggtttcgtggttgagcggtggagttgggctcgcctcaacggggattaggaaactggcgagtttccgaacctcggtgaaaaattccttgtctgttgtctcatttatttgttgcatttacatttgtgctatttacattcatagagacatatttgagcccatatcacctaggtttgcaaaacttaacttagttgcttagttaacccttgcaccttaccttgcctagcaacttaggttagttttgtttaagtgccattaagttttaaaaccgcctattcaccccccctctagtcggcctccttgatcctacaagttgtatcagagcttggtctctcattttgtggacttaactattccgagagaaaaggatggcttctagagatatagtacacacgggtggtgaccctcctatgtttgatggcacaaattatgcacaatggaaaatccacatgatttcttattttacggccatgagcccaaaaatatggtggattgtagatgtgggcttttctcatgctttggatgaccatgctccaacaagtgggcaagataaatgcctacatctcgatgctcaagctactaatgctttattttgtggtttgagtgatgacatgtttaatgaagtatgcaatctcaagagtgcacatgctatgtgggtaaagcttaaagaaaaatatgaagtgcccacacttgttgagaatggttgcacacaagaatcgatgtcgggtgaagactccacctcctcaagtgatgatgaggagctcccaataccatccacatcacctcattgcttaatgacaaattgtaagaatgaggtaaagaatgattctctcgatagtattattgaaaatacttgtgttgttgatgatggtggtgatgatgatgaaccttcatatgatgatctttttaacattcttagggaggctagtaaatacattgccaaagagaagaagaaaaaatcaaattttagagaaaactcttctctctttgaaagactcaaatgtggagctaataaattcttataaggaactttgtgattcttataagaagataaaagaagcttatgagtctcttctcattggaaatgcatttagtaagccaaaggtggacataggcatcacatgtaatttaattgatgatgatatgccatgtgtagctagctcatgtagtacatctaaggctagtgtgtccacctcttgtgatgacttgttagatgtaccttgtagctcaagcatagatgaaaattcttgttcttcctcctctatgtatattgttgctaaccttgtagaggaaaacaagcaattacaagcccaagtcaaagatttaaaagaagacttggatagaagctacaaagggaagaacacacttgacgaaatcctaagcaagcaaaagagcacaaatgacaagtgtggacttggctttcatcgcaaggagaatgctaagaagacaagacacatgcctagatatgcaaggaagcatgcatacttaagaaatgatggaaagaaaaatgtgagtaagaaccatcctcacattacatgttttggttgtcatgagaagggacactttgcctccgtgtgcgcaaacatgaaggatgagaagtgcaacttcaaattgaggcaaaccggcaagaagcaagaaaaacgacaagtcatagaggtcaaaacctaacttgctacaattgccgcaaaaagggacatattggtaaaaattgtcccataggtaatactcctaagcctaatattatttttgatgattatgtgcttaggaaaaataggcaaggcaatgtgtttgctagatatgttggtttacctagacttgcacctagaaggaggaccatttgggtgcctcgtattttggtaactaacattgatggacccaattttgttggggaccaaaatgtgccaaaatgagaatataggtacatgagaggcattggagttttggcctatgcgagaaaatgtgattctcaccaagttcaagaattggagccaataatgaggatggagaattcacatcaaggaccaatgccatctcggtaacatgcttttggtttgtaatttttttatatagccttgtgtatgttgcattgcattttcatagttccaaaattaaatttcctcttcttatgaacatcatcataaatgcatgttgagcataatgagtagtggcatatgaagctataggcttgatcatattaatgcaacatatttatcatcttgtgcttattgtcaatcttatttgatctttattggatcttgtgtttatttgctcatctttgttgggttgaagggaatatcgcattaagggaaagtattgcatttcttacatatgcactacaacccttagaatgtgaacaaagtaatccaagtggtagaaatgttttcaaaacgcccattttgaccaaaagtcaattttttgagaaaaactataattcttgaaaactattacttggaaaatatttcaaaaggcctctaatatgttttccaaactttagtttgcaagaaaaagtatttgcaaagtaaaaatgcatttttgactaaaattctagtttctaggatcttgttttcgagcaaaactatttttctctctacagggatatctaaagagaatttgaaatggagcccaaaacaagttagatagagttggttatttcaaatgtttttggtttttgaaccttatccaaaagaccaacatattaaaagaaatttgatgtcaaaactcaccaaaaattttaactagaccatatatggtcactttctatcactttggtgagtttatttcttaaatctgaataattgtatctttttggctcaaaatcatatttgaacttcatgcatattagtttctctcaaatatcatctcatttgcttctttttgcacttttggaggaatgtatttgaaaagagagcttgtgtagcctttttctcaaacttggcctttagtatcaaaccttgaattcatgaagcaaaaaaggagagttgcatcaagggggagcaatctgaatcaaacccatattccctttgctcccaaacatgaattttccaaaaggttgcatccataccctttcaaaagagcctattttagacaaaagtcaaaaatcttatttaaatggcccatatatgtgaaaatcctttcaaatgtatcccaatttgtatttcaaatgtttttcaaggcttttggagtcaaaatttccatttgtcaaacaaaatagcaaaattggtctcaataggatcttttagggtcttgttttggttgaaaatattttatttctctaaatcaaaatctattgagttttttggaaaagctttccatacaaaacttttagagttggtcgtttcaaacatttatctagttcaatgtttttccaaaataccaaccattcaaactctacaaccatttgaatttcagcaaaaatcttgacttgaccattttcggcctaaacttgcttatggcgtgttaagcctttagagccaaatttctttgtgaatcttggcttgaaagtgtatctataatcctcctaaggctttacaaatgtcaaactccatcgatttcaaatttgaatgtgatttgagctctcaactcaaatttactcaccctaaaggcctacaatgctccttttgtcttatcttttgatagaaaaatgatttttaagaaattctttttggaaaagttcctcacaagtataaagatcaaatctgcaaggtttcaactcatttcgatttgatttgcaaagattttgactttttctcgttttgctcagcttgctgaaattttcagaacaaccatgtttttgggctgatttgtgatttttgtatctccaaatgggttgcaaatttgaagaagatcacaatatggcttttgatcctcaatagttgaagtttacttacaaatttactcagaattttagctggtcatttggatgccttttcaacctcattttcagtctccaaaaatctgaaaaagtctgaaattttgagttggctgaaagcttgtgagatttgtttcttcaattcggttgagatctgggaaaggaccccaaaatgaaatttttgtatttttacatgaactatctccaggatttatggcatatttttccgagcttagttacacaggtttctattgctaaaagacgtcgccattgctatgtgccttttcagctaaacatggatttcaaagttcatgtcacttcttgttgattatttgagcatggtggtgaaatataagatgtttcaaataatgagatctttgttattttgaaaacttcatgaatccttgagctatgttggatatgttccttatttgaactcttttggtttttgaaatgcccatgatacatgaaaccactaaactcaaaagtttttttttttggacttctcaaaaccaagccttcatggatagactccaaattccaatctttgccaccaaatacaagttgatccttgctaccaaagccaactaccattccttgatcccaaattcgaattcctatacacaagtggtctctcaacaaatggtagtatcccttgatcatcttgaacccaacactagctcatcattgtcattacttgccgatatcatgcacttgagtaaaattcttccaaatagccttgaccaagctcttctcaatttttgacattcttgaaaaaaacctttgatgagaatatctcaagtgaaagttcaagtgctcaaactcaccccttctacatatgaaacatattccaaattctctatccaaagaaaagactctatgagtaagggggagtttttctaaatgggctatttctatatatatatatatatatatatatatatatatatatatatatatatatatatatatatatatatatatatttggccttgtgagtctttattcctttttgggattttgtaattgcctattttctagccctttttcattttttggtgattaatgccaaaagggagagaatatttgtgatctatttgtgatctccttatgatcatagctataaaagggggaaatattctaggatcccacatcatagcattacatatgcatcatatgcatcagcatgtcattggcatatcaatataatgttgatttatatccttcatatccaaatgtggttattatcaatggatttgtcatcaatcaccaaaaagggggagattgtaagttcaagtgccttaatttggttttggtgattaatgacaaatctaattatatgagactaacgtttttatgagcctttctttgattagtctcatttggatatgaaaataaaaatgatgagaggtatgtattaaacttcacatattctaacttggtctctcttgtggatccaaaatatagtgtgagctccctcattgatcttgattgattatgtgcatatgtgttcctttatatccatatgtatgtacacttgaggggagcttattctatattttgtttattataagatttctatcttgatttgaaatcatctttcatctcatctctctatattgtttatatcgaattattatccatcaccaaagagagaaaagattgaaagatcttggattaaacaatttgtgtaattgttactttggtgatagatgataaaccgatgtttataggattaacctctcttttgcataagttgtctactaggttatttcccgataatgagatgtggaagacttgcattcttttgtaccattaagttttaaaaccgcctattcaccccccctctagtcggcctccttgatcctacacgggggtctctcaaccagttctctccaaaaacctcgggaacgtcagaactcctctcgctgctgataacgttacattcagagcgcatggggactagagttcatggaacaggtaccactgatgttagtaactaaaaagctttgccatgacaaggctaatgtgtttggcacgtcatggattgcgggtaaagcgtacatttactgcagtaaagtataaatgaatctattcgaatagccgtgctcacggatttgagcattgggactcatatggtatttggttagaaacttaattccaaactttattaaatattgttgtatttaaaacattctaggctttcttcctctatattctttgctttctgcaagtaaacctagctctactcagatattaccatttcatgcattcattattgaatataatagcttgttgagtacgttgtactcacccttgcttcaacccccctttttcagagtcaatttgatgttcttgctgaagctgggagttcaatcatataagttagtctcattctaacttagttctcaagtatagattagatagatggtttaagtctatagcaaaacagtagagttgagtcattctatggcttctgttgtaacagttagccacaatcttgtaaataccctaatattattatgtaataatatctcctttgaaaccttgactaaatgtatgcaatgaagaaccagattgttgaacctgtatcaatctactgatccagggcttgatacagttttaatatgtcggtttccgaattattagttttgggacccgacagactggtaccgatatcgtggtctcgtaggaagcggttcatgttatttttcctacgacacactcatgtcaggtgccgttgtatagtggtgccggattagggtgtgacagatcagtacatttgtagtactaggcaaattttgctaacttctatatcgtgatttcgcgaatttagttgctagacacaaaaaaaagttaatctttgaaaaaaatcactctcaaaatgtggttatttgctatacacccttcattagaatattcattcctagttgaacaggagagaaaaataatagaaactatcatatcggcatcctccccttttctcatcgtctttctgcttgcatcgtgtagcttcgtagcaagtcacctagggccaagcgaccgacagaggtctctcatcctccgtctctctccccaatggccctagcgactggcatggacatcttgcctccaccaatggtgaaactgcgaaaggtagaggcgtgcgtacagtgatgacaaaggcaacgacgtcgaaggatagcatcggtggatctcatgatggccacaggtaaaaaacaggggtgttggatccgtcatccgccccgtgtaccaccgcttcaggatatgttgtcacatgcctcggcaacgtcctctccgctgtctcaccaagccagggatggagtccaatgggcttaggggggttcacaggcgcccagcctaattttcagatttagtacttaccccctattttcaccacatgggaacccctcgacccaaattcgtgcaccacccctggcccatgagcaagtcatggaagacctgaggcccatgaaaatagcgccccatctgggccaccgggagcgagagcgacgcctcgagcgttaatcacagccacgccggcaccgcacatctcttcgactcccgtttttcgccttttgtctttctttttcccgcgatacggcatctgagtggctgtgtgtctgttcgtctttgatccaacgcaatctcctctcaccacagtttgccgagtcgccgtctactcctgtcgctcaaccgctggtcgccgactcaccattgctcgccgtcctagcctgctgctggtcgccctagctggcagcccgcagcattacggcggcactgcggcagcgagcagccagactacaggggcagcctgcagctagcagcggagcactcagcagtgcacaagcaagagactaaagagaggtattatcttccttttagtttttttttttgagaacatcttccttttagttagttccaaactttcaatttaccctctcttctagttctagtcttattttaaatcctattaatttgatttgtaacttgttgatagcaccctttcaatatccaaatttatatataagctagggtttaaagtttgaagaactgaaagtttcaattgatttctggaagggacaaggactcctgctgtcctgctgccatcagtccatcaaccatcacttagtaaaattgtaagaatattgcgacacatttatttttatgtttttacatcttcattgttggatataaatttttagttgaaaactaagatgtttctgacttctgttctgcttttattgtaggctattatggattacttatcgatgatattgagattgacagctttgagaccggggatgtattttatatagattgaacgtcttttatgtaatttttgatgtttcccttcgcggtttcttttcgtcttatatttcagtaagcacttttacttgctactcaacgattttttttatcaatagttatctacaaatgaacaactatcattatttagagtaaatgccgccatctatacagtaaagtagtgcaccacccttaatatggttccagctccgccactacaccaagccgccaacaccggatctgccgtcgctccatccccttgacgtaaaatcggttgtcactgagcgctctgtgtcatgatatcggaatatataaaggctggcggaaggggcgcgcgatggggtgtgccacgtacgcgttttgctacagtacgcgtggtggaaatttacaaaaaagccctctgttttgttcgtaattcgtccggcgtccctcgccaaccatcctctgagctgtaggggtgggcattcggtctaaccgagaaattcggttcggtctttcggtctttttaaaatttcagtcatcaaaaactcaagaccgatcggtcccaaaaaaaatgaagaccgagcacttcggtcttcggttagttcggttcggtctcggtcatgaccgaactaacccgagagcagaagtctctgaacaaaaaaaatcacaaaagccaaacaacaaatgtatggttgacaaatcaaaaggcaactcaatagatcaatagagagatgatgcatctgctgatctgcacatgcaactaggaaatcaagcagattcagaaagacaaactgaaaagcaaatcgagctaggcggtgaaggacggtgtcggcgcggtggacgacggaggcggcgccggcgtggtgaaggcggagacggcgcgagggaggcggagggcgggcagaggtggaggcgacgccgacgcggtgggccgagggcggacggaggcggcgccggcggcgacgcagtgggccagggcgaacggaggcggcgccggccgccggcgcggtggagacggaggcggcgcaggcgcggtggaggcaggcggcgcggtgctagagcccggaggcgcggcgcgagagggaggagtggggagtgcggctgtgagggtgagggagccgagccgagtgggagactaggagtagggttggtgatttagggtttattttagtgggcttagtactggcctactgggcctcctagtctattgggctagttcggttattttgggtaggaataagtccattttacctccctcaattctttccctttgtcgaatttcatccctcaaccataaaaccgggtatattacctcctccaagtgttaaaaccagtacaaaacaactccctcgtggtttttgacagtggttttgctggcgtggcatcccagtcatcaaaaaaattaaaaaaatatgtgagggcccacatgtaagtggcatttctattcttcctctcctccaccactctcctctctcctccctcttctctctccccgaacagagcacggccggggacggcggagccggaggcgtgggaggtgtggggaccgccggaggatgcaggagcatgccacaagggagaggatcgccggccgcggcgcccacgcggggagggttcacctgtcacggcgtcgatctgctcggccggcaacacatcctcctgttgtctatccgcgccgccaacctccagcaaaatacataagctcatcaagctacctttcgaatagcatgtcatgtgctgactgtggagtgcaaaagattgagctgccacctaaacacttggagggggataaaccggcgaccatccatggagcagcaggagtaacaactgaagatgatcatgatccatcccaacaagtcgccggagcaagtggtagcctctttcgagcttcgacaccacacgaggaaaaaatcagacataaaaaaccccatgaagaacaacccaacagtaacaaaagcatcccccctccattagctgcatgtccttcctggaattctgtttttcttctccaaagagacaacgtgagatgcatggatgaacaattggcggtgcgcctactactgcccggactcctcatcggactcgccgtcgtcgcgctcatcctcccggtcctcctgctgctgctgatggtgttggtgatggtggtgcgggtgcggcagttgaccggtggcaccggcgccgccgacctggtggtagaactggctgagcgactgtgcggcgagcacgccgatgtggccgtcctatgagagtcctagctctagccctggcatggtgcgacggatgtcagcgccgacaccggtatggtccccgtccccgtggcggcgacgattgccggctccgcctgctggagcagccactggacggtatcgccgtcagacttgtggctgagctcccgcgtcagctggaagatccgggcggcgcacagtgccggcattcggatccgccgtccctggccgtccaccttggtgtgttgggtccttgttcgagctccgcttcggtcctaacccctgcatcctcctctcctccaccgccaccgctaccacctgcatctactgctactgacagcggatcctctccctcgcggcgtgcacccgccgcatcctccgacggtccccacacctcacgcacctccggcgcctcccctggccgtgctctgttcagggagagagaagggggaggagagaggagagtggtggagaggaagaatagaaatgccacttacgtgtgggacctcacgtattttttaatttttttaatgactaggatgccacgtcagcatcaaaaaccaccaagggagttgttttgtactggttttaacacttggggaggtgatatacccggttttgtggttgagggatgtaattcgataaagggcaagaattgagggacgcaaaatggacttattcctttcgggtatttcggttaaccgagcccaataaccgaaatacccgaaataaattcggtcttttgatgttagggaccgaacaactacccgaatttttcggtctcggtctcggtcttttcggttcggtctaattttgcccacccctactgagttgtatttttacgtttaggcccttcgtagatccgggtattctattagaaggtgagaaaaaccgtgaattaggtctgcgctctaaaatgtggaagctgaggggttttttcgcaaaacggcacgcactagcccaaaaccctaaccgccgccgtctccgctttcccctcgcgccgccacctctgcttcgcgccgtcgccatcgtcgtccgcatcgtctcgcgcctccgccgtcgtcgccgccgcctccgccgccgtcgccgtctccgagcgcctccacctccttctcccccctcgcttcgccgttgtcgccgagcgcggacttcgaggcggacgcggagaaagcgacgaggcgaacactcctctcctcttcccctctcgtctctcctttgcctgcgaggaactgtgcctcgccgccatcgtcatcgtcgtaacctgcagccgtcgtcgtcaactggccggtctagccgctcgccgcacgtggtggccgatggtcgcgcctccaccaacttcttcagcacgtggatccagtattgatgttggggagctactacttttcctgcagtcttgatgttttgattcatttggagttttagtttgctgtgctttgatagtgtatttttcttttggttcgatcagcatcttctgctcggtgccattccattccccaagaccttcttctgttgaaggagcttggagtttgcggtgtcgtgaactgaacaaatcctactagaggctggttcccatgtgcctgtaagaggtatactagctgagtaaattttacccacttctaattagctgctagctcataaataaacatcaatggaattttggtgttccattatcactgattgacctatgaacaattttttcgtgtgctcgggcacttagtgcggtaaggttttattagggtatggtatatatctgcaggtgcttctcaatatatgatttcattagctaacgtatgttttcatgtacttacattccaacatgtttggattcttcagaatatgatgggatgctgaatgtaatcttgaaaagttgggcccattattcttcagttaccctatttgcaaaaacccaaagtgtatagcaatgtgtaccagggattatttttctattaattttgggttattatgtaataaaaacattgtatattcatgtgaaccaagagtctgtaacgaaccgaaatttcaacagagatgctctacgttgataataaagtgtccatctgtagtaggatatttattacggaaaaaggcaatactaattacgatgctattgatatccacaagagttgaactgtaatctatgatgtcgcttatcaaattttcatagatttccctcatctatttaccgactgattgtcgttttagtccgtgcaggcggcgccccagcctctagtcctatgtaaagatttgccgccgtaccagtcttctcagaacttcagggaaaggccttgtcttcaactgaaagtgaacctcttaattccaccagaaaaaaaattgctggatgagagacgggtaagagatactagtacccccacaatgataggaagaaaacaaactaaatgaagtgatgaggggggcacgacatggagggccctaactatcaacttctccaaaccacacgagaagtcgagaacagatgcatcagcctgcattgtctgcactcctgaacatatgcgcttcgtgcgtccataaatttgtccgcctcctcaggaaggtgtccggaacatggacgcgtgaagggttcagtgattcactgatttgggctttgttcgaatgtgcctttagctttagctttttaatcgtataaaaaaatattagcatataattaattaagtatatcctagcttcatcctaaaatattatgattctgtttagttttcttgttctaaaatactgtccagatttgttgatgtagaatgggtataatatgactcacccttctagtttgtaacattttataacggagggaatattactcactacaaatttaaaaaatagtttatttttttaaaaaaatctatataaaagattttttgataaaaaatatcagtttgaaaagtatactcgtgataaacgggggagttgtaaaagcaaaatgcgctgtagaacacagccatacgtactgattagtccttttcattcagtacggtgcggcggtgcggttcttcgtgtgattagtccttttcatccagtattcgcatgatatttgctattgctacagcttgatttttactatctgctcgaggtctcgaggctatctcgcgtttgcatatgatccacagattatccatccatctctgcgcctacttgccgacgccgagatgcgtttcacgctttcatcagaggccactgttactactttccgtctttccggactcacacggtcacactgccgccccagcatatttttagaaaataggataaacccggtctctacatcggatcggatgtacacagccattgccgccccagcatacggaccgaaccgccgggaggacgcacgcgcgcgcacacgctgcggccgagggccgtggaattctgtcgtgatatctgtgtgtcgcgatcgcggtggtgggctggtggcgtgtgggcgaggcgagcacacacgcccgcagaaaacgaaagggggaagcagccaaagcccaagcggcacggccggtgtgaagcttgccgccccaaccccacctcgcgcgcgcgcgggggcacgccgcttcgcacgcgctcgcttcagttgctttgcttgcgccaggttgagaaatttgcgcatacatgccgccgcttggcatgccatggcatcatcatgcatgcatgttcttgctcgcggccagtttgcttacgtacggtcgccggtcgcgtgtgctccttagccaccgcggcgctatagccttggctcatgcagctcaggtcgtcgtcgtcgacgtcgccgtctcgtcgaggaggagaccggtacgaaggaaagcaggagtactaatactagttgtttggtacgccggcgagttaatgctttttctgttgctgtttattactgacagacgactgttaatggttcaggtcgcgagttcgttcactgtcgttttgagttttgacgaagctttcttgacagcttcgccttcgcggtctttttctcttccttcttttaccggcgtcacgtataattgcaggttggctcttagtttaaaatcgttcgatcttgctttgaaggtctgattgactgattcttctttgttgactttgtttttataacctttgtcatttcgtaagcattcagggtctgctggtttgcttgcgcgtgagtggcgggactctgcctgtgtttcttgcacggaatgttaatggaagcgattttttactgtatgttgtgccgactccctccgtccaaaaaaaaaagacaaaccctagtttccgtgtctaacgtttgactgtccgtcttatttaaaaaaaatatgaaaaaaattaaaaagacaagtcacatataaaatattaatcatgttttattatctaacaacaatgaaaatacgaattataaaaaaatttcatataagacggacagtcaaagttagagacgcaaaccaagggtttgcctttttataggacggagggagtatgtgtctgctgtttagttcctgtacactggcttccactgatcatggttatttatttttattggtttccccattactgttgacagttgatgctatctgaaaaagaaattgttttatactcctcccatctcaaaataaatatatttattttaagatagaaggagtaattgtcaacataatcaatctaaaccgtttaatagatatattttatagtaccacctcaaatacttcaactaatgctaggagaatttttttctactaattatttaactcataaataaatgggtgagataaattctatttcttctactagtgattatattggtagataaaaacattaccaaacctccttgcttccttttctgacgaaacaaaaccaagtatacgctatttctctttgccaatcacttcccctttcttttgtgacgtgctattcagttctctttctcaccttcagtttcgtttggctcgctgttcttgtcttttcagttggagcaagagcaagagagaatccaggctaattcaggtgggtcttttttacattatctttctggaatcctcgataccacactgaagataaaaggcagtgattttctttggagaatcacccataaaaatttcatctttttctttgcccctatggatttcttgcactgatccttggcgagagagcgcacttgttcatagcttcgttgcttagcacaacggatgtagaagaacacaagtgaggagctcactagctagcatcatattcgtgctaactcatcctcgtactgaaaaaaaaaagatctttttgtttcaccgacccttcattctctcattcacatgcctccgctggaactcggacacgggggtgaatctgacgccggaaaattctttccgccatgaagcaggagaggcggaggaagcggcagcccgggccgccgcgcctcgagctggtggtagcgcacccgcgggaggaggagatggccgggctcgacggcggcggcgacgccgaggagggggccacgcatgcccgcggcggcggcggcgcgccgccgccgtggcgggagcagctgacggcgcgcgggctggtggcgagcctggccgtgggcgccatgtacagcgtcatcgtgatgaagctgaaccttaccacgggcctcgtccccacgctcaacgtctcagccgcgctcatcgccttcgtcgtcctccgcggctggacgcaggcgctcgcccgcctcggcttcgccgcccgcccgttcacgcggcaggagaacaccgtcgtccagacctgcgccgtcgcctgctacagcatcgcagttggaggccaggaccaccccccattgcatccatcctccattcgtcgtctacctagtctaatggagatcccgactgattggttctttggatctttctgtgcaggtgggtttggttcttacttgcttgggctcaacaagaggacttacgagatggcgggcgaggacacggagggcaacgtgccggggagctacaaggagcccggcattgcgtggatgactggattccttctcgccgtcagcttcgtcggacttctcgctctcgtccctcttaggaaggtcagtgagcttccacagccttactctgtatcttcggtagttctgccatttgaccagttctgttcgtgttttactgcttagtttatatgtgtagatctaatgatgcgctcatgctagtttatatctgcaatgtcttgatttatttatagaataaattaaatcattatatgcttataatttcaacagttctgccatttgaccacggttcgctgtagctccttactccttagaactgcaattctacatttcataggcgtttttgtcgttcaccagttcacccttgtgagaatttcacaaaattgtggtaaactgaccatcatctccatttcagccttttctatcttttgtcccttcaacatttcgtaggtgttttaatttcatttcacgatgtcacagattacataagctaaaaaaaaggacaattatgcctgtatttagctaggtgatagagttgaagtgcagctagtattttaacgtatctgattgatggccttatggtccctgttgaatctggactgctgattgaattgttcttgtatggtcttgtttagttgtttgaaattggcgtgctgaatgaatcgttctggtatattaaataaatttgtctctgtcatgaaacctctttcagtctggctttattaaaccacctagttggttattggttaagacataccaacatttttgcttaatcgattgatagtgatttgtgctgaaacaaacaataccaactcattagcgtgtggtacttctctagtcccctgaagaaaatatagctattttgcttgtggtttgagttgtacttttataaataaaatatatttttttaattctgaaaaaaagcatacttattatttgaatcttgagttgcagttgaatttaattgaaagcataatttgaagtccacatgcaaagacttattatgcgtgattctggacatattctccttttcatttcacaacatatttatcttgtgaatacataaaaaatgaacagctggcagtgcttttccacatgtaaatggatgatttcatttgttaccaaacttagtaaaattccagatcttgataatttccatttgtttcttaaacttggtaaaatttcaggtcatgataattgactacaaattaacttacccaagtgggactgcaacagctgtgcttataaatggattccacacacctcatggggatgcaatggcaaagtatgtggttctctaacataactcataatgagttctactattcattataaaatttcagttaactgaacgtgttttttggcacatcaggcagcaagtaaatggattcaccaaatattttgctatgagtttcttttggagcttcttccagtggttttactctggtggagacaattgtgggttctcgcagtttccaacttttggactaaaagcttggcaacaaacgtaacaacaatcacttagctcattattctattaaataaattttgaccaacaatagtgtcacctgatttgttcaaaaaacaagttcatctgattcaaaactttttgggttatcagattcttcttcgatttcagtctcacatatgttggggcagggatgatttgctcccaccttgttaatctgtctctcctactcggcgccattctctcatggggagtaatgtggccactgatcagtgatttgaaaggggattggtattcagcagatatacctgaaagcagcatgaaaagcctgcaagggtacaaggttagtttcgtcattttattttggtagtgtacaagtatagtatgatcttttgattcttaccacctcatatatattctttaggccttcatctgtgtagctctcatcctaggtgatggcctatacaattttgtgaagatagttgcactcactattaagaatctgtttgatagctcaaaactgaagaatgcaaagaagggtaaataatctgacagaactcaatatgacctttctagtttatatatgatctgatataaggtgtattccacttacaggggaagacatgccagtgctcgatgaacttcatcgtaatgaagtttttacaacagacaatattccttcctggctagccttctctggttatcttggattaacttttattgcagtaattgccattcccatgatgttccatgagatgaagtggtattatgttgtcatagcatacttattggcgcctgcccttggtttctgcaatgcctatggagcaggcctaactgacatcaatatggcctacaattatggaaagattgccctcttcattcttgcagcctgggctgggaaagactctggtgtagttgctggcctagtaggctgtggtttggtgaaatcgctggtgtccatatctgctgatctgatgcatgatttcaagacgggacatctaacattaacatcaccgagatcgatgattattgctcaggccattggaactgtcatgggttgtgtaatttcaccactaactttcttcttgttctacagtgcctttgacattggcaacccagaagggtactggaaagcaccatatgctctagtctaccgaaacatggcgattcttggtgttgagggcttctctgctctgccccagcattgcttgcagctctgctatgggttttttggctttgcagtggcagctaaccttacgagggacctttgcccaccgaagtatgggagatgggttcccctaccgatggcaatgggggttcctttcctggttggtgcaagctttgccatcgacatgtgtatcgggagcctgatagtcttcacctggcatataattgacaaaagcaaagcagcactaatggtgccagcagttgcatctggtttgatatgcggggatggtctttggatcttccctgcgtccttgcttgctttggccaagatcagcccaccaatgtgcatggcatttaggtctacaaactagaggagtagcagggattataattacatggcagttccatctactacaggaaagatgcagcaatgcaataatgaagtattatatgggattcctggaggtacctgtgcagtaaatattggaaaggtaccaaacattgttaccatttccatgtcaatgaagtaagacaacagattcaagataattcatctcataacaatggcgtatttttattgcctcatctcttaccaatgtgatttatggttttagcctgtaggcgctaatagaagaaattttgtatagtagagaaatgtttagtgtatacatgtatatatttggtgataagttggacccgaagaccgaatattgtaacaggtctctttcaagatcagctgatccaattcttactttgccagtttccagctgatttcagctaatggtttcatctgaagatatgttatctgatgcgtgtgacagtgagagagttatcaaatggtgcactacatggattgatcaatactgaccaggtattgtgaaagatctgcctatccaagaaaaccactgcaatgattgattatcaaattctcctacaaaagcagctgcggcaaaaaagttttgagtcgttatcgttgtgcggcgtttctttttcatgaaaaagtgacctgcatttggtaccatcaattcagagaaatttgacgagatctttcaaggataagaatctctaattggctctatctcaaaacgagagactggtttggacactccattgctagccatggttgcttggttgactcttaagcgtttcgccataatagggttcttgaatccgaagcaactctccaacttgttcatctgtccacagccaggcttacatcacctagggccataggtgaaatgatcaatgaaaaccataaaacaatccagtgggcatgcttggccaaagtttcctgtgaaccaaaaggaacttgcctttaaaaaatgaatctttgacagcgaactgatcagccacactgctacagtcaccgcctcaccggattatttacttttctgcattacaatccagatgatgatgcctgaaagggacagggcatcttgtggatcgatagggaatttccggccttcacacgaacagctaggtgtggatcgacgtcgttcactgatgtctcctcacttttgagcgctgaagatgcctatacagtctgacgatgcgcagggtggtggtcttcagtttctgtgctgaaaacaacagtatttcatggaaccctcgcgtactgcctgatgtcctgtcagttctgtttgattggtgaaatcgattgcttttccatcccgaggaaagtggctttgcatgcacggattgaaccagaattttctgaagaagcagatcctctgccgctgacatgtgggcctcacacaatccccgtccagattctgaagtcctctgaacgtagccagaattccactagtttttccgaacagacgaacagttataacagatagtagttcatcggaactactactatctacgtgatcgcaacagattcgtagttcgcgtcagaatccagcacgattcaagcccgcgcgcacgtccgatcttgggagccgcgcgtgtgcaggaatccgccgaacacgagcagggcgacgagaggtcgagagccccacccatgtccatgtgccagacagccagacccgccttcgcccgtctgcgtaagtgcgtaggcgctgcctacccgcgatgccccgacccacgctccccttgcgcccgagcgaagccggctgcgtgatcgcgcagcccccttcgtgactccccccgtcccgcatgcggggcacgccggggccacgcgcgcggcgcacctagtcgcgtgtgtttggttgaagggatttgttggattacgttgggttgaatctatttttatatagatgtttggttgtgatttttagataatgaaataaaattctgacctttgctagagtaactacaaattgttacacaaattcacacaaactaaaaacacacacacaaaacaaagacctattgactattgaatcttattggtgaatccacacaaaacaaagacccattgattattgaatcctattggtgaacctctaagtaaagttggcaaaaaactgcatgactgttgtctcaagtagtcgacatgtagattttattagcttgatgtcctcatcacacctttattagtttggttgtgatactaggtgggatgggttggctccaaaaaagaatattccactgatattcaggttcaactcaccgatgaaaatctagcaaatcgattcgacatagctctatcgcgcgagtcacatgagatgcacatgtgtggtcacagtatctctctctcaccgtttcttgtctcttctagatcggcgcccatgcgagaagtggcggcgaccgtgcgtatgcccaagcgacggcgacggcggtagtggcaagaagcagcggcaagtaagcctgccagtgggctgagatccaatttgaatccaccccagcccacctcctcatggaatggcatgccaaaccaacccaccccatttcctctcctccaaaatccaaaccaacccaccccgcatcagatttcagtccaacccaccccaaaccattacactaaaatgggttcagtccacttcactggaatggattcaatccatggatcccagctacactacagagagcttggagccaggaggcctcgttacttctttagccatggatctcagctacagtatagagagcagcagtgtagacacacgtgcagacaattaattcaaaacagaaatattaaaagaacatcattgcttgctgaaacactgaaaattgggcaaaaacaagaaaatgaaacaaaaaaaaaatactcagaatgatacgcatcgcattgtttgttagctgatccagcactgaaatgaataccagaagactaatgatgtcatataattacaattaagtcaattgctcactactacagcaataataagggccataataaggtttatatcttcaacaaaaactaccaaaacatcatctatgccttgatccatatgcagttgtagataatctggaagagaaagaagccatcagaaatttatatttcagaaataacattgaaagattacaagttgaatattattatttctataagatatgactagcatgagttagtggacacactagtaagaatgaagaatgaatccatccatccccactattcaactaaatatctatactactatatacaaccacaaggactttcaagaaatggaaaaaaaaagagaggaagaaaacaaggttgagagccccaaaattctgcagccagaatcaacatagtaggatacaacatatcatatcaaacaattttgcaagagaaagaaaagatttttctctatttctaacaagtactctactaactcttcctgaaaaaaaagtactctactaactgctgacctaattagctcatggaagctcaaatcatggactagagaacaccctgaagccctgaactaatctgaacccttttgagtacaaaacaaaacatttggcctgagcagcctcatcaagaggagaaattgagcggattgatctgagctgagcacatcaaacagaaagaaaagattcagagacagagagttagagctgaagatgttacctggcagaggatgacagagtcctggttggggccttttttgcccctctgggagaagagagaggccaccttccttgcttatccttcacatacacaatgctctcatctatctcctgaacatgctctagctgctcaaataagaatatatacaagtaaggatacaactaatagatataaaaggcattgcaaggtgttacaaattctgcctaacatttcaccaactgatgaacaaaaaacaacattaagttactgagcacagggaccccaccattgtaaaaaaaaaaacagccatcataccaaaccttcttcacaaaacatcatatggtcagtactcagtacgaacctagatcaaagaaaatttggcacaaatattagtaatactggtgggcactcagacaaattaatctagattttgtgactaatcaaacaatataaaatgaaaacacatctacaattactatttgtatggcacagaccacaaagtctgagacgaaatacaaggcgtgagatattatacctttaatccccttgttttttggctctatgtagccaatcttttgcacaaacaagtgcctcgagcatctctggtgtcaatgagcttcttgtgtctccaagaatccttcctccactgctgaaagcggactctgagggcacggtgctaagtggaattgcaagaaagtctcgagccataattgccaacacaggaaactttttggaatttttcttccaccatgccaaaacatcaaaatcctcactatcatcctcacatacttcttctaaatatgtatcaatctctgacttctgagtacgtgcaaccttccggtttgacttgaagaggatgaattcatgctctagctttctttttcccaaaacaggtgagcctacaacactaactctctcactagactgtgacatgtaggatacaccccttcttcttgcaattccttcatatacatgaaagtatgatttcatctcctctataatagagtccactttactttcaacattagaaccatggggagacaccttctcataaaagaaatccaaatagtctcttttccttcttggatctaacacagtggtaatgacaagtgccaaattgaagttgtttgccaatttttcatcccaatattttgcaaacttggtgtgcataggagcagccaatcattttaaaagatcgctggtttgccaatcaggatcactcaaagcatgacggatacaaagaacatggggcaagaatgtgtgtgcagttggtgtcctatgagctgatacacctctagtagcctcttcaaaagccttaagaaattcacaaattgattcagcatgcaaccattcttcgtcagttggtagaagttcacaattttcagaggcatagctattgaggatagccttgtaaggcaatatttctctaatcatcttgaaggtcgagttccaacgggttggtacatcaagagtgaaaccagattttggaggaagacttttactagaagcaattgaattaaacgcttgaatgcgtgagggtgaatgctcaatgtactttaggatctcacggatcttatctatagctgcacgaatcaccctcatcccatcttgaaccaacaaattgaggatgtgtgcacaacacctcacatgaaaatgtttgccttccaaaaccaactcatccttgagagttttcactaattcttgacaagcagcggtgttgttactagcattgtctaaagttaaggtgaacagtttgctactcaagccccactcagtcaaacacctcatcatggcttcttcaattgcaaagctagtgtgtggatacttcacaggcttcaaacttataattttctttttcattttgaattcagcatcaacatagtgggctgtgacaaccatgtatcctaggttttgatttgaggtccacatgtccgatgttaggcatacacgcgaatcaagattctctaattcagcatgcaattcttgtttcagcctattgtaatagttgtaaatcttgtcgcggattgattgacgacccacaagtttaaaagttggctgcatggatgccatccaatcatccaagtagggatcctcaattttatggaatggtatctcagcatggatgaaatattttatcatcaactctttagtctttttaggatcaaacacaaaattttccacgggttgtttcctaactgttgatataaacctatttctaacttcaccatcaactagtggacaagattcgcaaatatggtttatgagatggctagttcctgattttctagtcgctgacaacattaagccacaatatttgcattgtgcttttggaagaccatctatcatgacaagctcctgctcaaaatgttcccacacttttgctctcttacgtgtttgtgaaggcagctcatgactagaaatattggcagatgaactttcagaattttgcatagacatgtttaataaacctgtgtttgacaagaatagaaaattaatatctacatttgctacttgtgcagaattaatatttacatttactacttgtgctaaaaactagtgaaatgataagcatacccaacagcaacctgttatacaccgtaatcatgcatctagcatttgggggctggacatgtttcttttcaaagaaccgtgcataaatattcttgtgcacttttttttcaccttttgaaactccactaataacataatgaatatcaaatcacatctttgaacaagaaagacaggcctcatgtcatgtcaacacataaaatagttagctacttaatactacagtgaaagacagccacctaaatcaacagattagtagttatatggaactgaatgaactgacattcaaaatgttttatcctttgaccaacagcttaaaagtttaagtgctggattttctagatgcgctcaacagtcaccattaagcagcaaaaaagctgcatgcttaataaacatgacttagaggttgggacttgggaaagggtgcaattgcactgatatattataaacaaccatctgacagaattaattgcgaataacagaacattgctagcaatcaatttgtgtaattccaatttgttcaaatctccaacatctttttttttctttttcagtagcattgcagtataccagagatctagatgacttctcaaggttagatgagacattggtactgctaatttggcaatagcttcataagtctttacctttcaagagttaagacctaattattgtgactaatcctgatgtctgatggcacacatactacaatccagcagagtatgtatcacatgagacaactaagatgggacaccagctgcggcattaaacccaacagaaacccaccactcttcagcatctccaatcgaaccaacccacattatctaaaaatcgaaacaaagaaaaagcacaaaaatagccaaggtaccataccaggatgctcccaagaaccacttccaagaacagtccccctagctcaccgagatccaagatggaggtcacgcaaccgcagatctgccacctccctgcccacagcaagaacatatatcagcggagctcgaccaagcagagagagaacgccacttcaagaaacatgaaagatgagtcaccttcttgagtgagtccggcgactgtggcggcgaacggcggtgacggcgctcggcggtggcagcgaacggcggtgacggcacgcggcggtgacggcgcgcggttgtggcggcggcggcggcagtgcgcggcggcgcaccgcacacaggcgcgtgcggggagtgtagggtttggagtggagtggggatagttcggtttgttttggaggctaacccatgggctgaatccatggatagtcttcacaggccaacccgcatccactccagcccaaaccgcaattcttcacaggccaacccgctccaatccaaaattaatatcagcccatttgaatccaaccaccaccatccaaatcaacatccaatccatttcgcccaataaaatccagcccactggcaggcttagcggcaaggtcgagtgtgtgagggagcatccgccatggcctccttcctcttccctctgttcttctcctcccatgtcgtcttctcgtgcaggaagcggcggcggcagcggtgactatcagcaacatcatcctgtgccctcttctgtggcaatcttattaacactcctgaggaggcaatatcccacctatatccctctaaccaaataagtgtaggatcattccatcttctttcactcctccaataaaaaaaaatccactccatccctccaatcaaacagaaaatataaccattctatcctaaaatttaagaatgaacccacccatcctagcttattcccaaaccaaacatatgaatcgaagatggtttgttgattagcctcttttgcccttagcagcgactgatcaggccaccatctatccaatcgcctggtcattgtgcttgggctgcgttctattcaaatattatagtttagctgctactcagttttccttaacacatggttcccaagctgttaagcagtgtattttaggtgaaaattttttatatataagttgtttaaaaaaatctaatatattcatcattttatatactaatacttaattaattatatgctaatcgttttttatgttttacgtgtgactaattagccgtttcaaacatataagaagaacacagccttggcgtcaaattagcaaaggttctacacaatgcgtgcacatgctgtccacaggagaattttgtaccgaaggattactccactttgagggctcctttatttggaggaaaaatatagaaattttataggattttaattatatagaaaaatttcctatgaagcgctttgtttcaaaggaatgaatcttatccaattctttgaaattcctatgaaatggacaatcctatagaaattttagaggaaattagtaagagcttcaatcttttggtaacttttctttgagtttttctctctcatccaatttctgtgtttttcctactgttcaattaaacggacattcctatgttttccttgtgttttgcaattatttattttacacttatatttctatcaaaattctatgtttgtcttattcttacgttttcttaatcctacaattcaaatgggctttggtactttgatctatcgaagtctcgtgctcccttctagaactgactaacacttgactcacggaggactccgtattcgcggtatttacgattggcactttggcaggcatggtttaaaacagtgatagttatagtccttttgaaaacgatacatcgacacgatcgaaatattccaagttaacaaataataattccgaattcacaaataataattccgaatccacaaataatgattccgaatcttgacagcaagcaccaatcgttctctttgcttttgggagagacaagacccggggggtaattaattaagacagacggttagggttcaccttcaccaaaaagtaagaatacatccagccagtatcatcttgatatcatttcaacaattgcataaagcagtattcatctagtatttaatattataagtcttttgattttttcctcaaactttttttatcaagtttgtagagaaaacatagtagtactttcaacacaaaataaacatattattagaatataactaatttgatgttttggatattgtttattttttctataaacaatatccaaagcaccaaattggaaaatgttagaatagatgtcgaatatactagtcctatttggttacggttggacttggagttgtaataggtgttagggggtggagttagagtcggagtctgtaacccggcatctctcttaaatagaaaggggggcaccacaatgtaaccatggcgactacaatgtagcgtagacacgcagggagatgatggcggcatggccatggactcgtagcggctaaaagctatattggttggggaggagcgcccataatcagagccccggggatgtaggcttcgggtgaacctcgttaacaaatatcgtgtgttcctgtgtcgtcatctggcatgtcttgggtgatcaatgattgaagcgatcgagaaggttagtcgtcgttccgctatatcggctaacttttataacagaaaaaagagtcgaaacgactcataatatgaaatagaggatgtaggtttttggtggttgaaaaataccgcgaaaaggcactgaatgcaaaaccagagtttattgcataatactacctccatcataaaaaaaaagaagcatcttaatttcagtactactagctccatcccaaaatatatctaattctcagtacaatatgtggtattatctaacactgtgaatctggataagccggttttaagtaatatcacatcatgtatgagacacttacattttgaaatagagaaagtaattccgagataaattagtggcatgtacagattcgtgctgctaggcaatatcgtatcatattctatattttggaaagacaaataattgcgagataaattagtagtagtgtgtagagatggcaacggggaattccctgtcggaggttactccaccatacccgcctccgcggtggagaattttccccatcaccatcaccgtgaaatgcaacggggcaacatctttccccatcaccgcctctgtgcgggtaatttatccccgtggagcctccatccccgctatcaacttactcaacagtcaacatgtatgcatttctcatatcaaacaataatttacatacaaaagattaacactcaaaatagcaattctagccatcaatttcagcacatcaacaacaactacaagaacacaagttcacaaattcagatcacaaattcgcaaatgcacatcatcagttcacaaatgcacatcatcaattcatcacttacaacagcagtgcagcaacaagtagtgcaacaaaagtgtgcccaagaatacaatatccatcatattcccagattaagcaacaacacaataatacatgatcattcatcattcatcagtcatcactcattagttatcaccacattgcagtagcaacacatgttgtcctaggcatacacaaaaccatagttcggagtaggtcttttgtgccaaatatccaaaagcattgccatggttttacaagtttatcatgacacataacaggggttacaaacatccaaaatcattgcaagaacagtgcatgtccatacattcatgtcttcaaacaagagcaagtccctaaattaaagaagtagcaaaagatattcaattagtcaagtattttataaggatataacaaataatggcagtaggagtttgattgctaattttaagttgttgaaagaatacctcaatctgatcttggatatcttgaaggcaactccaaaagcttgctgcttcttcattatcagctacaagataacaattataagaattattttgcatccattgcattgtaaaatctatgctaagcatgatgtatgaataaaacagcatatgtacctcgatacttgtttcgcagccaatcttgtgagcacattaaggcctccaagagttctggagtaagccggctacgatgctcactaagaacccttccacttgtgctaaatgcatattcagatgcaacagtgctaacaggaatagcaaatatatctcgtgctaccttcctcaatgtaggaaagcttgtcctagccactttccaccaatcaagaatcttaaagttttctgtattaattgaaaccaactcatcctctaggtacctgtctagcatgcgatggctggtccaacaccgcattggcgtcccttattgtggaccgccgaacgtgagttagtgactcaacgagacaacgatgcagccatggaagaggaatttagtggagggggagggggatatggtactgtagttaggcatctagggaggggtactaagttgggagtaggacagctagatgtgctcaccttgcatcgtcgtcggagcttagcggtggtgaaggcgaagccatggcggactcgagcggctggtcgtcgtgtggactcgtcgttttcccctttcttgccaccgaagccttcacctgcatccaccatcagcaaaacaaataagcctacatgatggatcagatattgacggagggtggaggaggaggccgacgtccggtggccggtgccgagtccacgacgtcctcggacctgggaggctgggactgggagtgaagggaacgggacggcgcggcgtggcgctgggacctggccacggggctcgggagctgggagctgggccacctgggaccgggcagctcggcgctggcgcggacgccgacacggcgggtgcggcggccctgcgcgcgggcgcgagatcgggagccagcgctactcagccgctgtggccgacggacgacggcgtggcgcgtggcggcgtggggattgggacgagcggggcggacggtggcgtgtggactggggaatggggacggaggggataaggattggaatggttagggttacacaattgctttatatactctatgctttgggctggtttttatgggccaaatacacaggatattactacacacatacttttatatcgggcctccacggagggcggggacggggacggtgaaccaaacccgccctcgccagacccgacggagactactttctctccatttgattccccatggagacacaattgataccatcaccatcacctaatgggagaattctccacgggggaccggggaccgggtacccattgccatctctagtagtgtggagaaatgatcatattgtgcctcattaatactcttggttgtactatttccataggttttgatttaatgcaaactagctgggtagcccgtgcaattgcgcggctagcacccatacaaaattatctatttttaatatgatttattcaaaatttgttaaatagctatctcattgtcttaagactttgaaagaccaaaccttatcattctcgtgtttctaattatatagtttttaaaagtcacaccaattactaccccttatgtcatctccttctttatttgcttgctcgatctaccactatttctattcatacttcttggaacctttaaaaaatggattttatagtttttagagtttattgtcacgttgggttttatttttataatttctagatgtctcgtcaaacgttgccattatactcctctacggcccatcaactatctcatctctttattgtcattgagattttaaaaatcgaacataattatcgttttggttcatttttactttctagaagtcccaccaaaccgtcagcggctttgccattgtactcctctacggctcgcccgctgcctcccttctttattgtcattgagattttagaaccgaacatgattagcattgtttttttttactttttagaagtttcgaacctttaaaaattggacttgtagtttcattttttataattttgagaagtcccatcaacgatgccctatgcccctctacaa

SEQ ID NO: 48670 - DNA, 25478 bp, Oryza sativa
ttgtcattgagattttaaaaatcgaatatgattatcaatggggtttgttttttttacttactataagtcctggcaaccgccttactcatttgcttcgcggcctgcttgacgtccctccttcacggcaattgtgttttattaacaatttttatatgtcgtatcaatcgccaccactctactcttttataggcatgttacttaacttatctcgtcatgtgttttagatggtcttttctttcaataatctttatttttatcaaaaaattgagttacttataaattgtattcctaattgaaatcttatttttctttttctaatttcagaaattttttaaaaaaattagttaataccgtattgtgttcttttaatgttttaatttcggattttattttatttttatttcgaattttgatcaatctcatattgggttcttatatggaaccttctttcaatattgcttatttttaattccgaatttcagctatttttaaattgtatttctaattggactctattttcttttctaattttagattttattttatttttatttcgaatttgtattaatctcgtattgggttcttatatggaaacttctttcaatattgcttatttttaattccgaatttcagctatttttaaattgtatttctaattggactctattttcttttctaattttagattttattttatttttatttcgaatttgtattaatctcgtattgggttcttatatggaaacttctttcaatattacttatgtttaattccgaatttcagctatttttaaattgtattcctacttggactatcctttccttttctaattttagattgtattttatttttatttcgaattttgattaatctcgtattgggtttttatatggactcttcttttaatattcattgtgattctaaaaatcgaacataactatcgttggaattcattttttattttctagaagtcccgtcaaccgtcggtggctctgcaactatactcttatgcaccccgcgcgctgcttctcctttttattgtcattgagattttaaaaatcgaatattactatcaatggttttttttttactttctagaagtcccggcaaccgccttacttgtttgtttcacggtctgcctaacgtccctcaatttaatcgtcattaggattctatttgttgttttattaacaatttttatatgtcgtatcaactatcaaccgccaccactctactcctgccaccactctactcctttataggcttgttacttaatttatctcgtcatgtgttttagatggtcttttctttcaatagtctttatttttatcacaaattttagttatttataaattgtattcctaattgaaatcttatttttctttttctaatttcagaatttattttttaaaaaaattagttaataccgtgttatgttcttttaatgtttttattttttattttcaatttcagttgtttcaacattgtattcctacttgaactctcttttaatttttctaattttggatattattttattttttattcaaaattttaattaatctcgtattgggttcttatatggattcttctttcaatattgcttatttttaattcagaatttaagctaattttaaattgtattcctacttgaactcttcttttattttcttttgctaattttggatttatttttatttttattctaaattttaattaatctcgtattgggtttttatatggactcttcttttaatattccttatttttaattccgaattccagctatttttaaattgtatttctacttggactctcctttccttttataattttgtattttattttacttttatttcgaattttgattaatctcgtattgggttcttatatggaaacttctttcaatattactttttttaattccaaatttcagctatttttaaattatattcctacttggactctcctttccttttctaattttgtattttattttacttttatttcgaattttgattaatctcgtattgggttcttatatagaaacttctttcaatattactttttttaattctgaatttcagctatttttaaattgtattcctaccttgactctcctttcctttttctaattttagattgtattttatttttattttgaattttggttaatctcgtattgggttcttatatggaaacttctttcaatattgcttatttttaattccgaatttcagctatttttagattatacttctacttagactctccttttctttttttttctttttctccgattaatgtgggaatttttagcccccacagcgaacgtggtacctcattttcaagctgtcttaataatataatagatagatgctgcagctttgctgtaacctctagaattgtgttttttttttgaataaattttaaacgtcgtaggacggaacgaatattattttctcatttatgtgtgatatcgcctgttgatatggtatctttccgagataactgtaggtgtggtgtggcatatagcatgccaggttatcttgaagttgaaatgtttttttcccctcaacaatgttaaagttctaaacagtctaattaacttaaaaaaaatgttatttaaattgttcatggagcacaattgatttatttagccatgagcacaactgatgtcacactgaaatatgtcaatacaactatagaagatcacttctattttggtttgaaaagtcacttcctttaacacatagtgatgatatacaaaacagtacgcacacaatacgtccttttttcagctttgtcttaacacctgaccatgcaaatttagctatctcgaaccatttacaatccaaagctgaatctttctacggattgctttgtaaagcaccttctttcgaagagaaaattgttgcagtctagtctgaaacaattgcagcccactgcgattaattgcttcataaccaatggagtactagttttcttctctagggaaaacgtagaacttcagaaccttgaacctcacgtcgacactgatctaaggtggtgtttacatccagggacttaacttaagtccctgtctttagacactaatttagagtattaaatatatactacttacaaaactaattacataaataaaagctaattcacgagacaaattttttaagcctaattaatctataattagagaatgtttactgtagcatcacataggctaatcatggattaattaggctcattagattcgtctcgcaaattagtccaagattatggatgggttttattaatagtctacgtttaatatttataattaattttcaaacatccgatgtgataggaacttaaaagttttagtcccatctaaacagggcctaatactaacaaattttttaagataatggaataaaatttcagcctatgcttaactagccatagcccaaaatactaacaaatagtactagccatcgaaacattaccccctacaatcccgagcttagcaagaaatccccaaccttttttcatacggatcatcagtaatccagtacaacacgaagcaggttgctgatgtgtggcggcagcgagagaaacctccaaaggttcatatcctttttcacaggtcgaggaagccggtggtgcgccacaccgcgttgcgcacgcgccggaggtcgcgccctttcagcgtccgcccggcgccctccatcaccgacgccgccgccgcggcgcggcgcgcggccatctcgtgcggcggcaccacgagctcgtcgtcatcgtcctcctcgtcgttgagggcctcgtgctgcacaccacggcgacgcctgtcgctgtccgtggccttgggccaggccggcacggcgaccggcgccgactggtggtacggctgcgggggctgctgcctctccgggcgtgccttggccgggatggacgccgtgggggcgtgatcgtcggcgaggagggcggacaggccgacgctgccggcggcggggaaggcgtgggacgacgacagcggccggcggacgcccacgcccgcggacgcggacggggtgagggacggcgaggaattggttgaggaggcccacgaggagggcgaggtgttcgacgacgacgacgacgaccagacgacgtcgcgctcgtcgagctccagctcgtggtcgccgctgccgtcgtcgggctgcttgaggaggccgaggaagcggagcgacggggacgtggcggcgccggagcggcgatcgggcttggacatggccggggagcctcggcgctcactcgctcagctgccgctgccgcagcgcctgtgccgctgtgtggtggctactgaccagcgcgtcgtgggttttttttagcctttgggcgcgctgctattattggcgggctagtggcggtcgcgatgtgggcggggggaggtgaattattgtggggatgatggcaaccgagcccgagcggggtcgccatgtgttggcgactccgtgtcgtgtgctcgccgcgcgagggatcgcgtcgtgacacggccgtgccgagcggcgcctgaaatccaccagccttttccgaagcctctgcgcctggaatctggaatcattcctcgtaaaatcgtcgcccagaaaaaaaagcagcgaagcttttcgttgacaggtgcgtgcgagcagaacttcggagttcagaagcagtaatatcgactgtatatgcgtacagatacactcgtttacagatgaaccgatcagcatgtcatcatcagcaaggaagtggacagacttggtttaaaatggggttacagataaacaatcggatctcgctagcatcactagcggatgtgcgttccccttgatccaatggttatagaagcacgaatcacggaaacgattgacagggcacctaccacccccaccgtccctattccctgcacttactccctccgtcctaaaaaaaaaaaacaaacccagtttccgtgtacaacgtttgatcgtccatcttatttaaaaaaattattaaaaaaattaaaaagacaagtcacgtataaaatattaatcatattttatcatctaacaacaatgaaaatacgaattataaaaaaacttcatataagacggacagttaaagttggacacagaaactcagggtaagttggacacggaaacccagggtttgccttttttttttggacggagggagtaggtttttctttgttgaggatgaggaaaaaaaaaacgaggggtgcgatcaatcaagcttgacacggggaaaaagaaagcttggatatattattagccggtgaggccgcttgtgtaagacgtcagtctgtctgttcgtttcgtttcgttttcagtattcactcgttgccaacttgccttccgagcccaaattagctgaatctgctgcttatttcttggacgtgcagagaccttcgaggtttatgcaggctcagacctctcgagatttcacagttttttcaagtgcacgtgtggcagaaggatggaagccttggagaatgctgcttgggaggtaaaggcgcttatcattttggttttgcaaagatggggattggtgaacactgaacagaacgacaaagactggcaaggttatttgtttgaccacctctttaagactttaaccatcgggaagaaaattacgtactaactttctgtattgttggcaaaacaaaaggacctgtcaggctcttacagaaaaataacagttctgtgatcggcataactcacagggcactacgcaagtatctgcaaggaaccaaactatgaacgtaccaccgaggcatctcatatactctccactagtaggactagtaaaactgaagataagagtagtacactatcggcagaactaccaatgtacagcaatgataaatgaaggggccaaatgaaatgagaattgagaagatacccaatacacttccagatcgggcaaggcattagcaatttcaatcaagtaagaatttacattctaatgatgttgtggtcccatagaagatcccaaggggcaagggcattgcactagcattgttagctgttacacttacatctcatgagttctgacatcagttcacgaaacaccagaattgtgcataaaatagcttctatcaactaatctcagaacaataccatcaaaataagttggaaggagaaacgacagaaacacacaacctgtagaaataggttcaggtggtggaagtatcatgagatcgccatctttcttgcttaaaattccgatcacgctcaatcgcataccttcagcgatatacctacaggttttgcattcacattttaagtttccaaagatgcaatatgcaaagatgctggcaaaatgtatatctattatcgagcaatttgattacccttcttcgagacggataagctgacattcttcagaaggaatatttctttcatccagccaacacctcaaggttgaagataactcagtgttcccgcttgtcgtaaccagaagattttcatcgatcaagggaactactctcgagtcgtgcccagctttcaccaaggctcttttacctgattttgcatccgttatgtagaaatcagcagcaaacctctgcccaactccacaaaatatttgaataagacaaacatcacactatctatggcatcttactgcctttataatgaactcaattttacagcaacagatacaatgacattagagaaattaaaagactactaaataaacaactcagacataacgcagatgagcaacagttttaaaattgtgaaaaatgggtaatgtctactcgttgatctacttatgaaatgtattgttttttttgttccattgtactatgcagtcaagatctctcgaactttacatacaactgagaaacggtattatgaatttccaatttatcaccaatattgcacaagtggaactggaactgaaacaataggttattactaattgtgtacaataataatgcaagctagtttatgaaatagtaatgcttttgtaatcatcataaaaaacaaacacactagtattacagttggattgaattgggctagcttgagtcatgataaacaaaaaggtgaaacaataattaaaaaaacaaaattttaatgacataaggtgcaagataaatgaaaatacccatgtgttctgtagactccaccacacatacactagaagcccttgagatagcaacaaagcatccttacctcagcgtgtgtcaatttccacttggaacagcggttcttaggattagctacttcagaaccccatcttccacattttcgcaataatgtagatgtatatacacaattctctactttctcgtatgaagaaatcagtgaaatatcaccgcacgcaacaagctgcataaaacaaggggcatcaccacacatgcaagaataacacattatctgattttttttaaacaatgcaagaataacatgctgaaaactgaacacaactaaaaagaatattttttgtaacaagagtagaacataatgaaaaacaataaatgtactgtaataggaaaatgtggaaaaaaacacaaatcaatgcatcacagcatacactccctaaggtaaaaggcacaaaatttccccttcagactagaagatacattcaatgtactaccagtacaaagttgagaaaggaaacaaagaaactgcccttgactggttcgatatggccagtgaacctactgcatacaaatctggacattgctgtgcttgctccccattgcacgattatggaatccataatttggcgcatcctatttacactgaactacgtgaccaccaaaaaacgaagaacactcaaggtgcaaacaaaccccactatgaaacaatgcaagtgtatccggtccacaattccacaagttacatgaaagcactatatgatgtagaattacggcaccaaatgcattattctccatgcatctagtggctccaccaaaatgctccttatcaattcagcaattcagaattcagagacttaaagacggaataaaatagacttattggatcaatagcagcacattcatggcaaaagaaagataatgcttttgcaaatgggcaaacatacaccggtgatcttgacgagctggtcgtcggtggcggagcggaggctggacgcgggcagcccgtccacgaaccgccgcagggcgcgccccgacgcggaagccgcggcattccacaggaggaacgcgacgacggccgcggagaggagcacggccaccacgagcagtgcggcgctgtgcacgacggcgaggacgagcgcgccgaggccgagccccaccgcgagcagcgccgcgaccgcccaaaccgccgccctcgggaacggcgccagcgcggggagcccccccgcatccccggcggtggcgcataggtcgttcagcgaggccgcggtcgcggcggcctcctcgtcggcggtggcgccgcggtgcttgccgccgtcctcgcctcccggaagcataatcagctcgcgccgctgctggggtgggcgtctcggggtcggggggtttcagtttactcctctttcttttttcctttttttcttctattggacctttttgtcctcaactcggtatggtgggtttggtttttggcgtgcggtttaaggaaaccaacgtggagcgcatcggcaactctactttagcgtgacatgtgggaccataacaaatctggcccgcatgtcagtgacacagacaaggctgtggggggtgagctgtggagtacacggcgtagttatcctcctctcgcttttggagcaaaaaggagtactagcaatatgacatgtggggcccgggcaacctgtaccgatgtcagcgagagcccgtggtgcgatgcctcgtgcgtcggagaacgtggaccacgggatcagggcattgcgtgctcacatgagctgctcctcatcactgggttgtgagtgactgacactgaagcggttggcgttgtactcgcacaatttgtgtccctggctagtggggcccggttcatgtgcttaccgatcatgtgtacttgatctagtactagtactcctagtaccgagtgatctgtactagtactatgcacaagtatggttgggggcaaatggtatagtagtacaggaggagctaagcagaagaattaagaaactgacacagccttaacctacgttttgggtggattagttaacagtaatctcatgacctcatccgacgagcggttttgagccgttgcgagaagaggaagcaaacagtcacatgcctaatcttttcgatactctcaagtttgaatcgccacttgccccgagactgacggtggtgcagactgcagcgacctgctctgcatcacaccactcgtatacatggaggcgctactgcgctagtggtgctagctagcgctgcgctgggccccctggatccgatctgcaatctgatccattcaattgtactcgccgtactctccctctcggtcaatgctactgtagtatcgtactcttgtggccagccgctggcgtccgtggtactgtacctcgactggttgacggaagcggcgtgatgccgtgcgtagaccaacgcgccatgtttcactgtgctctccgtatactgttcacaatgccccacgcagaaagccacacccgtgaccgctccgggtgcgtccggtggtccggcggaatttcgaggggaaaccgagccgagcgctgcgccgtgccggcgtacatgcgtgtcggcgagcgggggcacgcgaggcccagcaacgggtagtggcgagatgggcctcccactcggccgctcctcgaacggccaatactgggctagagaaaggctcatctgtaacagcccacacacggaccactcaccctagccgagttaattagaggaataagttcactctgactcccttacaggatttgagatccgtgagtattcactcgagtcccgctcagtgagagattgaaaggttctgtacatctctttagcttacgttggcgacaagtaagccagccgggagggcttagtacgtgatgtcaatgatttcatgcttacttgtaactgcagactgctcatctttagttccttcccaattgctatatacaatatgctctggtcaatcgaccggtactagataatgacttgctcctacaaagtttacacacaccacccccacctcaagagaaagcaaaggctttgcccggtcctcagtatcctcgcgcctacgctggcagagaattgacacttaccaaccaacctcgtcttttcggccacgcgcggacaccttatcacattaacaacaacgggatcgatcgatcgcgccgatctttagctaggtggccaccgccgcattgccggcgatcgataagatggccagatgggaggatggaagagacggcgccacacgacgtcgcgctcctcctcgtactcgcgctacgcgctgtcccgtctcgtcgcggcagctagcgcatcgtctcgccacgccacgcacaccggtatacccgatcggtgtggatggagctagagtaccaattaccaaagctctttcgtttggtccctgtcacgtactgcagttgcagggccagctcatgcatgtgcacgcttcgcgcccctagccagggtagctgctatctgcaactctctctccgctaaagcggcacactgctgatcgattgtaatttgatggtgattgctgaagctttttgccacaggcaaggaccaggcactgtgcaagctggatatacaagattctttacttcgcgcgaacgcaagtttgccatagcaaagctttcagtggcattaagctgaaggtcgctaagacggccggggacaatgcaaagaagtatgagtgcgattgcgaaagcaaacggtatgttacacgcggcatatgcaaccggctcgggtcaatggggaaaaaaacgatgatccatgagtccagttacgcactgtgtgatcagatacagacatggaccataaagcagtgcaatgatcgaatcgttagccacattatccttgcaaagtggtgtttgggcggttaacccaacggaaggtcgcccagctctttctctgtttttttgagagattgggaggcccagcttttcgttgcgcctttccggtgtttctagaagatttcacacggcctgaagctggagctccaagacaccgttggttttaaattggggttttaatcagctcccaaagtcgcagctttagccgtgttggactccttttgatctccttcttttgagcaggtcgccatcaggtgtaaaaagcacttttttgggtgaaatcggagatcagagatcaaaggataaagttgcccccccaatagcataaaaaatcggtctgttggtttgtcaattgtcaagctcgaattggtgtacaaaaaattctgaactagtcgttctctgtcgatcaaaacagtgctaaacaaatgtgtgcaacctctctttcacgtacattgccgtataatatttccgaaacggtgtacagatatacaagtggaataattttaaattccaaagagcttttgattggggataaccagttcgtcatggtttgtctgaagatctctctgataactaacgatttgattggataccttagtttttccacgtagtcgtagaagcagtggtttagacgtcatatgtattgagattcttctctaacaggtccaataccaaagcaaataagcaatgcccaccaatgattatttagaaaactggagtataacaatgaccttgcctgttgctttgactataatgatcatttctaataatgatcctttcaattctcctactaacctacgcatttaaagaaactaatctgtatcgcaccaaacagttaactaaccataagtgatcatcaattctctgagtctctgacccatcattggtcacgcatgttgaatgcgtgaatggagaacagcaatccagacagggaaaaagaataaaacaaaccaattaagcaccaacatataggccctgactagtcccaatatcaaattaatttccaacataaaccagcaggacttgtccaattcagagctagtcaggtttcttcataaataagcatacatccagccatatgatctgcacaagcccgtatttaccaatttaaagaaaaggcaagttcctttatccaaaaataaacaaaccactactgccaaaaatacttgtgctatcctacgcgtccacgagataaactccattttagaattctcaggaatatctgtccggcaaaaatcgttttacgtttcaatcatgacacagtacgggaggactggaggacccgtttcggccacacattcgagccaccgggccacggctcgagaactttctcctcgctgcctcactctcctgaattcctgatccgtgacgtgcaggcaggcaggtccagaagtactcatactgctgctgctagctatcgatcgatcgatcgatggatgtatccatccctttgggatttctcactcttttatttttcatgcattgtgcctgcacagtagcggccaattcgcaaagcggcaaagggggacaaaaaagtcgacattgccaagcagtcgaatgtttgctaggctccaaagcgaaaagccctggcacgtattcatctcctgttgatagtatagcaacgagacgacaacgacctgccgactactgggtgtagaacaacggcgtcctcttttccttgacgtgtagtgtcgtctcatcgcaagcgttccggacagatcacgcgctgtattatcaaccgtggactgaatgcaaacccagggaggatttgtttttcattcgctgagaactctgggtcagtttgttaaattttggcagggtagaaatgagaagatatttgattggtgttagaattataatggtaagagaaagtcctcgagtcttatcggctatcaccataagttgatgtatattattagtcggtccgggtttgagaatcattcattgcttaatactattgatatgatagtctctccattcatatcttcctttttgaaaacgtgctagtaaaagatcaatatatttgcaatgcctaaactttagcggagtaaattttccatgtaacgttttgggtttgctatcatacaaaaattgttgctttagccctactatcagaacatcgaagttttagctagggagcactataaatagataccatcttttttaaatagtaagcagtctctgactttgcataccagaaatgagaaccaaagttgtactaaaattatactgttctttttttatttgttccatcattatacatccttttattcaataaaaaaactactgcatgtgtgccgaatggcaaagccgaggatataaatcatttccatttatctaagtgagaattatgtgtttggtactccacaagaattttaaaatgtgttttaaactacatgtttggatataataatttctattgtctgagtgggaatgcataatagttgtaaaatgtgtttggttctccacaagcgtttctatatatgtattcattcactcatgtgagtgagaataatggctgcatgctactccctccgtttcacaatataagtcattctagcatttcccatattcatattgatgctaatgaatctagatagatatatatgtttagattcattagcatcaatataaatatggtaaatgctagaatgacttatattgtgaaacggagtaagtaagtagcactgaaaaactgtgagatatatcgaattacgacttgtgatcctatatatgccttgtcctgagtcaatgcctatctaagattgacggtgaacatcttggaactctccgcgtcaatcttagatgaataaaaggctacaaattccaaaattaattaaaaatttccatatctatatctatatctatactattataaaaattgaagatgtttttgctggtattttggtacgtcgtccgtgtttaagtcagtttttaagattgttcgtttttggaaatacatatccgtgtttgagttggatttcaagctcatttgcttttggaaatagaaaatgagttgtataagaaatctctttttagaaaactccgcatgctaacttgagatgaaagtctgactcctagctgtagctcatgattttctaaaaaaaaatcccaagcgatatcccacagtaaattttaccataactaaatcatataacaataataagattaaatagcattcacccgttgcaacgcacgggtatttttctagttattttttaaaaaagggaaaatactattcatccaaatctattcaactggtataacaatattaggataagatgaatctctatcatttggtgtattgtatggatacccttaaaaaaatatataggtctaatatatagagggtttacactaccaactcaagctgatcgattttcatgaaattttgtgattttgaggtggctcaaaatgatattttgagggagatttgaatggtttttcagaaattcaaatttgaaattgtaaatcgaatagaaatttgatcaaaattggatgaaaattaccggttgtagacatgttgttagggatcaaaatccaatccccatggttttgtgaaccctactaatatgactaagaactatcatgcattctccactaactgcatattttcttagataacaaaaggctcaatagcaaatagcacctccgtatcaagagatgcacacaagaacataaccaacaattaatctaaattacaaaagggactttaaggcgagaaaattagcccgcttgaatgcaacacactagagtacaaaatctaaaacttcattgttttaaattaacatgcttgcaaaaggtaaataccatgattactcaacctggaaatcttatatacgttcaagagagcgatcgatcaaatgtgaatttgatgtgcttgcgacccattgacagtgagcagtaaaaaattcttggccatgcatatctcagactctcagtagtgttcctcgtcgagccacctcaaacctaagaaagatttctttcagttgctcatttcaaacgattcaacacttcagttatgaagaaccatgggttgccctaaaaagaataagccaatgccaaaattttaaatttaaaaacttaattttgagtttattttaaaatattttcaacatattttctttttcagcattgggttttcagtcactaagaatatgtctataaaaattttacaaataaattaaaccgatgaggcctggacaatatatgacagagtcaaaaggagcatcgctaaatcaagaggtcactagatcgggacatggaggtgtgaggagacttagtgaattagagttaaataaggagcaaaagagactaaggctgtgtttgagggagagggaattgagaagattggaaagatacgcaaaacgaggtgagccattagcgcatgattaattgagtattaactattttaaacttcaaaaatgtattaatatgattttttaaagcaactttcatatagaaaatttttgcaaaaaacgcaccgtttaatagtttgggaagcgtgtgcgcggaaaacgaaacaaacaatttccctatgttctccaaacgaacgcagcctaaggttatctataattttccttacaactttcatcaaaatccgtgtttggggtctaccaatcacactgaaactatggagtatatatacctaaataaactaagaaatgatcaaagttagcttggagaatcctacaaaatccttattatgttgacttcttacatgctactccctcatttccataatataagacacaactacattttctggacgttccataatataaggcatgcatgcatgcatacaattaattaggacctcttctccattaaattattacttttttaaatcttccatcctcaagatctcttattctattggatgcatgcattatatttattagggtgatacaaactatgagatgataataattgtttcttggtctttgggttaaatgtggttgtgccttatattttggaacggagtgaatatcatcttagtatatgcatgtgtacttatgtgtagatataaaactagtttaataatatcgtcaattgaacatctttcgaatagattactactaaatccgaattcgaagtgaccacaaaagatgcttgaattcctatgcaactcttccaatgagctcgatctagttttctccattttagcaccatccaaaacacaaagtccattggcttaattgcttccaaggtttccaccaccactactccaacgagattcctcttgcaaccccaatctacaaaccggccccacacgtcattgccacggccctcttttccctctctgtccaagggagacggcagatcagtcgaggagacgtgatccacgtactttaagctacatgtacacacaaattaacctagggtaatatactactctctgtctttcaagccaccgcattccactcgacgagcggccatggctcccacagctccggcgtggcgcagaaggactccgggaacaagccctcatcgtagtcaagctggtcgtcgcactgatccgactccaccgacacgtccgccggcgtggcgcacgtcgcgccgccgagcacgcagctctccggcggctcgaggtccaggcaccccgcggcggcgttcctcttgtcgtcgtcgtcgtcgacctcctcgctgcctgatccgttgcagctgctgctgcttgctgccgtcgtggcggcaccaccgttgccgctcctctcctcccgttccctcagcctctctcttagctcgtgcaactgcatattacatgcaaagagcaatcaagttagcgtttgaattaattatggaacacatgatctgcatgttcctacgattagtagctaagctagcttgcttaattcatcgttaattacctggacggtgagagcgagcttctcttgcttgagggactcgacgcgggagtggagggcgtcgtacttggagcggagtgcggcgtagtcgtgctcgagctgcttggagcgccaccgcgcgcgcttgttctggaaccagatggccacctgccgcggctgcaggcccagctcgcgcgccagctccgccttctcgcggggctccagcttggcgtggtgcgcgtggaacatggactccagcgaccgtatctgctcctccgtgaaccgccgcttcctctccccggccccgcccctccccggcgccgccgccgccccgccaccgcccaggtccatgtactgctcgtccgccatcatcgccggcatgcacagctgcggcggcaccaccggcgcaggcggtggcatcaagaactggtgctgctgctggaggtggtggtggtcaccccgatccatggcgatcctagcccagctagctagctgtgttcgaccattcatccctctcccggctcccggcccggtcggccccttttataccggtgcgaggagtgacgtgtccacgtccggtccgggggagatgcaaacatgtggtctttgcgattgcgggtaaagaaaaccgccggggccccacgcaccgtgacaccgagcaaagctgcttttgtttcccgccaagtgtcacgaatccgcccgcgccaaaagctgtgcccctgccccccatggttatccggccgcctcgggatcgccacttgacacgtggcgccggtgacgagcacgagtgcgagatattcttctctccttctcccgtaccggttccttgttggcctactgctaatcgttggctgctgtacaacacctccggatttctttttcgtttatttctctccctctttggcctctttcgatcgatcgccacctcgtgcaggaaattggtaccactgctgctaaggtgtacatgcagtagtcgttcactcgttcgtacgaagaaccggatgatggcgtgcgtgcatgcgccaatgggtggcggaaaggtgggtgcgccggagagagacggagacgcgcgcaattggaacaggtaggccaatggccgaggagagcgcggcgcacgcggtcgcggtcgcggtcgcggcgccaagtgtacggggggcttcgcccgaaaggctcgtcgaggtggcgcgccgcgtttgtcccgttgcgcgcgggcgccccgggctgcgcgcgcctgcgctacgtcgtaccagtgtgtagagctagccagcgcgcggtgccgggtcttttcggcttgatgtgtgatggcccgctgcttgttcacgtaccaacgagacagtggtgggggtaacaagattagagacagataattagatacggctaggtgataaccacttcgatatgaatgatcaactggatcgatctgattagtgcgcagggcttatctcgatggatcattatcgtcgatctctgtaccgggtgaattttctcctactcgatatcggcgaggaagagaagaaaagcggttcgtacgttgttcccaatctcttgtccggtcacgtgttggagtcgatcaggtaagttaaaagcggtggtgatccaatgtgttggatcaccttttacttggattgttcaattcgatcgaggggataatcacgccgcaatcgcggtagcgaacgagttaacttaaaagcgccgcgatcatctattatatactaaaactccataaaactttctacaaacgctctcaaaccgccacgtggcgctctaataaaatagagaaaatcctataaattctaagaaaaaaatagcatatatcccttgattttcacttaaattggtgggtccaatattatacaccgttagataaaattgatcttaaaacaaactaaataccatgtgtcccacctatcctctcctcccgtgcattggcaggtggagtatataccgtaccctcccccctttttttccttttttcttcttttttccatttatatatataatgtatatatttttaaaataatgataattttacaaacaaagaatctaccatcatataacttaagccggtgtactttttactctgtactattattttcaaataatgcactattttaaaataaattttacacaattacatcgtgtcctataaaataaacaatatctatattaactaatttatacgtgcacttaaactgatggctccattatataaatcatcggatctactttttattacactggtctattattctcaagtaatgcactgtcaccattatattgtgtacccattaaattaacaatttaaaatctatattaactaatttacacttacgctagaactggtggacctattattataatcatcggatctattgtttgctaataaataaagcgtccaaaattctctttttgcccactgcacaatgcacgtctgcacctttgcctttcgcacgtgtgacgaagcatagtgtctgagacatctaaggtgatcacaaccgctatagtactaccgctttgccacatattaaatcatatatggagatgattaattttgttaataacatgaaaaaaattaaaggtgtgatgcagtgagagaataattaagcaccatgggttgtgtttttctcaacactaattagctctgtttaagttgaaaacgagagttgttacataacaattataatgtatttgtgttatgtcgtattttgattttgtactatttgttcgtaaaggtgaaaggaatcattatgttataaatatgagcgcaatattgacgaatatcaatagaactcttactacgacaaaggtgataaagggagtttaaggccctctcttttttttcccgatttcatattttggatttttgtttgcacgttttccaagtttctaaatggtgtcttctttaaacaacattctaactttttagaagtcaattcattcgtttataccctcaaatagctatcacataaattatataattcatcaatttcagctatcctaaaccttaagtactacatattttttttcatgcgagccatggtgatcaataaattggtgaacaacggatcatcaaagtcgtaagatgaatatataagagttactctgaacaattgtaaataggtgtcaaaattaattgttattaattagacatctaatggcttgctagccacaaaattaatttctctctacatgtatataaacatggacgaagttggaacaaatattaccatatgtcccatacatatatattgcgcaattaacattctaattagtcatttaaaatttcttaaaatgctcttaagctgccacgtggtgctataataaattagggcaaatattaaattctaacaaaaaaaatcaaagtatctattattttatttcgcttaaatccgtaggtctaatattataaaccgttagattaaattgatcgtaaaacaaactaaatactacgaggtcccacctcgacataggtacgcacctacatgcgcgggtacgtacgcctcccctcccttttttcatttttctctttcttctttttttcccatgcatatgcttccctccctttattactatatcatgcgtcttcatgagatgatttaatcaaaagaattttgagtatcttgcactcgcatttttaatttgcgggcatactagacggtatgtatatacatagactgtatgataattaactagcaatagtttcttatttactcgagaaaaaaatatgattcaaaagtcgtaagtaattaatccatctcctactcaaaagtttgtgaatggttttataagataccttaagaaaaatagaacccttaaattattataaaataacattatccaaattttagtttgccctgaatctataagacaatttctgaacaaacaataattttaccttttaaataatataagtgcccgcgtatacgcgcgggccaccaccttcctagtttcgggcaacagcatcacgtcaggacgaggccagccaccaactctgtaaccccacgaaaccacaccacgtcgatgattttcggattttctctccccgggccgggttcccctattctgattcattaattaaagacaaactacggagttgaactaccacgttgataattaaacaagccattaatgacgaaactagcctgttaagctacaattaccgggatatatatatatatatatatactacagccgtggcggtggtagttcgtcccgtcaagaaagaaggatatgataattggacttccggccggcttagctagcttgggtgtggcttgctactagcatgcacgcgcgtccacactccacaggcagacatgcttccgtgtcggcgtcgcgcacgcggtagcgaggcgctcggcgcgggcacgtcacagtagctgtccgtgggtcacaccgcgattaatcacggctacagctacagctgcacagtgcacagcggaggggaagagttgtgttaattatgtgggctctagctagcctcctagccttgactagctgatgtcgatgacgatcactgatcaggatacagccggggaccagcaggggtggcggaggaggacgaggaggagagggcgcgcgcggcggcggggcccgcgctcgacggcgacgggcgaggccgcgcagcggcgggcacatggcggggcgcgagtggtggcggggagaggcgggtcagcgtcgcgcgggtactcgtggctgctgcgcgcgtcggcgtcgcggcgtggggacgggggcgcgaaagcttcgcgcccgcgcccgcgtggccacaacttgggcgtttctttccggtcacgcatgcgccttcgattcgcacaggctgccgcgcgctctcccggccggctcccactcctcctacgtcgccgctctgggcttcccgttcagcaatgcgtagttgacatatggccctgttggtttaattctcggtgtggtccttacacagaagatcaaccgtgcacctcagcttatcgccctctctttcacatggatcagtttaacgatccgatccatggtctccttagataatggaatgaattccaaagaaaataggcaaaatgaactattgaatgatccgatcgacggctccttccttatcgttcttgttgctcggcgatggcgaggcgccgaggcgtatcttgtgtgttcacgctttcttctttcttaaccttcgttgctgcaaatgcaagccgggttttctgaagcgaaatctctggtataacacacgagactcttgaaaatcacatggcaaaatcatgcatttagtccgcacggcaacagagctatattctactactcgcacatacttttgtcagtaagggctggtttagttcctaactttttttttaaacttctaacttttccatcacatcaaaacttttctatacatacaaacttttaacttttccgtcacatcgttccagtttcaatcgaacttctaattttaacgtaacacaccctaacttcaaaactaaagttagcccaaccatttgaagaaacgcacgtttgctagctaagtggtccgtccagttattctggaaaccaaaacatcgctagcccctttgcagaattgcgctaaatcgcactgaccattagaattttgtaagattatcgtagttgattagctggccctaccagatcgcttgtgctattccctcattccatcgtttgagtttgacctctaacagtgcttcaaccttttctaatcaaggaggcgttgcgtacgtattaaagaaacatatctcaaaactcgacgtggaatttggtgtcgaccactctgagaagaatacatcggcagaaacccccaaaaaagacatttttacacgtaaagtgcaatattaattctaggtttctcattcgtgcatctttcttggtctcttatgcatgcaactgtacaacttggcatcttccaaatccaaactgtacgtgaagttcaatgcgtcgattcatgtccaagactaattagagtttttacgcaggtaaacaagtttgtacgcagaacctgtgttctttgggaacccgactatccaaacatgtctgcgagcgtcttaagaaaatgaaaacaacatgtttgcaagcgaaattcatagaatcaggttaaaggtgtggaaatcattaaggacccagacttaccttggccgcacaggcaatcaaagcctacaaagctcacagctcggaaacgaaagacgggataaatgcaaatgctctttagcaaaaacaatatcaatgaaaagaatcaaggtattctcctataatcactcgaatatacagaagcatcacagcattgtttgttcagtccaaattctcgaggtctgcacgttctgaacccactcacacaccccattagcaagtagcgaaatatagacaactcaaaagaaaaaaaaatcagttgttcgaagtggaaacagaaaatacagtgcctcaaaaactcgaaattcaactaattttacagcacttaagtagattgtctgctttgccggccaataagcatgcattgctcttgtaacagggagcagagtacatgtcccttgacgcggcaaagctcaccgtctattccacacccattgtgcgtgtttgcacctggtttaagcttgacagactttacctgtgtcaacgtcagctaaaagttagatattatccttggtagatgaaaatataagtgcaaataataatttagcccagagccccagagcatgttttgataactattcgccactgtcttaatttaggtgaactttcagtgatccatcaccagagctgacataaactcccagaccgcccaacaggtccaaacagctcatacttctattgacataacaaaagttaaaatgcactgcagactgctgctcttaagaagccaaaaggtttacgataataaaaaggtgaaatcaggtattcatgagcgtatatgataatatcctctcaacaaaaaaaaacagaatatacacattggaatatgtttgttttcagaatgcattcaactatgtagagaagttaatttgtttcaaacgtaaaaacggtatttatttcagaggacctaagtaataaacaggtattcggaaaatttgccactggtactcgaatgaaaaatcccttgtctgaaaagcataaatacaagagggtgaaaaaatagcttgagaaaagaaagaattgtgcatgttaccttcacatattccacataaggcaaagaaagatggcgaccaaattgcagaagtatgaaaaatttcaacaacttccatctaccctttccaccaactaagagcaagtccaaagtgttgtcatcatggttggcttttggtgcaataacctgcgaactcaaactttgcactgtcttgcatgaatgattgcaaactagaacaccaagaaagtgtcctttcctgactacccatttatcatccaaatttggcacaagttccactgatggtccaatttcattgtcttctggtggtccagggagttcaatagggtggtcagactcccaggttagctctgtatcccattttggcccattgtcccactttggttcagagtcccaaataggtcctggatctgaaattgttgaggaaatgtcctccttgtcatgaattgatggggctgcccaagataatcgtgtatcgttagtagtgacaccaactgaatttctctcagttcttgttttggacctggttcttggccagaatgatgaatgatgtggttgagggtgtaaaacttcctctggttctgaaacaatgttgcttctgcccaaagaaaggcgttttgcttttggatcaagaccacgaacatactctgaaggttcagtgcttgctgctgtgctacctgatgtatcaacgtccccaagtgacatccgacttggagtcataatagagtcaatacttgacaaactggaagctcgtggaattccttctctttttgatcggctgcgcattacattggtatatacatcagacacaaagttttcttgtcctataccttttccatggccagtcatctcctttgaagaaggaagatactctaactcatagaaatagcttggcaggcaaaaaaatttgagtattccagccacaaaatatcgaagagggccaaatttcttttgatatttctcagaaagctccaggactgcagcaaagtaatagtgcctttttcagcttattaaattattatgcaatcctgtactgctaaactacattgcactgctgcaaatactggaacatagataaataaactacactttaatgagcagtcattgaagaaacggagacaatagcaaatttaccaatgaagcatacaagttatctcaaattttacaattaagagtacagtaagataacttgtatgtgctaattgagtgaaatgatgaaagtatatgccagatcattagcctagtaaagctgttgggaagagcaactcagcatgcatcagatcaagtgtttagtataaggataagtactcaaggcggtctaatttttggtaaaccaaaagtattttaaaaactatcgtattctaaaagtacttttgtcagctaaaaagtttaccattgtcccaatacaacttatgaagcattccaaatttcaagatttatggaaaaaatggcaatgcaagatatatgaatctgagggatttagaatgtacgcaacttttgtggccttagcccttaggatatcagtgcatacagtataaatgagaactaccataat

SEQ ID NO: 48671 - DNA, 1860 bp, Oryza sativa
ccttatattatgggacagagggagtattaaagagcaaacgtcttgtacaagaagttaccatcactgataaaaccatagtatgaaacagttgtcccaaagtgtattagcccagactggatccactcaacagacaggatgtctagggcagtaaagccaccctgttatcaaggaacagaccttatgagaaaagctataagtgatctaataattttggacaaaattaactgaaaagccttaagggtgatgttgaaattttctcttcctgtaagaagaggtcgtgaaagattcacattgtaactttgtaagcttatagcgataggcataccttcacaattagtaatgatgctgaaattggatctttaactcccaaaacagtccaaacaagtgaattgtcagatcctgctgggattattccaactggaattgatacagcctctgctctatcacttctactgagtagaccgttgaagacctgcagaactataaatgttcagctatcatatataagttttactaaatcccattaaactataatatataatcatcaaggacaaacctcatttacaattccatcaccacctacacacacgattcctacaaaacatttaatacattatcaattcaaccagttgaaatggttgccgtgttgacctacataaactacttggcaacatctgtgctgtttataccatcagggaatgcgctaaaatcaaatgtagatgcaagagatttagcgtgaccagcatgagtagttttaaccacttccatgtgaaaacctgcaagctacatcagatgatacaaaattaatagcgggaaataaatgatataaagtttatgtaggcacgcatgaataataaaaacagggtaacgggtaaaaaatcaccaagttgagaaatgtgaatgcatacaagcaataaaaataatccattagcaaatatctaagaggagaggaggtgatcgagtcagcacaattctctcttttttttaaaggacatctcgaaggaggcctataagttaactgcgattatacactttcgattaaaaggtgaaggaagtgcaattttagttggtctaaattgaaaagtaaatttgcaacttgacagcctgtgctgccaggagaaagggggttaaataatctcccttaaccttttgtcaataaattttacccagctttatgtccaactccgttgctgcattcacaattgaatcctttactgctaaagcatcagatggaagcccaggagttttgtagagctactaaaatagaaggaatgtatgatgtcccccacatgtctagattggtagggcaaacaacaaacataaattagtcatctgcaaatctaaccgtggatcattattttgatattttctaaacttaacacttcaggttggaactaaaaatccattaaagagaaacgtgatatgctcttcatgagttcttcactgttggaactaaaaatccattactgggatacaaaaaataccaaacattcctctttagttggcactaaagaatctccatggtcaaataatctatacattaaccatcaatatgtttggaggtatctagattgcccgtaaaagaactacatcagtagatttgcatcataagaaacattaagttgtaacaatattaagttctacagagtttaattcaaagttacacatcatagaacatgaaacaaccaataattcgatacagaaaagaacagaggtactattctattcctcatgacatctccttgagactaaacagcgaatggtttaaagaaaagcttcaaaaagaaagtttattgccaagaagaataatagacatatacagttagtcaagctatatgttgcttactgcagagcaataag

SEQ ID NO: 48672 - DNA, 1133 bp, Oryza sativa
ccatatttctcaaaatatacactcttacaatattgtaattttatggatttttgaaatacattttataggaaattgatggttacaattaatttcgaagattgtaccaatgtttcatatttaaatgacatattaccatgatcgggaggagtagatggatctaatttaagtcaaattgttggcttacatccataatgttaaaaaaaatgctagattgccagctatgaggttttagattgtgggggagaaaagtagttggtggaacggtagggacaaaaggtaattaaattcgagtgtgcaagttaacaaaggtttggtaaaacttgtaaagctgtactatgttaaaaggttgctctatcataaaatgtggagttgcgtattatgcatacatcgcttttagcttccaccaccttgttcttcattgtaccgagcaaaattcaacttcacaaaactaaacccagttgaaaagaattcgtcagctgaaaaaaaaaagaacatctcaagacatcaagaatctcaaaccttgataggagtacattattcatttcctccacttaacgaatacaatatgattagcttattttgttttgaatgcagaaatggaagatttttgggtaagaaacaggaaaatggctgcgtcctgacaattgattagcacttgattttctagcagagctaccctttttgtttcaataaaacaggtgcaaattaggcatgcctccaacctgctgcatgtactttgacctttgtcatcactgtctcacctcatatgattagcatcttaatcttgcttttcccatctacctctagaagagaccatcaaaatggcaaatctaacacgaatgcgacagtttcttccctatacttggaaaaggacacaaacaaaaagggcaatgataaataaattaataatacttgaaaaacacaatcacaaagtaacaagcaaacaaaaaaccacctgaccatcaaattatttctcccaatttttcatacataagaacatccaattccaccagaatttgatcaatatctcccatacatacaatttaattacatatatatatatatatatatatatatatatatatatatatatatatatatatatatatatatatattcgtattatcctactc

SEQ ID NO: 48673 - DNA, 6812 bp, Oryza sativa
cgacagaataatttgatcgtggttgatttggttcaatcttctgttttacgggaaaaaaacaaatcacaacaaaatatcaagatagcgtcaattgtagcagttctaacttccaactcaacacaagaataagatagctacttgaacttcttttccaattccaattaattctgtcattttgactaaacgaggatgatagatgaattaattcaggttagtagatgagctcttgatcggtaagttcgtttgtttttccatctcgcacatttggagaaaatattttggttcttctcgttaaaagaggagtatatgggtgtagaagagtggttgaggaagataggaatacatggaatgcttatatttatagacaaggggagtaccatatcatatgatatggtaatatgtataatgctgtcaaaactgatcagcaaacgatactcactctgttcataaatattagcattccaaatgtttaaattttgtaaataaatataggcattatagatggttgcctttgccatcaatcacctccactacccttctgctcccatctgtttcttgattaactattccactcttatttgtttcttgattaactagtaacatactcctacattgtaatgggtcatgcttatataattaaagatcggttgggagaatgattgagaataaaacattggatctggtggttacttttcacatacaaacgcgttgcgtgcagtgggaaaataagatgaaatgaggataactctgcttttaagataatagagatcaaggatgttaaaatctttacttcccattcttaataacaaatgtttatatttgtgggtggtgggactatatttttcgctctatatttttctgtgtgatgccagtgcaaacgttggccttcttcacgttccattcaccgcctgtgcatctggctcgacaagacgatgatgcacgcagcagaagagatggatgaccctggtcaaaaagcaacgcacgattagccgctggtaagtacattacggcgactagtacaccaacggtcaagcggccctctcctctatgttgcatcctctacttattcatccatcctaaaatataacttagaactagaactaggatatatcactacgaagttggttagacggatatatctaatccgattctaagttattatattttagaatagagataatatttcatagagattagcgagtaagcaacggagtcaatgcctcacaagccacaacacggcaaaatattgttgttgccgaggagatgctgagtatggttcgtgtaaaaactttgttcgatttgtaatttgtggattatatatactgaaatgaaaaaaaaaatctcaacttgagatttttctttgatacttttcaaccaaaagaattttcttacaagcagtggcggatctaggaagagatagtaggggggtctgaataaacttgataaagcttacagccccccctcccatctacaaatagcagaaaattttagcggggtttttgtggggctcccaaagttggctcgagaccccaccgcccctatgtcggatccgcccctgcttgcaagcgcatttcagatgaaatttgtgacattctagtttgagattgcctattgttccactaaaaccattgtgagataatgtgtcatacccaagactcctttgaaatatagaaattttacatgattttcacatggaacaattcgatttctccaaaattaatgtgaaattcctacgtttcaaagaaggccaagattcaaaatgatggaaatatttcacggagctgcaaataggagtaatagccacatattccctccaaaaaaaattaatttctactatccccgtcctaaaatataatcatttttagcatagtgccaaattaaatatttctaactttgactattaatagcaaaataataaaaaagattaatcatgtaaaattgatattactaaatttatcattaaacaaactatcacaatatgcagctctttttatttaaaacattttatttttatagatatcgttggtcaaagtagcatattaaatatcatgtcgagatccaaaagtgcttatattttaggacggaggcagtagttacaaacctgaacatggaattgaatttttacggagggtgtacactgtttccagccaaaatgccaagtactccttcaccgacatacttaccgtataccccctccgtttgtctagtatttgcatgtggacccgtcccctagcctcctaccgttgtttatttctcttccttccttccacaagtgtactatactcctacatagccccagaatcagagcaggcaggacaggggccttcttttgacttttctggctatcatattcacatgccatcatcagaacccatgtactccagtagagctaaacagaatgctaaaagccctttaaatggttatcaagagggcttaagtactgttgtgtaggggctagccttgctagtactaagatctacttcctccgtccaaaaaaaacacaaaccctgagtttccatgtccaactttaactatccattttatatgaaatttttttataatttgtatttttattgttgttagatgacaaaacatgattaatattttatgcgtgacttgtctttttatttttttcataatttttaaataaaacggacggccaaacattaggcatgaaaaccagggtttgtctttttttttagttttttttttgagactgagggagtactagatagagagagagagagagaggaggtaaatgtaatggtaggagaggtggtagtagtagtaggagtattttcaaggcaatgaatgagccaacaaccccattcaaaagaggggccagctctctgccaggctaggagggacttggccctggggcccaaatcattaccagctggggccccaccccacagatctgaccaccacaaaagagagaaaaatagccataaataaggaaaaagaatcttgagagaggatgagagagagagagagaggaggcacaaagaggaaaaggtcttgtttctctcactcccaagcacattgggagatgtgacagacaagtgtcactcccagctaccaccacactcccagaaccaaatctagttccaaaaatgaaaaaaaaacagatgctggttataactgataacacaacacaatcagcagctgtgctactaatgctcaccccaggtgcagagattggcatcaccatcatcattatcatcatcatcacaaccacaaaggagagcaaggcaaaaaattccaaaagaggaagataaaaagaatgttggattgttttattcatggaaatggtagcattatgtatcagcaccacaaaccagcagcagaagcagcaaaatgacaccaatctttcttttaacaccaacccctaaacccatcctgcaccaattaacaagctctcttgattcgctaaaatgacagctagcctctcctgtactaacctcctccaacctccaaaatttttttgataccaccatttctccagggaagcaatccttcaattggatttctgatgtttttgctatatggtatttacatgtaatgaaaatctcaaccatcatccctctctaactccctctccccctccctcctctcctctatgataatatgctactaatctaaacaacattacaaacttgcccttcttgagaaggagggttggctggttctattggactataaggtaaagcaaaatgtatcaaatacaagaggtgaaagagcccagaaggtgaaagaattgaatggggtcggcatatgaacggtaaaaaaggagtaacaacagatggggaatggaatggggggcaaggggggaaaattggggaggctcttccacatataccaattttagctcattatgctcatgctcgtcagggaaattattgtgcagctgatgaaatgaggtgggactggtggaggctgacaacatcatctcaagttttgacagtaaaaggctataggggggaaaggggagcactatgcatcaatgaaatcgggaaatcggggttttcggtaccagctgcttctcaagaactagatacggcatagtgccttactgagtagcgcagaacatgcaagcttgggcagatcatttccttcaccttcaccccatctttgtatatcttgaatgttgggactatccgcacgttctccgccttcgcgaccatagggctatcttcaacatttacctgttgttttgcacacacaatgcagatttgttagtgtcatttataagcacttgttggatgtatttgattggagacatgtcaagtgtctcacctttaggaaattcagcgaggggcattcgctgcaaagggagttcaccgaaggtgtaattagtgtgcactgctgattcatgattgacatgaagtaaacaacagacacccctgaagatatagcaaattgttcaatagtcagtcaattgcaaaataggcaagtctggtatgataaacctagtaaaacacatgtttcaagaatataaagaaggcagtatttcggattgttcaggatgctaccagagcagcaccaatgagttaatttcagggtatgagatcaagggaaaaaaaagaactagtagagaataacacacctggtgatcctatggcagcacggagttgttctacactggttaccatctcaacctctcctccaaatttcatattcgatacatcctcaccacgagttgtcttcaatgcaacttgagcatggaacagtgcttctgcaacctctgtatcagcaggaagctctttatgaagcacctcatagtcccgcacacaatcagcccaacgctcgagctaaataatagttaacaaggtcaacataatgtacatagagtggaaacaatatccaattactcaattccactatcaaaaataaacatttaatgcatatgattgctgcttaccttggcataggatgaagctcgccttaaaagcgcctttgtgtaattaggttgtattcttaatgcttcgttacagtcatcaacagccttttcccaccgctctagcttcccccagcatgctgctcgattgcaatagagcactggatttgagggctcatatttgagcccttcactatatgctatagatgcatcagaaaacttggcagctttatagagctcatttccttgggctcgagcctttgcaactaatttgacattatttagaatcattccaacttccgcatttccaggatcaataaatctagcattatcagctgcctccacagcagcatcaaacctgtagaatacagaataacaaattcatgctaatctattttaaccgcaatgtggaaaattgagcattattctagggttagagaatcacaccttcccaatgccatgtcgacttgggctcggacaatagagacatatgactcagctagcatgcctgacgggttggctcccatccgatacagcaacacgctgtccaatttcagcaaacttgcaagagtcgagtcagcctcctccaacttgtggagacggagaagtgcttctgaccttatcgcaagaagctgcacagaagagcaaactcagtgtgaattgctacaaaccaacaattccttgcaaccttatgcttgacattaccagccgagaggagtcagctccagcagcaatggcagcatcagcttccctcagcgcgctcttccaatccccgactttcctggcatctatgcttcttccctgatgcatctccacctcctgcagcttctcccactccgaaggatcagattgatggagatgcccagcctgcgttaagtgcctcctcgccttgctaatcatccccaacctgagacaatgcaaggtccaatcggtttaatctacaattctagcaaaaattacatcacaccggttgttccaactgtaaaatcagacatcttgcgagtcagaacaaaactaggacaaaattttcagctttgtgtggcctacatccaatgcacctaaagaaagcttacaaaatacagctaagcaaacgctcccctttcatcagcaatgtgtgatggggaaccactttaacagcacatttacttcatggccaacacaagcttgtagctttcgacaaccacaaatcaaaccaatcaattgttgcgtaagcaaaaagatggaattcttaatcatcctatcatcaagcgtaaaaaaaataaaaaagaaattaaccaacagtgacgatcaagcatgccgcacaaagcagcagcaatcctaaatcgaaatcagattagcttaaggaaaaaggaaagacgctagatttatgttgctctcgctcgcgggaaaaaagagcttagcatccacatccaagaaagcaacagcaccatgcacgaagaagtcggaggaaatcggaagcaagaaagaagcaatgcgggaggaggaggagagctcaccggaggcagaggccggcgaggcggctgtgggcgcggccgttggccggatcgaggcggactgcctcctcgcagtcgcggagcgcgtcggcgaggcggccgaggccggcgagcgcggcggcgcggttcccgcggcacgcggcgctctcggggcagagggccacggcgcggtcgtagtgccgcagcgcctcggcgtgcttgcccttcttgtaccactcgttgcccaggcgggtcacatcctggaggctcccgctgctcgccgacgacgccgccgggaaggtcgccggagatctcggagcgtgtccaagaaacgacgaggagtcaatgctgctcctcgcgggggccatgccgccgccgccgcgcatgatgctcccgtggccgtagttgccggtgccggatccgagcacgtccgggcgggagcg

SEQ ID NO: 48674 - DNA, 17934 bp, Oryza sativa
cttggggaggggctaccctggaattatggaagaaatccagggggcagagtgcaaaatatgttgtgtggttatttgggtcatctctggtgtgggttttgtggtttttggtctctagtgtcattggagtttagggtttttctggtttccttcttccgtttttgggtttttaggtgctggagtttcaattgttcttgttatgtaaaaacttttaagctgggtttgagtggctcctagtagtttttttttctttatagttgtttacttagatgaaagggtatagttgtttgtttggaaaaaaagggttagtttcatgttgttttcgtaacgtcggcgtttttattttatcgtgagtaatggattttctcaggtaagtataagccacgtcattattcgagcatctttacagctatgttcaaccataattattaattagcgttgtttttattgaaaaatcacatgtggcaactagtgttctactgatgtcaaagtcggtcgtgcagaaatcgacaagcgtaggcacttaaaaagtcatggtcaatgatgttctggtcttgttttgtagtcgtgttgttggttgatatagtgataagctttaaacacgtatgcatatatcttttattacatatgtcctaaatttttctatcccttattatcatcacgatgtctatatgagtcagcaagcaaaatacgtgtaaagagattatctttttacatatacgctcattaacattatcgtgtgatctgaaattttccatccttaattaatatcacaatgtccgcggggatataaaagtttgatcacatcaaagaagctttgaaaattacgtattagataatatggcaataagctttctacaagcgtgcatatctctagttacattgattccttaatcttccataaccttttaggtaacaccatgacgtttaaaaaaaaaacatatttcatcaacacaaaggtttcttatacaatttctgaaatggagtggcaatcttccagttacgcccacgtttagattttacgtccgcacgtattagggtctttttaacatagtgccagctatatttttacttttcttgagctatagttcagccaacagtttatgctcttctcaaaaagagagtggagatggctgaaactctcacaaaatgaatttgaaatgtagtgttgtgtttagaacgctccacaattttacttgagactcaactttaataagagatatctaagttatatgggatacataaatttcataatatggtaacaaatacatagttcaatgataacgaagaaaaaaccaatcatgtttttcatctgttttcactgttcttatgcaggaaacaaatgtaaatatgcatttatgaaatcttcaaaaacggatgcatattgcattttccgaggccatcaaaattcatgagagaaagagagagagggaagcatggagctcggtcccgaagctttccagccttctctctcacactgcatacgcaagcataccctaaaaaccagagaatctgcttcccaaaaacagagagagaagggatgagaagagacagcacaccatagatttccagtggacgccaaaatgaccgttctgcccccacaacaaacactgtgcttttcgctttcatgttcttgccaaccacgcacaccggaacacattccttcctaaccgcttcctgtgtctcaatgttatccttgtataaaactaaataaaaagctatgcactatgtcatcatatgtaaataaatttctaagttctggtgagaaacatcaacacaacattcctcattataactgtatcactatacaaaacaaaaaaaaaattggtcttcgcatgtaattcagtctaaaattattattattttcttcagcaagctttttggctcctttgaaacaaagtcatgaaatattatagaaaatttgcatatatagttctttggattaaaggaatagttaaaaaaatcatacgaaattcctttgtgttgggtcaaaacaggaatatttaaccatttgccacatttagatgtggcaattaactttttgccactggacccatatgtcattaagataggggtgacaaatatttatttaccaaatttaaaagtgacaaatagttaaaacccctgtcaaaacatagtgatcttggaagaattttattcatggaaaaaaaattgtctgtgtttatctttcctctaattgctacgcttccctgcattccatcgaaacagttatttctatctttttagggggggttttaatcaataggacactctaaaccatgtattttccatgttttatgatgaactctttccatcacaaaataattatttttctagagttcaaaaattgtctcaaaatagttcatatcatcctatctatttgtcccatcaatcatctcctattctagcttctctccattttatccccactactcacctacttacatttcaataagagatattgcagtattttctttttaaactttaatttatactaaacagtatagaatgatcagtattataggatgggagggagtgagaatattgtagtgtaaacgagccctcaatcctaagggcatgttagatctcaggagttgtttagatttcaacttttttcctttaaacttttaactttttcatcacatcgaactttcatacatacacaaattttcaactttttcatcacatcgttctaatttcttcaaactttcaattttggcgtggaactaaacacacctcaccctaaaattttacaccatatcacgtcaaacgtttaacacctacatgaagtattaaatataggctaaaaaataactaattacgcagattgcgactaatttgtgaaacgaatcttttaagcctaattgctctatgttttgaaaatttggtgctaaagtaaacatgtgctaatgacgggttaattaagcttaataaattcgtctttactgacggattctataattagtttttttattagtgctgaatattccatgcaacactctatataatatcacatgtgacacgccaaaactttgcactcctgtaccaacaccaccaaaaacaccccctaagttgatgttgtaaaatttacctacccgctaccaacaaaccatacatgcaaccaagaaaacacggaaaaaggagagcgaagggcagtatggtaaattgacgttccccacgggacagggtcagcaagacatgcgtggcgcgtccggggagaacacccgcactgccagctaagcacgtccacctcatgtgggcagtgggccccactcagggtaggctcgggtcgtcaccttcacgtcggccgtggagtggagatcccgacggaatattccctccgcatccacgtggcaagccctgccccctgactaagcggcctccgtggatttaatcgaccacatttcaacttttcaactttcactctgtagaactgaaaagattaatagagcagagtacatttcagagtattgagagattagcctcttggcttactaaaaagataattaacgtacgattaatgttaaaacttctataatacaaacttaaatattgcatttacttgctaaaaaagcacttctatacataaagctcttttaaaaattgcaccgtttaacggcttgcaagcatgcacgtcataatatagtagctagttctctgtaatctactagtatttgtgttagggtaaatataaaattttggagtaattttatgagtattaaacttatttctacgaaaatcatgtattatttgtgttgctaaatgtgtccttttggccgtatgttcacaagtgatctccattactttagtgttttaatggagataaggtttggatggcataacacaatattccactatgaaagtgagccataggtaggattaagtactgtttaagtgcccaagccaaacgttaacaccatcaccaacaaaataattaggtaggtgaaccgctgctttccgtttaggattaagagcaacacgacgcagattgaattataaacagcagcgtttatattaccggtgtaatgcccatgttggcccctagcatttaccttaatctcaatactgccacctctactaaccacaaccccatcttttgtcttattcgagtttgcaaacgaaaaataatttataaatataacttttacatacgtcttcataatgatctaaaagcaaaagctgataaataaattacgatgaaaaaaaaatcaaaatcaactctaaatttaaggttaaaaatttaaaatttaactgataaaatataaacataaatataagggaaaagatgagtccgtacatctcatttttaacattttgaccggcaactctcgcaactgtgcatgccatcatacgtggcgttttgatcatgccctcgtgccagctggacgcgatctcctgtagcgtccacagcggccgccaagtacacggcctacccgttctgggaaaaaagcccaaaactttaccattattagtttattattaccggtttgttacacactgcatgcgaagccaccggaaattttatgcgagaaggggaaaatttgcacggcaattagctgtaatccggctgggaatttccggctaagcaagtacttaatgtgtccgatcatatcatatcgccagctatgttcggtgcaattagtggcttaagtccgagagaagtttttatgtgcgtgcttaatttgttggagagggtactggatgggcacagcagaactcaacccggtgcaattcacctgcaaaatggtgaggtttttggagatggagaggtgcggtttaaattgtaaattgtgcccgtcggattttattccttaattatgttacgtccatcatacaaaagtagttgtaagcatatgggattctaaagattatgacaataacaaaaacactgacggaaggaacataaatgatatagatggtttgacgtatataacgacaattttcatttcatatctatatcatttatggtcatgcagtcatgccctcatataacatgtggtgattcctttagcaaaactttcaatatttgagtttcgatcattttctattaagtaacctagataaacgaaaaccatatttgtatattaccattggaaatactttcaggatgacacagttaaatagctcatgctgtgatcctattttaaaaaaaaagttatcatggttatatcttaaaaccccgcgtcatctatttggcatttgtcatgctaaagttttacgatatttgtgctgacttaaattcaccctccactaaaaattaattggtgatgaattgcaacactgaaaatcattccatccctacctaagcttggacttcatgtctacccttccaatgcttccgtagttccattccttaagttttctatgatgatgataaagctagcttccattctactactgccaccaccacgtaccattgcatacgcacacatattgaaaccagcgaagctaaccctcatggatggtggtttacaatcccatcatttagcctttagttcatatgcataagcggaaatttaaaattttaattttaatcccagagttacttttgggtgtttcgtattgtacattctagcgttaaaaaaaacgcgttaaatagttttatttataaatcaattttattgctaataaacagtttcactataagcataagagggacaataattatattattctcttctctcatgagggggtttgatctgttcaaaaaggacaccacagtgcaaaacaaagccggaccacgctatgtgcttgggctacatatatagtcctttccttgccacgcacatatataggggagactggtcgccactgaccaacaactattggatcctaattaaaaagcctctccatggccggtaacacacagtggcggcgtgcatggtatcgtgcaagtcagagctaaaaagctggagtattgtgttgttgccagccaagtcggatgatgatggagacaccaaggccaggtcgtcgtgcacacatggaaaaaggagcgaagaatattgattttgggctttgtttacacgccgtgccggtattattttctttcgttatctgagatacgacgtgtaccatatactatcttttttttctcctgaaaaagggtgtaccaggtttgttctaactttcttcgattatctactacgcaatagcaattaatacgaaaatattgacttctataacttttttttttattggcgataagttgggatgaaaaaaaaatcagttctagcctgatgattgaggatgagaccaatgtcggagaaataggagtgataacattgtcggattaggataaaaccagtttttagttacataaataatactatatgtaatatttgatctatttgggtggaaataagaggtgaggtgcaaccaacctactcttctctcccagctgtacttgtaaaactcctggtgcatcttgtttggagctctataaaggatagggtcttgtttagttacaaattttttctttaaactttcaacttttccatcacatcaaaatttttatacatacgtaaacttccaacttttttatcacatcgttccaattttaactaaacttctaattttagcgtgaactaaatacaccccacgttacacacatggagagcggttttaatgaagaggagaaatgggaaggcaagaaagaagaatactagaattcaaggaggtcacattggccatgtcatgtgcctggaggccgtagacgagtcgtagtagattctctcctctcttctctctgtgtatgtgtgtgcgtgtttgtctttctgggctctggattgcagtcttgcagaggaagcgaggccatgatctgagcacggaaaacgctttggctgcacacaaaggctgcccctttttagctgttctgttcactggcctgcaggccatgacacaagcctcggctccagcacccacttcttccagggaggcacaagccctgaagcaccgtatgtatctcattggatgccttcgtctcttctgatattctcttctccggggtgtatgaactatgaagaatgtgggcactcaacgtgccaaaagcttgaccagatgtttatgttcgtcttgaattattataggttggccatgtctcgaccgggcagtgtgcgttatttatacttgcatgattacatttacatcaaagataacatggcttgtctgttaaattagactttggaaatgtcatgtgttcaaggtatcaataatgtaccgtgcatatcaccgtgtcgatatgtcgcagctcagctccatgaaactctgggcgtcagacgtgcatggagctactatagccacaggccacagctttctattctcctttaattaattaggaataccagatactgagtgtgtcggacagggaacagagcagaggaccgatgcgaaactcctgaaggcatcccggcgatgtgatgcaacaaggacctaggccaggagataaaaacggtatattttcgaaaacaatgctccgtcgatcaataattaaccagatttatcaattaaactatttagtattgatatcaatatgataagatattatctaaaaaatcaatatgataagatagaaattagaaaacctctcttacgttatgtggtaaaaaatatcggtcagaaatgatacgctcggtcagtagttgcaatttgcaaattgctgtgatcctatactcttcagtaattagtagtactactcgtacagtactccagtatatacacactcgtttattcccgatgcacacaggcgtttcttccggtatatgtttcgcggggccaactactctgccacacaacgctggctcaacaacccccccacggtaaacgaccgacctcgagtcacgtacggttagcgccataccggatgccaccccccaccccctccaccgcgcgctcatacgcggcgtggcggcggcggtgccgaacgctgaccccgaccccccgaccgacgacgacgagaacgcacacgcacacacgcacgcgcggcagcttgctaggctagcccgcctctcggccgcggcccgcgcgcgcgcgcatcatggcggactggatgcggtgatactgggatggcgcgtcgctgcatgccgtcgtcgatcgtcactactcccgcgtgcccgtgcccgtgcgcgcccacccacctctccagcgaggtggagcgagctgcgctacacgcggtacgcgcgctagctgcagctgctgcatgcatggcggctgggtggctgcctttggctggccgcgggtacgtacgtatagcgaccggaccgatcgacatatatgcggggtgatgggcggccgcgaccgcgcgcccatcacatgcacgctgcgtgtgcgtcggtacgtacgtacgcgcgcgccgggtactcgaaaggctgcgtgatggatggggtgtggcgcgcgcgggaggacgggacgggcgccgcacaacgtaattgcccatcggctcagctgcgtgcgtgcgtgcgttcgtgacgttttgcaccggcacgcgataggcgcgcatgcagccaccgaccttcacggggccgggagacccacatcggcgtttcttctcgacaaacagctcttccagtcttcttcttcttgtttttttgaatggtttagcgaggtttcagatgaacacaattaattatgtatacattgcacgagtaacttttcatctatgttatacacatagttattttcagcagaataaagaaattaatatttaaagactccatccgtttaatattgtaagttgtttttttttcaaagtcaaacttttttttaactttaacaaagtttatagaaaagaaatagcaacatctataatattgaatcaatgccattgaattcaatattgatatatcttgaaaatgttgctattttttctatgaacccaaccagaagtttgactttaaagaaaatcaaaacgcttatgatatgaaacagagtactatataatacttcatccatcccataatataaggcgcggttaaagttggtacggtctccaaaactaatctctagcttataatttctcataaactataaggtctgtagcaacaaaattataactatatgaaagtaaatttatatctcaatccaatgatataatttttaacaaataaaatctatttcatattatattaagtattggtcaaatcttttataggttgaatcttgaaaacacttgtacgccttatattataggacggagggagtatatgctaatttatttcttttaaaatagtggtagtattactctgaacctttatatgacctgtgtacaaactaaaatgtacactatcatattcttggataagaagattcgaattctaatatgttcccacgacttcaccatcacagaccatactaatgatgcttttccatgcatgccaatcgattcgatcataaaacggtggtgtgtaacaagaaaaagggggtgggtgattaagcgttcaagactgctaaaagcctaagatgctttctgtgcacgatgtgtacgatgattttgcctaccgccaatgattaatcaggcgattaacaacaaacttttccacacaccaccggtacatatttctctcttgcacatgacaggcgaaaaaaaaaaggaaagaaaagtcagcacaagagaacacgacaagtgtctcaacctaaactcatcgatacgataaagcacacgagagccattaatacgtagctgctttaatttcgtggagtattccttactacacatgaaccctactcctgttaagtacgtacgacgaaaccactaacaatttaattaagcaaatgcctcgctggtttccagccatctctgtgtgctgatacccaaactgcccaagttttgaaccacctttttccagacacaagctttaacaactaagagcacccgcaatggtaaagtagggtgctctctataaaacatgtacatctcagcaatagactagattaatagtaaaccacctcaatagtatgtctacataggtatctatagctctctcatgcattgcctcgtttttctctatagactatctctaagctagtagatagctttgctctctctcttcatttaatatcttccaagtaggaaaatatgctgacatggatctcttgtagatagcttatagataaccattgtgggtgccctaattaaggggagtacttaattacgagtactactcaaaagctggcaaaggtagtacgtaccacgtattagctaattctttctttccctaaaccagcgaatagtcttacactccctctgtacatcatacattctctttcctgaacgtgcaggtaattaaaagagaatagaaattactgttgcagtcttagttatgttctcctatttagaacagtaataatgtactagtattattgttatgtggctttttggaacgtgcgtataaactttcccagtgattaatccaaaattgatctctctaatgaaattaaaggtacttgtatcaatctatctatctatctatctatctatctatctattatcttctattatatactaaaagttcattaatcttcctacaaacactcttaaggagccacgtggcttcctaaaaacgctctcaagccgccacgtggcactctaataataaattagagaaaatcctacaaattctgagaaaaaaaacaaaacatctagcacttaattttcacttaaattggtgggacataatatttcaggccattagattaaatctattaaaatcattccttctaatatagatacgatgcatggagaggaaggtacgatgtactattcgtaaacagaaaaaaaaatcatatgcgatgcatatggaaggagaggaatgtacgtatgtactacctaaaaaaacaaaaaaaaaattacatgatatacgtttatatgaacgtaatgtaagatcgtatgatcggaaattaaaaagcataaagcgaaaaaaccaaatatatataaaagtccactaaactttctacaaatgcttttaagctgtcacgtgactcctacaaacgctactaagccatcacgtggcgctctaataaattagagaaatctaaaactttttgagaaaaaaaggaaaacatcatatcattgattttcacttaacatggtggacccatcattttatctcctattatctcacctgctcacttctttatccaaattttctagatagcagctcagtacataaacaataagaaatactatattaactatctattatatagtaaaaatcaaataaactccgtacaaacgctttcaaccaatgaaaaaaaaaaccaatgaaagtttgttgatatttcttcacgaaagagatatataaagaacactcaattcaaaattgaaaatacgttactttaattttaatttttttgttagaactattttcgaaacaaactaatgcgcggattatcttcctggttgtcatgaaaagacaacctttgctatcatgattatgttctcatatttagagtgtgaacaatgtattgttgtctctgattaacttaactagcaggtccattaagattataacgatacgacggtgcccaatgttaaagcaatgtaatgtacttgtaatgtacttagcacatttttaaacagtcaagggaatacagtaggtgctgccagtagctagcccagtcagtatacaatgcgactatctaatctaaaatccagtgatttgatttataataatcacatgagtacgtagtacatatggttgtcgcatccatggacgtgtacgtgttttgtttagaggagacagattatctccaagcccccatggccctcctgctttcggtttggtcggttgttgcagtaattaaacatgagcacgccttaatcctcaattagcaagccgtattaagctaattaacaagctcctctctctaattaatcttaattcttctctcatgagacaaatcttccaaagcgtccatctgatgatttgattaatccgagcctacacaaggctgggcatgcaagataggtgcatggaatattacaggcaggcaggatcagaaattcagaagtactacacatgtgcagtccagctgacactggctcttataatctcctcccttcacattaatcaaatcactcacaaggtgcatgcatggattgttcattagttggttagtagttaattagggcactcgttgatggagattagaggtgaagttatgtgagtggatggatctgggccgtccgttgctcctcgagatcggtgttgagagccattgatcggatgatgcatgcatgtactgctgctgtagtggtgtgtccagtgcaggagaatcatgtgtgtgtgggtgtgcggttcttgtcttgtccctgagtttaaattagggctgcagattaggtgctgaactcatgatgtttacaataatcaagctcctctcagacagatgaaatgtactataattaagaaggaaaaacaaatgcttcacaccagcccatgcatggtccctaacagttactgtttctgctcttttaaagaaaactgcacgaatcgtaaagcaaattacatgtcttgctaatactccgtgataaggaattttttatgttcaaaacatgatttctttgaaatttaaattttgacattacaataatttataaaatgtaataatttttatgatatcatgacaattcttttaagcaaatctactaatactatttcttgtttttaaagtaagcatttcagatgttattggtgatcaaagtttcaaagtttgatcaaatcttatcataaatgctatatatttataacttgagggagcagtttcattttggcttgtatcagagtagtcactacagctctcttggtgaatggtgatttcaagtgcctatagcagctcacatggaagatgaagtcattgtacgtgttctcttagccaattaattaagctgtctctgatctgtgagcatttgaaaagcacccgagttaattaaccaaaagatcagttctagttgggcatatggtatgaatgccagcaatatagtactcctagtgtgcctgtgtgtgtgggcaatgcaagccaccatgtttgcaagatttgcaaggttttaaacaaatggatttgatccaacaagaggccatgtgcatcctgtcagcaaagagaggggataactgcaccctcattctgtgcacttaccagaactgagacctccatagattccactgcactgtgcatgctgtgctcacaaaacacaaaaggaaacacaaaataattagttatctaacaaatcgtcctggcacaagaaacagagtttgcaggccagccattggctctggctgctgcttaatcagtgagaaaaagcaagtgattacagagatggatggccttgatcagttgtgtgcttgggatgacagtatctcctctctttggtggcttttggcttgcacaatggtaataaggttcagagcttttcatgtgggaggttcagtgtatgcagctgatgaagaagctcttcttttgtgcagagcatatttatagtttacctgtggcctgtctgtctgtcctccatggaaagataaagcgtcaccttaatcattgcatcccattattattattgcacactacagattcttgtgtgtgtatatatatatatatatatatatgtgtgtgtgtgtgtgctgtgtgagaggatttgaagccattgcagttcttgaccttggcagagtggacgttcagaaaactattgaattcaaggtcagatagatagatagcacaaaaggtgaatcaattggagcatggcaacagcaagcatactaaaagggagcaggtctgcttgacccagattgaggccatggcaaaatctatccaatgccaataaaagttgtcatgcaatgcaatgcaagggatgtttatggccatggtggtggtggtggtggtggtggtggttgttgttgcagcagaagcaagcagcagcccagcatgtgagctgagtggccaaggcataaatgttgatgagaggagaagatgtgtgagaaagagagccaatattgccaagggggttaccctacccctcttgtgaacccctaaactaaagagttgagaaaagtagatggggttgcacattgcacacctgtcctacttaatgcagatcaccatccacctgtgagtgtgtgtgtaatgcatcaatccacgtttgtttatcatttcatcctctctgatgatcagatgattcttcactcagtcacatctatgctttggggtcacaggttaatcaacggatgatggcacaccacacactacctagctaccactcctacttggtactcccattggatcaaatcaccgccacattgtttcatcttttcctcctctgatttgatctgcacttccaactcaaacctaactgagtttgtacttggtgaaccctctgatgagcctgcaaccaccactacaccccatgcctactgcctgctggactcagatgtcacatggcacaaaaaccatagaattgaactgaattattaacctcacatgtttcccttttcacacacttgtcaattgtgagctttgtatgtatgttcaaacatgagtaaataacatggttgtgctgaagatgaagctagggggtcaaatgttgcattgtgtctcaagatcccaaaacaagaattgttatagttatcctttatggcagtaagtactactagtaagtactagtaactaagcttagatttggtctgaagagatgtgccaaggaccaacaaggagagggagtaaagcatccaatggaacagttaaattggatgctattggctcacttaacacccccacaattaaatcttggcatgtgcagtaaaaattgtttgaccgtactgctgtttgtggcaatggtaacttggcaggataggagaagataaaaaggagattagactggatagatcttgcttaggactagtagtagtactggctagtccaggaagagtgattggtctatgttagatcgggattcagtagttattgattgggaattatatattgtcctcatggaccaagccagccagagtaatattttttttccttcctttttttgttcagagtccttgccctaggatatggttggtttgtagtaggatgcaagcaatgtaggtcagttcaaatttaagaaaatggatgaggctatctctttaggtgtcctttgggtgtcagatttcctgaagtttttgcgggaatttaaataattcatctgaaaattctgtaaaatttaactactccgtagtgtccaatccccaagcagtcaagcaacagcttactgtatttatttgtggatatttatgtatttgattatgtaaccttctttttgctaatcctaagtagtattaaccaattacaaaccttctgaaatagaatatttgattacttggattgtgtataaagaaatattatgttgaatcctttaattgcagaccttgtgtttgtgaagtcaagtatttttaagaagtccagtgtcatgaaaagaagttcagatcacactgttctggttcaattttgttctatgttgagggcttcttctttctttgtggtgttatgagatgcaggcaagcaaagctttaatgctgtcagagtgaaaactgaaactactaaagcatagtaggaacaaaaggattataacaagcataagatgacacagcattaggtgaggccagggtacataattttcattgtaccatgatccaaattcatagtgcttttattgtctcctctccttcgatctgaagccttgtaagtacacaattatatgcacagggagatagaaaacatacatgcatgttgcattagtccgcagacagctacaattacttcacttccctgacccaatctaaccatccttgcattgacaccccccgttgtgcaggtgcagcatctatttgctcttgatgatagttgccactaaactgtactataatgtgctcagggcaaagaaaaagaaaaaaaggctgcagccttttcattaaaaagacacaccccaattgcaaccttttcaggtagctagagagcatctcacagatccatgatggcaagcaaaatatggctttctgcataggttgttctcctgtggtttttgaggcagaaaaaaaaaagagagaaggagagatgcatccatccaatccacatgagccccaaccaccaagagttaaaggctttgctcatggcaactactgccttgatctcttctccttgacatgtactaccatgtaatggggtttgtgacaaagttgggagtagcctcaaaccagtcacaggcaccctgggttggctgggttctcaacatctgattgaaggtggtcacacagcagaaccgggcctgacaagtccttttcccttctaccatatgcatcctctttgtactctcaagactgtccccaagaaatattctcttcatcttgagattttatcccccactttaagccctcaacaaggtagttcccgttttttatatttctagaatttttttaaagaaagttttgttgataatttatagtatttgttacaaaattcaagtgctacattattttggaacatttacaagggcgtattggcattttctatttgattagctaagttagccgaggctaatgaccaaattaatttcagttagtaagaataatcgacgaatttctgaacgaaatattcattatcgattatttcggtatcagttagttcggttaggtttttcggtttcggccatttttctcatgcatagttggattggatggtgaattagtgagtgttgtttttctttttctttgagccgatggtgactggtgagtgagtggtgttggcaacagcagaggcatttgcctgcctcaaaccagagatgccaacgttttgcagcggaagggaacaaaaaagcccacgaaaagcccatgtgtactcgtctcgccaaaagcccacagagtggggcctacttgcaaaatcgttccttttatgccctctctacctggctccgtgcttcaaacaaaagcaggtaatagctctgaattattcatgtgcggcaattgagaaataaatgtatactgtaccggtgcattggacatggttagctgatctctccgtaccaagcgtaataaaaacacacaagcacttccctgcatctataatttgacctaccacacaatttgttacacttagcatccatgcaattctctttttgtccgactcttaacaaaaaagataaacactacgcgagatgttatgttacttgtgtggttctagtggctaacaaaaggtaatcacatatgacaaaaagatcgatgagctagagttcaccatatcgaacaggtgtaattaatcttctcccccgcgcgctaacacgtacgggtgaaaaagaggaggccgggtaagtagctatagacagcagacacaggtgagtcccacatgttccgtagccgccgcacaatatctggcctcctacctctgcctccgcctccatacgcacggccgccgcgcgcacaggggattttcgcggatcgcgcgcggcgcgtagcggcgtgcgtgttagcgtacgtaggtgaggccgtgagagagtgagctgtgagcggccgcgcgacgcgacgctttggcgcgcgcgggcgcggcggcggacgtacgtgcgacgtcgcgtacgtcgtcgtgactcacacagaccaccatgcgcgcgcgcgcgcgcgcggggcttcgctcgacgaccagccggggccggtcggcaggcggcggagacccccaccgtgcgcgtgagctggctgcacacgccgtttatgcatggtgttttatagtatttggttggagagatgtgatagatcggattggaatgaatctatcttttgaaagtttggtttcggaatatggttagaatggcattatttttgaaaataaatgttatctctagatctgagtcaattccataaaaaaaattaaacgactaatccaactcacctcctttatctcactgatatatgggctacacataattct

SEQ ID NO: 48675 - DNA, 1674 bp, Oryza sativa
tctctgccgtcgttgatcgtctgctcgatcgctacttcatcatgtacacatccaacattacgtgcatatacacacatggtaataaatcctcggatcagattttgccatggatgaatttaatctgtccccctcagcaaatcaataccgtagcatagtatgcagtgatcactatctcaaaacgatatagagggatcactatgctgcgttcgttcgtgagatagggtgagaaaacacctcgttttccttgcgcacgctttctaaactactaaaacggtgtgtgttttacaaaaaattttctataggaaagttgttttaaaaaatcatattaatttttttaaaaatttaaaatagttaatactcaattaattatatgctaatgacttatattattttgcgtatctttccaatcttcctcattagatagattatgcatgacgcggcgtgagggagctatagctcgtggtccagatgttgggagccagcctgctgttattacggtcatacgacgccaccactatgtgtccaaaatctataggccggcgcgccttcccaggtaggtacgttcgcgtacgtacgcgatttactcactcacgtactgcgcgcagcagtgtgcatactgcgtacctctcgatcgatcgatcgatcgatacatcggtcggaccacacaaatatgtacagcatccgggaatgattaaagactagtagtaggctaaggctgtctttagatctttccaaaagttttgacgtatcccatcggatatacggacaaacatttgaagtattaaatatagactaataacaaaacaaattacagattccacctataaattgcaagacgaatttattaagcctaattaatccgtcattagtaaagttttactatagcacaacactgtcagatcatgcagcaattagacgttaaagattcgtctcgcatttacacacaatctgtgtaattagttttttttcctatatttaatatttcatgcatgtgtccaaacattagatgcgacagggtgaaaaatattgccaggggatctaaacatgccctaaatcagttttactttatccgtcccatgaaagacgaacctaataccaaatacaacatatctcagtactatcaatctgaacagttagttatattatattatgaacaatgtttcttgttagtttttatgttatattatgaataatgtttctttttagtttttatgggactcacggagtgttctatttgttccaaaatactgtacgaatctagaattggatgagacatttcaactttttcggatttgtagtataaaaaatatcacatctgattctaggttcttactacctccgtcccaaaataagtgcagccatggttttcagcgctcaactttgaccattcgtcttattttaattttttttgaaaaaaattaaagacataagtcacgagtaaagtactatccatgttttatcatcttataacaacaaaaatgctaattataaaaattttttaaataaaacaaacgatcaaagttgggcgcggaaactcatggctgcacttattttgggacgaaagtagtatattgttgtagcaggtacttataacagtttcaacgtctcgtcgtgcagttggatcgatcgatcgatcgcatcatggtccggcagccagtgaaggagtagctaaaa

SEQ ID NO: 48676 - DNA, 14445 bp, Oryza sativa
  unsure (1)..(14445): unsure at all n locations
cgagaagaagtagaagaaagatgatgattctaaaattcattgttctcgaccgacaactgcagcgtgatcgctcaatcatgcgtgcactgcgagtaactttcttgtgacgagcgagctggtactgatggattgatgagccacctccacttgttccgctgcccaatcatggccaggccaaagatcacggcgagacagccagtataaaatatgcatgcacacctctttttttcaagaagagaaatcttcttgcgaatggaaatagacagtactacctagacacggtggcataataatatgggccttgtagtttgctgcccaaaccaaagttctctttttaagattatggttcagatgagggattgtggtcaatggttgagattaggaagcagatgaggaaaaattaaataagaaatagctggttgaagggcctatccattttagaggaacttcagcacataggaatagaaatacatgcacacttcaattcataggaatttttccataaagtttgtgtagatggaaaatttccttttgttttctctttgtaacttgtagggaagaaaatttttttttggttttcctatatctacattcgtatgaaccaaatgacattcatacgaattattccttaggaatctaaattctttgaaattcctctaaaacaaataggcctcaaatgagaaagtaggcggtgatactcttatatctctactacttaaaaaatttaacatgtttccgtcgtccgtcaacataaaaaaaacagcgaaaaaacaactaaaaaaatccgattccctagcgaaaaaaaaagatccgattcccacctaaaacaggaaaaaaagtccgatacctggcgaaaaaaaagaaacgtagatggaaaaaatatatctgattcccacctaaacggaaaaaaaatccgtttcctggcaaaaaaaaaagagaaaacaaatgtagatccgattcccacaacgggaaaaaaaagtccgattcctacaaagcgaaaaacaaaaaaaatccgcaaaaaataaaaaaaaccaaaaaacatatagaaaggtcagactctataagagagtggcaaaaaaaacgttcgtaaaaaaacgcacgaggaaaaaataaaaagggcggaaaaaagcgcggcaaaaaaaagtctaatttctattcgcagttttagtagtccatatatatctcttatctatctctaatttaatctaatctaactatttaaaagaagtttccatcatatattaaaaaagaaaaatgtacgagaaaataaaaatggtttaaaaaatgaaatgttagaaaaaagcgcaaaagaaaacgcgctagagaaaaaggtttccgtagtcaaaaaaacatatgagaaaatatttccatcgtctgaaaaaaaagaaaaaaaacatacgaggaaaaaactgtcagaaaaaaagctaaattgatggatgcttggtcatataggatcatcgattttttccatctcctacactgctttttgtttcgtcatctattctcctgtattggagaccctgcacatctctgtaggcaattatcagactatttttatgaagaatagctactattcttgataacatattatataaaaataatattagaaaataaacataatttaattgttatttagagaatagtgcacagtttatgactctattttatgtagacttgaccatgcgaggcagtctagaatttgattggttgcaagaatgagtttaaaagaatattttagattatatgcatgttgtcatatgaacaatccaattactttaagtaaagcaaatatgaataatccaattattttagataaagcagacatcggtaaggttgccatcatcgaggttgggccattacatttaagatgttctaattttttgtttgtcatcgacatggttatacatgtaaaacgtatgttatcattagttttttcacccgttacaacacacggacatgtttgctagttcttaaagaaattttaagctctagatgttcatacatttatgtggagtaccaaattttggcagtgttgtgatcaatgcgcttgatttgaagtcttgccatatttctataatatttgagtgaaaacttccggaactacttttttttagagcagcaatatttatatatgtatattcaggttgtcacttaccaaattttttcgtttcaaataattttatagggttcaaaatgatagcaaaccaaacaagatattcatccgttctcaaactacgcaatattagtattcttgggaaactaattccaagtaaatcaatgtgtttttggcccagcaagtgcttattaggagacgaatccaaacaattcaaagtttagaatttgaccaatgacatgacaaaaaggaatctttcatccctacctaaacaaacttatatatatttatctaatgatgaggtggttaattacaaagtactaccacatcgtttagagatcagcagaaaaccattaaccgagattcgttgtactgcacaaggaaacactacacctatagtcctatccataggtactccctttatctcacaaaaataaatctacgtgaggatatgataaaagattgtccagattcattgtcttacataaaatcacatttgcactagactttttttttatagagaaaatccatgcatatgcatgcgtgtgcgttgcctttacttttttcatccgttaccccccaccatgaatgtgatcacatgcacggcacgccatgatccatccatccatccgctttgcaccctatctcgcagtattcccccgatcaggaggctacccatgccggttgctcgcggcctatcccgccgcgccttgccctccccggctacaagagccaccatatcacaatcaatgcgtagtcgccttcgccttgcagtttggaggggtcgcacgggctcgtgtgtagcaaacgatgcgcccatcttttagccacccccaggctaccgatcgagcaagagggtagtgaaagcaagtttaataatagtatagtcaactactagctccaattcatctatagctaatctaataactcattcatactatagttacatactacactattaatatatggtctcatctgtcatacacactgcgctttaaagtccgtgctatagctggctacaaatttgtagcccgctgcttttatctcttctcacttatctctttaaaatatgtctgcagctggcttatagcctgctattgtacctgctctgagggtgaggccatcatgggatgggaggacacatagggcatgatggagatgggagcacgccggccggatggatgttgaccccgagcatgcatatggttggatggagcgaccgtcacagtggagtttgaaggccagccagccagctcccagctgctcgctaagtcgctagtgtgtgtgcattctgatgtggctgaaatgtttcacatggttcatcgatggacggatgctccgtgatatcaagtccatggaccaagtaaaaacataatggttggctacagtcgggtatagctcctgtttggggatcttctacttctggtagatgcaacaactcaaaatctcaggctctcccaaacaattcagatcataactcttgattctccaactcaatagttattacaggaactatggcttgttcgatttggaggaaaaccaaaggatttgaattcataaggattaatctctatgtgtagaaaaccaaagaaaatcctcccctttgtcccttgaaaaaaaaggagaaaatatccccttccaacaagttgtaaaagagagaacaaaattttccatccattcaaatctcttggaaaattcctatggattaaagtgtacatgcatttctattcctccatttatcatgttcctatgagttaaaattccaccaaaccgaataagcccttagaaaataaactagtacccagaattctaaattctcatctagttgtatatttattaactacttaaaatctctagcttccaaaacaaagctagtctgtctacacgagaagagtgttttagcactaacatgggcacttgacaccaagaagaataagctatggaaaactaatggtcaaggtggtgacctgacccaaaaaaaagaaatgcacgttcaccctcaacaactttaatcacaattcacagaagacacgggtttctatcgacaacggttactgttgtgttgatgggcctattattttttgaatacccaacaatgggccttcccaaaattaattgatttaaagtaagggagggaaggaatttaagtaattgcctttgggtccattggcacaaggcccattaaacctggtgaagccgtgccacattttgggcattcaaaacatcccaacaaacatgttgactgtattcatgaactctacaatctacagccgtctgaacaaatatattatacacaaatagaatttctcntgtttcgcctgtccaactaggaccaagtgtggaagaagacatcctgactcctgagaaagggaacattctgtaacctctggaaggctctgaagcagcttcatttgggggcctcagtctcagaccatccagtttgcaaaactgacatgtaaatacactactgccgcaagcaggttgggaagaaaaaaggcatgatgctcaccatataggaacttcaacatttgcaaaacgaagatagagggccctcaattgctacagtaaatctagaataggtggctgctctgatgaaacattggaatgaggagtacgtgatgctcgtgaaagtgccgattgcccttgatttctaccacgccctcttccaacagaagcagatggaggaggagcaagcctgggtggaccctgtgttgtgctgcttgacaatgaccctgtactccgtcctccaattggatttccaaatccaagagctgagttgccctgattcaagtaattgcctgttgagttcacggccattaaattagtagtgttcggtttcgctgaccagctcatttggttggttttcatttgtcccagagaaccactgttgccactgaacccaatatttcctgtacttagtccagaaatactttggcttgtgcttgacaggtgtccaacagctaaaatgctggcaccactgcttgcttttgggggccagtcggcaaaaggatcaatatcagcaagaccatcactagatagccctccagatttactttgctcactaacagataatggtgcattaaagtcagacgatgtgttttttctaggaggccactcaatgtcaacaggaacacatgaaccaaaagtttggggtccagagcttggtgcaagagattgcagtgatggaagtgatggtgcaggcgaaattgtagctggtgtcacttgcgggattgcagatgatggcttangttgttgagtactgaaatcaaaaggaagtgccgagggttgctttgtttgagtgctgaaatcaaaagggtctgatggttgcttcatccgtgcatgaatcagatgactgtgatggagtgcttgctttcttagtagggccccagtcctcatcccatgcagcaccctttgcagtttgtatctgttcagtttgtcccacacctcgtgacaatggctcagaatgaatcccattagccaatgagggtgatacttttacctctgtattcccattatctgtaacagtcacaccacgcttctcctcaatcttgctgtagaagtaggcactaatttagttggcatattgattaacgcatcgcaagtgtggtgggacaaaaggtaccttgtgatatccttgacaaatagtatgtacttagcaaattgctgtacattcagttgatgtgctgtgagcagtgggaagacgagaggaatcacgtactccgcagcaaactcaacaccacactggatcattggcaaatgagtaaaataagatatcttttacaaggaaaaatcaattggcataaaaaataattgttcatgatttagcaatactgaaacaaactatatcaagaacaaacctgtttaaaaattgcattagccactccaagggtgcacataagtgttggtgcggtgtggtcaacagctgtacaacgccgaagagtttgcaagatctccagtatgccttctttatccaaagatggaacaagatcccctaaacagcgcaaggcatttacacgcacctatattttcaagtcacaattcaaaatcaagatcagaacaaagaaacataaaacacaaaataatataaggtacagaaggctgccttcctggtaattaggcgggattataatagggggtgataaaatacagaagaattatataatagcactatagtgacactaacatctaagatcttaacactcttgatcaataacaagctataggatggagtagctacatagaaaaaccatacactcaacatctcatggctcttatatttctgtttatttattttatgtgcaaacgagacaggagttttcccttttaattattcttttttaaaaaaaaagttgtttcatcatacatgctatttgtgtgttttaatgtgtattaatatggtacaatctgacacataaagtacccaaattataaaactaaaacatgtattatgcataccgcagcaactgtagtctttaaggctaatccatgtacgcgtggcagaacagactgtttcagtagctgcaagaagaaatcactgagtgagtacaaaaatggttcatgtggaattgttgattcttttgtcattgtgaagttaatttgtcaagtgagcccttactcaacgagaggcaaagatagtggctttctcaattgtgatggagaaaatgaagctacagtatatagtttatcctcattttaagaatatatttcaatgctaaccttcacgtcaagctgacgagacaatggcactgtccgtcgcagtacttcttcctgtagtcggggatcagtgtcatcataagcccgtaccagcataggaaggacatgtgatatcaaatgctcttgtgtggcctgaaaagagaagcatggtaaagaaattgattaggtcatctggccatggaaaattccagtaattacaactattgtgttggtaccattgtgaatttagattataattgcatttactatagagataaaaagagcaaaaacaaaaacaatgaatcagtgcagtatttataaaagtaacttagttaccttgtgaataataagatccgcatgcttcacgagcaaaagaagtgtttcacctgacgctgaagtaaataccggaacaagggccggcagtgttgaaagctcaaaatcacctttgtcctgccagagagcagagaacaaattttcagaaaaaaaaattatagcatttgcatcataaagaaacattaccatataacatagctttaaatgtatttcactttacaaactctatgaactcacgaaattgaagcataacaaacaaataacaatgttcgagtgttagtactgtggatgactctgtgttgcagcaagaatgatacaaccacattaaattggacttactccagtcaaaagcaagttcagatgaaaaacagtcaaataaaatatgatacttcacattatgcaaagtggtattacagaaccatggtatcatcccattagttaacaatcagtgagataagttcttactatcattgaacaaagaatataattcataaaatatttaagaaaaaggtattcgtaaaacacaaggaacatgacctgagattccgctattgttagaaccatgggcaaaatcattggctgcatgaccatgttgcgtaactcagcacagagaggtggaagaacctggttgcaaacagagtcagcttacagatagtcaatatattaagtaacattgtgaatcagcattttttttccttccgatagaaagaattcgcatgcacacatatgcaaacataagtaagttgcgcaaattcaatacattaatagaaaatccaagaaatgccattgacaagcactcaatttcaagaaatgtcatcaagtacaagttccatgaaatgccatcatacaagcaactttgtcccaaaaatgccattgccgttagggttccattagcagccctccgttaagtgctaaggatgaacagtgcacttaacggcgcgggattgggggaaccctaacagcgatggtatttctgagataaaatcgtttgtacgatggcattttatggaactcgcactcattgatggaatttcttggatttgggtgtttgtcctggcatttcttggatttttctcattgattcattgaatcaaaactgtagataaggacaaaaaaggaaagtgataatgctaatagaaggatcaacaaaagtgattcctctctaaaagcaaacaggaggcgtgattcacctatgtaataaaggaatggaagttagaacattgaggtgtgtatatgttatctttttattttcaatattacaaccaatagttctcagtgtctcaacatttttttttttggcaaaataactagaacacactgaaattttgctatgtgatcttgataagctcaatagcacaaagaattgggcaatgatattgaattgaaaatttaagatggacttcctgttaattttatgagtatagtatagctgtcgatgcaaaaatacttatcagacaactgggaataagtaacatggaataattagataattagcaggttctaacatcttctatgaagcagcacacaaaccaagaaaatgtggccataatttcataagaccacacttgatatgaaaagtggagataatggattgctcatactttataccgaagaactcgggaatcgaagtccttccacatatccgataatgccttcagaaactccgtcttctgcatattgtctctctcctgaagacgatattggatcaagattataaccatttctaggtaacaaattagtatgttgtctgtttagacaaacaacagtcaagcagataaagctcctagttctgtcttcccacgtacaattgaaacttaagccaggcaaacgagattctcagatagaaaataagcaagctatgatatgcatatatatgaaacaagcaactaacttatctgtgaaaagaaactggagtaatagacacatacaagcaaatggtcaaggaaacgaagagcacgcaaccgcgtatcattccggaagaaggaagagcctatcagacagaaggtgcaacatttcaaaagaatttcatgtaagtataggtaacctggtgatctccaatcaaatagaacatccaaaaactccattctggaagatcttatgcccaagataaagaaatgataagtgataatttacctgtgaacgccatagcactagggcgtgatgctacatcaactgatagcatcctttgcaaatccaccactaaatcagcaggaatattagaaaaggcttcacttgttaaatacgtcaaggaattcatatactgcaaaacaaaatgaaacatcaacacatctttaaaaatgctaacattgcagcagatgcaaccttaattccttaacagatggtttgtttgcataccaaagggaaactacatacatgtaccaacagcagttcagagatcaggtaattaaaattcaaaaaaaaaagcattaagaataggtaaaatgtcaaaatccagattcaagacataccattttcacattgttatggcaatccagaagtggtctacgagcaaccaggtgataagctagacatccaaaactaaatatgtcacaagccgagccaactttagaatctccacttcggaccaattctggtgcagtataattcagagatggttgaagaggtaaagctgtatcctcaacatcatagtcctttagagggaccaaacagacaaatagattatgattcaaattgtgaaaatgacacaatgatgggtattagaaagcaggttccacaaacagctaattacattgacaaacagtgttagcaaaaataattacaggggaagccaagttgtaaataatgtttacttgttcactgctaagtacttaagtaggaaatgatttgtgccattataaagaaaagcacttccattgaatgtggaaataactcagataacagtagctgtacatgcttgatgagttaaacaaaaaagagcaagaagaattatgtgctttatcatggagtgcaatcaggtcagctaagagaatctttatcaattatagtagaaatatttatgctattgctccaattagttagtgtatccaaaatggtaaaacaaatacacagcttaaaagctatcacataatgcacaactaagcataaattacttactaaccgaatagtggaattgctgtgttgatgtcaaactgcctgtggcttggtcaacagaaagagcaaaaccaaacccaccaagtttccaagatccattcaaagttataaagaccgtctgcaaaagaaatcaaattattacaacgacagaacataagacttgcagatgaagaccaaataggctaaatgcattatgcaagagcaggggaaatcacagattcaaaaattaactagtatatgcatgatcattggcaggcagtgttagattatgtgttcccgcaacaccagttcgtgcagcagattcttttgaactcatttcatgcatagttaagtgcgcaaaaaacagcatgataaaattgagcggctagcctagatcacagcatgatatgaatggacttggctaagcattcatcagagacaactccaaggcaaagaacattatattgttgtactagaaaacttgagaaactaactaaagtaaataaaacaggtaaaatgaaaaaggattctaacagatttatgacaaagcacatccataacatgaaacattcgtgcagaaactatgagttgaagaatgtgctgcattcaacctcgggtgatatagctcgatgggcaagatgggcattgttatgaagaaagtctagtgtctctgagacttgtagcaacccgtgtttaacctccagtagccccatttcctgaaacataacaataaacaagcaaatctcagtacagctgaaacacatcgtcatgctttatagaacccacggcactttttgtaaatgaatgtattctaagtaccacgtaacaatttatatgccttcccaggaaacttggcagatttcagacagattgattgcattagaaagttaactgcaaagaaagctcgctgcaaatgtttataagtaccaatgatcccatttaatgaattttctggatatggcactgcaaagtgttgcatacaaaagacaaagccttatgtcaattttcagctcaaattatgttctaacgcacaaatctagataatgttactaaatatatcccaactcacaaatggtacagttgccagtttaccactgtcagtaacactaatcacttcaacatgttaattagaaggaacttttgagctagcaaacatcccatgcccaaaataaaccaaatcacagatcttgtggactctagagcggctaattactagcaatcgccaaagtggacatctaggcacacggaaacctaacaaaaaataagcgaggcagcatcgctccgtaccatgcccttgagctccttgggcaccttgccgacgttgtcgaggcagccgagcgcgttggcgacggacgcgaacaccggctcggtggccatggccatggcggccttggtctcgtccagcgcctggacgacgtggagcaccccggggtgccggaggcgcacgagccgcgcggcgtcggcgcgggcgaggtcgaggaaggcgtcctcggcggccttggtgagccccgcccgcgcccgcgcctcggcgagcgcccgcttgtcgagcacccagacggagaccaccgggtagggcgcggacggcgccccctcccgcggccgcgccgtgtagatccgccatgcgaggccggggccccccgacccggcctgctcgagcagctcgaagtcctgcagcggccgcggccccgtcacctcctgcaccgtcgtcgtcaccgtcttctcgatcaccgccgacgccttcgccagcgcctgcgtcagcgtcttcatgttcagcgccatctccccccttccccctccgcctccgcctccgccgccgccgcagccgccgccggcgagatctgggagccccccgctgcttacgtcggcggaggaggggtccttcgatcggtcggtcggtggctgcgtgtgtttggtgatttttacgggtttttgtttcttaatttttccacctaattttcatgattttttttctctcattctcgcgtgactccgagacagcgaggaggatgcttcgtggcgaaagggttggattggggaaattttggttcgatctgggccgtccgttctgtctggcggatgggatggacgggtaggattcgtcgattcggtggggaacgggaggaagttggtggggtgcgttaacgctttcgctaatcacgttccgattcagtcaacggatttttttaagggggtaattgcgaaattaacaacacggtttttgtgctgtataacctgtgttaccttcaggtatacggttgccagtacagcgagaaggcggataatggtagtacggacctgtttggtataggagttaggtctaatgtggagttgtggaggtgcctaaatccagctccacaactctagtttatttcgtgagatagctcaacccagctccactcccagttttggtggagttgaaactatttggctgagctccaactccaggagggttggagctgaagctgtgtcaaacaggtcctacgtaaaccttttctgaaggcgtaaaacactagctcagcttagacgtttagaacttgattcgcggagtggtggtgtttttaaaagccttgttagagggtgtaattaactcattaaacacccaagtttaaggaatgggtgaaggttaaacacctaaactatcagtcaaagtagggcgtcttctttattgctcgaaggtgtttttttcatttggatctgttatgaaacaacagggtgatatcatccatataaaaggatggatcacaaccgaaggcaaccgcgccttccttaggcgctccttggcaacagacgcgatggttcccaaccatcgtgtctccggttgccaccccttccccatctatatattgtaccgcattgatcaataaaggattccgctcattcattccctacattcttgtgcaattctctctctctctcgctcaatccctctcgctcaatcaatcttattcacttttaacatgttattagcactttcgctctcgcgaaggagatcgcgaagtgaaagaaggaagaaacatcgcttttgatctaacagaaaagcgaacagaagaatcaacaaagaaggtacgatgcctacctttcattggattatggatgccgttctcggcctctctcgcaatcagcgcgtccgtcgccttcgccatcttctccgtcgatgggagaggagtcgccgccaccaccacggtcgccaccaacaccatgaacgtcgggctagggctggtgcccgtcgccaccaccctcgccgacgcatcgtggtggccactactccggttgctcctccttcgcctccgtctccgattgccgtcgtgcctcgccgtatctgtgtgcagggggtgcagtactgcgcctaccacggatggacagcagtggtgacactgcccggcgagccatgcgatctttccccggagatggagtcgctgccgccaccaccgaccgctccttcaccacttccaccgacaccaagttgactccaacgccgttcccccattcccgcgtcaccggggtccggcgggaccggtaccctggctgcgcgcacgagggagccgcccttcttcaatccgtcctcgtctcatcgtcatgccggtgaagccgccgctcgccgtcccggcctccaccacaccttcatcgtcgttcctcatggctctcctagccgtacactccctaacggggtgccggggaatggtgtccgggctcggccggcctccgattccgatgaggatcgggagccgtcggcctaatccggccggcaaaccgccggcggacgaagaggtggccgtggcggcagtggatggtggatggcgacagcggtgggtggcggattgtggatgcaggcagtggtggacaacggcggatatggaggcagcaacgccggcgcatcacgcgtcggcgctgcaactgggagatggcggcggcagatggtgcggcggcgacggaggaagggcggcgccaccctcggcactccctcggcggcgtcgttggcgatccacggcggcgtcgttagcggcgaactggcagcggtcggcggcgaaatggcggcggtgggcggcgaaaagggcgggggcgtgagcggcaaaaacggcggcggcggcgaaatcgtgggggcggttagggttaaccctaacacccccggcggctcccccctgccttttgctgtgggccggatgggccggcccaccgcccccttgcctgccggcctagtggccacacggtggtgtttt

SEQ ID NO: 48677 - DNA, 18090 bp, Oryza sativa
agttcattagttgtacaagtaattatgtaatggtcctacagaccgctgatgttatgtgttaattaacataggtgtttattcaaataccctgtttcactaaatttattgtcttaataacatgtcttttgcattttatttcaagacatgctctactttctcgctttattaatttacaaaattctataaattttgtactttgatttagtaaattctcttaattatgtacaacatgattaatggaggatttaatgcatgttccacttcacattttgactcggaaattaatcacatgtcgatggagccctatactttggtcatatcgaccataacttaggcagcgagtatctcgcccatcatcaagtggtctacattttgagatgattacccgatggagtcctacaaattggccgcactggtcataacctaggcaacgagcaccttgcccatctcacagaggtctacatctcatgatgattacccacatgtgttattttccaagaataagttttgaaaaatgagattatttgaattttggttgagcacaaggtagtggagtcctaaacattggttgtggtatattcaacagaatatatttgcctggagaccgtgttttaggcagcaagtataacttgcccactattaagagatctactccactgtttaattacttggagattatccacattgtgccacctaatttcgaattctaactcaaattgtcaggtccattacctgcattttttttcgaaacattacaaaatatgaagtcttacatttcgcattgagattacaaccttaatatcatgtttttattaatttacctctgtaaattgataatgttaaccatgattgtagggacatggcaacaaaagagttcgacgaactcgccctcgatgggactaactatcccatatggtcttctgatatcaaaatcaattttgcctctcgggggattttaaatacaattgaggaacccaatgatggggacccggaaattgagcctaggaagctcaatacatccctttttcttttgagactctacattcacaaggatcttaaacattaatacatgttagagacgagccctctcaacctttggaaagctctaaaagagcgctatgatcagcaaaaggaactcatttggcttgaggctaattatgagtgggttcatttacgcctacaggactttaaaactgtggcataatacaaccatgttgttcataacatttgttccaggttgaagttttgcgaacaagagccaactgaggcagagaagatagagaaaactctatcaactatgcttccggaggacaggataccgactcaacagtatcacgctaacaatttccagaaacgttctctgcttatacatacattgactcaggcagaaagacaccatgagctttctttaaagaatgcccaacagcgcccaccgggctctgctccactacctgaggtgcacttcaatgtacagaataatgctgagaataagaaaggattcaagggaaattcttcaaataatcctaagaatctgactggaaagcgcaaacgcaacaacaacaggcgcaaattcaagggttgaaagaaaggaaaagggaagggtaaggcaccacaacctcgtagcaatggcaacaagcattgcaacaggtgtggatctgacactcatgtcgctaaagactgccgcatcccgaaatatcttgtttctcttgtaccaaaaatccctcaaggacaaaaaatcttctgagaacccaagatttgaagcccacttcaatcttacacataaagagcgccctgaggttgcaagttctcaccaggctcctgttcaaccagagagcaacctcaatgttgtcccagaagatgtcgctccactctctgcgatggacgatatgttcatcgaatactgctcaacggacccacttggagatttgcaatgatctcggtgcgtcccacttggagatgaagctgctcttatctcaatgtgcttgaaatagtatattgatatcctataagtttgccaaacaatattggttgtaataagtagataagtatgaactcccttatattgtaaggttgtatggcttgctagtcattagagtatgtactattaacatatgtaaacatcatactatgtatctgatgttttaattattgtatgtatgtatatatattggataaagaattcttaatcaagtaattcttctttcattatagatgtctaaggatatcgctccgattggagaggaattatgtcttttggacagtgataccacaaactctatacttagggagatcaaatactttcaaactctcaaaaagagagaaggcaacgttttgactatcgctgggcgcgatactgtgatagttggctcaggacgagccaattattacacttccaatgggtacacaaattacaatcgaggatgctttattgtatcccgattcaactcgtaccctactaagttatagatatatccgtcaaaatgggtttcacattgaaacccatatggataatcgagaagaatttcttctcttaaccaaacaacacggatatggcaaacgcatttgcgagaaaattccatctctcacatcgggattgtactatacatacattaagcccattgcacatgttgcgtataaagtaatttttcaaaatgttgatgcattccacacttggcatgatcgacttgggcatcctcggtatcgggatgatgagaaaaattattggcaactctgttggtcatcatttgatcactgacaaatttcccaaatcctctgatttcgtatgcactgcatgtgctactgggaaactaattttgagaccatcttatctcaaaattagagccgaaccacttaaattccttgaacgcattcaaggagatatctgtggccctattgtgccaagatctggaccgttcaggtactttatggttttgattgacgcatctacaagatggtctcatgtgtgtcttctatcgacacgataccatgcctttgccaaattaatgtctcaaattataaggctgaaggcaaattaccctgaacataggattcaatcaatccgtatgaacaatgctgccgaatttacatcccatgctttcgatgattattgtatggcattgggaattcaggttcagcactctgttccatatgtccacacacaaaatggtttggctgaatcattgatcaaaagaattaagcttattgctcaaccattattgatgaattgcaaattaccttcgtcgtgttggggtcatgcagttctgcacgctgctgaccttgtccaactacgaccaactgcatatcatgaaactttcccaatgcagttagtacgtgaaaatcctccaagtatttcccatttgcgtaagttcggttgtgctgtatacataccgatctcaccaccacagcgtaccgctatgggcccacacaggaaagtagggatctatgtgggattcaaatctctgtcgatcataaagtatttagaacccttaacaggtgatctatttactgcccggttcgctgactctatcattgatgaggaacatttcccggcattagggggagacttcaagtaccagaaagaatgccaggaaattgattgggatgcccagggtgttccagcctcagacccacgtactactgaaattgaacttcaagttcagaaaattatacatttgcaaagacttgcaaataacctgccagatgcatttaccaattataaatgtgtgactaaatctttcattcctgctcagaatgcaccagaaagagtagaggtaccaaataaaaccactcaacttccactcactaaaaagagaggaagaagtatggccacccagcgagaaacaattgctaataagcaaagaaagacggtaaatgcaaaccaacctttagttgttacacaccaaattgatactatatatcaagcagatcgtgatagtctgcaacctagcttggtggtgcacaatgctgagactaggaatttggaagaccatatacacattgtttcgggagatcacgatgagtctataagggttgatgaaattgccatcaactactctgaaactggagaatcttttgatagaagagctacaattgtcgacattaatttttctgaacaaattgctgattgtctccaagttgatccagaacctaggtctataaaagagtgccaaaagcgctctgactggaacaaatggaaggacgcaattgacgcagaattagcctcgctttacaaaagagatgtattctcggctgtaatgcctactcctcgtggtatctttcctgtgggatacaaatgggttttcgtccggaaacggaatgaaaacaacgaggtggtgagatataaagcaaggcttgtagcacaaggttttacgcaaaaacctggcgttgatttcaacgaaagttactctccagttatgagtggtataactttccgatatttaatatcattggcagtacaaaatcgtctatttatgcagttgatggacgtagtgacagcatatctttatgggtcacttgattatgatatttacatgaaggttcctaatggaatcgacatcccgaatcagaaggtaaatcataacatgtattgtgttaagttgcagaattcactttatggcttaaaacaatcaagcaggatgtggtacaactgattaagtgaattcctttcgctaaagggatacactaaaaatgatgattgcccgtgcgtctttatcaaaaagtcccccacaggattttgtattatctcggtatatgtcgatgatctcaacatcataggcaatacacaagatattaatgaagcacgtcatcatttaaagacggaatttgagatgaaggatttaggtcaaaccaaattttgcttaggtctacaacttgagcatttaccttctggaatccttatgcaccaaagtgcatatacccagaaaattttggagaaatttaatatggacaagtcatatccttctaaaacccctatggtggttcgatctctagacgtggagaaagatccatttagaccaaaggaagatggagaggatgtacttggtcctgattttccatatcttagtgctattggcgcactgatgtaccttgcaaatagtacgaggccagatattgctttccaggtaaatctattagcaagatacagcgctgctcataccaaacgccattggactggagttaagaatgtctttcgatatcttaatggcataagagatcttggacttttctttaaaaagaaccaggattcaactttaattgggtatactaatgctggctatctatctgatccccacaatgctggatcacaaacataattcgtatttttacaaggtggaactgctatttcatggaagtcttctaaacagactctggtagccacttccacaaatcattctgaaataattgcattatatgaggcatcacgtgaatgtatatagcttcgcagaatggttaaccacatattaacatcttgtggtattggttcattggaatcacctaccattatctatgaagataatgccgcttgtgttgttcagatggaaactagttatattaagagcaacatcactaagcatattgctcctaaattattttatcctcatgagcttcagcaacatggagagataaacatcttgcaaactaagtcatgtgataatcttgttgatttattcacaaaatctctaccatactccacattctttaaatgtgtcgaaggaattggtatgatacgacataaaaatttgcaggattcagggggagtatcttcctctggaaaataacctattttcgttatattatactctttttcctttgtatgagttttaccctttaggttttctcatccaaagtttttaacgaggtaatatcaacataagttatatttcttatcatttggcttttccccactagggtttttactaaatgataaccgtagacattatactattttggatcatactatgagctttactcatagatctaaaatagtcaataatatatatcacggttctctccttatttttcccactgggttttcgatgagttttacgtgatgtatttaactataattatttctaagattatctttacagatatctggaacagtgaaagagcaatgattaaagctggattcgatcaagggggagtgttatgaaacaacaggtgatctcatccatataaaaggatggatcgcaaccgaaggcaaccgcgccttccctaggcgctccttgggaacggacgtgatggttcccaaccatcgtgtctccggttgccaccccttccccatctatatattgtaccgcattgatcaataaagaattccgttcattcattctctacattcttgtgtgcaattctctctcgctcaatccctcccgctcaatcaatcttattcaccattttttacaggatccatgccattataatttgtgtagtatacgttttttttcactacctatcccttcaaccattttctaaaattttaggataaaattgcccacgtcttcttcctggtcttctccccatctcacatattcatcttccctctccttcttcgaagcagtaggtggaagttggaactgacggcgatgggctcccaggggaggagcggcggtggcggggcaggggccgccaaatccgcgagaacgtggcgagcccaagacccaccaccaccgtcaccgtagctgcactgtgcgcgctgctgcactccagcatctagcttggcctcggtggggggatggcatcaatgggagtaatgccgacgagtctgggttgggataaatccttgggtcgccggcgggggatggattgatgatacatcctgacaagcttgttcttcttgtagtcgagcagaataatggcagcaagttgatagagcatcgaaaggattggcctttgggtagaacacgtgtatctaatgttagctggtatgaacgtggttgccgtctgtatgaatgaggaaggggggaggagagaaagagcccgcgcctccccaactacggatctggaagcgccgccgcgctggagctgcaccattgtccacctgtcgcactcgagctccatcatcttgatctgctcgagagagcttcgccgccggtccacctgtcccgctcgaccaccagagggtgaggacatttttatcaaatacaggtaaaatacatatcttaatggtacaactgaaattataaacaagtgatcgtggcattgttacaaatacgtaaattataatggtatattttaaaacctcaatatttacagtggcataaatctaattaatcattttcattttggagttgatacgtctgctgtagttacacgccatgacttatgttgttatgttagtcaaatctcttaattgtactgtgactagggatgtaagcgggccaacccgagaacccgtttatagacaaaattagtgagtgacccgcgggttaactcgtggattacctactaatttgacttataaatgggtttatatattaacccacttgcttttctataaacgcagcaagctgagccatgacgtgaaaacccgcggattaccctttatttaacatataaataggttcataggtcgtcccgcttacatccctaggcatgtccattcctcagaaaaactagtttttgctgaggtgatgagtaagagatctgcttccattgcgtgtttccaaaatcactttatttaaaatttccatttcccagcttatatcacccactcctggttattttttgattgagacactgtggagctttcattttcttttctgtagatctaaaatatgactgcatggttatatgtttacgtatttgaaaaagaaccgagtaacttgagagtacttttttggcgcatgacggcatgtcggcatgcaccatctcaaaagcatggtaaaaataatacagtaatgaaaacatgaaatatatagtttggctagatggatatgtatgtgtttggtcaatagagttaagtatttgaaaaggaaccgggtaacttgagagtatattatttttggcgcatgacggcatgcaccatctcaaaagcatgattcagatagtaatgaaaacatgagatgatttgaaaaccattgacacgacacggatgtacatgtccaaatactatcaactttacatccgtttcgcacgcggataaacaaaggaaaattaagctgctagtgtcattgtcccttttccaaaattctttccattataatttgttcttctgtaaaggcgatatgtttttctaataatggattctaaattcattaatccggcatctataaacacgagggatatacacagtcaaaatgatagaagagcacttagactcacacctcattaaaaaggagaacacacaacaaaaaggaaaaacctacgatctcgccacatccttgcttcttgacatcctctacttaaacggccaaaattgacgagtggaggacgtctagtcgccaccgtccctagtgcgttgtcgctgcaaatctcagttcatatcatcttcatccgattcaagtgagttgatgccacgctccgccgataaggccacagccgaccaaacgcgagctgaaaggatccgcttccgcttcgccgaattcctaggcctccgccactatcgtcggaatcctcctctgcctctcagactcccaggcctccactgccgatgagatcttcctccgcttgatccgcctcctccttcgcgagaatccttgcactggcaattaggccgctgccgccacagccgaagaggtattctgcttggactcgcaggccaccgccattcctagggtcgttgctacctacggaaccacctccgtcggatctgccttctccctgccgagggttggccgttgacgcttaggtcgccgccgtactccgccgcatccgccgccaccatcctccgtcgcacctgccgacaacgttctccgcagcgcccaccgcctcccaaagaaacaccgccatggcgtcgtcgacagctcgctgctacctgccgcggcgctgttctcctgaccacctctgctaccatgcgcaaccaggtattggcctgccaccgccgcccatggccctgccgtctctcgcactagcgcgccgccagatctgggggcaaaccccagacccaatcccactgtccgtcgcaggtcccgccgaagccctgccgccgccttcctcgcagccgcacggcactccggcggcctgctagggtggcggcatggcagcagcgaggagacaagaggtcgaggcgatgagacgaagagacgaggagtcctgtgaaggagatatataaggctttgaaagaagtccagtctagagcatctccatcaatatttcatattttaaagttgttaaaatgtatatatgggttaccccatttgtgagaaccctaagatcaccttttaagtccggtaacagctctcatttctcagtcttcattttattttttcttctattccgacatatgccggttactcaaaacaagaaagtatacatcgatgaatatttcaaagcaaactgatctcatagcaaacctagctatctgattctgcatctcctgtccctctaaaccctgacaatgcgctgatcgttgtgccggagttcgtgatgatgccagtgctagctacaaaaattgcaaagactaggttgatttgagctccttgatcaagtacatggttgattgtgtgtgttcgtcacacctatacttgcaatttcacttgagaaaatacatgacctgacaaaaatgaaaaccaaaagaagatagagtccatatagagaacgcctatgcttcatcgatgatcaggccaatgctccaagcacgatgctgatcgactagggatcaggcttctctaccttcagagctaggtgcctttgtcactaacatgtgagttcaatgaatcatggatacacctgtcctgtcagtgacaaaggaatggtgtctttgaaggtagaggatctcaatccatcaactaggctccatcctcgctggagcaggtcggagaggcgcggcggctagagtggggcaaaggatccggagttgcgcaagatccatccacagtcgccagccccttaagactgaggggcttggcatgaaataatttcgagatgatttaggggcttcagtagggatggatctagtttttaaaccttaaccctcaatttttgttttgtttgagacctgtgtttaggggtcctgctaaagacgctcaatgagagcgtatttgtaactgaaattcagaataggaaaaaaatagaatcgagactataatcaatattttgcggttaggtatgtgaacgttctctccaaaaagacatcctacaactgattataagacacttaacgtttattggaggaaaaataataattatagataaaaattttatatgtgtcgttatggacttaaaagtcaatgctagaataaattataacaaataacatcaaaattaagtatgaaattaagcttgaaaaaaattaaatttagttttttaacacttatataactaacatactccctccgtcccaaaataagtgtagttttgcactattcatgtccaacgtttgaccgttcgtcttatttgaaaattttttgtgattaatatttttattgttattagatgataaaacatgaataatactttatgggtgactatttatttttagtttttttcataagtttttcaaataagacaaacggtcaaacgttagacacggatctccacgactgcacttattttgggacggaggtagtaaataatagtagatgcataagtccaaaattaagcttgtgtgaatgataagctgaaatgcaaacgataaccaattaaaccatacatttgccacctgtcctaaactttgacacggataattgtatttacagctaactaattattctttcagtgataggtgatatacacgtcaaagcgagcgcttgtgtttgtaccgtgcaccatatattcttccatgcatggtttcaaaacattttccgaacaaatacgacagataggtgagaatcgatccgtgccttttcaccaatagcaatcacagagtcctctggtcatttcgagttcttagaccatctacacgcaacaaaacctgctcaagtctttaaatagttctatacttcctatgtaaaaaaaaaaaaccttatacagatgaatctaaatgaatatatttcagatacactcttagaaattgttttttttaacggagagtacttaatttcgggctgcatgcctgcatccaccgtgcatgcccattggcattacggcaaaatcctccaatttttttaaggcaagggcgacctcatctctcccaatcactccacgccaagtccacccacaaatccagacatgtaaccgcaggcaataaacacacagagcagtacaggtactggagtgagagtgagagcatgcccggcctgcactgcacgtcgcccctcaatttcctcggactgtttgtttgggtgcacgccaatcactcatcaccagcaaggattataccccccccccccccccctgcacgctgatcggatctgcagcttcatgaatgcaaagcgcctaccccagcgtcccagccagctgcgcatgtcgttgcctgcaagtttgagcatgcatatgctttgcaattttattgtgttctcgggtgactgcgtgcagtgcatccatggctaacctgcaacagcaagactaggctaatggtgatccccaaacagcgagccgacgcgtacctgacctgcaattttttttaaaaaaaaaagcatgtctgaatttgagaggattgggaacttgtaacagcagtttgttgcttgcagctaccgtggacgaaacgatgaacccttggtgaaaatcaggtttgatcagacgacaactccgatctacctggctcaggattttattttattagtctttgacggggacctgacctgagacatatggcaatctctgggtctcacattaatctctgggtactttcctatggcaatgcaatgcgtttatactgtgagctgtggctgtgcgactgctagtgctaagctatagtggtataccctgtggagtactcctctgtatggagaaattcttcatgctgcactgtacagacatgtcacattggtgattggccggcccgtcagtatctcgcaggacagatgcaaccaaaggatgaccgcacgtagctctgtgttgactatttttttttttttggcaaaaggaaggccacgccatggccttatcggcttgctccattgcgttattgcgtaccaatgtactatacctccgtttcttggatttaaattctccccatcatgaccattgacaaagtactaagtacatgtctacatgagcatacgatcgtgatcgagcctgccgctgcccactgaattcgaattctcggttttcccttcgaagtctagtgctatttgtttcttctctcgcattttgtaactgctactgatccttgtccttttgcacatcgtcactcgagcagagcagatgctcgatctccgaaaatctcaataagggaaaaaaaagtactcaatccgtctaaaatataagcatttttagcatagtgataagtcaaatatttttaactttgatcattaataaaaaaataaaaaagatcaatcatataaaattgatgttattagatttatcattaaacaaactatcataatataccactcttttaatttaaaacatcttacttttatatatattgttagtgaaaatagcatctcagaaactatatcagagttaaaaaatacttatattttaggacagagggagtagccatccgccatgtactctgcttagctctaaacctgtacggccggctgcatcatcatcatcatcaccatctcatcatcagaggaaggcaagctgccatgctgccgcgcgccattggtggtgaagccacctccaaccaactggctgatctgccgcccagtcaatggtgcagctcatcagaaaaaaaaaacaagaaaaagaaattggccaaacattttcttgcctcgcgcagctgcgccgttgccccgcgcgcgcgtcgcacaagcaagtaagcaacagccacagggcgccgcaccaacccggagcagtcaccggtgatcgatccgaccctgcagagtccgggctccagtgctctctccacggtactccctccgtaaaaaaaaaaaaaaatggctacgtgattttacctacgataaaaaatctagacatagttatccagattagcctttttaagaaaaaaaaagtatacgtggaacacagtctagacatagttatccagattagtctttttaagacaaagaaagtatacgtgaaaaaaatgttttttaaatactttttatattgaacttttttaaaaaaataaatagatcctgtttttctataagatataacaattaatattcaaataattatatgttaattaatgatttgtctcattttagatgcaagtgagaaaggtaataactaccccactgaaactgtggtcagatcatgggttggttttcagaatatgggtagtaaactactcctggagtagtgattggctgcaggttgacgatgacatgatcaaaacgaaagggccaattttcctggagatgactacagtacaaatacggacgacaataagaaagggaaatctccccaggaaattttaaaaaaggaacatggaggaggagaaagtagaaacctgagtaatgccttgtttatgtaatataatgtatggggatgagtaacaggtacaactaataaattcatggtccacacaagcttaattttggacttatgcatctactattatttatgttagttatataagtgttaaaaaacagtccacataataatatctacgagttgctctgttgacttttagaggacgttttttttttttgaaattgttcttcaagaatgaagtttgataattaatttcccataaaatgtatttttaatggatatagactacattgtgcgaaagcactttgaagtataaatctatcggtgcaggtctatgcactaaacacatttgtaattgagctatttgtcgatcaaaatccacagagtttgacttttcaaaattaaaatgtcttaacaaaattcaatacagggagaatatatattagaaaaatattgagagcattatatatcgtattgaagcacagtggcagtcgttttacttttatagagaaaaaccgacacatggatatataccacggccattggtaagtgtaggctaatctcacacgttatttttgttctatgatagtgtatatccattcccgggtacttgtcaccacatactatttatactcaaattttgaccacaactattctagcagctaaattgtaaatatttgaaattataccatagtattgaagcatgttgcatgctaaatatataatcatctaacttccacgcataaaatttgacatttgagaaatatttgagaacgaagcgaacattagagtgcggtgaaaacgacttgtaagaaaaagtatggtaaaaagacctggttcaatcctatgtcctaagtaccatgttaatgagagaagaatatacggtttgacacatgtggaaattttaaaagtatggcgggggattaaattataatggtgtaaattaaaacaaaagacacatgtggaaatacaatttagaaaaaaaaggtgatactgtttaaaaaataatcttgactatacacctagacaatataattaataaatataccatagaggagttcatgtcaaaacaacgcatcaacaatggaatttttgtttggattattggaagataaagatagaactagtagtttgctcactggataaattccaaagtaaataaaatacttttgattcttgaaatacaaatatactttaaatcaaaaccagctgcccaaaagttggccactaaaagctgaagcaaatagcatacccttccatttggcaaacgtccagatcatgatctgattattagcctataggcaaccaattgaaccaaagatgccccgtaatatcaccccctaattctcagatcgagcaccgggacgacacttaactgacgtaatcggtagaaaaataaactattacaactatagcaacccaactaactacaaacacaggtgaggtgatcaccggcatgagaaatttgaaatggaaaataaaaatagtgccatgcgttgatccgtcccagtacaccaatttcagaagcttgggtgttatgcccccaaatcgtcacttccccctgattcacaagcaagccccaaatcatcagtgtgtgacagaaaaaccccccttaaaaacgtccgtgcggtgggcgtaggttaagagagaccgtgcgcgcgcgaaatctctcacacgcccacagctcaaaccggcgcgagaggaggggaggggtttggtttgcttggacactttggtttggtcgggtagctcacctcactctcatccgaccagcgactctctccctcctcctcgcttgcacacttcgtactctctctagtcccccgcatacatgtcgtccgcggccgtggcgtctccgagggagacggtgtcgccgcccatgtcgctggggaaggttggtgtcgccgtcgtcggcggcgggaggaggaggtcgaggtaccgcctcgagacgagggggttgtcgtacgtgctcccggcgaggggggcggcggcgaggttgtttcttggaggcggtggggaggagaggttgctcctgaggggcgtgacgtgcgaggccccgcccggggaggtggtggcgatcgtcgggccgagcggggccgggaaaacgacgctgctgtccgtgctggccgggtcggccgacccggcgagggtggtcgccggcgaggtgctggtgaacgggcgcgccatggacgctgcgaggttccggcgggtgtccgggcacgtcccgcaggacgacgcgctgttcccgatgctcaccgtggaggagtcgctggtgtacagcgcgcggctgaggctgcgcggggcgggcggcgggaatggcggggcggcggtggcgagggcgagggagctgatggcggagctcgggctgcggcacgtggccgggtcgagggtggggagggtgtccggcggcgagcggcggcgggtgtcgatcggcgtcgacctcgtgcacgacccggccgtgctgctgctcgacgagcccacctcgggcctcgactccggctccgcgctccacattgtcaagatgctcagggacatggccgccgcgcacggcaagaccgtcgtgctcaccatccaccagcccgggttccgcatcctcgagctgctcgaccgcgtcgtcctcctcgccgacggcgccgtccgccaccacggctccctcggcttcctcgaggctcgcctcgccgcctccggccacggcatccctccccacgtcaacgtcctcgagtacgccatggagtgcatcgactccctcaagcccgaggtcaccacggcggacgcgagccacgcggacgccgcgtcggggtcgtcacggcggcgcgcgagctccgcgccgtacgcgaactcggcggcggcggaggtgtgcatcctgtcggcgcggttcgcgaagacggtgctgcggacgccgcagctgttcgcggcgcggatggcgcagtcgctcctcgccggcgcgttcctcggcaccgtcttcctgggcgccggcgacctccagtcgaggctgggcttcttcgccttcaccctcacctacgtcctctcctccaccaccgagggcctcccggtgttcctccaggagcggcgcatcctggagcgcgagacgtcccgcggcgcgcaccgcgtcgcctcctacgtcgcctccaacgccgccgtgttcctcccgctcctcctcgcgtcggcgctgctgtacgccgcgccggtgtactggctcgccggcctcgccagggagcccggccggttcgcctacttctccctcgtcgtctggctcgtcatgctcaccgccaactcgttcgtcgcgtgcttcagcgcgctggcgcccagctacatcgtcgccaactccctcatcgcgggcctcatcggctgcttcttcctcttctccggctacttcgtggcgagcaagaacatccccaggtactgggtgttcatgcactacgccagcctgttcaagtacccgttcgaggcgttcctcgtcaacgagtacggcggcgcgcgcggcggcgccgagtgcctcgccgaggtcggcggggggctctgcgtgctcgacggcgccacgctgctgcggcagcaggggatgcgggcgagcatgcggtggagcaacgtcgccgtcatgctcggcttcgtcgtcggctacaggctgctctgcttcgtcttcctctggttcagatgccaccgcatgaggaggtgaagcgcgccaaaaaaaatgcaaatagtaattgctcaatctgaattcgacattttttttcttctcttttttggctgtgcttttttttctctgagacattttcatcttgggttcgagtaggataatacgaattatatatatatatatatatatatatatatatatatatatgtaattaaattgtatgtatgggagatattgatcaaattctggtggaattggatgttcttatgtatgaaaaattgggagaaataatttgatggtcaggtggttttttgtttgcttgttactttgtgattgtgtttttcaagtattattaatttatttatcattgccctttttgtttgtgtccttttccaagtatagggaagaaactgtcgcattcgtgttagatttgccattttgatggtctcttctagaggtagatgggaaaagcaagattaagatgctaatcatatgaggtgagacagtgatgacaaaggtcaaagtacatgcagcaggttggaggcatgcctaatttgcacctgttttattgaaacaaaaagggtagctctgctagaaaatcaagtgctaatcaattgtcaggacgcagccattttcctgtttcttacccaaaaatcttccatttctgcattcaaaacaaaataagctaatcatattgtattcgttaagtggaggaaatgaataatgtactcctatccagggttgagattcttgatgtcttgagaagttctttttttttttcaactgacgaattcttttcaactggg

SEQ ID NO: 48678 - DNA, 5280 bp, Oryza sativa
attttcctcatgtttaaaacaataatggctgtcaaattttaaagtttacctaaaaacatacaaacgacacgttctcaaggctagtgaaagtagctcttgtgaatctcaaagaattttcattccgagatacatacgagggccaacagcccaatattaaccaaataaaaaggaggtgtcactgacgtggtgataaagttgtatgtaggtgattatagcttcgcttattattgtttaaatctggatgctcataaatattacgcacataccggtgaagttttattagaattttagtaatactaggtagttgccataggtctccatctctataagcgtgtattactatattatgaatgtattcgtgggtgcatgagtatggtgttacgtctagtggcgtgtacgtgcatatgtttcttttgcgcgatctatgtattctatatcgttgaaataaaaaactaaatatgcattaagccacaccacctaaaaaaatcttgacctttggatcatcaattagagagctaggaggaataagatgatgtgaaactaaagagttataaagacatttagttctcttcggttaacattcattttattgttgtaattacggtacgttcgtgtagcttcaactttcaattgaaaaactattgggcatataagtgaagagctttaagccatttatggtgctattcattggtagtagaaagaaatattaactattgatcttatttgatcgaagagtttagatctatatatatcaccttagttagaagtaatagaaacataaagaaacatcattgttaaaaaaagtgtggagaggcataatcatcatttagcagtgactaaacatttttccacatttttttgggctttttcgatggaatatgagcgatgctagggtaatggattaccacatatcgatctagctgaaaaaataaacataaataacaaacttatccttaatcattgaactaataaattactgatttataaagtatattaccagtagagagcaccgtagcatcgctcatatttctgttcttttgtatattttctatggctcgtgtatcttcaaaaatcatttatctttacatagtagcaaagcacaacataccatctatcgaaaaggaaaaaataaaacatcaaccagctgggaggcttttgattgacgctggccaaaagcacaatctttttttttcctctctgaagcagcagaaagtgaaaggattcagaaaacacaccttattgtgtcgtgggcatggtggggtgtaccgcacatgtcacaccgtcaccgcaaatggcatgaccatgttgagcttaaaattttgctacaccaaacatgtctgcatatagctttccaaaacaaattttattccaaacagtaattcatggagctaaattcatacattttgacttttgagtatcccgttccagtatttacaaactatactgcatgggtggcatgcactgacatcgatctcactctcgtattcccatccatcccgagaaaatggaagcataaacttcacgtgtaacgtaaaactagaaactactgttgaataaagagtactacctccgccccaaaataagtgcagccgtggatatccgtgcccaacgtttgaccgaacgtgaatagtataaaactgtatttattttgggacgaagggaatagatgtttaagatttatctacatcatgttatatcacgagtaaaaattttatttattatgatgtggataatttttagatgtcttttttttaattcaatggtcctttacatgtttgcgctagctacttaagctatacatatttctccatgcatctcgaccatccggtgcaccgtgcacagcgtacgtcccaaacataagcagcagcatctcttttttttttttttgaagcagatcaaattttcaagcagcatctcatcagtgcgcggcagcagagagaacgcggggtgctgctaactcgccggctaaaatgtgaccccgggtctcctaatatactttatttgttttaaaatggttgacgccgttaattttttaagtacgtgtttgatcattcgtcttattaaaaaaaaattaagtaattatttattctttttatattatttgattcattgttaaatatactttcatgtgcacatatagttttacatatttcacaaatttttttaataagatgaacggttaaacatgtgctaaaaagttaacggtgtcaaaccattttaaaacggaggccgtcgcccgtcgccatcgtcgtcgcgatgaagaatgcggcgccgttggctttgcggcggttgcccgccactacggcgtgcaagcatgcatgcaggctggtcgatcgatcgcccggcacgcgcggcggcggtgcgcaacagaagtaatgctccatgccatgcatgatgcatcgatcctctgtacatcatcatccagcagctaggattgcattcagcgcgtggatgagtggatcgaatctccgaaatggaacgggcaggaggggtccgatgaggtcggcgacgatgcatgttgctgtcgatcgagctaattctagccgataattccattggccaaactctttgtctgcacaaccaatgagcgatcagtcatcagttggctgtgttcgttttggtgtatggctctatatcgttgcgatcagatcgatcaaatgatggatgatgtgaggaggagggaaaaaaaaggaaaagggacccgagtcgctgtcgatatacaccattatcgatctatatctatatccatagatcggcgatggtatcgatccaccattggctagctagctcctttaaacttgcattgcgttgtacgcttaaattacccgtttggtttccaacccaattatgatgggagccgaatagccgatctgcctccctctgctggtgcgttgcacacacgaaggtcaaaagttttgagccagataaattgacggagattacgctgcgtgcgcactggcgcgaaaaaaagaacagattggccagagtgccagccccagataaataatggcgcgctttttgcgctttttgttgtgaatgtgatctatcgagagcgagaagaaaaggcgcttcgccattgtagtcggctgagtggtgtctcacacacaatgctttcatgtttcatcaacaactcggaggacatccgtgtgtgatgagcaagatatattgatattcctttttttctaattaaagtatgttgatcaactgtagacttaacctgctattattgcaccgttccacctttactgtacatccacctcagcattagtcacgctccatatgataaattaaatatttataaatatgaaattaacaaatattagctccgaatggttcaagcaacacaatacgaaaataatttttttaaaaaaataatttaagagacttgaagcaaataatccgtgatgataattttgtgtggtagctaaaaagaatgaggtcgacgagtgaaatgagcaactataatgttgtactcggtgggtgtcaatgggtgtaaaatgaggatgtgccatcggggaaaattaattatttgtcactattggatttaacaaatcttcaaatattcctctcttaattttgtcataacaaaactgccaataggtagagttgattttttttaactatttgcgaattttgcatgtgcggcttaccaacgtgaaaaatcaatgtgggatccacaagttagctctctcctccccttcatcacccccaccagccagacaaggtagagagggcagcagtggtggaggctcgacccaaaaacagttgctagctcagtaggcgtaggtagtggtgcggcaagggagataagggtggtggttgttggggggggggggggggggtatttactcgggccatcttagagatgggagcaatgaagcgagggagcccatgatgctggcgacctccacatcccagccagggacccgttgtagcagtctctagatgacggggcaatagggagcaggttagggggtcagcttcgtgcaaaggaggcccgacgtggaggtaggggcctcccattccgcgatctggcagatgacaatgcaaggccacccttgagcagcgagcttgggaggccttttcatgtcccaacagagatgattagggctttgagtgaagatctatgtggcacgtcgtgaatagcagaggaagccagaggcagagcatgagaggctacaacggtggtcagggaatgtgggatggagcgggtgacgttgacccagatccaaggacggtaagacattatctttctattggtaatttcataagtttaaaattgagggtcacttagaaagttgctaaattttgatagtgacatatagttaaatttcccttgtcagcaaagctaagttgcccatcgtcaacatcagaaaatttgtaaatggattaattataaataactacagaaagataaagttttgaaaaaaaaaagaaagaggaaggtatacttttttttttagaaaattataaatttaccactggtttgaatcggtattataaaactgatataaaaaattaaaaaatattactaaaactgtcattcgagtggcaatgccctttttttaagagaaaaggaggaataagggatcgagacaaattacatttcttggcctcttgggccttttcggctttcccctcccatggtcttgagacttgagaggagagggcaagcgaggttgggccggaagtattcacaccagttttggcccgttccagctaggaaaaaaacgaaaaagtacaccgaaggtccctcaacttgtcatcgggataaaaaacgtccttgaaccgcaaaaccagatatacggggtcccttaaatatataaaaccggtcacccgaggtccttcggtggttttgactccggttttggtctacatggcggctgagtcagcgtgggacccacgtgggtcccacatgtcaggtgtccacatcatctctctttactctcttatctttcccttcctcccctctatctctctctctcgggcagggccgatggtgagcaggttgagcagcggcactgcgacggtggtcggcggcgacagcactgccgccgcgcacaccacgcctacctcgccgctgccgccacgaggcccgaggcccccattgcgtcgtcccccaatgccaggctctgccgcctcatcgcccgcgacgacctcgccgaggccacgcgcctcgtcgaccgctcacgcggggagacacccgacgccgccgtcgtgaagaccaacgccggcgaagtccatgagccgaagcaccaggcacacacagccatggacggc

SEQ ID NO: 48679 - DNA, 2568 bp, Oryza sativa
taccacgagctctagcaccagcccgttgtagtactggccgataagtacgctcaccacttcaacgtcgtccatggctgtgtgcgcggccaccgccgccgttgcagtgccgctgctcaacccgttcaccatcggccctgcctgcgagagagagagagcagagaggggaggaagggaaagagaagagaggaaagagagatgacgtggacacctgacatgtgggacccacgtgggtcccacgctgactcagccgccccgtagaccaaaactggagtcaaaaccaccgaaggatctcgggtgatcggttttgtatagttaagggaccccatatatctggttttgcggttcgaggacgcttttttatcccgatgacaagttgagggaccttcggtgtactttttccggaaaaaaattctgctagatgggccacattttcccaacaaatatcgggttcggcctctaggcttccatccacgaacgggggctctcaccggcccagccgccgccgacgcgctctgctccgctcactctctccccaccgcccaccgcatccgaagcacgcccctccctctcggtctcgtcgccgccggtgcgaccgcggtttcctcctccccgctccacctccgcaacacaaccgtcttcgagcctcgggcttcacgtcgacctcatcggcaattcggcaccgcaccctcccctccccatcgccgggttcgccttctccgcgcgcaactcgtcgcgtcctcgagctcggctaattaacgatacttttactgattactgaagcggttaacgacaagtccaactaacaaagtcgtcgggttggtgtcagtggcccagtgtgccacctactcctcctactcaaagcctcaccgcctcagcatcgcacgacgcctaattaatcaattcctctcccgcgacacgcgcgcgagctcaactgcctcgcttcctccctcctcccgatcgaccgcgccatggctgccgccgccgtcaccaagtcgccgccggcgctggtgcccccggcggggcccaccccgggcggctccctcccgctctcctccatcgacaagaccgccgccgtccgcgtctccgtcgacttcatccaggtcttcccctcctccgccgaagccgccaaggaccaggccgcatcggtcgccgccatgcgggagggtttcgccagggcgctcgtccactactaccccgtcgccggccgcatcgcggagccggtccccggggagcccgagatcgactgcaccggggaaggggtgtggttcatcgaggccgaggcgagctgctcgctcgaggaggcgcgcaacctcgagcgccccctgtgcatccccaaggaggagctgctccctcgcccgccgcccgaggtccgcgtcgaggacaccgtgctcctcgcgcaggtacggattccatcacccattgttacttgagctaaattttccactgcaaatttggtctggatctgactcctgagaggttgggggttgtggatctgtgggggtgaggagggttggtcaccattgctatcgttgactcggtaatgtggggatgtcaatggcggcaatggtgtgaaaggaaaaggtctagctgaatttctagattgaacttgctgcaactgctcaattgtgtgactgactccactctgcagacagtgtgactgaccaatctgaacttgctgatgacttctgacttgctttaagacgtagtactactagcataaacttctgacttggtgtatgtatacagtatcacgcactactgatcccaagtgaaagtgatctatagctccggtggcgcggtgaggtgaactggaccgcgcggtgtgtgtccttccctcaatcctcatcctggtggcacttctctcctcgccttctaaccgttggatggatggaccaaccgactggatcatccgacactctcgtagtcttatgccctgcttgagttgcattacccgactttgaaccgcacacgctcctgagtcctgaagtgtttctgggagatatattaaggccctcaacgaaatttaacaaaacctttgacacaaactgctcaattcctgagtcctgaagtgtttctgggagatatattaaggccctcaacgaaatttaacaaggccaatcacactgtctgctcaatttctagattgaacatacacatatttgacacaaactctaacagctagacaataagccttggaaaattttgtacaagatatcgaaagcaacagatgctgcaactgctcaatgtctggacaccggaattttcatttttgcttgctgctgttagtgaattccatagttccaagcttgcatgtgacgaagagatggtctcatgatgacatggcatgcctgggctgatccaatctgttaggtagttcatgagaattgatatccaaccttgcaaatcattgccatgctttctcttccaagcttgtgaggatgagggttcacatagtactgtcctttctacctacatagcttaattacattcaaggctgcaaggatgaggatgagggttcacatacccctaatgctttttggatactatgatatgatactccctccgtcc

SEQ ID NO: 48680 - DNA, 15569 bp, Oryza sativa
aactttctgttctaagttcagtgaaattttttcatgttggatgctaaagaagtactaagtcgatgacaattttcatgtaaatgttgttcatgccacacatccttggtaccactacctgttaaaatagtctgacactaagttgacattgtaacatggcctgtattagactagttactgaatttgcatgttctgtgatttgaatgattagtttttcaatttcctttccttcagattacgaagttcacatgcggtggatttgctgtgggcatttgcttcagtcacttggtgtttgacgggcaaggtgcagcccagttcctgaaagcagttggtgagatggcaagagggctccctgagccatcactcaaaccaatttgggccagggatgccattcccaaccctcccaagccacctctaggaccacctccatcgtttactgcattcaactttgagaaatccgtcattgagatctcgttggatagcatcaagcgtgtcaaggaccaggtcgcaagtgagaccaaccagaaatgctccaccttcgatgtggtcactgccatgatgttcaaatcccgtactttggctattgactttgcacctgatgccgatgttcgtctgggttttgctgctagcacacgtcacctgctgaacaatgtgctgccttcagtcgacggctactacggtaactgtgtctaccctggtggcctcgccaaaaccagccaggaggtcaaggatgcgtcgctcgtagagattgtgacagcgatcagggaagccaaggatgtgctctcgacacggttcctcgattggatgagcggtggtgccaaggagaaccattacaatgtgtcgctggattacggcacactagtcgtcacagattggagccatgtcgggttcaacgaggtggactacgggtttggcgagccgagctatgtgttcaccctgaatgatgatgtgaacattgtgccgtccgtcgtctacctgaagccgcccaagccgaagcagggaatcaggttggtgctgcagtgcgtggaggctcagcactccaaggttttcggtgaggagttgcagaagcttgcatagaggtaacttcgtgtttatacgcctacacttcgcagcgttgagagctgttgtattctggtgtgttgaatagccgcttcttgaacttggttacaaataaaacaaggtggatcgtgtttgtattctgtattgttgttaccatactacattatacattgattgacattgttgaggcagtactgttacagttgagaacaaatgattccattgatttcaagaatttgtacaatatagtcctacatgaacattatctttcattttccacctatatggtcaagcctgagacggcctatttgtcattctgtggatatacgcaggaagatatttcacatgtcgtagtaacatcatatgcctatttaccaccaatctgtgaaacctattcataactctgtgtgatgaaacattctcagtacagtgcagtcagactagcatcatggctttgtcttttggcttattagccacaacaaaaatattaaaattttaaaacttaattttaaagtctacctttaggcttttcgattgttgtttattttccagcattagtttttaaatcactaaggacagtttaaagatacacaagtttttttttttgggtaacgatgaaatcattagagtttagaagactagcccttgatcatccagcttcagtagtgttccaagttcgtcagggcccgatggagctcagcacctgagcagattcagaaatgaatcttaggggggagaacagtaagaacacatgtatggtcatgtgaagtccactaatcttccaaccacgaggagctaccaacccactgaaacactgtcctcagtttgtcacagatcagatctaatcatctatacctaacaaaaatgcctgaaaattccacacgagaaaaagaaaggcaaaaaagaagtcaaccactctcactgagcattgagagctcgtgctcgccacttagcaacaaccacttccattcattggggagggaaagcggcaaagcaccagcccagccagcgcggcgccaaactccacctaccgacgagagagagagagagagagagggggagggcatggccgccgccgccgccgtcgccgccgtcgccgccgcggccgcggccgcggagcccaccgtctccaagtcggcgccggagctggtcccgcccgcggggcccaccccgcgcggcgcgctgccgctgtcgtccatcgacaagaccgccgcggtgcgcgtctcggtggacttcatccaggtgttcccgccggcgaccggcgggcccgcggcggacggccaggaggacgccgtggccaggatgcgcgacgggttcgcgagggcgctcgtgccgtactacccggtggccggccggatcgcggagccggcccccggggacgtggtggtggactgcaccggcgagggggtgtggttcgtggaggccacggcgagctgcacgctcgccgacgtgaacaacctcgagcgcccgctcctcatcgccaaggagcacctcctccctcgccctccgcccgaggagaagctcgaggacctcatcctcatggctcaggttcgcaccatctcctccccaattcccaattcccacgatgcagctgctcgatcgattgatggttgaatccagcgagagaaattttaggcgctgattaattcgagatcttgttgctttgcacaggtgaccaagttcacctgcggcggattcgcggtggggatctgcttcagccacctggtgttcgacgggcagggcgcggcgcagtttctcaaggcggcgggcgagatggcgcgggggctcccggcgccgtcggtgcccccggtgtgggaccgcgacgcgatccccgacccgccgaagcccccgccgcgcgggccgccgccgtcgttcacggcgttcaacttcgtgacccaggtggtggacgtctcgccggagtccatcgcgcggatcaaggaggacttcagcgcctccccgacgggcggcggccaggcctgctccaccttcgacgccgtgaccgccgtggtgttcaggtgccgcgcgctcgccgcgtcgtcgctccccgacgacgccgaggtccgcctcgggttcgccgccagcacgcggcacctgctcgccggcgttctcccggcggtggacgggtactacggcaactgcgtgtacccggtggggatcgcccgtcaccgcggcgcggtgcggggcgcggcgctggcggaggtggtgggcgtggtgcgggaggcgaaggaggcgctcgcggcgcggttcacggactggctcggcggcggcggcggcggcgaccactacgacgtgccgctggactacgggacggtgacggtgtcggactggagccgcgtggggttcaacgaggtggactacgggttcggcgagcccgggtacgtgttcacgctcaacgacgacgtcaacatcgtcgcgtcggtgatctacctccggccgccggcgcccaagcgcggcatccgcctcatgctccgctgcgtcgaggagccgcacgccgccgccttcgccgacgagctcgccaagttcgcctagatatacgtgccatattgccatgacgatgtgtgtaaggatctcatctcatatcatttgggtcacaagttcacaaccctgctgctgctggtttgtgcatgtaaaattcgatcaacgttggaattcgtgacgtttattcgtgtcttaacgagacgttatgtcgtaactttggcgcgagagggaataaaatccagtgaagtctctggtttacatctagtcggactatcaccgtttggtataaccgatttgagatattttggtgtgtgattatgatcgttcggacagcctattctgcgaaaatgctcaaaatgggacgctccccccccccctcccgcccccgcgcgcgcccctcccactcgcctccaccattcgcgtctcgttgcaacaaatctcccacatattacagaaacaccctattaagagaaatccggttttttttcaccaacaatgttttagctaacgtactcatgatattttattgtgtatggatgaaatgatgttttattgtgtatggatgaaatgttacagtggattttgttatagtttcatattttcatcttaatgtacacgtggtttgttgatgtacacggggtttaagtattgcagtggcttttaattgtttgttgcatacgttgaaccaaattcttttatccagtgatcttactgtgtttcactacttttttttaagaattaaaatatttttttcgctatttactgaaacattatttttatatagggtgaaacaacggtcgattttttagaaacggttgtttcatacgttgttggtaatgtttcagctttttacaaaattgaaacattttcgacctacttagtaaaacatgttcgatctacttggtgaaacagcgaccaattttttttttaaaaaaatcgggcgcctaatttgtaggcgcctcgcctattctgcaatcgcttgcaattttgggtggttgtcagtcgattctgtgcgccgtgaattatgcatccaacggcatgctgaaacacaaaaaggaaaaaagagcttgcgcaaaaaaaaaaacgaatgaaggttttgggcccatagtctttttgttttggactactttgggctttgggctttgtgtagtgttttgggctaatatctgggccatgtgagagagatgcactgtgatcttctctttgactggtttgcatgcatgtgcctttgggattttgtcaaaatattttgggcttataatcgtcggcaggctgccgtgacttccgctctgagtgaacaatataaatctttggctgaaaagaacttttaatccataaaatcgaattagttttgtttcatgcatctgggctttgggctttatgacattatgtgttgcctctcaagacaaagcaagacacgtgaagggtgaagagaggcaggaccaaaactcataccaagagacacacccatatattccagatcaaatgcactatattggattagaggaagcaagaggatcaggtcgatcgaaaccacagggacaaaatcagtagaaaatacaaatcatcagatgtaatttctattttttggttgatatgtagctgcttgatctgtctgccaccgctcttttttctgttgtagttgaaaaaagttccagtcctctgaaaccaaaaaaaaaaaaagggacaaaaaatagtctcagtagtgttgttttggattggatgtctgattccatcaatatatgaaatgacaatgctttaggatctcatttgcacttagtgggtcataactttatagattgaagggattatggctgaaatgacaatgctaaatgcaaatgatcgtgagagattcatgaaaatatatcttacaaattacaatctcacatgtgcgcatgttggccatgaaactgtcatacgtacatgcacatactatcttctttatttataccttctttatttatcacattacaacatgcatcagatatatataaaaagcaaggacctttcattattgtatcattacacttatagctagacacagcttaaaactaattagccaatcttgggaatctcggccacagtgtcgacccagaggatgacacggttcgggacgaccactcccaggatgatggttcctactgggagcacctcaacttggaggtctggacggtcagccttgattttcgccttggcctgctcgatggtgaggccaactagctccggccactccgtcttaagaccaccacatggcttgctgtctgatgaactcattctggtcacagcaaattaatgaagcaaaattcctgcaaatatagctaggattaatttgttgttgtgtacacgcaaggcacttaattcgaaacactctttcatcaaattaagatcagaacaggtacttacaaccaattgaaactgcttgctatcgagactgaaacgggtgttattgtccagcagaatgatagatgctctattgatcgattcttaagttgtgtgtgcgtttggtgtatgagggatggagttgtgtggtgtatttataagatgagaaaagaagcaaaacgtgcaatttttcggtgccgttaatggataggcttcccagtttgctgagatgagatatacttgtagacttattaatccttctggactcagaaaattcacggatgtaaagggtggcacgtgtgtgtggtggagactctactagtcagagaaagaaagtgtcaatttgttaaggtagtactcttctgcatataccacttggtgcccagatttgcagaaaacgatatgattaataaacattttacaggtcaaatttacaatgtgcaacgtggatataaatatgattcattggatcatgccattgtaacttcttcaatactaaaatataccactacaatttatggaattttagacatgcttaatttaataggtatttcaaatatgccactacatgtgtatttcttcgatgaaccaacttgtccatgtcttcttttttttttttcatcccctcctcctgttcatcttctgcaccattaccatcagagatggactcggccagttatcagcatggagctatagcttagagcagcactgcagcaggcagccaaatccatccaagcttgttgccgctgcctgttaaatgcatcgaatagctaagcactgacatatcactaatgcttatttttggttctaccatgattatggtttcatttcctctctgcgccacatagctactactattatttagctcgaaattaattaaatcttcctagctccaaatgcgtttagaagaattaattatactcagctctatatgtgcaaggttcatcgtcaaaattcaaatctgcaacccacaagtagccacgcaccatatggccaaatgtccccatgtccaaatcgttgaatatgcatccaacaacccctctacacgtgggtgcacatgcatgaagattgaagcctatccactaatgactagtccacgtaccggcccgctttgaaacttcgttatttacacacgttgctcgatgtattggtgtgctgtgtttttttttagaccaaattgctccgttcatatggtcctataaatgcacgcatatacgttacacaaatccaaatccatatccacacatcgcggtgcaaaaccaaaacccactgcagagaagaagcatcgatcaattcaagttaccaagtacgtactcctgtctctaccgtatgtgtctacctgtttaggttctttattatttgaatctacacatgaggagaggttccgttttttgattagtggcgtttggagtcatcgtttcgcttattcacggcatatttgtaaagaaaaataatttatgaataaaacttttatgtgtatgttcttagcgatttaaaagtaaaggctgaaaaataaacttcgataaaaaaaaccttgaaatcagctccaaatttaaggttaaaaatttaaattttaattaataagcataaacataagcgaaaagatgaggctctaattaaggtcccatttgcaacaattttaaagaacaaaatatgattcaacaagtaattaacatagaaaggtgtttctttgatgatctgaagatgcagtaatcatgaattaaccactcataatttgcaggcaacttggatcttctcgattgtttccttgcgaagatgagttcctcttagacccccaagacggagtggcccgagctagtttgccggacgatcaaggaggccaaggagaagatcaaagcagaccgtccagatctcaagattgaggtggttccggtaggcaccatcgtcactcaagagttcgacgagaatcgcgttcgcatctgggtcgacacagtggcaaagacccccacaatcggttaagctgaaaccccgatataggcatacatctagcaagtgtacgtccatgcaagtatttctggatatggtccagtatgataaataaataaataaataaataaataaataaataaagctgtgtatgagcgtgtgtgtgctcatgcatgtgtgtgttcacggttagcttttttttttttaaattcttgcatcaataaaaagtactacggagtacgtatgtactctttgaacaatgcgttatacgacaaatgagatgtgtgtcctcaatcgttttatctgaaaagatatcagcataagtacaaaattgctgctgtttacaacgtttcttcccatctttacctctttttaacttgtactgcctcctttcccacgcacacgtttctcaaatcgttaaaccgcgtgtgtttttctaagggtaacaataatgtatataacaaaaatagtccatataaatgggacctatgtatagagcttttaactattgtatagtgctactgagtcccatcgccgccgcgctcagtagcagccacggccgcctcccaccgccgccacgcgcagcagcagccgagtccttatatacataattaacaggttgtcaatacgtaaaaatcctcctaaatttgtatggattgagacattctttaggaatctcatatgattcaatagtttccaattctttatttcaaagggtcatatagtgaaagtgcatttatgcccctagtgggttttggtttattgatgacaaacgattaagggactaatgcacttattgagtgtataagcaagtgattagaacaatgaagaagctaggaaatagacttatagatggatgagaattaaagagaagatattgaagatgcgggtatgaagtgactacctatggcaagatggtgaagcgcaagcgacgcttagctacaatggaccatgcagtggtgaagggcaagcaaggggcttagcgccgacgaaccgaaaccggtggtgaagggcgagtgaagactgtgtcgtgatgaaccgtgcgaggccatttgaagccatggattatccgtattaatcatttgagaaatggaagatgaaatgtcaaagatcaagaagatgagatcttcccaatgatcaaatgaccttgacgttggtaaccctccaagtgaagaaacaatatggtgtgaaggtactcctattggtataactttgctttttaaatttgagtttaggatgccgtactattaagagggataccacatgcatataattggttgaatactagtgctcaaaatgcttcatgtttgtgtgagttgaaaaacctaagccaaaattttaatcccgagttgtttcacttgtcacaacacttacatcgggtttcattgcaagtttttcaacatctcttgaaggttttggaccatgttttatattgggtttgatagcccacgaaactagctttccatagagtccaagatcttcgaaatcggagttcggagtaaaaagttattgcatttttacttgagcagatgtatcggactatccgatttttcacagaacttcattctctgtctttgtttgaaaaatcctttcgagtgagtttttctaagtgtcggagtatcctatgttggatcagatagttcgatgatacagagactccgaaatttcatagaacttgagtctctgtttgaggacgaagtttttgcttctaaaatatcagatactctgatttaacatcagatagttcgatgtctcggaaagtccgaaatttcatggaacttcgttctctgtttctcgttgccttgaaggtttaaaatatcggattatccgatcttgtatcggactatccgacgtgggctgaaagattcccctccaacggtcacattttgggggatctatataaaccccccaccaacccttttctagggttgcccaaactgatttcattccaatcttgctttgggttgagctttgtgctaagtgctttggatctttgagctctctccctctctatctcaaatcccccttgttctttgtgacttggatctttgtgtgtggatttggtgtttgggagcctagtgtgtgtttctctttatcttgagcactaggatttgtccaagagtcgtgtggtgtttattactcttggaggttgaggattcctagacggctaggtgtcgttcttgggccaccgatctacgtgtggttggccaagagaagtttgtgaaggccggatctcgcctccgcaagaaaagagatacccttagtggaaggaggagtgcatttgtgcaacctcacgaggatagggttgaaaaagacccggctctttgcgagcccctcaacagagactagaatcccctcaaggatttgaactccgggaaatacattggcgcgtaaacctcggtgatatgctcactctctttaccttcttgtaccattgctttgtgctatgctaatattgttattggtcgagctcacctctttgcttgtggattgaatctagagctcttaggttgttctcttgtttgtattgttgttgtgcaggtcagatagtctgatctcagttcagactatctgatcacataggactatccgacctgatatcagacaatccgatcctgttttgttttagctttcgcatttatttaaaaaatcgcctattcacccccctctaggcgacatcaagatcatttcatataggaaaaataaatcctatataggattataatcctaaaaaaatacaaaatacctatacttttcttttaaatcaaagagcctaaatgtcttgtaaaatacacttgcagaattatgtttggcaaaattttgattttttttctttggtttatgcaaaattggtcctaaaattaaggggcaattacttatttttagtaattgaccctgtttcgatacctaactaccaaattaaccctaattaaccctacttttttgaagtttgcttatttgacccttcttttcaaaaacgaatgtactatctgaccctaatccgttaaggtgagttaacggtgttaagctatggacaaattatctcttttgtccttgcttatttgaccatgttatcaattttgaagaattgaggtgaacaattcaatttgataaatttgatatcaattttgacagattgttgacacaattatagaagatttttaaaaaatttcaacagcatattatcgtattttgtgatccaaaattgcatttaagtaagcatatacacagttaaagtcaaatacaacaacaaattcatgtccaacaaattcaaggaagaatatacatagttaaagtcaaaaccaacaaccaaattcatgtccaacaaattcaaggaagcatatacacagttgtagctgaatccgcgctcccaccaccaccgcgcacaccagcaaccgccgacatcccgctgccaccatgtgccacagcagaagccacctcccaccgccaccatgcacagcagcagcagtcgagtcccgtcgccgccgcgctcagtagcagccacggccgcctcccaccgccgccacgcgcagcagcagtagccgagttccgccgccacgcgcagcagcagccgagtcccgccgctgccgcatcagcagcagccgcggctgcctcccaccaccaccacactcagcagcagccgcggccaagtcctgccgccgccccgctcagcagtagcctcccaccgctaccccgcgaagcagccgcaactgactcccaccgccgccatacgcaaccaccgtctgcgcggatcccctacctccctccacggcctgccaccgtcgccggtgctccctccctccacagccggcaccgcagcagatccatgcccctccctccctccacggtccgccgctgccaccggtgctccctccctctaccaaccggtgccaccgcttactaccgtgcgttgccgccgccactcgccgggggaaagagagaagggatacgagagagagagaatgatatgggatgggatacacagagatgtggataaggttggagggtatttcggtcactacgaaaatttattatatttatttttttaaaaaaatgattcttaacggtgttgtagaagcagggtcagacggggtgtttgttttcaaaaatcagggttaaatagtagggtcaatttgatagatagatttcataatagggttaaataagcaattgcctctcaaattaaaatttaaaacccaacaaattgtaaacatactgcctcaccagtcacaaattgtaaacatactaccacctcagcttgctaggcgtattatattagctggaatcgaactcttccacgaaacgaaacctccaaagtttttatacacacgccaaagcaaccatccgattacagtttacagattttaatttcgaaggagagagaaaaaaaaaagaagggagagctcgcagtcgcagcgccggcggagggagaagacacggcggcgatggcggcgcgggcggaggcggcggcggcggcgccgcggccgctgcaggcggcggcgatcggcgtctgcgcggagacgggcttctgggacgcgctccgccgcctcaagctggacgtcctcggcaccgacgactcccccatccccatcaccggtgcgaacccctcctcctcctcccctacctttgcttttgttgttcttagttccgatgttttcttccccccgaaaacctgccgtctcgagcggggaacgggaagcgtgcgtatccccgcgtctcccaggcttcccccatggaattcggacgcggtggtggttcgtcggagcgattgttaagagccgtattgtttgcttatgggtggcgatgccgagtgtggatgcttgtagattaggggtttcgctcgcctgagttggtggtttgtgagcggaatattgtttagggagaggttgcggcgatacgaggttttcctgaatgccacattgagttggtctccgtgcgggagttcatgattttgtcgtcgtaatgggtgtatagtaatttggattttagaacttcttctgttgtttaatgatcaatttctagcccgaagccctactgtttgttgtcattactgattgctctttctgcaatattgctgttagcacccaaacagtgatgtatttcagattgtctgttgagaatcctaagagaagtactagcaattagcaaatataattcaaattttgctaggtcattttggttttttagtttggtcgtccatgtgttgccgtgtgaatggttttttcatggtttgatttctcaatcaactgaacaagtttgctgaactttattgctaggttattatactccacgccaatatgagaaaattgcaagcctctttaggatatgcccagaatcgatactgccaccttctgccaattcctttggcgataggaacaattgtccagtcccagggaccctactaaacactaataacatgagaggattccaaaacttggacagagcacttctactgaaagctgaagcaaagaaggtacatgcttgacatggaattttgctagcattaccactaacactactagtttcttaaaaaaaaattaaagcatgtaatatgtgttgcagatcttgcatgatattaaatctggcaaagtagaagagaatcctgctttgctactaaggttccttgtgatatcatttgctgatctgaagaattggaaagtatattacaatgtcgcattcccctcgttgatttttgactccaagataactttgctcagcttgaaacttgcctcacaagtgcttaagcaagaagaggtcatgttcctttgaaccttatagaattacagttgacaaaaatttttcttgttttaccatttccttgttggcactaaagattgttctatttctgcaggcaacatccttgtctaatgcatttactgagtggcgtaaatcaagtgaaacaccaggtttgagatgaatacctaattgggattgttttacttggttatgtcacttgatgcctaaactgtattatattgaaatttctgcagttgttccattctttctgatcaatatatccccagattcatctggctactataagacagctgaaggattggaaagcttgccagggcaatggccagaaggtctgttttgtgcaatacattttgtcatttcatgttttttaccagatgagttctgacaagtgatttagaagactccttatttacctatcattcttcatgcatacctttaatttcatgtgctaatggttgaatttgctgatgcagttgctattcggattttatgatcatggtaatcgaggttttcctggatgggctcttagaaattatattgcattcgtgagcctgcgttggaagattgagaaagttcattttttctgctaccgagaaaaacgaggacgtcctgacatacagcagtcccttgtcggcgaagcatcatttccggcacctcatggtaatttcgtacatctgagaaaaaaaaatagggggaggggggatcctatcaaaataactagtaattttggaagcttttaaagctgacactggttatgctttgtaatagcaggctgggatgaacctgattatgtgcctgaagcaattggatgggaaggagaaacggccgggaaggaatcgaaagagatgaaaccgaaagaaattgatctttcttcaattaatccagcaaggtagattaacatttttttctgggatttggaaataatcagtaattgattgaattacctttgattgctttaataagcacagtcaagatgaagaaaaacagctgatgcacttgaagcttatgggatggcgccacttccctgtgaatcttgacaagttagctggggtccgttgtcttttgttgggtgctggaactcttggatgtgaagtcgcacgcctacttatggttaatgcttttagctgacacaagatttatgttccatttttatggttaatcataacagggcatttaaatgtgcgtatcttttctgctgttaatttatgggtttttttttcagacctggggtgttcggaaactaacagtggttgatgatggttgcgtttccatgtctgatctagtcaaacaatccctctacacggataaggattgtggtgtcccaagagtgactgcaatagtcccacatctaaaagaaagatgttctgcggtggtgagtctttgcagccttatcttaaaatctatgttgtttacatatttctctcatcggtaacaattgctatcatgcaggaagttgaaggcatccaaatgggaataccaaagcttgagtataatatttctgccagcaaaatatcaagtattactgatgattgcaagcgtctccaaacattagttgattccaatgatgtggtcttcttgttgaatgaaacatgggagggaatgtggcttccaactcttttatgtgcagacaaaaacaaggtaaatcgtagacaaccactctgtaattaaggaccttttgagtagttctcataagagagaagtgaatatcatgcacttttaggagatcaggcttgagtggcaaatctgtcaatagattgaccatgcaactcagtttagtattcttcgccttccatttttcatcacatagagtgcccttgggagtggaactaataatgagttggctccactgcagatagcatcactgtgtagcttggatatgacaattaccttgtcatgcgacatggtgctggtccacgaacaaaaagtggatgtatggatgaagggattgctca

SEQ ID NO: 48681 - DNA, 10821 bp, Oryza sativa
tgaaagataggtgtaaagggcaacatacatttgtatagcattgtctgtgatagttgaatagttggttgacctagtacatgagaacataaaaacaagatgatgccttatagaattttacttcttgtagaattcatgctccaggagatattgctggtacagacactgagcatcagcttggtctattgccacatcagatgcaaggatcgctctcaaagtgtgtcttgtcaactgtgctgtgcaattcctcaagcaactgtattgcatgttccaatgctgtacgtaaagtagaacatatgcaggactaaattctcataattctatttattctaatgtttctgcatgctattacaggttttatcagaatatagaagaagaggatttgattttgtaacgcaggccatcacctgtccaacatatttgaaagaccttacaggcatatctgatttgaaaaaaccatttgcttctaaaatttcagccagcattcctgtttctaaaacttcggccagcattcctgtaaacctagagaagctgtccagtgcccgatgtctacttttaggtgctggaacacttggatgtgatgttgctcgtattcttatggttagtctttgtccagttctacttttatgttgaactacgaacagacttaacaaaacatttctttgactatggtggaaacaaaacttttcaggactgtggtgtgcggaaactaacagtagttgacagtggtcgagttgttgtgtcgaatttggcaagacagtcactctacacatctgatgatcgtgacagcccaaaagcatcagcaatactagggcgtttgaaagagagatgtccttcagtggtaaatttcaattctgttccttcaaagcaatcttcattttctcacattcttgctccctttcatgtctgagcatatttcccttgtaggatgcaaaaggaattaaaatggaaataccaatgccaggccatcctgtatcacctaatgaagcagtcagtgtgcttgaagattgcaaacgcctccaggagttggtatcttctcatgatgctgtcttcttgctgaccgacacaagggaaagtaggtggcttccaacacttctctgcgcaaatgaaaacaaggtaattcttgtgtgtattcttcactaatgtagacttgtgaagtgttacatgataatatccctcgcaccgcagattgctattactgcagcattaggatatgacagttaccttgtcatgcgacatggggctggtccaggcacgaattgtggaagtccagatgtggttgctgctgctgatacactgtctgcagaagatgttcttggtcgtcagagactaggatgttatttctgcaatgacgtcgttgctcctgttgatgtaatgttgcctaaactttggaaattatactctttttacttaacatgctacattctgcaactgtcacatcattttccttaaccatcttgtgatgtagtccgtgtccaaccgaacactggatcaacaatgtacagtaacacggcctggattgtcctccattacatctggctgtgcggcagacctcttcacaagaatgttacatcatccagatgggtaagtgactggatacctgaacataatatgaacttgcgcgatatcatttccagggaaaatgttggcggcatttggtgattgaaaaaccaactgcatttaattgatctttactacattctgcaggatccatgctccaggagagattgctggcacaagcagtgagggtccacttggtctattgccgcatcagatacgaggatcactctcgcagtacaacttactaaccctattgggctattcctcgagcaattgtaccgcatgttccaatgcagtaagtaaacatttatgattgcatgatttggaacagtttctttagaacttctttcttgtattgtattgcttcttcctcatgtgatttggtgcaaaatattgcaggtgttgtctgaataccataggagagggatggattttgtgatgcaggtgatcaacgaaccaacctatctggaagacctcaccggccttactgacttgatgaaatcagcggcctattctcaggtcgagtggattgatgaagttgacgatgacgacgagatggatatatgacgtgttgcatgttttttttttcatgatgttaacacgtgtaaatacaattcatacgcatacttagtccatcagacgatgagaatggcgttcttgaatctcgaatagcctcttcttaaccaactagcaaatcacagtgtaaacattaccaatctctggtgcaacaaacaattgtaacctaggggaaaaaaatgtacactttgctaatattcaatgctaatgttgttcccattctcaattccaaaagagaacgttgtccccgtgttaaatcgcatcgttttctatgtttctacgcttgctggagctgcaccgtcgacggctgcatgcgcctcgttgtgccgcaagtactcggcgaggcagaacccgaataacgcagaaactcccgcgacgtcggcgcccatgaccagcaccccggcgacgggggcgacggcgacggcgagcagcgcggccaggaagccggcgccgaagacgagcgggaacgcgaacacgagcgcctccacgggcacggcggcgccggcgccggccgcgaggttctgcgtgacgtggtacgcccagaggtagagcaggaggcagagcacggcggccagctccgacgcgagccacagcggcgagccgccgtagctcagcagcatgagcgccatcgtcgccgccaggagcagcgacagcgagcacacgaaggcgtgcgcgttcgcgtgcgtcctctgcttcttcctctcttccgcctcctccttgctccggtcgccgtaggcgatgccatcgccgtcgccggccagctgctgcttctccttctcctccatctcctatacaggttggcttggctcgagttgtgcccgtgcacgagctccttttattgctccgagtccggagctgagctcgagtcggattgcatcccgacttactctacggattcggtggcaaaaataactttgaagctttcagcagaagaactggacagcaacagcaaaagaggaggtatattgtgtatccatctgttcttttatagattataacaagatagttactagctctctgtactgtacagcaactcatgtgccggcagaagtcacaactgatggaacatggaaaatcaaaggagcaatttgagtaacatgtggtatgtacaagatacatgattcacccagctgcctgaaagtctccgaagtcgtcgtccacgctctcttgaggggccttctctgctgcagttggttgctcctgaggagcagcttctgctttcggtggtggggaagaagcgacgttatccgcggctggttgttcatgagaagaaggaaattctgctttgaaaggagtggtatcagctccagtatcagcagctggttggtcttgggaaggaaactccgctttgaacggagaagccgcgatgccagaatctgtaggagagaccggtgatggcggaggtggagggagcttgagggaaactggggcctccttggagttggctttttcgttaaatgagagcttgttgaggccttgctcaaaaaatgcagattttatctttgcgccggactctttctgcacagaacaaaagcaaacccaaacattaaggagatgttgcacaagaagcatataactacaaaaatcagaagagacgtcaagaggttatttctcaaatgatgtgccaaatctggcgtaggggcagtgcaaatatccttcaattaagttcaataaggctaagatggatccctacgtaagagcagctcaaactgatatatctacaaatatgcagttttatttaacacattacatggaaaatagtctagagagcaaaataatctaatatgaatattactgagaaatagtaggatcctgtaaaccattatacggttagcttcatttcaacaagacaagaaacttattaaaacaagtttgtttgaatacaaaagtacttaagacacgttcatcacacatgccgtataagggttgatatcttcgagccatgaataggcattgtcatatgcatggtaaacctggttgtcatgatatattttttttacaactgataattctgagaattggcacagataatattttcatcttaataaatttcacggtttgacaatttatgcgtgtcaatgcttggagtggacacaaaaattaacttcataataattatgtttgtgaaaccaaatgttgaactacttcctactcaatatataaggcatcttatgagtgaatacacagattaagaatttaaaatggtaatacaatcaagataataagaacagacaactatcgttcttaaatacctagggaattggagaaagaataaggccaaacatcagaaaatcccagccagaaaaaactggacctggtacctgggccaggctgttctggccaatgggaccgttaaaatagctgacaagggaaaatcccggttcaaccgccggtttcttagcccaccagaccaacctaggcaggtaacgagccattcaaaatttgcaaaagtagttagtgacaactggaattcaaactcaaaagatgttgctaattgcttgcatgggcaaaccaactcggctaacaccacttgcttgtttctactagctgttaacacgcctacaatagcacaagaagtagtacgctcatgtggtctgagacccgttgaccaagcgattcaacctcttacttactgatccaagtcctcggacaagtcaatgtctggtctggatctaataacattgtgtgtaattactttagcaaccaagcagctctagtggctttaggtaggatgctaatactctagtactgagctaataaaacaacaattacatcatgaaggcctacagaaacaatttcacatcaccaatctctagtttgaccaccaaaatatgacacatgaaaacttacattttttagctgcaaaaccaaagtttccccttctttgaggctgtaatccactgatgatgatttctcatagtgttgtaccatctcttcagcagtctttttcttgtttagatatctttgatgatgtaagaaataacaaatcataccggaaaatggtccgttataaaaagaacttattggataaaaatattaccatacacaactacaactgcaaaaaggaaatacaaattgaattcattgtgaccaaaaacagaaacatttcatctgaccgaccaaaagaaacataattggcaagcaaaaaagtacatcctatgaattgattgtatgggtagaggatttttttgggttcatttagacctttttaataataaaatggttgaacattcaaaataataatctcacacgtacgcgtgttaacaggaaatcaatgtcatgttagaccattttaatgatactgcaattgaatcaaattcacatacagagtccccagccattgagtgattacatgggagaacattcgaatacatatcatgcttcaagtaatgaacacaaggatacttcatatggtcgtgcagagcagcttggaaatcatatgcttgaggtctttcacggaagcctaaaccaataaaggcatggcgctgacgtccatctgaaaatatgtggtaagatttttttaataacttaatatatttctacgtatggatcaatgcgataactgataagccacttcaaacactatgcttaccacctcaacactatgatcaccaactcaatggaaaaaacattaagacacaagaaagtcataaaaatcatgagaagatcagcttatcacctatattctcttcaacacggagtacaaaatatctgcaaaaacaatgttggagtagcaacaatcatttcaggttatctttatacagtctctacatagtaacttatgcagaatagaaacactaaggacaaaagtcaccacaggattaaaccaccatgtggcagggaaaaaatgcagacctgctgctatcaataacaggttccaccggatgtggttcgtcttctctgaggaatgccctagcgtacagctcccctaaaaatgtgtccgaggaatcaacattggtgatcacacaagcactgaccaacggcactaccgtgattttttttgtacctgtgttcttatcttccagtttgatgatgcactcttctcctttgctgacaaccttgagagtcccttcccaagcccacttgttgacgttccattcatcagccctggttgatacccacggtttaaaaaatgtgactcaggctctcggctcataaggtcataccaaaatcagaacagaacaagtacaacaatggagtgagctaatccaagattgccgcattcgatagggccaatggaacgagagttctcgaaacaggacgacctatagctaattcagattgttatctttgatctgtctagcccctcacacagtcaaaccttcaaactacatagccttgctcccgcggacaaattgaaatgtgaatcctactaagcccatttctatcgggatttttttgatgaaccaagactagtatatacctgtaggaggcggctgtcttcctgggaggtatctgcgtaaagagagagaggattaaaaaaaaaacattagcacgttcacgcacacatagtgctcgacgaattgcgcgcccccaagagaacacaagcacgggggcacgaagcgggtcactgactacacacaccctaaacagtcaaacaaaccggaggaagaacaaggcggcgaggggggggggcgcacggggcgtaccaggtagacgtagcactcagcgacctggaacagcacgagctccaccgcctcctcggcctccgccttcgcctgcgactgctcgccggtgctcgacatggaaccggcgccggatcttaccgaggaggggagcggccggggaaaggaggggaggggggaaggctggccggatccggcggcggtgggcgtccccgaatgcggcgacgcggaggcgcgtgagagaggaatggatttcttcttgggggggagagagactgagagagagagagagagagagagagagagagcggtgggagaggaggaaggtggggaagggaagtgccgaagaggggagaggtttgcgtcgggttcggggtcggccacgcctgtttggtcttgggtttaggtgcggtgttgcggtcgtgttcggctgacccgatcgatcggtgttgcttccggtttgggtttcattccacgtatccggtcggtgtggcgatcagggtcacggtatataccctttgcttagattcggctcaatttgaaagattagagatgtccggctccattggcttattccgagaataaaccatacaatatatctacaaataaaaaataatttgtgaataaaatttatatatatatatatatgctcttgacgatctaaaagcaacgactgaaaaataaactatgataaaaaaaacccttataatcaactctaaatttaaggttgaaaaaacaaattttgtcttataagcataagcgaaaatatgatcgcattgcccatgacttgtttagaatgtgagattttatagcggtacaactcttcagtttatagcgggttaataccgcacgataataagaaattactcttttataatactgtaaatgatcgttttccatttgtcgtaaagtttattgacacctaaaatgctatcaagttggttcgcaccgagctcgatcatcacataccatcaatctggtgctcaatcctgataactatagtgcaagctttgaccgcttcactcaagctccacactcacacacatgagttctgtcggtccgcactcaccactcgagctctatggtcatgtggccggtctttagatctgctaatcgatttcccctaagccctattattgtgctcaagcttcatggctttgtgcgcgagcatcactgcctagccctagacttgagttctgcaatccaacataagctttgaaactacgtctgtatgctttgttggtctcacatcttatgtccggtagccccatccccaagttttgccaaccttgaaaatgggctctactacacgctgagagattggtgagcaattggcgggagaacgaggaagaaagatatatccgtccttagttgtataagtgttacttgtgacaaaaagaagtggacatcttctctatttttttttacattttagagtcaataaacttttagataaacagagatgatcctcaactatattatggcataaaatcaattttctccttacagcttattaactgtaaagattataaaatttaaaacattattgttagttcattattagaaaagaaaaggactgaactaccccctaactatagggaccacacgatttaccccacaaaaccacaaaaccagacacccccaaattttcataccggacagatgacatcccccaacctgatttgatctagagcggttttggtcctactcctacgtgatgcgcatgtggcaatctcgtcagcataaaaagtttaaagaacgatgagccagttagagggtaattaggactttttcttattaaaaaaatgaaaagaacattattagtaacaaaaagagagtcgagatttatcagtgtcagcgacgatacgagtcctaaaatcaggtaaaacgtcagagcgcataaactttgcaaccttaaaatatagccaaatgttgtgtgcacagtgcaccgttgtactactttcttggtgcttgagatttaatctatatatagtagtcaaatctactacaaatatgcttttggaatgctttcctcgcaccttcaggagcaactactcttggtttcttcaaaaccgttgcagtcatggatctagcttgctatcttgttgggaagagaaagatttgattgccttttatagtttcatagttagtcctagacgaatttcaagagcttatgttaatttgaccatattcaagagggtcttttgcaaaagtgcttgcactcgcagttaactcccctctagggataaacttcatatgtgtctaattatctatcaatatgtatctaattatctatcaataaaaatgcatgggttttttgtaaaaagaaagtttactaacccaatcatggatgaagtttctggtaatgtccacccggctaccagtcctatatcaaaggtcacgcaaaagcaaccatggaaacatacacggggaacttgtaaagcgtacacaagaccatcaagaagtgtaaaactcaacctgtggattatccgaattaatatgtcaattgtccgaggtgacaaagggacaaaagcacaaagcattgttcttgaaccaagaacagtgcaaaagtaaaactcaaaatctcaaaaactaagattttgcaccagccgggaatcgaacccgggtctgtaccgtggcagggtactattctaccactagaccactggtgcctcttgttgtaaatttagaaaacaaagttatataatcaggatagtaaacgagattcagaaacgctgtggtcttgctgttgtagttccacacaggctacttgggtctattcagtcagcaaggtaaatcatggggagaatatcatcgacatgtttgatctgaaaactacttgagcatatgttccttattgttttaagaaattttgttaaggagtacgatggaacaggcaaatactaagtttcagtaactgtatccttggtttcattaatatagttgctgctcaccttggtcgtgatagtgtttaggtgcaagtagaaaattgaaccaccgttttcttgaaacgtcttctttttttttaatgtaagtcgacctgtaaatcccaacctaacatcctggttccctagttaacaattgccacaattctcacttttttaaagaatagtcacaattctcacttccaatgcttaatctttcaatcccaaacaaagtttctttactgcaaagtagaagagttgaaaattttcaattaatatctaccctattttcataacgtctcgtatcttatcgatattttgcctaggatttacaacaccccatagttggtggccatctttctaagttctatgcacgtgattaaatttatactttaaaacatactacgttctagagtcttcagaaaagacaagtaaaacaaccatagaaaaactccactacttccatgtatgacaaaccacaataaaatataatactatttattttactaacattaatatcaatgtactattagggacgaagctatgaatgcgagcatccaagtttgaactacggtgcatatacgagaaaatagataaactaaaacttaaaaaaaattataccgattttctggagttctcatcttctcgtatgttccacccagtcactaaaaaaaatttgagcctttttcaatatgaaattcagataaacaaactttataagtcaaataagggtaagagcaagtttaacagtatagccaactactagctccaattcatatatagccaatctaatagcttattcatacaatagttacatactacactattaatatctggtctcatctgtcatatactcactgcatcttggagtccatgctacagctggctataaatctgtagcccgctgcttttctctcttctcatttattttcttaaaatatatttatttacagctagcttatagtctgctattgtacttgctataactataattccttttttagacaagtcattgacgcgtccggcttggacaccacggatgcccgtgtccagaaatcctgcggctgccggcctgacccgataaaacccctcgaccgatcccaccccaacccaacccttgtcgaatccgaatccttccc

SEQ ID NO: 48682 - DNA, 4154 bp, Oryza sativa
cacccgagggtgcgcaggcctcgttagtggactcggtgaaggtgattgacgggcaccagcttgtctgcaagctagcgatcgaagggaaaaaggggaagcaatcgcagcagcagcagcagcaatctggacctggtggggctcagccgccccaaatgctccaaggcgggccgccggacatgccgggttcagggcttgggcttggtggaccacaaatgggtgcgcagtatggtggccctgggagtctgtcttcgtatggtgcatttgggggtgtaggcgctgggctaggtggtcccaatccgtatgcgaatttgccatcttccatgggcggcggcggagctgggttgggttcattgggcaatcagatgccttctgggatgggtggtgctggggctggtgcgtacgggcctgggggattgggtggtggttcatttgggggctcatcccagtttggtgctggtgggatgggggcttatgggggtctaggcatgggtggagcctcatcactgtaccgcatgcaacagggttcgggtgggcttccttctggcgggtatggtgagggtaactaccctcttccagggcctggtttccggggtcaggagggtggaatgtcacctggaccaggtggtagagctcctatgtaccccaatgtgcctccttatttctgaggtaattttttgcaacccttccgtgtcttgaattttgtacctgattcccttaggctttttacacccaaatgcttgataattgtcttgttatgtggttatgcctgaacattaacttaatttgtgtttgaattgtgattgctgcatgctgtgtttgcatttatgtgaatgtgtatgtgactgaaatagtgatatgtaagaaactctcactggttacacactgacagtctgtagagatatggggcaatagagtagtgcagaatttataggatgctacttctgacaatataggtttagtatgttaatgtgctctagttgctgattacttcgttctgtatatttttatgctgagaaatctctttgggtgttccttgttttggtagcatcaaggttcagtataatacattcatagtaatattacacactcttgattggtaaaatgttgctcttgtttgttgttgcaatagttgatttcagtgcctgtgttgcttttatttgttcatgtgttttttgtagtgttggactctaatttgcatccaaagtggactgtcttgtaatattcaaggtatttgatttcttataatgctatatcatgcgtacctgtgtggtaatttgcttggtcggacaatgttgcattatatacttgaccacatttctttgaaaggttaaagtgaaggcaactgtctgaaatttgaggttgatctgctatttgagtatatataataaagtatgatccttttggcttaaaactgttaatcctgcctgtttgcagtacatcatatgattgttcgttcttgggtactctggcctgtggatattttttgtaggttactcctgaatatgttttcgcaatacaagcacatttaaaaatccatttgcctggtttgctgtttgacgatattctacctgtttcattttttgccttttttgcttcataattggcatgcagcttattgttttactcaaaacatttgcaattttgaagttgccatatttttatacaagataataagactaatcaatattctctatcatgaatcctttttttttgttatttctttgttatttctttttttttttgttatcaatatttatgcatctttacttcacttgatatttcttctcaagtttcaaagttgtgcttgatggcattcccctttaggattaggcttgtgatatttgagcttgatgtattaagcaatactatatcttttattttactttaaagttatattatcttaattttgtttgtatatttgtgaattggtgaactattgattgaattccagtgaatgtgtgaatcaggtgtgtgacaactcttgggagcatatgctttgaatggttgtgctgaattcagaagttgtctgcttacatggatgtcttgcatattctggctgcctctgatatggaaatcagttttttgctctcaatttttctgttacaagataattcaagctagcttagtgttttctgagatctcttcattagacatgtactttctcataaatatgtgaggtgtcgtttcacattgttgtgtaatgctcattgtcttatgatatccagttacttatgattacatctggtgcttggtttatttgcgtgacatgttatttggtggcaacttgattggcgaaccatttgttatcaatatgtgtctgatgttttgtaatagctatatataacagcagttttactgaatgacttcaggattttttttttatggttaccatctgcagatacgtgcagatttattagaaaacctcctgtattttgatatgactatctgctgagttggatctttagtaagaaagaatccatgttgtacttacccacttccatccccaactcttgtacctagcatttgtagtttcatcgagccatccttgttgctagatacttcattttgcttggagtgagaatttcctctatggtcagacgctatatggttctgttgtgctcttgtgatttggttttcaacatttcttgtgtatgtacatctacatcattacacgttttgcttctagtgattctttcttagatagttagactgtactacgttcttttgttgtgctcctgcatcattacacattttgcttcgactgataatttctcattttgtcagactgtactatatatgcttgtactgtgctcttgtgagttagttttcaacatatgttgtgtactcctacataattatacattgcatgcgtttgttaggagtattttcaagtgtacaatcacatgacttgttgctgttacgtgagagtttgaacattttctgccattgagctgaggggcatctttcttaggtccttttcttggagtgtagcagcttgctcccctttttttgggggtcaaatttgtgcttttgcattcactgaaattattttggcttgcactactgcctttgctattcgcaattgcaacttctgtatgcaattcaatcaccatgattttgtttagattcaaaaatttttctttaaacttccaacttttctatcatatcaaatgtttgggcacatgcatagagcattaaatgtggacgaaaaaaaaaacaattgcacagttttatgtaaatcgcgagacgaatcttttgagcctaattacgccatgatttgacaatgtgatgctacagtaaacatttgctaatgacggattaattaggcttaataaattcgtctcgcagtttacaggcggaatctgtaatttgttttgttattagtttacgtttgatacttcaaatgtgtgttcgtatacttaaaaaaaattggcacgcgaactaaataatactcatcgtatgagaatgctgctccatgtattcattgattcttgaattttgattctgtgataattaaataattgtaatgtgctagttatctatcattgtggcgctgatttgttttgtccacgattttggtgtacctgtttgccgctacaaacttacgcagtgttgattcctgacacactgacgggcttgtttatttctcgtcgtatgaacttgcatgcgtgatgctgcctatgctgtgcttgtttagtttatcctcagctgtgccattcattaccaggaattgcaaagctgcaaaactgtgtattatctcttttatcctaagctagtgtacattaactggagacctcgccaaggaggcaagcaagagcaggttccaggtatcaggcagccccggtaagcaccagtggctacagtcagcgtacaccagcggctgttgccgctgctccgtgctcaggggcttcccttccctggtgatggtgtacaccgacggatgcgcgtcgacccggagctcggagaggcgggtgatgttgaggtacgtgacgggcgtcctcgtgctccggatgttcctctcgacgatggacaccaggcccctcgggaaccatgggacgatcttcgtctcgtccgtgattggggacgtctggttgtagcaccagttttcgctgcatttgcaggtgttagatcagtcatcagaggtgtccattgtg

SEQ ID NO: 48683 - DNA, 20859 bp, Oryza sativa
  unsure (1)..(20859): unsure at all n locations
ttcccgtccgcctccagatggtcccacctgcagtaacacactcggcttcactgccctgctggagagagagagagccagagaggagacgctctggagcggagtggcttacgctctgaggttgccggtgtgggtccaccagtggccggtgttgaagacgaggacgtcggcgccgcgcagcttctccagcgtagccgggagctggtcaagcttgagcgccctcgtccggtcctgcttcgtctcgagcgtcaccaggaacgggctccagaagaactccaccgagcagttgtagtcctgtgcatgtttgagtcacatatgtaatcagaactttagaaaggtcctgcttgtcattcgatgtacggattgataactaaacgaacactggttagttgatacatagcccaaagttttttttttcaaactttcaactttccatcacatcaaatctttcatacacacacaacttttcagtcacatcgtctctaattttaaccaaattctaaactttgggccgaactaaacacagcctatctcaaatatatagcttttaaattgccacctaaaagttagggccagtttggtttggtgctatactaaaatcttggtagtaccaaagtttaggcaacttttagcactaccaaatttggatggccaaaacttttactatctaaaagatgtgttgttaaaaatttgacaccaaaccaaacaaatagaaacactattgaaaattgccaatgaattggtagggcacaatttggaaccaaaccaaactagcccttagtacataacctgacttcccaattcataacctgacttcccaattcacacactagtagttcaatccgctaatttgatactattaactttctcccatcatgtctctcactttcatctcctttccttgttactaatatggtgtcagtctcaaaataagcgtagttttgcattcttcatattcaacgtttaaccgttagtcttatttgaaatttttttataattaatatttttattgttattagatgataaaacatgaataatactttgtgtaaataatttttttaacttctataaatttttcttattttttaaataaaatggatggtcaaacattagacacggatacctatagctgtacttctttgaccattcatcactgttcatgtccaacgtttgaccgttcgtcttatttgaaattttttaatgattaatatttttattgttactagatgataaaacatgaataatactttatatgtgactattttttttataaatattttaaataagacgagcagccaaatgttagatacggattcccacggctgcactaattttgggacggagggagtacttggcaattggcatgctattcaacgtcaagtgtcatcttagttggagcatcagaattttcctaagcatgtccagaatttgtcttattttcggttattcacttatgtctatttgatacccgaggggggtcgtagactggtagcggatcgaaaatgataatatagaggacattaatacatgtttcatactattgtttcaacttaagttgggcttcccttatcgcaaagtgtaaactatttaacatttactgataaagtaaggaaaatatgaaggccgttgcatctcatggtttagttttggatagtgttgcgtgtcatgccttgtaataagaaaactcggcctgtacatatgcactaattctgggacgttgtccaaagaaaaaacacccccgtaatttcgcatgtacagccgacagagcattcttcgatttgactgatttgtcccgtaggtcaacactacctcaactctggcgacacaatcgccaaaactcatcggcggattaaatcaatcgtgtaatattctccctctagtttgtgtctatttcatactacaagtcgttggttttttaagtaagtttaatcaatttttttaaaaaaatatagcaacactttaaaataaaataaacatattatcgaaatatagtaaaagttaattgtagtgaaactaatttggttatataaatgttgctaaatttatcaaaaacttaattaaattttaaaatgttaaaaaattaaaatgatttgtaatataaaatcgaggaaataatatgaaatggaggggtagtaatttgtttggcgtgcacgtaccatggcgcggaagatcctgtagtcggaggcgacgtcgaggacgcgcgaccgcgagcggtcgggcacggcggtgtagaggaggcaggcgagcgactcccacatgttgcggttcagcgagtcgccgacgaacaccaccctccggttccggcactgctccagcgctagcgccagcgccgcctccctactcccgccgccgccgccgccgccgccgccgcaccctcgcggctcccatcgccactgctcgtactcggcgtccggccgcccgttccgccggcacgtcacctggtcgctcaggaacgggcactccgccgcctcgtacagcgggtagccccccgccgccgcgccgtcgcgcacccaccgcccctggaacaggtcgcagctctcctcatctcctccctcctcggcggccggcgaaggcgccggcgccggtgcggtgctgatggcatcatcgtcgtccccctccgccccctcatccccgccaagatcaggcgcgcgatcacgggcaccgcccggcgacgccgcttgcgccagcttgacgtacctctcccacggcgcctccccgaccacctcccgctgctgctgcggcgccgcgaagagcggccggcggaacgggcgcgtcgagccgaggaggaggaggccggcggagacgacgagggagaggcagaggagcgcgcagagcgaggtggccagcgcccacctctgccgcgacgccgccgcgacggcgagcgacggcttgttcgccatggcggcggcggaatgatccatcgctaacgacgagagtttaatccacaaagaagcacacaggtcaactgctcaaagcgaggtagtaattattaatttgtagggttaattagctcgccggagcacgggattaatcaaggcgaggaaagcatggaggaggaggggtttttggtttggttgctttcggtgaggagaggttgggtttttggttgggtgtacacactacacttcacttgggacgctgctgttttcatgtgcacttgaaaacagtcactgactcgcttcctctccatgtacgccgtgtttagttctaaatttttcttcaaacttctaatttttctatcacatcaaaacttttctacacatacaaacttttaacttttccgtcatatcgtttcaatttcaaccaaactcatgtgagtagcaattatactgccgctgatgcttagtggcaagcagtacagtttcaccaactgtaatcatgaagaacgttatgtttatgccttccagagtgaaaacgaagcaattttgatgctaaaattcctactatcaaatacgtggagtacttttaggaaaaaaaaggagtatatatttttaccagaatatttatatctttctcgtgtatccaaatcagtaattatggagagttggtgatggatgataattggatagttcaatttgtattcaaagttcgtgatcaagttgatgtggcacgtgaatgcttcttgattcgttattcttccgatcgatgcgaccaaagtacatacacataacataagccttgtggtagtacgtatgtaggtggacctgcatccatgagtagtagtagggtagtagatgagctgttgttagagtaaaaattagaaaaagcacacgcttttagccgtcagctgaatgggcacaagccttgttaatcttcacaacctccttttgccatgggcatttttctcaatcatcatgagactcagatcgaccacactactacctccgtcccacagtggatgtcgttttaactttttcttataacatttgaccattcgttttatttaaaaaattagtgcaaatataaaaaaaagataatcatacataaaatattttttgataataaagcaaatcacaaacaaaataaataataattctaaattttttaataagatatatgattaaatattataaataaaactcaaagcgataagtaatatgagacagagatagtagtaattatcagcgtgccacggtgtctgtcttttttccgggagagacagaggccatcatctgcatgtttatagcaattagcaaagtcgaatggtgagaacaaacatagtaacggagtcacgcgacgtgcacgttgcacgcacgtacggcgcgcgcggccatgatcagcgagcgatcgagcgtggccgtcgcgtaaagaatcggtgagatttgccggcctggttgcctcgtcgatctcgtctgcgtacgcgcgtaacgtcgggcaaagcgaagctcgcgctcgagtagtggctgcccggccatcatgtcggtcgatcattccatcgcctttgccgctttgcgtaacttatgtctatttagcacagctgtaactccacctttatttcttctggagttgaagtccagacgctctagacaaaaaagagcggagctagatagagcgatttccacaacttcattatagacataacttctggaactctttaccgtgttgggctttcgagtcatggggagttggaataagttcatatgaggtcccttaactttacactgagtccgattttcgtccctgaatcacaataccagataccatgggtccctcaactgtcaaaaccggtgtagatgaggtccctcagcggtttagatggcagttttgactgatgtggcgctgatgtggctaatttgacttagtcctcatcgtatgtggcggtgatgtggcacttggaagcaaaataaaaggtcggacccacgtgtcagtcattaaaaatagtgggacccaccctgctctctatctccccagcgccgtcgtccttgtcccttctccctcccggcattcttcatccttcctcgagctccctagccggccggcgagcgcgcggcggcaggcgagagagcggcggccggagctgcatgacctcgcccccctcccccctcctccggcgccgctgcatcgatctgcacgagttgcggcgacggcaagctcacagccacgggacacggtcagcgtggcgctgacggggcccgggactcgagctcgcagtcgcagccgctgctgcccacttccccaatcccctccatatgcgtcaaagtttttgatattcatggcgttctgctcttgttctggtggattgattgattggtgtgcttgtgcggatgatttgtgcgaaggcgacgcgaagaacgcccacctgatgtctctggacgtcgcctcggagaggctgcggctgttcaaggccgacctgcttgactacggtagcgtggcggcggccatcgccggctgcgacgacgtctttcatgtggcctgccccgtgctcctctccgcccctaacccaggggcacacatctctcttttttcagcaaaataattccttttcttctccattgactggttcaaactgtagactggttactgaaaatcgacaaaaatcaacagtttctactaaaaatgatttgtcgaaactattgatttctcaacaaccagtagtagctgaagtctgcagagttgtaattaaatcgtcatgttcttgtagctaaatgaattgatgttgttgtaggttcatacacttgctgctgctgtaacgggcacgacgaatgtgtggaaggcttgttcagaagaaaggttgggacttggtaaggttgtggtggtgtcatatgtctctgctgcgatagtaaatcctaactggcctgaaggcaaagctgtagatgaagattgcaactcgtgcagatcgatgcggcggcgtagcaggagtcttcgtcggcggcggggccaaggtcgtgcagctctggccgccgctccttcctctcccgtcatgcgcatgccggcctaccctccccgcccgatggctggcgccctccgcacttctccccacgtgcgcccttctccctctccatgcgctcgccggccggcgaggaaggtcgaggaaggatgaagaatggctgggagggagaagggaaaggacgacggcacggtggagatagagagcatggtgggacccactgacatgtgggtccactattttttaaactgacacatgggtcccaccttttattttgcttccaagtaccacgtcaccgccatataggactagaactaagtcaaactagccacgtcagcgccatatcagttaaaaccaccatctaaaccgctgagggacctcatctacaccggttttgacagttgagggacccattgtatctggtattgtgattcagggacgaatatcgaactcagtgtaaagttaagggaccttagatgaacttattcctggggagtttgcccgcacgggcccgaagctggttggaaaaagcagcatcgccgaccggcccacaacatgtgacgcgacggcggcccatgagagaagccggagcccaagcaaaaaccgcttctgctcactgggtccatgttgtcagcgacgcatggggccctccggcctccgctgccacgtgaggtgcgcccaatccccggggagctaggagcaaggaggcgcgcggcgttggggcagtggtactcggtgtgacctggtggaggccgtgctctccgccttttggctgcttgatgcgtcgcagccatccgatggcgcaattgctcgccgccgccaccaccaccaccacgccaccctgcggcggcctcctaaccgcgcgggcctccgcgtcctctcccggctgcttcctccgcgcgctgccgagatcccgcgccatggcctccgcctccggagccgacgctgccgctgcggcggttgctcccccgtcgctgctcgtcttctcaggtgcgtcttgctctctcccgctctcgccaatttggatcgcttggagcgtatgatagtgcgtgcgcgggcgccggggggtctcggtgatttgctggggattcgatgcgtgcccataccttgctgcgagtatgggcacgcgtgatggattggtcgaattggcgagaggaagttcctgtgatttgtgattggctgtgatttgggcgattctgtgcataatattttgtgtgtgactgagtatgcgagtttgggaacaaaaattgtcgaaattacatttgtgcattttttttccttactcaagccatggatccttcagtactatcttactatcttacccctccttgggatatgtattttgacgcaatgtggcaatttatgatttggtatgctcaactaggatgatggaaagtgtccagtgctttatgtgctcctttctagctcacgtttggatgttgaactaatatgacaattatggcatggatacatatgaacgctgctccgatagccctggtttatgtgttgataattggcacatcttaaattcttgtgatagccatgtctgaaatcctggatattctacctgcgaaacggaacactaaatggtgtttgtcttggtaacactaggttctgcgaaagcatatctccatgcagcgctggatgaaaataatgaaatgtcatttaatttccatgtcaaaattttttgtttcatatatcctgcttgaatgatggattgcacaaactataccatgctcctagagtagctgtttaaacagttctattttctttcttatggattatgcattttgcgactttgcgggatttcataaattgaaattcgcttggcacttgcaaccttaccctatctgtgtaatgaacaggtttccttttttccttttctggttggcacaggaagggatgcactaatgtcatttacttttgtgttctaatatttaacgctatccaggaggaaccgcttttaatggtgttgtagaagagctgaagaaagtgacgactcgagttgcacatgttcttcctgtttccgatgatggtggaagcacagctgagattgtgcgagtgcttggtaggttgaaatctcttgccacaccacctgctacctgagataacaatttgtatagtaattgaaaatccaacctgttcttaaatgttaggtggacctgctgtgggtgacattagatcaagatgcttgagattgtctgatgaaagcacttcagaagccctttctgttcggacattgcttgggcaccgtttgcctcttgatccttcagaagcaaagcttgagtggtagcaattagtctgtctattgcatatcaaaactcacctttgttcattcaaactggatcaagtaactggctgatgttttttatgtatgaaacaagatgtgtgatgttgttaggttgtgtacttgacaggtaccagattgtagaaggagagcacgctttgtgggatggtgtctcacagccatacagagaaacaatacgtgcctttttagtctacttccataatgaggtcagttcctctgtagtattttcttttcatagcatatttttaatttgcttaaagattttgctttgaaaatttcaaatgaacagttttctgactggagaacagaagagaatatgatttttcgcctcccccccttctgttttcttttttgccaagatttattttcctggtatagagggcagtctgatgatcaagcagtcgttccttgcccatgacatataattgcagtcgtttcgtttgtgcagatacttcgacggtcagctgaaatgttttgcttcaccaatggcaggtgattcttttaaggtgaaatttgcagtaaatcatattcttgtgattgcttttaacatgtcacccgttggtctcttgccacttctcaattcgatggcgtgacagggatgtcctttgtggcaatacttatttcttggtattggggcattttttgtggtcacaactcataataacaatactcccatcttgcctacatctgttattgactacagctttttattcttgcagcattgggaatttcttttttgctggggcacgcatattcttccagtctctggatgctgcgattttcttgttctcacgtgtgtcacagatccctgctgaaagtcttgttcttccagtgatatccacaaatgacaggcttacactgggatgcgaactatgggtaacatcacttatcagtattttagttgcacaataaaaaaaccagtagattcatttttcggactgctctggtgatctggtcttcttgttcttatgttggttaattttattgcttccatttatttatttatttattttgttatttcactgatagtttaattagccccccttataaactttctttaattattccaacttgcttctgaaaactggcatgattgtctttgttttacaatgttactcctattattacaaacattcccttactacaaaatcacatataatcatcttggacattattccattttcaggatggaactatcatccgaggtcaaaatgaaatatcacatccaagcaatggacgtaaagaagttgttaacaaggtactccagtctataaatcatttcagcatactcccaatagtagttaatatgatctatgtaacatcattgcgatgaaggctccaaagcatttctggggccacttcaatatgttctatggaacaacttttttatgttttatcttataaaagaagctatagaagaaaaaaaaatgttactcctacctttaaaattgtgttgccatatccttctctggtggactgatatttacaattgtgcaaactccatttcgttatgacaatatcggctatttttgcttcatttccgtttttgttcatggcatggttgtcattgattcacatgttatcttgaatctatgtttttctcctttttacctgggcatgcttgttgatttcttataatatttgtttatctgtcactgatttattttttattttgctttttatttttggaaaaggattgtaattcatgtagtgcacttccttcaaggattaagcgtgtcttttacatgtcaagtgaaggcagcaacctgttgcatgaggttagtacattcattttatcgtaaccacctagactgaacctttcattgcacatctatcatgaattcttggttgggtaagactttgatttttgttaaaacaaaagctactagtccctctaagaattgattcagcctttctactttaatttctcagcgtaaaatttttttcttgaataccacacatcttcatgttcttaataatgatcatgatataataatcagaaaatgtagtctatatttccatttatcatgcttatctaatcagtctcatggtgttacttacaacattgtgaactataccattcatcaatagtgggtttttagctcttggttaacttaattctttaaagagtacgcttactccttctaagcttagtaggcatgagaagggacaactccttcatatagtaggctgttatgttttgtgaatatcatgggcttaaaagggtgtgcacttataaccatgtaagcatattgggatgacatgtatcaaattagccacttcacaacagtatatatgtaaacaacccttttttatgttttaaaactcctaactgttcctactaaccttgcaatgcaggtatttcctgaagctaaccgtacagttttggagcagttaagtaaggtggactgcattgtatatgctatgggatcactctttacatcagtctgtccatcattggtaaccatgctgctctattttttgtttgtacataattgtattgacttgatggtcttaagtcttaacatgatatcagatatgttcatttttatactacatgcagtactaagcaaacatgggtgccgtgcacatctgattactgatactgactttaagcttttttacctgtgcctgttttccacatcagcttgtcttcttctgaaatttaaggctgtgcaggtattgcgtggcattggtgaaactatagcatcaagatccattccgaaggtagtcatgttaaaaaaatattgtcttgttttcatatgctttaatacaatgttctgtatttgtgttgattcattttttcttgattccatcatgtaaataaaagcattactaagacctgacattcttgttaaaccatattgacttgcttcatgctcttgatttcattatgctagaatgggtttaatagcaacctagaatagtggattcacctccatagtagtggactcatggggttatttgatgtgtgaagggagtttttcttcacataaaatgttgtttttcttggtttttagccccttggttgatcatgcttgtggctattggtgcttttgtctaaaattatttattctgaatctaggtacttcttttgaatgggtcgcatgacagagaaacaactgggttgcctgcttctggctttgtgactgccattactgattctctaaaccgtacatatggatatcctgacaaaagtctaaagaatcttgtaagttcggtgactgtgcctttgaacagattttcagctaatgattggaggaattatgcatcatatcatttactagctttagaggatgggaatatcccacagatcagcgtcccctggtccacatcttgaatgattcagttaaagatgtacatatgcccctgccccttaacattatctgtgtgaagattttccatctgacagcttctttttcattttgtgcagcccaaagactatgtgaatgctttattggtaccaaaaggaggccaaattcctttggatataaaaaacttgtcttctaaaggaatctttcatgtggtaagtgtttgtgtttgctaaaacagtgatcattaagtgtaaaatgtgtggaaaaatgttatagttatccatcgagtccttaactgtgtaatattttcgagaatggatagaaaatccagcctctatatccatgaatggatatatacagccaaaggttacatgaatacttagattctaggtcttttactgagaaacaatcacgaaaaagaaaatgaatggtcgagatgctccgaaattttaacgcttctttcctagttggcttttctgtgtgcgataccatgttacttccgtcatttcatccccaatgaaagaggatatctagcatcagcttattaattactactacctccgtttcaggttataagacgttttgactttggtcaaagtactgtttcaagtttaactaaatttgtagaaaaaaataaaaatattttcaacccaagacaaatttgttatgaaaatatattcaattattgatttaataaaactaatttggtactataaatattactaattttgtctataaacttagttaaacttgaagtagtttgacttcgactaaagtcaaaacgtcttataacctgaaacggagggagtacatgataaaactacaataattgcagattttgcacggtgggtcacattgagctctgtagccttggttaaacaagcttacttttgcatacttaggcatttatccattacatgttagaaaaaaggcacactgttatttacacaagataaatatgaaaactcaatgtgtaggtcggtattccagaagtacgcgatactggtccacgttcttctgtattgtagcttgtgcataaacagtattgagattgtcgttttaatgtgctaacttatgaagtatattgcaggttactgtggactctatacacgatggaaagacgggcattatttttgatccgcattcattgattcaagccctgaccagtctaatatcggataggcgtttcgtggaacctgatcttctaacagaaaatgtagagtctgtatgctgaaatctcagttctcaaatgttaggtatatatctcgctcctattttttccctgttcaatacattgtatggggaaactgtagcatcagttgcccacttgcacttcgtcagctagcttcattgcttcattcattgaaaacaaaatatacaaaaacaattgtgctcatagtttaatttcaccatcgaatcagatttcagttcttttatttcttgtgttattcaaggcgatgataatctcccctgttcttttgtgctgagtggctgaatgaataactaaatgatctgtgataattatttgaaggtacgtacgaacgaattaaatattataaagttgataaaaaataaattgtagtattctaagaaatctatatatagatttattattattattttgtgtgtgtgtgtaaaaatcgtacccttcgggagctcgggaagcccgggtattctttattccatttctctctaaaaaaacagggccttacagttgaacaagtaaaaccggaggggtcaaacgacgtcaatggaggagcgatgcgagacgggaaccccacgcgtacgcagcagtcggggatacggccggcactagtcgcttccgtccattggcgctaccctaccgggacggaaacggcatggagctcgagaatcaagatggctacaaagaagaaaaaaagaggaaaaaaacagagagatcgatcgggccagccagcaacgttccctcggtcatcggtacgattcagagcgtgtgtgttcagttcggcttcatcttcaattttgtatgtaccagtttggtccggctcaattggccacaaattatgaaattggttaatgcacaacacacgagtacggtacacacgcacacaccaattaaatcgagcaaggctttaccattacgaccttgaccatgatggacagcgagaggcgacgacctttgcttgacttcttcactgacccatggttggagctcgcctacccaatctcctatatataaaaagctagagctaccctgcatgcatgcacagcacagcccaagcgaaccagcagtccagtccagcacgggcgcacgctcaaggacacccagtgtacgacgagagatggcctctgctcgccgctggctctgcctgatactcgccgccgcggcggcggcggcggcgtcgggtgctccagctccggaggacgacccgggcatgccgatggcggcgcggcaccggtgctggatggcgagggtggggcgcacgtacgcggacgccgcggagaaggcgcgccgcttcgaggtgttccgcgccaacgcggagcggatcgacgccgccaaccgcgccggtgacctcacctacaccctggggctcaccccgttcgccgacctcaccgccgacgagttccgcgccaggcacctcatgcccgacgctgacgtcgacgagccggcgaccgcgagggtgttgttcgagcaggaggagaaggcggcgaagcagcatctccctccctcacgcccgcctgcggtgtggggcagcaaggactggcgtgacctcggcgccgtcacccctgtccaggatcaaggcaagaataattgcagtaagcaccaattaaactgttttattaataataaaaatggattatatcttctgtctcagtgagtacgcagccaaaaaaaagtcgtagaaaccaaaaaaaaagtctttgaagtaaaaagaaaggaataaacaaaatgatgtgatagaaaagaccccaacttttgcaatgaaaatattaactgaaagggaaactcttttaagcatttaggtggacgtctactggtttcttacatcccaactaaatgttagtatgatttttttttaaaaaaactgataagacatattaataatatatcgctccataaacatgtaagttagaattaaatttttataaattataaaaaaaaagaaatttgactattggatgtacatatactggagtttaatttgttatttttattataatttatagaagtcgaatttaaatttgcatgtttgtaaagtgatatactacctattaatctattttattattttttaaattttttttaataatcatttgattggcatgcatgaatcacccaagagatttacaacccatcttccaaccgaattacgtttccagaatcacataaatcttgcatcttcatcatgtcgttcatggcggccggggtgatatgaatctatgatgtgtcgtgtgtgtgtgtgtggtgcagacagctgctgggcgttcgcggtggtggcggcgacggaggggctgatcaagatcgagaccggcaacgtgacgccgttgtcggcgcagcaggtgctggactgcaccggcggggacaacacgtgcaagggaggccacatccacgaggccctgcgctacatcgccaccgccagcgccggcggccggctgagcacggacaagagctaccggccgtacgacggggagaagggcacctgcgccgccggctccggctccgcgtcgtcctcgtccgtcgccgtcgtcatccgcggcgtgcagaaggtgacgccgcacgacaaggacgcgctgcgcgccgccgtggagaggcagcccgtggcggcggacatggactcgagcgacccagagttcaggggattcaagggaggacgcgtgtaccgcggcagcgctggctgcgggaagaagcggaaccacgcggtggcggtggtcgggtacgggacggcgagcgacggcacgccgtactggctgctcaagaactcgtgggccaccgactggggggagaacggctacatgcgcatcgccgtcgacgccgactgcggcgtctccagccgccccgcctaccccttcgtctaataactaaggataccgtgcgtcgatcgctgtcgcgtttccttcctcgtttcgtactaagttaccgtaatttcgtccattaattcgtatacatgcttgaaattcggaagcatgtatataagagtatatcgtagagtcaataacccatttgtactaagcaagtgtatgtatatgcatgcgttgtatccttcttttttccttgaatacatatcacagacattcatgatgcgtagtggtagtagattatgccgcgcttcttgcatgtgtacaaaactgtaacgtgttagccccaacagacattccaactcatctggacagtcccgtccgtcccgtgtggcgtgtgctcctgaacgactgcaaccttaattgccggccacagacggccggggctcattggaggaggatcaggggccaaaaattagcgaggcccactactattggaaaaggctaagtacattttacgttcctcaactatgggctgcgttatttgtgaccctcaactgtaaaaccagctattgagtgctccctgtcttataaaccaatgcaaattgagtcattcaatagtattgattgtggttttggttgacgtgacatcctagatagaaaaagaagaaaataagaaacgcattagaacctggctaccccaccttcctcttatcttcaccccccctctctctctctctctcattgtggctcgccagcggctgcacccatgggagctcgattgaggaaggctgcaccaaatggaggaaggctgcgaagacataggagctcaaagaggctagcgagaagggagctcgattgagtagacactcaccatgccatccctcgtctcccccatctccatcgccatgtgcgcaaggaacttgaagctcttgatagccacatcccatcagcacgatgacagacttcaagtggccacttgccctctcatgatgttgacgtcgaaggcaaagaggttgaagaggatgagaagggtgtagtgcttgctgaagctagacgaagtcagatgtagagaggaaagcaaggagcagcagaagaagcttagcctccaatttagagaagcagccatgtgcgccgccgcattcgtagggagtggaacaggagaccaagaagcaacatgacggcaatcgaaaagcagccacatccaccacaccacatcgttgactaccacgaagcatgatctacgagtcgtccagatcagggtctgcatccatggcttgcttgaggatgccaccgccgctccatgtaggcaaccacttgcataggagaagctcgtcggtagttgggattaggaatgtagagtcgtggggtgaagcagcaacacctatggaggccatgatagggagcttctacctgctgatgggaggtggctagcggctaaggagctcaagcacccaaaagccgccaccaccaccggcgccacgcaagagtactagacgactggtgtaggagagggtggtggtcttcggctggtggggcggtggaattgaggatgggtgaggtggtggaattgaggggatgtgcagtggtccaaacaactggcggagagaggaggagacatctgcatgtaaatggagaaagaggggaagagaggagagggaaaagggaagagagatgggtatgccactgacagatgggacccactaactattttaaattctaggcaaattttgctatacgacaccgtgacttcgcgttttagctgtcggacaccgcatgcattaaagtaataatttccggttgaagaggagagagaaatcgtgtgaaatatcaaaaatgcccttgggcccacatgtcaactctcctatctatcctctctctatcactcatcttctctctctatcccacatgttagcgacgatggtgggcaggcgaggtccagtggcggtggtggcagaggcagaggcgtgagggcaagggcagagcggacgcgaccagcgatgtgcagaggagcgccggcgctggccggacagcgggcgaggttcggcggtggcatctgcgtgtggaggagcggcgtcgtggttggacgacaacggctgcagcgcgcggagtgaggagccgtcgcccacgcagagtgaggagggaggggcgccgtcgatggtcgacgccgctgtctgggcgtgccgttggccggagccgtcgtcctcccgtcgccacggccactcctccctcgccctcacgccaccgccagaccttgcctaaccgccgtcgtcactgacatgtgggatagagagagaagtgaaggaggggatatagagagaagagagataggagagctgatatattggccctattactgacatttcatgtgatttctctctcctctctaacaggaaattattactttaatacgtgcggtgtcgaccagcaaatattcaacttttgagaatgtcttccccaaaaatcacttcgtgcggtatcttatagctaaaaccgtaaattcatgacgtactttagcaaaatttgcctaaattttataatggtaatgctacgtaagcgtcccgtagacaccatgttagatgaaaatcagattaacatgccacgtaggacgaatcatccaattccaaaccatcgagactcgagagattcaatttatactggtgtgatagtcggggacgtaaagtggatataccctcgtcccctgtcatttgcctattttgatccgctcagccacttctccatcacccgcgccacgcatgtgccacatgtgccactcgcgcatgcaagtggcgctgctcctttgcacccatgcatgcaggccggagcgagcagtagtagtagttagttattgcaagcaacctcagcgatcgcattcgcacgccgagttttcttccaatatcaggacaacaactcgtccaccctgcccattcgctcgctcgctcgccgtgcgtagctagctgctagtagctcgtttcatcacgttgcatttgcgcccgatcgagcgggccggagcgcgcgtgccgccggtgccggcgtgcgcgccgtcgtcgggacgggccgtggttcgatgcacgccgccgtgccgtcacttgcgagagtggcagacagggacggccggggcatgcgcagcggcagctagcccatatatgaacggagcccacaacccagcatagtagtataatgtaatgtgcccgccgccaaggaggagtgtcatcaggattgatcaggctagcaataataatgtacaaatggactacgcgcgcgcatgcttagtcaggatggggatgcatcgatctggtgcaagcaaacgctgaaacgcaggagtgcatcttcctatcaccttaattgattgttactcctttgctattcgtcaggtgacatcgttttcaaatttctatactgggggaggcgggaatagggcagagggaggggtattgcggactcggtgccggtgaaccggctggcttatttttattagggttttaggattgaaggtgggagggggtttgggaggcggagagggcgatttaaataagtgttaagggtggtgaaaaccagcggcggacgttaaggtgccggggccatgagaatagaggagggtgatgagcggggtttacagcggatctagcggtgtgagccgccggagatagggatgagaggcatggccggagaaaggcaccatagtttatacagtgtttatggatctaatcttgggggaagggggaaaggaggagggaagtggccaggaaggtgcgactgattggccttgccgctaatgtcgataaggtggacggaggtggcgacggttgggtatggaggaaacgatgagagaggtggagttttggtaataacgcttaacatgaatgttgaatcaatttgaattgttaaaaaaattgatttatgttgaaggaagaaattcgtcggctgatatatagtactctttgtactaaaatatagttaacttcatataaaaaaatatagttaaatatatgttatttttaaagtagctatttactactccaccttcgtctcaaaatatattttttttctatgaatgtttatgttttaggacggatgaagtatatcttttatagaaaggggtaagcctctaattgttgttatcagtgtaatagccatatagggatgggatggaataatcgtgctgagcctgagattgaaaccggccgtccacatcaatgggatcacatctgtcaccatcgacggccgatatattgttgcttcttccatcctcatggtgacaataacatgcactgtgtagtttgccactcatggtgataacgagatgcattgtttagatcgctggctaaaaaaaatctacgccgatttttggagtcggtaatgatcttggccgtgcaggttactggactgattgacggccgtgtgcatgccatctaaatgattatgagtatgaggatggattctaatctctcgggtggacgtccacccgtttcttgcataccacctaaatgattatgaaaaaatttcaaaaaaattcacaagataggttaatatgtaatatatcactttacaaacatgcaagttcaaattcgacttttacaagttgtaacaaaaataacaaatcaaactctaactagtatacgtatattcacagtcaaatttattatttttgttacaattngtanaagtngaatttgaacttgcatgtttgtncagccatatattacatattaacctattatgtcaatttttttgaaaatttttcataaccatttagatgacatgcaataaacggatgaacatccacccgagtgtttaaaagagtttccccggtgtgcatgtatggttgaagttggagtattgtgcgtcgggataatgggattttttcgatcggttgattggctccggcgctggtcggctttgttgctccgctgcctgcttgcttacggtatgcgtcccacttcctaagatagaatcaactaatcctttctgataatatatattaatacttctttttgcaattggagacacttcgtcagatgcatggtgtttcttccttgccgagaatcaatgatcatttgagatgttccatcactaattgcaacatttgagatgctttaaccagatgcaaaactcaaaaatatactaatgcaacattaaaaaaaccaatacgtacgagaaacaatcaacaacatgaagaaaaagaattattgacaatcaacttcaatatggtgagcgcacgcctttaatgcgacaatacatatcatttgcaagtacaacaatatgtaaaaaaaaagaatataataagatgaaacaagataaacaatgaattgtaacagtatctaaaaaaactgttcaacataatcctaccagtctag

SEQ ID NO: 48684 - DNA, 11210 bp, Oryza sativa
gaaggcggaggtgcagcccacctatgagtaagcaaaagtgtgcggccctcctatgagacatattaattcataaatatgcaaagttaaattcactatctacaagttataacaaaaagaacaagggttggtttggtttgtggcctagataggtcttaccaaattttgtcaatgccaaattttggtaagttttggcatgactaattttgataaggtaaagttgtgtttggattgaagccaaaatagtctaagttcactattgaaatgacctattttcttagggggcttttaactatttgccacttttagatttggcaaataactatttgccacctctatctcaatgacatgtgggtccacatatgtctatgacatgtgggcccagtggcaaaaagttaattgccacatctaaatatggcaaacggttaaatatctcattttcttaggcatgtcaaaattttgcttcaaaccaaatagacactaaacactattaaaattgacaaatattggtaagcctaatttaggccccaaactaaacctgccccaaatcaaagtgaaactagttaacatacattcacatttatatttattagtttaggtacgactcgtagaagtcgaatgacttacatgtttgcacagtgatataactcattaatcttacttattaatttcttttaaatattttaataactttttagatgatatgtaataaacctctcgaggatgaaaactctttcccggatgcacgccaatccaccggacagtcaattcaatgaaccatcccactggacactggcgcatccgcgcatgcacaccagagtgcaatatggactgacccgaccatgcatcaaccgtgcgtcgtctataaatacgaggcaaatgcgccacgatcctcagctcacaagtcacaagcaacacagagtgaaaaaaaatggcacgggttcccgtctctcgccaccttcgcgtcgcgctgcttgctctcctcgtggtcgccgtcgccgccgcggcggcggcgcgcggggatcagccgcgtcgcgggcatagcatggccgcgcggcacgagcggtggatggctaggttcgggcgcgcgtacgcggacgccgccgagaaggcgcggcggatggaggtgttcgcggccaacgcggagcgcgtcgacgccgccaaccgcgcgggcggcgaccgcacctacacgctcggcctcaaccagttctccgacctcaccgacgacgagttcgcgcagacgcacctcgggtacagctgggcgccgccgccgccgtcgcaccggcatggccaccgcgccgagaatggcaccgccgcggcggcggcggatgacacggacgtgccggacagcgtcgactggagggctcgcggcgccgtcaccgaggtcaagaaccaacgcagctgcggtgagaaccactcccgaacacaaacacgtcgatggcatagctcacgcagtggcgtatctcgaaaattgattcgttggtatcataacgtatctactaataccataatatgctaattatacttagatcatgatgttataatacatggataaacagtttaactacaggtttactgaaagtcgtcggtgtcgtgtcgtctgacaccggccgttacactgtagatcagctcatgtgtactgtacggcgttcgttgcagggagttgctgggcgttcgcggcggtggcggcgacgaaggggctcttccagctcgccacgggcaacctcgtgtcgctctcggagcaacaggggctcgactgcaccggggggcccaacacctgcagcggcggggacgtgttcgcggcgctccgctacatcgccgcgagcggcgggctgcagacggaggcggcctacgcgtacggcgggcagcagggcgcgtgccgcgccggcgggttcgccgcgccgaactcggcggcagccgtcggcggcgcccggtgggcgcgcctgtacggcgacgagggcgcgctgcaggcgctcgccgccgggcagccggtggtcgtggtcgtggaggcctccgagccggacttccggcactacaggagcggggtctacgccgggagcgccgcgtgcgggcggcggctcaaccacgccgtcacggtggtgggctacggcgcggcggcggacggcggcggggagtactggctggtgaagaaccagtgggggacgtggtggggcgagggcggctacatgcgcgtcgcgcgcggcggcgccgccggcggcaactgcggcatcgccacctacgccttctacccgaccatggacagctagctcaactgagcactggacagtgaacactagactgatgcaaatatgtactaatattgataagaatgttacgcctaatgcaaatatgtaatatgtgtgggcgtctggcttctaagtgataagctattaagccatagttaaggagtatatagtagataaaatgattatgaaaccagaactgtatcgacatatgcagttaaagaaactgatgtcggtaatggatggagcaaataagcacttgtacacattaagaaaagatgattcagaaaattcaggacatgcttattgcgcacaacatttttctgtctttttactgttccaacgaagaggaactattcatcgagataatattagtaaccaacataaactgctgcgttcactatatagcaatcatcgtttttatctcccattgcttctaggcatacgccacttgaacagatcatcccaccgtccacaacctcaaagctgataattttaccactgcaaacaatgagaaaatagcataaggcggcgcttttgctacgtcatatgtaaaccaaatcaagatgcacactatcagtatcatcagattaaggctataaacacgctgctaatgatcattctggacaaatgagatccattgagtatctcagacattgtttgattacgagttgttgttagcaaagaaatgctttacatccaagcagctgagtccaggccattaataattctggtgtgttcttccttttatatatttgatcatgcttactgccacatctaaatatctaatattactgtaaaatgcaaccatgaatacgagttcatggaaactgtctgcgcactctaaatatttctcttgctgatctttcattttcagtaagtcgtgaaaatcgtatgagtccatatggctttcttttgtatggctgctttctatctcagcaaacatcacacagcacagtattgcaactattaaacattcctacaacgctaatgtgaatcaatttgtcatggcaacatggatttacctgcttgttatgcacactagttagcacaaaatgttatagtttgccactttggcttttgtctgagatactgtaagctgtaaccatgtaatactttcacatctgaaggacattctggagcactggtgttgaacattcaaaaccctcttatgtagtaagtatagtgctgaccacactgtcttgtgtacttgataaaagatggtatttatttgcctaagacgctgtgatgactttaaggatgaagtttttatagaaatatgatcaaaaggaaaagcaggtggtgatagaaaaaataatcaaatatgctaaaaggtgagactgtattgatcgagggtcactgaactacccggttctactttattatatacataaaaaatcttagttagagatcacagctacactcaataagcattcaatttgaaggtaaacacattggataaccacatctatcttttgtagttatgggaaactggttacaattttgaaagaactagaacacattaaactttttttttttcaaatctaagcccttgactgcctcagattttgttattaaagagctaagggctcttttcaatacagttagcttatgaaaatcattagtgttggaaatagtgagcaactgagcaatgttgggtaatgaagaggatccgtacttgatcttgccatatggttatgaacataatcacaaggaacaattgtactgaacaaataaacatgatagctcatgttcctctacaccacatttgttcaccatgtccatgagttacctaacctagatattgccaatcataccaaggttcaaacttactactataatgcgagctagtatggtacacaaccgaccaaaacatgctcaataaacttgtaggggtactcattgcatccatttctgattcagcgttccaacaagaagatcccaattttactaataagcacgaagagaacacagaaagagtgctcactaggggaagacggccttgactctctcaacgtccagcaagtgctgcgttggcctcggcaccccgagcttgatctgcagcttcatctgctccgtgttcaccccaggaatggatccttcatacaccaaaaacagctcagttaatcaacgataggaaacaaaaagaacaggtgaagaatttggcgtgcggatgaggtgttcgacggaatgtctcagagacaggagaggcgagctgtgggggaggctaccgctgcggaaggccgggatggagttggaggtgatggcgtccctgcaggcgcgcacggcggcggcggtgacgtcctgcccgtgctggtcgtacccgacgcccatctccacgaacagcagcctcatggcctcctgctgcccctccccgccaccgcacgcctgggtctgcgccgcctccatctccatgggagacgacgaggaggcgaccgctctcgctactcctgcggcgggcggcgccgggttctccggcctaagggatctgatccggcagcgaggcggccggcggcaggaggaggtggaggggagcagcggtggtgttggtttggtcgggcgggggaggaggaggaggcagctgggggatgatgctgctgacatcatcatcatcatcatccttccgctgtttcaataagccgacgaaatatagccatcgtgtgaccattatgattgttgatcaaggtcaaatggagttgcagaatacaccctctgttttcaaattaagttccatcttatagttttaaaacgaagggtgtagttggatctgctaaaacatcactgctatactacttccgttttaaattacttgttattttaattttttttcttagctaaagttatgatttatgaccactaatttttaaaaattcatatagtttaactatatgtgaaatatgtattataaaattatttctcatgacggatcttaaaatataaatcatctaaattaaactatatgtcttctaaaaaatattaaactatatgagtttataaaaattactagttaaaaaataaaatatttgatttaagacatatcttaaatgactgaatacgaaagtcgcgacaacatggtatccagaaaattaagtcaccgattatgtgcttacccgtgtcatattaatcatattgttatctcctacgtacgattaataacgaacacggcctatgcaaactgcgcggctaactaccaatattccttattttctattctaaattttcatttttttctaaattgtatttttatatagattgtaaactcttattttagtatttttttaatttttatttttataaattaaagttataaattgtatttctatacggactcatacgtctacttctattttctttttttaatttcaaattttagtatactgatatggattgttttttctttcaatatttttttaatttcgaattttggctatttaaaattgtatttctatattgtctctattattctttttctctgattccatattttaattaattataaattgtacaccagtatgaactctagccttctcttccaatattcattattttttaattatctatgtaaattgtttttctatatggactttaattaatatgagaatttctaggcccagcaaacgcggagtctaattttcttaggctgtgtttagatccagggtgaaaatttttgccctgtcacatcggatatactgacacacatttgaagtattaaatgtagtctaataacaaaacaaattacagaatccgcctataaaatgcgagacgaatttattaagcctaaataatccgtcattagcaaatgtttactctagcaccacattgtcaaatcatgcagcaattaggcttaaaaattcgcctcgcaaattagtcgcaatctgtgcaattagttatttttttcgtctatatttaatatttcatacatgtgttaaaacgttcgatgtgacaggatgaaaaaacctgttagcggatctaaacatgtccttattacttaaataagttaatgcattagttcttaatccaattggttaaattagaaataaactttgtgaatgtggtttgtttggtcatgtccatctcaagctttttttactccgattcctatagttagtttaagcttccgtaaaaaaaattatataactatataactattatggccgtgtttagttgtttaggtgtaaaaattttgaagtatacggacacacatttgaagtattaaatatagactaataacaaaacaaattatagattccgcttgtaaactgcaagacgaatttattaagcctaattaatctgtcattagcaaatgtttactgtagcatcacattatcaaatcatggcgtaattaggcttaaaagattcgtctcgcaatttacatgtaaattgtgcaattgatttttttttcatccgcatttaatgctctatacatgtgtccaaacatttgatgtgacgtttttggcaaacaaattttggaatctaaacacaccctatattaaatctaaactgttataatctggatctactatgacccaatggttattttttctctcttttttcttgattaaaattggaatttctatttttcttgtccgttttcactattttctatctttcttgtccaattggaatttttttgtccgtttccaagtttttttttgtccgtttcagctcttaggtttatcttttttgtccgtttctaagttttttttgtccgattggaatttttttgtccgtttctaagtttgttttttttgaaaagtactccttctatttttctttttttctttaaattaacgtgggattttctaggccgtgagagcgaatgtggagactcttttttctattactatgtagatataatagatttagctacctacatcctctaaaaaaagctacctacatcagatccatgtcatctaatcccagccttaccaaataatttggtactactagactagtagtagagttttaagtaggacaatatattctatgtgcacacatcctaatgcagttactacgttatacactcactcactgggcactggcgaccataggatctcaatcggatggattggatccaaacgggacaatttcgtagaaaactgcccgcttcttcacctgtcgtttgttcccgaagcaatcgattgttgatgacctcgggatggcaagcagccagccagccacatttcacggcagacggcatcctgcgtcaccgacgccgtggtcggtggaaaatggccgtggccgtggtcggtggaaagcggcggcggatccctctggcatttggatacaagcggcagcggacaggcagacgacgcccagcagcggacgagagaggcgatagctagcgggatcgcaaaacaggaataggggaacgacggaaaagaactgctaagaagaattgcttgattgacagttcgtggatcgatccagatcgagccgaacctggagcgagcgccgcgcattgacatctctcgcgtgagccgagccgagcggggtgcggatggagccgtgggggctggccgtcggatgggcgactcatccacgcgtacgtcatgcatctgcgtagggccgggttgaacggaatgaggtttgcacctcgtatgcacataatttttttccgaccatgcaatagggagaggtcatcacgacgaacccactctgatcccgccgatgccgtcgccaccgccgccgctgccaccagcatcgatcgacaaggaggaggcgtgcaacaccttcgatgaggacgacactgacttcaatcttccattgattgtgagcatagacaccttctaacagggattttgattgcgggaggcatcttgattattcatcttcttcaagcaatctcccgtgagcatggtctaccgagaagattcaatccgccgccgacgtcttgccgcacgtacggggaaggagacaattaaggtgggggagaagtagcaggagcctagataaagagaagagagaattttaagggtaatttgcgaacccactggtgaaaaagcggggcgttttttacaaattgccctgattatatcctatccatccatccgattgagatcctagctacgactgacagcaagtgagtgcacaaggcaatgagacatttacagtttgaagatgacgatatgctgtgtggtagaacttctatagtgaggggcgaaggactttaagagatgctacggtgtcctgattgtttgcttccgtagatttattcgcatacgcgaatacggaacaatatataaatgcatacattcttggtcaatgataggagaggacgacggaagaggacaggacgtagctccacttaggtagcaaacacttcctccatttctcatttacttgaaacatttgattgatgctgttttaataacctgatcacactttcaaattgttctacagattctgatgaacaaaaaatgtatgattgtattaccaatttatcatgcaatatattttggttgcatggtatattattttatatatttgtaaattaattatcgagataaggggtgatcatttttttaattaataagagaaaacataggtggtgtgatttttagataatcgattaaaaattacacccttcactcacgtagctacaaccaattattaaaaaaaatcactcaacgatgagcacacaccaacaagtggtatggctaagattagtaggtttcttatgaggttagggagttactgttatttcgttttctttttttcgagggattagggcagaagctctgcaaattttattatagaagaagagagaatcacaaggttcacctcttagaaaggtgtcacagcgaaggacataagggattacaagaattgagcttgtcatacgctttgcatacatggcgatgatagagtcaaccacctgcagaaccgtactatatgcaccattgaaaattctatcgtttctttgaagccaaatacccaaagtcatgtagatgattaagccattgaaatttcgtctttattctttgatcagttctcttcagcaagcttcccaccagtccagcatgtccccattgaagaggatgcattcacgagatggcgggagtgcgatgcgcatccacatgcgtgtaatgagagaagaatggaagtgaatttttttcctcgaggggacatcccctcgttttgtgcatgtcattcaaaaagttatcaaaattcgaaacaaaaataacaaatttgaccgtgaattacgcgttctattcatagttaaatttttttatttttatttctacttgtataagttgaattttaattggcatgttgtaaagtgacatatcacatattgatctatcctactaaatttttttaatttttttgatgactttttaagtaacatgcaaaaatgaggggatatcctcttatgtcatgatttgagttttccgagaaaaatgaattaagataatacatgatctctatttctatggccctttgatggtaccagggttaccacgcattttttagcgctaattaattaaccaccatctgaatagaaactgccaagtgttacttgtatatatgtacaatatataaatatataattatttgaatttgacacacaaagggtaaaaacaaacacaaccttaattttctcggttcttttctccctccttttgaacgcttttgcccttcgttttctcgttccaaacgcatgcaaattcatgaatcccatataggcccgaacgccgggatgccggccttcctgcacccgctcaccacgtccctgctcccctccgggttgctcgtcaccaccaccacctccgcgccccaccgccgcgccgccgccacggcgagctcccgcacgtccggccgccccatcaccgccgtgtcgtgcaccaccacccgccccgccatgctcttgccgcccgccgccgccgccaccgccgccctgatctcctcgccgtagttcgcctcgacgcccttcgccacccacaccagcgacagctccgtcgccgtcgtcgtgctcggctgcatcagcagcgacaggaacacgcagatgcccgaccccgtcgccaccatggtcgcccgccggtacatgccgatgaggtacgggaggccggcgaagtggacgccgcgaacccagaggtgggtcggcgggtcggcgacgaggccacgggtgaagtcgccgacggcgccggcgagcatcgcgtgggtgcgccgcccgtcggagatgatgccgaaggcgtgccactcggagagcggcgagcggctgatgcggccgagaaggcccgccctgacgccgccctggaaggtcaggatcgccgcgtgggtggacggcgcggtcaccgtcaccggcacgcggcgcacggtgagccacgggagggtggtgaagaaggtgatgccgcccgcgagcctgatgtcctcgcgccccgcgaggacggcgccgccgagcgggacgtaggacctggcctcccggtcgtagccggcggagagcacgacgaacgtccagagcagggcgagcgcgccccagccggcgaaccggtgcgtccgctcgaacacgttgtggtggaggtggcgcacgagcgggaacgccgccgcgcaggagagcgcgagcaggaagaggatggccgacgcgacggcgacgatctccggcggcatctcgtcgcggcgccggagcgcctggacgagcgcgtaggccagccacgcgacggaggacacgccgcagccgctgtggacgccgccgagggactggaggatcgccgtgacgcccgtcttggcgacgaccggcacccacggccggccgaggagcgcgacggcgagccagaacacgacgcggagcgccgcctcggagcggcacagcgtgagcgccaggatgttgcccatggcgaagacggcggcgcgccgctccgcgtacgggaaatggccggacgccgcgagcgcgaccgccgccgcgttcagcgcgacgcagagcacgaagaggcgcttgtacacggtgaacagtccctggtcgaacagtat

SEQ ID NO: 48685 - DNA, 2454 bp, Oryza sativa
  unsure (1)..(2454): unsure at all n locations
gctgctggcgcggctctgcgaccgtccaacgccgcagtccggcttcgccggaatgatcctagagaaggaggagtaacggctcgacgacagtagaggcagccagatccaccttccggtgctcggcgccgccggtggcggcttggcagggcatgcggcggcggcggcggcggcgatggcgaaggggctcgccggcgagggcttgggctcgaaggtgacgccacggcagctcgagaacttgatctcgatgggcttcgttgtcagctcgtctcgcccatccatggcgcgaggcagtaagcctaagaaactgacttgaattaactagggtttggtttgaaatcgccagtggttgtagaattgcatgtgtatttataagcagctgaagcaagcaagcatcagcatgaatgcatgggtagataggcttgatgaaagtgttttcaactctatgtcaaggggatataccagtatttttcgtgcaactcaaatagtcatcaaaatattttttaaaaaataataagataaattactatgagatatgctccaaacatacacgtttaaattcgacccatgtaagttcaaacaaaaagaacaaagcggacctctaaaaatattattttttagttatatttattatttttattctaatataacttgtatagttcgaatgtaaacttgcgtatttatggaataatttatctcatggtgatctatcacattatattttttttaaaaaataatgactatttaggtggcatatacaataaaatatattctcctaaggaatgaagatccatctgagcttgatattacaagttggcatgaaggttgtaaaatatatggggagtctttgtactatattttgtactttggactttcaacgtactttccaaacgtatacaactatacttcaataaccgtgcggagtcttttgataaggagtactactatctgtctatctttatccaattagtactactgtattctcacagcattatcaagctagttctactccctccatttcataatataagtcacaaccacttttttagatgttctataatataagaacacccgcaatagttatctatagtctctctacaagagatccatatcagcatattttcctacttggaagagattaaatgaagagagagcaaaactatctactaacctggagatagtctatagtaaaaaacgatgcaatgtattagagagctatagatacccatgtagacatactattgaggtgatttactattaatctagtctattgctgagatgtacatgttttatagagagcaccttactttaccattgtgggtgctctaaggtatgcatgcatgtagacaattaactatggccccttctccattaaattattacttttttaaatcctccactctcatgttctctaattctattggatgcatgaattgtatttattatgataatccaaactacaagatgataataattatttcttggtctttgagttaaaggtgattatgccttatattttggaatggagggagtacttttatttttacgaaacgcaatacacaagcaatgctcatataaacatgctcacgtttaccttatccctataaatacctccgaaaactaaaccaacgtatcttgagaatcataaagtcaccgcagacgcctcgcgctcaccctatacatatagacacctcggaatgctgaaccaacatatttttgagattcatgaattcatcgcagacgtctcgctgtcgacaaatatgtcacttacccctgaaagaataattagccataaatgtgggcatcgtaccaagtcttagaacttaaacccggatgagtagattccactaccagaaacttaatcagttgagctaagttcactttgcatatttcatttacatctcttagcacaagagaatgtgtgcaactgtatgcacagttcaattaagaaatgatgacataaacatgaaatgcttttggaaatattcattttttatttcactgaattaaaaattacactcatatgaaggacattgatgccggttttttaaataaactgacaccctcagtaggagtcaagctgatgagccagccaactgccacgtttttaatttggcttgttgctcgctgctctctcgctctctcgaagagcgctgctatgagtgtctcatcctactcgcatccaccaccgtgccatgagcatcgccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 48686 - DNA, 1454 bp, Oryza sativa
ggaacgagaagatgaattgaagtcagctcatccgcatctgttcgccagttcttccgaatctcgaggacgagattctgtttaaggggggtaggtttgtcacaccctaaaaatccaaaatatataaattgttgtttaattggaattattagaatttattttaaaagcctagaagagaagatctaattttaattaataaattccaatataaaatggggctgataaaatttcattaaatactttgcttaattctatgattcctagattattctgggatttatttgagctaaggaagtatttttaataaatggaattgcatttcatgaataatttaaattgaaaaaggttttttaaaagtctcttttggctttgggccgaaagccggcccaaaatctctctctctctccccggcccagtcggcccagtccagcagcagccgccgctcgcgcgcgcgcgtccgcccactgacaggtggggcccacctgtcagtcttcgtctacctccggccgccgccgcccgaaaccctagcgccaagtcgccgccgcccgctttccaaatttggccgcgtctttcccgatccggtgaaatcaatagaggggaaacaatcttcgggatctcctctaccttttctcttttggaatcatcgtctaaatcgctttggaagttcgtggattcgaggtcgaatcggatcgatctctttcctccgaaccccaatgtttctttcgcgtcgccggtcgccgtgggccttcgccgctgcctccttgcccctataaaaggatccccggtgtcgccgctacccgccaccaccattgtcttcgtctctcgccgtcggaagcgccctagcgccgtgtaactcgagccgcagtcgtcgccgtcgctccagccgtgcttcgccgtcgttccggtcgtcgtcatcgctcggggaggtcgccatcgtggtcgccaagtcgccgccgtcctcgtccgccccttcgccgtcgctgtagaccgccggagcaccgccgtcgtcgtcaagccgaaggtctccgccgcttctttctcgtcgccgccgccgtccgttcatcttccgccgacgttttggtcatcggtgagttcgccgccccgcgctctacgtcctggtgccctccgtccgcgtcgtcgcgccgtcgttcgccggcgagcaagcgcgcccgagccgctgagccgccgagccgccgccggaggtgacgtcgccgctgacgtcatcgtggccgtctgccgtgagccgccgtagacccgatcgatctcggccgtccgttttggatggatcgatctcggccgttcgttcccgtgaaccgctgccgtgcgcccggtccaccgcaaaccctagccgctgacgcaataaaccccttttccttttcaaaaataattcattattgcgtcataattcaattaaaatccatataagtgttttaatccgatttaatcttcaaaaattc

SEQ ID NO: 48687 - DNA, 829 bp, Oryza sativa
cggatccctgcacttaatctaattcacggaagtcatccctctgctctagacatagcagagctagccatggctgagctcgatctggagctcgccggcggcaaacggtggctcgcttgaggttgaggtcaaaagataaaatgaagagcaagctctcgcgattccattcctctagttttcttggttagaggacatcggagtagcgccgatggcgagtgtgagcggcggtggttttggggtgaaagtgcatgtgcgcatggaagtcgattacaacgaaaaggatgcatgcatgtggtcttctagacttcaggatgctcaccgtgggtcgagctagggttgtcgaggtcttggcggcagcggtgacttgtggaacggctcggcgacggcgctcctcctcgggtgaacgacgacggctcgaacgggacaatgagctgcttcaagcaagcatgcacgagggttgtgaggtcaaggagatggtgtatgcgcaaggaatcgaacaatggctcaccgaggcagcggtaatcgacgatgacggcggaggcgatcctagattggcgccggtgaagaaaaggatgtgttctccgtgttcttgatgtttccggctggggttcttgaggcgttttgaagaggaggttgaggcaatgacaatggcgcagcagctttctctgaggtgaatgagaatggccggacgacgatgatggttgaagcggcggcgctccggtgcgtgctccagggcgttgtcgacgtggcttgcgttcccggcgatgcactgcacgagaggggtttaggtcaaaagaggaaatgctcggcattgtgtggagagatgggaacg

SEQ ID NO: 48688 - DNA, 1716 bp, Oryza sativa
catttttctaggtataaaataaagccctttttaccattattggtccattctgaaaccaatggaactaatgaaaaatcatgctccaatcgagaaattaaggcagaaacttgatctttaatcatctcatcacagcacacggaggaaagtacttcacgaaaaaaaaagagaaactttcgcctccggttttgcctcagaccttagggctgtgttcctagcccaggtttcccaactcatcttcctcactttccacacgtacgcttttcaaacggctaaacggtgtgtttttttgtaaaaagtttctatatgaaagttgtttaaaaaatcatattaatacatttttgaaaaaaaaattagctaatacttaattaatcacttgttaatggaccgttttatttttcgtgcacactgttccagttgggaacaggctccagcgaacagacgaacatagccttagtcttgcggcgatcaatctcgtggacccgatgccatgccccattgttggcggttgttaaatgacaatccataccgccaacatcttcataaagtctagataataaaacatcaacatagtaataggtgcttaatcttacatattccacaagtgttggtgtatatttgtatgcagatgataaaccctgaagttgggaggaaaatcagactaaagtgaggagaactatgtatccatacaagtagggttgtgcacttcatcgaaacatcagtaaatcaaccgaaaactccgagaaatgaatagaggaaggtcccgagagtccaccgaccgaaggccaggccaggagggcccagcccaggtttgaccgaaccctctggttcggccgaaccccccgatcaccgttcatcctgggtttggcgtggatgctccagatgttctcccaatgacggttgcggtgcagttcggacatttccccttctcacaaccgtcataactgccctataaaaggacctcacttcattcactctcacacacacttccaagattgagctgaattataagaggctctattgtactatattgtacactagaataggaagagagtagagtagaagtagtcggaagaatttcggagttgtcggtaatcttctcctatttcttttattctatttattactctgaattcaatataatattcttcttgaataatttagatttatcttgtgagaattatctcttggttagttcctaaatagcatacgggattattgttcactataatcaactaaaatatagtgattgctttgatgagttataaacactaaagtagatattaattgcttagacgtggtatttaggtatttgttatccagtaattgctgcgtatccacagtacgtttgaggtaggtgtagaggtggtgacagctcttgagatcacttaagtcctccctgtccgggtacgtactagagcgacattgggaacaacgggttgcctgtgcctgaagtattgcattaggattaaagttaagctttccctagacactgttctcactagtaaatcctctctatcctggcctatcatttgcttggtgtccttggataaactggaggaagatctaaccatacatgttcctttggattcgatatccttggaatactccgtaagggaagtgctacctcggtatatccgtgcacttgcggattttatctgtacccgtattaaaaaccagcacccatatccttcaaatccaactcacaaaaaatcatgg

SEQ ID NO: 48689 - DNA, 1529 bp, Oryza sativa
ccatgcaactggtgtgatgcaaatgagaccttctcctgatcggtgcactgaagcaaatccaacttcttctctatggcatgcagccaatcaccagcttcaacaggattagtggtactagagaaagtgggcggcctcacacgaagaaattctgctaacttgttctggggaggtgcatggttatttccctggttctgctggttctggagttgctgcatcatcatgttcataagatgtgcctgttgagccaggacttgggcaagtgtgggattctctccattgttgttgttattgttgttgttgttgttgaggccattcccgttgctgcgagtgagcaccatctggcatgggcaagagcacaagaagagaaaccggggaaaactacttaggactgagaattaatttaacttttattgatcttaagtgagtttcattattacaaaactgaagactctcacaccactaaactcaccaactacctaacactcgaaagcaaacaaacgcatgcacttaccatccaccactgatgtaaatcacatgcgaggcacacacaaccaaacttaaaacaagcaaactaacacaacgatctaagacaaccgtttgacaaggctttctaattcttccgggcatcggagttgattgaacgctcgttcggctcgtcttcatcatcttgaatcgctccccactcgatcttggaatgggtgcgcttggattcttctacttcatcatcacttatgttgacgaccgaagaatccgctagggctggggtaacttttttttccaccacacggacctttggcgccaattggtagcgatggacaaatagagctctcttccttgcggtaagacgaaccctggccttctgcggtggtgcttctcccttcaacgcggctagttccttctccaaacgatccactttgtcttctagcttgcaaatcttaccacgattccgatcttcacgatcttgagctgctaacacagtctccacacggctttcatccatagcccacagcatctcaaccaaatgccttgtggtagcatcattctcaattccttcagtcttaaggtagctgccacggtcacttccctgtggttgacggggatggtagcgatactcagtgtcggccaactgatcactgtagcgatcgcggagctctcctatggcgatccttgccacctcctgacatgtatggatgtagtttcttcctccagcttcgaacatcactgaggggatatcttcactattactgttcaaggtgactttgactccgcacttctcttcgtgacgatcatgaggaatctgggcataaaaaggagcagtcccaaatcctatggcaaaggacatcgtacgcaactcctggacaaatccttcaacaccaaacaagtactcaggcttgtagcgcggcatctaaagacaagtgaaaggagggaattaagacatttatccaattaatagcacaagtttctggattaatttgaataaagttagaaaatcaaagtaaaaggtaagtaaataaagtaaaccgagcttg

SEQ ID NO: 48690 - DNA, 739 bp, Oryza sativa
acgattatacatgtgcctagatgttgctttaagggatgtataaagttgaagttaatagtttcgatttaatacatcatcaggccctcttttacatcccccagtacaagataactgattggttttaactagtaaactaatatgttttattttgcatggctctgtaatctttcttttgaaccttgaattttctttattcagttagcaatataagatggctgtttcactctttctacacacacgatgccatcttatgtgtcaaccaaccttaccctttatttgtactcgatatcatttgtaatatggggtatcatttatatcaagatttgtttgcattaaacaggttgctcttgcatctgggaataaaaagaacattgaaaaagtgaggaaagctcagcttggtatcaacctgcccaatgttgtaactgtggacgcatttggactgtcattaaatgaagatcatctgcatcttaccactgaatcacaagtaaagcttggtgaaatgctcgcacaagtctacatgagcaattttttgccagcaacatgctaggaggagtcctgtcaggtgaaataatctgtttaactctggaagtttggcacctaaatatctttctctttaaactgttattataattcttcattttctcgttggttgaaactatctagaggtgaaccaaccaattcatcttgcatttcttgcacagtaacattgatcctttcatttaacaggacatcaacttac

SEQ ID NO: 48691 - DNA, 772 bp, Oryza sativa
tgatctcaagtatgtctctagaaatgtaaattgcacaaatataaatgtgacaatcaaatgagacaaggagacaagagatttttcaccgaggtttggaaactcgccagtttcctactccctgttgaggcgagcccaactccaccgctcaaccacgaagccaccgcacgcccccttcgtcaaggggtgggtaaggcgggagccggcccacggagaggactacccaagcctcaatcactagggtagttcttccttcactccgaaggtggtgaactccaaaccactcacaaaccggcgccgggcctcctccacaatcttctcggagaggtcaccgggcaactcctccacaagccgtctaggaggtggcaacctccaatagtaacaagcaatgacccggcgtggagatgatcaatcaagtgccacactagctctacaaatgaaagcaatgcacttgactcttggctaatcaaccttctaacacactagatggatgaacacaaaactcaagtaggtgtgagagaggtgcaaaggatgtatgcaattgaattgggtgccaagagagtccccttgctgctggtgggggagtatttatactcccacccaccaaaactagccattgggggggaaatcccaaatcattgtgctctgtcgtctgaccggaggtatgtggccggtcagaccgtgctactctcaacggctagaaaactagccattgaagagctgtcagagggccccatcggcctggccggtcagaccggcattgagtgggcggtca

SEQ ID NO: 48692 - DNA, 46852 bp, Oryza sativa
  unsure (1)..(46852): unsure at all n locations
nnnnnnnnnnnnnnnnnnnnnnnnnnnnnnnnnnnnnnnnnnnntaaccgaatgcagtttggtgtaccagaagagagctcattgggtcagtattggcatccccatttgaatgatgttttattgttttgtttcacaataaattatcatggagacttagatttattttcttaacataatcaaatattggtgtcatcaggtgatggtttaggggaaggttatggcatgcttggacaggcaggaagtggaaagctacgcgtgtcaactgcaccaagcaaactttctgcaaaaattaccaagaagtacgcaattttgcttctctttgttacctgtcatcttgttttagaatataaaacaaacacttcaagaacatgaaatacattcagtgtgattgcatgatagaagttgcagtaacccataggcactgttagtgttacgcctgctaccataatgcctctaattctctttacgtaatctgccaaaataccaatattttgaatattatccccttgattctgtattgctgtctgatatcagattcaaggagaagagctatggtagcagtggtgcaacatcggggctgacttctagtttggcgtttacaccagttcaggtaaattaaagattttttagctgtctcgtttgcttcaaagataaataaacggtatgcttaatctttagttgttttgacttgggtcatggaaaaggtagtacatgtaatttttgtttatcaatagcttcaccagtagaactcttctaaattaggtgtattctgctatgctgctggttattgcacagcttcgtggattttatgttgctattcttgtacggtaagttgggtactgcacaccattgcatggttggttttgtcttgaaatctgacgctgtatgttttgtaggctaatatcagagttgatatgcgcctgcattgtaacatatttgcaattacatcgattagtatttttaatgtaacttttcttttcatagttaactgcgtaggagtcctctcgtcattttgtttttctaatgctctattatttgttttatcgtccaggggatagagttgtcaaatccacaggcccacggcaacctgcttggaagtggaactcagagcacctatttttcagagaccgggacgttctcgaagatcaaaaggacctgagctgataagcaaaagtttcttcttcccatcagcccacagacccgtcataatcctcaggatgcaccgatgaatccattttgtaatgtactccaccttatacccgaattcagcagactttcgtggtgctgtttgcaatctctagaagttcgctaacttccatacggttcaagttaattcgacatgctgcgtttgatctgatgccgtctttgcgttcaacacaatttactgtttttggtaggtgattatcttatctgtcatctcatctttaaagtgtaatccctcttgtttcttacaaggtgctagttttgcgtctagaatttctgaaacaaagataagcatcagttggtgttcccaacttcccaatgttcccatcagtccgctatcaaggcagcgtacacgcaagtggattttacataaaatctttgaccaattaacggcgaatagtctcagcataacctctatgtgatggttgcatccgtatactcaaaacatagccaaatgccaaaatttacatgtacaaaaatggggttgctcacactggttcaccctacagagaattgtaagacagaaaactgtctgaaccgagcaaccaaaaatggatacaacgctgcaaacaatgtaaaatgactattcacccattctacaaaaagaaaaaccatcgggatttttacagggctactcgataaagttcgtttactcagcagttcgctgaataatatgatctgctggatatggtgtacgacctagcctttgctcagcctaactcgcaggtcctattacttatccactttgtacagatagtacatctcgagccatcgattcattatgctaacacgaacagaaaatgatctttaagctagtaatgatttaccaaaataaatgctttttgctcatgactgaagaagcccgtcaccttcccaaccaagacgtaacatctgatccactaccttcaagctcaactgcaacattaccagctctattagaacgaaggttaagtggcaacgtaagtactttatggaaaagcaagtgctaaatggattttgatacatcaggaatttatggtactcacagcaggatcagtgaacactattagctgcttatcagcagtagacagtagaagatttgtgttctctttgtttagagcgattgctgtgacgtcctggcctttccccagctccattgtatgaaatacctgccagtaaaatatttctggtaaggttaccacaaatgaaaaataagccccccccttttttttttgcttgtgacactaaccttaagtttatgcagatcaacaaagcatacagaaggcacatgaacagattgcctagtttcagcttgtttagatatgccatccttgccatttggttcattaggttcatgatccccagtctcagtactgtcctcacacttataattgcttgaagaacatgttcccattaaggcgaaatggccatcagtagaaatctcaatgcaactaacccgtccacaaaaaggtgatagaactgtggtagcaatagggagtccattgacagtgaatgtagatagtcttttctttgattcattccaaaccagaatgaccccttgagaagataagcatacagcatgtgcctccgctacattaagcttccttatcagacgaccagtcctcaaagaatgtagaagaacacctgacatgtttgatgaggatacaacaagtcccaagtcaggactgactgaacagctagtcacttcctcaagatgtcctctcaatacatgcataggaccttcaattcgacgcctcctgatttctgtaaggttgctcacactaggactgcgtggtgttgtcggagttgttggtggaggctcaggggcatttttcttatgtaaggagcctgcctgatgaatcctccagagtataactgtggtatctcgagaccctgttacaaggtagttgctatcatgagaaagtgcaaggcaggtaacaggagcaagatgtccagtagcagtttcaatagtcttcgctccatctggggagatcaacttcacagaaccatcagcatgcccacctattattgagtaaaatggtattagaaagcagacgaaacttcataaaaaaaatcattaaataatggaagctgcctaccataacacttcattaaaatccagaagtttctatttgagaaaaaaaatccagaagtttttattcgagaaaaaaatccagaagtttcagatcaagctgtttgcttgactttatctagcgcaacaggtgttcagtattttaatttaaatccaatatatgcaagatataaagggcaaatttgcatctttggattcgaagtgttgtcacaactcacaaggcaatcttaaactacattgcttacatgcgcgtgactttttacattacaatatgaatccacaactccatgctgtgttccatttaatgcctttcttgtacgttagtgaatgtctagcacatatgaacttcattggctcatgataacgaatctgtctggtaagaaaatgattatgaatctataaactccccccaaatctagcaggtaggatgtctcatcctccactagtaagcagagaattccccagaaaatggaaagaaaatgatggatgaagaggaaagatcatctaaatgaacaaaaaaaatacatatagaagctaaagcataaacagtcaaaagaaacaattaccagtgataatctctttgtcacatgtgacagcaacaactgctgaactacggatgccagaagcagcaaatgctatagctcttgggaagtcataatcttctccagaactagcagatcctttaaaaatgcgcatcagtgcaccaccggttgaatttgcagcatttctaccatgatgaaatagaaagggtgtcccttggccatctggagtatttggttgccaatggtgaagtgccacatgagcagcaggcacatttacatctacaactacaatagagtcattggatacaaacatggtactggccggaacattgcagcgatctggatttggaagtaaatatgatttaagttcacttggattccggaatatagtctgcacagcaaataaaagggtcagtccatgtaaaaaacagtgaggcaggccgcaagtaatgtctactcttgaacatggaataccagctccaccatgtgaaaactagttagctacacaacccaaacttaattaaattgccagctaatgcttttgggttcaatttgaactactttccagtgttccacaccaggtaacttgaatctgtttacttgacttctatttgacaatactcctcatccaaggtggaataatttggttctgttcaaagaaatgctttgaatcgtttgctttgggggttgttctcaatagccagggtttaatatagattacctgtagatgtaaaacttctgccaatggctttctcctcatgtggggaatagttagcaattgagatggtgtttgtccaaagtaagcaatttgatcttgcatggcttgccgttgcaccttcagcattttcagttttaaaaaaatatgagcagatagatgacaacacgggaaaccaagcactagcttgagcgcatactagtacttactggatctgtgattttgtcaatgtccacagttccttcatatgtaatgtagaagaacacattgttggccattactgcttctttacccctctgtttaaatctgcaaaagaaatattcctaggtaaatggtgatatgcgaggagaaaaaaaatagaattggcttcttaaaaatactaaacagaagtcctatatcaccctacatcattcataaatgctaaatttcaataattcattgatatgatgatccaacaggaccattctacctaaaatacaagcagagaaacatttacaaactcaagaatcttttctgttcatgtggggcctaacttattgaactttgtcattgttgaaagtcttgcttcgtcttcctacaaaacacatctttctattcagatgcagaacttgtaacaggatgctccatcagatggctacagttctttagaaggatctaccattatacctagaggagcacactttcggaatgataacttgcagtaatggcttataatataagtacctattacaagtatcttgaatagcaagtgattataagaaagggcaaagggaaggtgaattacaaacttatttatacctacaccaaattatagagtgattgcataatataagcattcaaattaaaaaaaaaaaaggaaagtgagggtacccaaatattaaatcaatccactcatgcaaatgagcagaaacatgctcactctcaagagccttccggtgtttatggacaaaatcaacagggtcctcagcccaaggaggcaaatttacagaatctgcatttatgttcggggttacataactctgcttttacgaattgtactgtaaattttacacaagctgaaatacaagtacctagctttcctccaagctgagttgtcccgaagtcgatagaatttatattggtaaatacttcagggaggtaaaacatctcagggacctgataaatatcatcagatagttatattgcagcaaaagatcttgactggatttcggcgctgcctactcaggaaaacaaattgctggtaagacttactagctcttttacatcactcatgtcttcaagaacactgtcccatgtaccagatagatcagaaaacatacgatcagcatgatcaaatttgccgccttgcagctgtattgagagcgtagtataaggttccaccctgaaaaggtaatacaagacctgcaacggatatgtattgttatcaaccaagatatacattgaataaaaaaaatcaaacaacatattgaagttgttatattttaggatggagggagtaataaataaacatttgattcagctttaagatgtaccgtgccagcactggagtaatgtgaaccataatggaactttgggatgattggatcctcaaacgtagagtagcgctcttggaatttttctagtcgctcagggtttagtgcaccaatcggctgcatcaaataatactcacaacggttagcatcctagataggcaaaaatatagaaacaactgtcagaccaacctttgaaagatcccgatatgtacatgggtcatccagattaagaatttcggatcggtaatcagcaattatccaaggaaaaacaggatactgcacatgcatgtaaattgttagaatgataagttaccttgttttagagaagaaatacaagtgcagtaaactgacctgagttatgtcattgtaacttcgtccagccagtgtgttcagttccatcaagtactcaaaattgctaatctgaagaaattgaatatactgagattcaaagctaccaacaacagcatagaaaaattatatgttgtgttcatgtacctcccagttagcccagcgctccgtcaactgagttcttttgagaatttgctcagctctctgaatcaagtataatatattactgacaaacgtcattgcagattgatcatactagagattaggaaaaatgggtttcacacgaacctgggtagctagaaaaatgtcattcaaattgggaggcttgctgtgaacaattgcccgataagcatttttgcgtgcttccatatcctagatcaagtgcaagacacaagtataataaaattatccggttgcatcatctgtatctcagactacagagagtagagtttcataaagagtgtaccccaaaatcaaaaaagaaatttgacctatctaccataaacaattccaaagcacttcgccgcaacaaatatctgcaagaagtcattgaaaataaccaagtaagtgaatagaaataaaaattatgtggttaatgtcattgatgctgcatgcatttgcttcacaagtattgaatgcctatttttaatctcagcagacaagaatatccgcattgcgacttgataagagtacatcagaaaacaaattctaaacatggcatctgatcagaaaataatctttaccgtctgctatatatctgatgcagagaggagatcaaccaactcctatctttatcctgttgatcacattggccgctagtggacgcatgatcatccatgttactctcgcttgcactctcatcaattataaagttaatcctcttagatgttacctacaaaaaaaaaaaaacagggcgaaatgatatcaattaacagctaaagtgggagttgaagaagcagaataggatcatgagtagcaactaaatctttgtaattccaactgtgtagctttatatagcagaaaaatatagtaaagtgcatatagaattgaaataatacagattttgaacagatccaggactataacataatataaacacgatagaaggatagatgattctttaaagaaaatatattggatcaaagaaataggatgcatagtcattactaactaaattaggtaacacggtttttttagtattatccatctcaaacaaggtgtcaatggtttagccacaaggaaaaataactgtctatgtatttgcagcaaattggacgccctatgttttacttaggggtttagccagaaaacaaattatagtgctaatcttagcatcccctagaatttgatgaacataaggtacttcattgcaatagtttagatcaaacctttcagtatataagcaaataaaatacaatgctgcagtacagatagcatattatgacaaaaaaaaaactaacactgcatatatccgagtacgtacttgacttattttgcattttcagctaaaagaaatgtttttagttaatttggaaccatcagaacattctgttcgatctactgcagcaccccattaataataattaacatgtgcacactgaaatataacgcaagttgtagtggctaaaatccaattccaccatagtaactgagaagtgttataactaatacaccacacatcggtccacaattgcaacttgcccttgacattctttaatacgatccctaaaatatgtatgtttgtaaaaggaaaagtataagcttgaacaattgcatcttagcctcttggcattatttatttgtagcaagttgccttacaatgttatgttggagcattgcaacgcttactggtaacaaagacaatgttattcgatacacagtagctgaattatgtgatgagtaatcttaagacaattgacaacctaaaattgacattctggagtctatcagaacacatcagtatgacagatcgtggatgagccaagttgtaataaaattaaagttcactttctgattatttttttttaagaactggtcatggcaccatcaaaatttagtaaatatcaattacttacttggaatgttcctcgtacaactttcaatggtcgcaccatcgacgatggaagctcaacaataattctctcatcagcatcactaggcacatatccaggtgcaataaccgtcgaccgaaccaaattgcgatcagcagaaatgccagaacctcgtgaatctattgatcctttcacagactgttgatctgcttgttggagtcgatcgtcaacactgctttgagttgtgtctgattctaactgctcattgtcctcatttctgtcatccactgacatggcctcagccgttattataggtgcagttgatggaagtgtgtctgttactaaaggttctgtaccctctgggttgcattcatttgattgtgcaacattacttagctttcgctcttcataatcagcagctgcacccaaatgatcagaccccttgtggttccttttcataaatcttctcatccttgaagaactttcagtaaaatctaatttccagaaaatctgaaatacaggaaagaaaagaaacatcaaaagatgtcctgcaggttgtcttttccttctatttttgtttcttttgtaagggtgctagtataccagaatgcgctggtctggaaacaaaatttgctggggaacagggcagaaaaacacacacacacacacatatgcaaaaaaaaaagaagaaagattagaaaaagttgtacatacacgatcaggagcacacaagggttcaccgaaaggtccatatagtctgtccatctctgttaggcaatgaagaagatggcgccatgctcgaactccagttgacacccgatgtcgattcagcacatcagcttgtgtttgcctctccatctgcatgttccagagttcatatgatttatggtaaatttatatatcagaaatggacatattccaagtggattcacctcaactcgctgtaagttccgcgccaacgcaaaaccagagacaagaatagcgacatatttgtatgaaagggctgaaaaatcccttcctgaaactgacttggaatcaactgattgcaggcactccatccaagcagcactcatagcttcagatgtgttccacctctttgcacgctcaatatcacctgcactcctcctttgtcctgatgttgccattgctacagcactaagaccccttcctgaaccaatcttagcagtccgctcaaggtcccgagtagcagctaatgctgctgctttgacagctgctttatcctttggtgtggatccatgcttgttgggtgctgtttcaataggcttctggaaacttgtaaaagactgtagttttggtgctgctttacgctcaggcactgacgtgtcacgcctgttcaaggtccttggaggtgctattgcttctgttccagaggcaccagcagccatcatggctaatgccaatgcaacaggtggtgaggcaaaagcagcagcccaaccaggtgatatcattgaaagagcagcctgagttcaaaaaagtaggaaaaaccccttgaatatatttttttctttgagaaaacatctggcgataaaactttaagacagacaactagacaagtacaattttctaatctatgctaaatgtaaccacaactagactagacatatgatctcaggatggatatcaaaatgtttaccttatcattaatatgctaatatagttacataagcgggaaaaaaaacaacccatggttgctgagatactagttaccccctccctcccaaaacataacagcttctagtatttaaaattgtcacaaaatataacaacttcttcacctacattctcttctcaaccaatcacaaccttccaccttctaatttctacacctacttcctcttctcaaacaatcacaaccttcccccatttaatttcacctactttctcaatacccatgtccaacccaaaaacttcttatattttgggacagaggtagtacttttcaggtttcagcttctaggtttctcaaatatcaagtgcactcaatagtaccagattaggttaaggttgccacttgccagcttatgttaagttcatgatcattgaaagcaaccccaacttcttttcttccgcagtattagtaaactagagaggaatttttgtggactgcgtttttcccagcttaaggataaaatatgtaaaacaaacacaactgaaatcactagttggaaatttcatagatatcatagtggtatctatatgtcactgtctcactgatgtataatttagcattaataccacataacttaagctatagttggattttacaaagaaccagtccatacctcaatgggtaatgcatctgctgccaaagcgcgatcatcagcaatcagtggattttgcccatctgaagaagttagctcatgaataccagccaatagtggacgccaccttctcaagatggctataaatggtggtaaaatcagctcaatgtactgtttccttagggggctcctgtccctaccaatagcatgccatacctacagaatgaataatatcgcataagctttatgacaaacgaggaataacttctttgttatcccctacaaaataaacattgcaggaatatagtgcctaaacattataagcataaaagattaacatgcaacatctgtacatctacaaatttacctttgattatagtgtttggatgagcaaaggcaggttactgttcaaaaatcagaatcacaggcaaaaggtataacatggaattcgaaacaactacaaaatttggtactcaagagtaaataccgaacacactttatctaacaggtatcaaacataattgcaaacactgagagtaaaacaaatcaaacagctaaataggagaaaacgaaggaatgtggaagtatcaacaattcaacatgtacacaactgcagatgggcatcactatttcttctcttttttaaaagtaaattattagaaaagaaaagagaaaattaacagaaaaagaaaaagaaaatagatttaagatgtgagcatacatctagtcacttaaaaatttgcagagaaagaaatctactttcaggtgatataatctgtagaactttcttgaagataaacgatagaaaaaaaactaaaatattgcactattttttattagatgttccactccgtagcatgggtccacaatcacttagacaaactatatgcttaggttaagaatattaaaactaacctctgaatagagaatagaggaagcaaccaacaccctttgtctcttagattcattaattggcatattgagaatgggaccaagcacactgaaaaatcacaagagtaccaacaaaataagaattgataaaaccagagtaaacgccatagtcacctagatatattatcatgtatataggaagccaactgtgtttccatcaaagttgcggctaccaactgattgtgacatatcatgccttagagcagttatatttttcaagaaataaccaatgccagatattatatcaaagcatatagtatacaaatcaagaaatgttaggaccctgccagagattgttagcacttcaccagtcaccagtgcttttcttagcttggtggattttgctagtgtttcccctctcaacattacccaacattgaataaataattttcagcttccattttttctcctgcagttaaacacataccactaactttgattttaactgttgatacttgatggtgcatagtgcatacctccacagaagtgcagatcggggtttccttgtagatgagcgattgttgctgtcaagtggcatcatgcttccagcttgatggcccaacccttccgatatgacatcttttatgctgatgttgcctgtgaaggcatcaccttcaccattgtcatcctccctcattgaaacaagagtcattctgagcatgcaaaggaatggctggtcgctatccagcaactgataaagtgcagtcataactcccataccagggccggagccccctccaatacctagaccaccaccaagtccagaatcatctaacagcaatgcctgcagcactgcaactgatttcttcacaagtggaaggtcaacccaagtcccatttgagtccttctccagaacagatttccaaaattcccaaccacttccaccgccaccaaatgtatcagatttggatgggattccaacgccataccacaagcggctcctgtacttccaactttcagcaagatctgcaatgcagctcccataagaaacaaatgcatgtttgacagattcataaggttcagctgctgctgctgatgtaagacgctccatcacagcagcagagatttgtccgtttgaatcagccattgaagtaagcacctgcttgatcacacagtaaacaagaatgaaactacattcatatgaaggaacagtggactctatatatagtcaatacgtgaccagaaatctattaaaactaatgatatttctttcaatagcacttgtctgttttacatgcattatcatgctgtcaacttcccataattgtgcattctacagactgaaaggcatatgaattttcctacgtatcacatatttagaactttctttcagaattcctatccagtaaagtggtatgcatctttctgtatgaaccattagacatatacctccgtccattcagtattattgtctatgtagatttttttttaaaaaaaagaagagcagtattcaccatggcaataatattctcctgtaacatgtggttaaaaaccaatgcaggacagggtagcctaagtgactggcataaagagcctcaaagatataggtaactatgacgaaaaaccagcagtagtaagccagaatatagattaaaaaaattctaaaaacttaggtgactaattgtgacacatagtgccaccttttgcaactatgcaccatcttgaagaaaatagtaaatggaatctcagaacaaacatgttgacgaaacatgctagtgcatatagacctaaaaatacaagtattccagttttgagtcctgttagaaataaatatcatttgatcaaaatgatgctaatagctgaagtaacataaaatatatatagccatgcgttacatacatctaatggaaggccaccagcatcagtggacaaagatgatcgtcttgaggtcccagcatccataggctcattaccacttctacacaatgaatttgatcgactggcagcagacgaaaccattgaggcagaagggacagcactatcaagtgatctggatgtgcaaaaatgttgaccttgtgacctcagatgatcttctacaagcatcagaataactattgcattttccgctagtgctactgaaagatgagcagcattttccgcttgggtttttgcttcttcaggagataaaccctcagctgcaacaccagctgcagctgcagcaattacttcagtctgttgtatgacaagcaaaacaaagacattatagatttgactaacataagatgaaacagtatccatgaaaatgatagaattatcaaacttcacgaaattgtatcaaaacataacaaagacagctatcttcaaattaacataaacaatacaatgcaaatggtaaagtacacccagtaacattgataacagaaaccaatgccactgacatggtattgtctaggtgtcaacccttttcttttgtgcagagtaagcagtgatgtagtcaaagctaccagttttagtgttccaccattttgaccattacagtaccaaaatttgtaagttcatgctgaacttttctggattattaccaccatttaaactaggccaggaccaaactatacagcacaaggcaaaggtaaaaaaaactagtgcagaaagtagaaagagcaaaaaaatacaaaaaaaaaaaaggctcacacatatacacaaaacatctctgcacagaaagtaaactgtaacttttagaggaaagtccaaccacctggacttgaagttctctggcagaaaaatcaagcagaccgcctagcaatctcctttttaaaattggcaatgattcttcccgtctaaaagaacataagtgccatattgttataaaaggagcaagataataatgccacaagtaaaaaggccagaaaaattgtagagaaaatgactctttctctatctaagccaattgccaatttcaggtcaaaactcctcacgcattccctctgctagcctgcacacagaagggagcacgagagagagagagagagagagagagagagagagagagagagcacctgattctttggtctcctgtgctagatcctccaaccattgaaagccactctgcacaatgaattgttgcttccacatcctaaattgtcacagcaacaacaaaattatgaggaaataggccaaaatcagcaatgatacaagcatcacaaacacaaataagagaggaaggttgggatggcaacagcggaaaagattttctgcataggatgctctacaaaagaaaaatagcttgccttccacccatctttttgccgcattgaatgctccaacatgataatcaggaaattgtgtatgaggtcttcaatatcaccaatgcttatgccatcagcatatttcttagcacccatctataattagaaatttgtgaattagatcaatgggtagtggacagcacaaaatgtagcatgattcttcttgcaatatattctgacataaaaaaaaggcctacgatacttacctcatgattataaatcaaaacctccaaaatccattctggccattctgaaattgaggtcatcgtggttctattctctggatgactgcaagccaaaaacagaagatcctgaaataatatagagggaaattttgacaccataagaaatttaaacaggtaaggtcgcaaacaaggtttcaggaaaaaacaaagaatagataacagcaaacagtactgatgagcaaaaataataaaaaaaaaacaccaaacagtactaacatagaggttatatgtgggcatataatgcaatggaagtgaatatgattgtgcagccatgcaggtgtttggttaaaagcataagaatatagttaaacacggcatggaatattcccactaaatatgtgtcagttgcatagttcaagcatacattctttttcttttcttgagtttccaaaagaaaagaaatgtgcttgaacagtgcaaagtgacacatatttccttaattctcttagttcttggctgacttctactgagaacatggcagctggttgtcccatgtaaatgtattaaaccacagctgcatgtgatttcaatgagaataattagaataaagcaaaaagaaactgactaataccataaagcctaagttcaaaacagctcaaaatcctaagagcatgtttggatcacttgtcaatctctccatggcctatgtgcaaaacaaattgtgcccaatatttatggatggaatactagatcatttgtcaatctctcattggtctatgtgcaaaacaaaatgtgcccaatatttatggatgaagtactagtacttaacaaataacaaatcactttataaggatttttcactgaaaataaatgcatgccatattcataccctattgaccaaaagaaatattgtgtggatttatcttcaattcttcataatcttcacaaaaccacaaaacaacaaggcaaagattggtgttttttctgtaacaaatactactccacaattatcacaaggtaaaaaaagccaaaccacgcatagcatataccataagaaactaccatcgacatgacagcacaaatcctggaaagtttatggcaagaagatgaaaaccaacctgtatagcacgagattggaatgaccttgatgcatatggaagcgaacggagcaagactagcaacagttgaatatgttcaaaacggtggccacaatcatataggtttagattttcatcaactgaagaaacattgatctgcattcaagatcataacaacatcaaaagtagaaacttcgaattgtaaacagttgggtaataattaaatggaagaaacactaatctgcattcaagataatattagagtctagagcctataatactaatcaaacttgaaacactgtggtgcttatgccattccaaatggaatggacaaaaaaaaactaagtaaaggatataactgcaaagtccgccaaaactgacatggactcggacactcgactgggcagagaaaatctagcgttcatgcttatttttacttgaaataccataaagcacaatccaagagattttgttgatagaaacttagatatcagtttttcatgtggcctgagttgagaaaaaggtcaggtgataaggtaaccaacaggcaactaagtaatttactcttaagttaattaatcataggaaatcgatttcgtggaagtcaaaaacatatacaattatctagacagcacataaacaacataccgcagcagaaattaaagccatatagacatttacagtcataagcctccttggggctgcttgaaatgctttctgcagagcaaacagtaacagtgacactctatcttctgacatggtatttccttcttcatgaactgtcgtcagaaggccaccaggtaaatttggatttgcagcccttgaggcaaactttaggtgacctgatgcaactagagcacccaaaatgtgaatgattccaacaacaatgccatcacctttgtcaacattgtaaacattattccggacattgtcagcagtaattgagaagttgatgccacccaaattctttagcagctgattttcagaactggacaacttccttcctatacttgatcccaaaatctcacaaggcacatcatttgtgcttgtagatcccagctcagtatgttcttcatgaaggatggattcgtgctgttcaagttcaactgattgaatttgatcatcctggctctttgcttcaccactagcagcttttgtgtctgaatcatcattccttaaaaaatcattttcacttaaaagtgcatcagaattgtccaaaatactgttgttaccagctttagcttccctctgtaaaagaacgagaagtgcatccacaccaccacaagatatgaatgactgagcaaacatgttggctctagaaatgttaggctgcacaatcaacctatagatgaggtgcaacacccttgcaacctgttaacaaggacattgttaagatcacaagaaacagcttagactatattgtcagatgagctatatagataagatggccctagactgctacacatttgtattgtctttcaaatgatcaaggcaagtataaatatatcccaacagaaaaatagcacgtactccctccagttccataattcttgtcgttttggacaacaacatgatctccaaaatctttggctatgattttctattataatatatacaaaaaataagtaaatatttagcttttaaaaaatatttttaaactaatatatgcatcatgttctagtgtcttcaaattaaatattttaaaagttagtgatagtcaaggttctaattgtttgacctcaacctcatccaaaacgtcaagaattatggaactggaaggagtaaccacagacaagctttaagagcaaagagctgatgcaccatcaaatttgttgtgactcacggttaaaataatacccacttatccttatgatatgatgtatggaaataaatacatcaaattgtaactttacagttttcagtgtatatgctcactagatattaggtagtagtagtaccattatgatctttagttcaagaacatctgcgtataaaatatgtagaaggttgggtatttccattcaaacaatggctcaggaggaaacagtagaggcatcagcatgagtttgtctagcaatcaatggccaaattacctgattaggctgtgggcaatcaacaacaaatccaatcaagcagcgaacatcatcagaagctgctgtggaagatgctgatcctaacagaagttcaacaacaaccaagagttcatcaatcagagcattaatttcacccaaggatctctttgttccagtaagggcaaagttatcgatcgaatttggttcccggattgcccagtagcaccttctgcagctatcaagaagcatttgcaatgcatttgcatccctcatgcaagcagcctctgtaaatatcatgtctgcaagcgaggacagaagcttcttctgtaaaccataagtacatgaactccacatcttcaggtccaacagcaaagtactgaaaagctgcactttaagctcatggttgtttctttgagattggcacaaggatacaattgcatcaactagctcctcatcagtcactgcctccccctctccaccttccatctttggaaatgcttgtaattggtaatgtaaaacacgtgacaaaatctccggtgaacatgtccgacataattcttcattatttccaggatgctgaatagccagggaaataatcctgaaaattggggcagaaagagaagcagtggcaatcgacaattcaccaagcataggttcaagactatccatctgcacattgcttatagtcaacggaagtaaagccattggacccccataggctaaggcccataaagactccgcaggccgcacacgagatgaaacatgaaccaacccaagaacttctgcaggccttcggtgagtgcctacagttcaaaagaagatactatcaataaaatcatgtacatgaccgaacgtgtcaaagtgccactatgaggaagcttgggaattttttgacattcggttagcccagtacatatcaaaaatcaataatctgacatcatttcagcaacaaggaacatgatatatcaattactttgcacactgaaaagggtatagatgactcaagagagtgtcatcacaaagatttatcaacaattgacagaaactactggcattgaagatatgattcacctgtgagtaaatacaatttcttggtagaaactacagttagcagcttgctctcaagagctcccacctcatttttgagaactcttatgttttgctatgggaaaagccctattttggtcattcgactttaggatacagtttgtgttcagactgaattttttttcaaggatgctattatggaaacaaattgagaaaattgctggacaaccaaaactttttaaagatactatttacagaccattaaatgaaagtttctgaaccaaagcgggccattgaaaagttaaaggtcctaagagaaatcagagccctttttttattggtcaaaggcacattagttatatgactttgagcataacaatttgttttgtccagagcaagaatttaaataatgtgttcaggagtttgagtaacataacatttctgtatctatacctatttcactaaaactggaaccaacaaggatgtgtaaattggacctaaaacatataagttgatgttaatgtgggaaaaggggtaaactactccgtcaacaaaaggggggggggacaaacctgctgagccagaaggggaagcatctggacataatcgtccattcagaagactaggatgataaagaagatgtaagcatcctcctatctgttggttcaatgtaaaactctcttcggccatgttcttaacatggtcattggttgctctccaaggcaaacctgcaccatttccaaaactagggagtacatctcctccacgggatgccagacgacccatcctttctggcccaattggctccctaaaaatgtatataggtcccatttctgcaaacaatggacattgtcgcctccgcctctgcaggcctgcaatagttggtggaggattcgttccaatgcagcaaaatgctagtggttttgagatgcgtgggaactcaaaaggacgactctcatgcaagcttccatcaacgtacaaccgcaattcactgtcgccctttccaagcaaaccatgcttgtttgtgtgctccaacccaacgaagtaccatcgctgaggtttaaacgcataagtgaagtgcagagaagccttcttacccctcccacccccactttccaccaccaagaactgtccatggaagtaagcctccacaccctgattatctgaagagagaaagctaaaaagtctaggcatgtgtgttgttccttctcctgcaagagcgctggctgcagcagctgctgacattgctgatgattttccagatgttgctgcggctgcagcagcaatggcagctgcagctgttgctgtactaagtgtatctgagaatgattctatgtaaatccaagtagcaaacccgtagccattagagaagggccacctgctgtcaccagggccaagcaagccagagctctccccgtcaaactcaaatgtcgcagcaggacctcttgcttcctcactccccatggctttctcaagtgccagcatcagtggtgttgcccagcttgtaccaagcgccttcttaaccaaaccaagccacgaatgcaagtccttcacgctaagcgagtgcccacccaatagctggatgcaatggagcagtggtgttccgtcccagctacttgcccgacccattccaatgagtagcttctcagcagaatcgaggaggacgggtagaaggcccgatgaagagcacatggcacgattgcgtgtgcaggcgcggagcgtggcgtgaatgcccacggccatacgagtgcgcggagatggctcatcgccgcaggggaggtaaggcaggagctccgcggcaacaacggcggctctcgagttgaacatgatgcttgggggagcgccggtgccggtcttgtcttctacctcgtcgaggccatcggcgccgcccatggtgccaagcagcacgtccacgacggtgtgcggcaactcgccctgttcctcggagaccatctcgtggaggcggttcaccccggccgccgccgcggccccgcctccgaccatgatcgcgtcgtcgaccgcccgcacaacctcctgcggggcgtccggcggcacgcccagcggccgaggccttctcctcctcggcggcggcggcgacggctccgaccgcgccggcgtgaccgccaccgacgtgcccgcgctcgtatccggatccagctcgctcccctctgcacgcacctcgtcggcgagcgggaccgccgagaactgctcgtcggagtcctgccccgggggcggcggctccggcgaggaatccaacgactcgcggggttcctccgccattgctagggctttacgacatcaacaccaaacaccgaacaaggtctcgggaataaaaatgcgggcggaatcggtcaacgacagtgaaaaccgcgagcgattcgagagagagagcgggggtggagtggaagggggcaggtgagcagcgcgcaatgcggaggcgcgcagatctggtggcgttcgggggtgggattggccttgcggcgcagcggcggagaggttggggatcagcggcggtgcatggcgagatccgcgaggcggagaggatgggtggggatatcagatggacgaactggacgagaagaagagcaggaagggggagaggtagtagacgacgtggcgcggccggcgggttcacggtcacgggtcgcggccgctttccagtgtcgcagcctcgcacccagtcgcaggcgtttggactttggtgccgcggtttgggccttcgcggcgcattgcgcccgttaaggaagctgactaacaagttgggcctggtggcccatgtgacagagacagacaacgaacaccaattcaacgagcaggaatatacacttgttgtacgtgatgaaatttttttatgaatctggcaaatacagttttggagttttgatctaagcacaacccctagatggaagttgaatccaacatgatttcatttcaagagaagttcaactcattcaagatcaacagcacatgcagggccaggcatgatggaggagctgctgagctgcatcgatgcaggaccaacaataaaaaggagcaacgtactactcctattgcttcaatgcttgcagacaaaggaaaggtatggcacaaccgatggtcgttcacacgattgcgatttgcaaactgaatgttacggagtacttacgatcgaagtaggatgcggcctactcccatggacgtaaacacgtttaagacagtatacatgcatgaactgaatagcagaaaggggcattttctcgtccatgtactattactgctagttattccaatctcgcaatgctcgattagtgacctatatgtgcaagtgattacaatttaattacaaagaactttgacgagtaccacatggactgattaaaaaatctcagttaattctctccgcgaactactgtgacgttcaaaaagtgattagtaggtgagctcgcctgacagtctgacacgactcagaaagattgattagtccagatcttcgcgaggtcatgtgcaaagttgaaagcagcagtgcagcattatactcgttgagtcggtgcaactttgaagacacgctacacagccaagcatctagttagtgttttagactttcagtcacgcagtgctgcagaagccggacgcgatgaacttgtatcccttctggcttgaggcaatgccatacacagctaaatgcttgcctgaattgtgcaggctgacttttgcaatcttgctggaactgtggttattgtcttttcttattctggattttgaatttccatttgcatgctttccaagctctccgtgcatttcgtgcaaagaaaacaaatattatacaaaattcctgaaacatttttaaagaaactttccaacttcatattagtttaactcattcatttatatcctcagacaactacataaaaaccagattatgcataatttaatcaatttcaattatcttaaacgggatgtgtgtgttagttttgcagggtgtaggagcactgctatgcatacaactcatgcatatgactagcgtgcgactcaccttatgagactaatcagtttgctcggattcttttcatgctcaagtctttcacagcttagtcatagtcgtacatgggtcgtatgcaaagtgattcggagggcgtagtacgagtacaagtacaagtaccccaagggaaatctttttcggatttccgtagactacctaaatcgctaccatgacttatgaccaaaatgtactgagggagttcacagtggacttgtgtagcgttcagcatcgtcctcccatgtctgcaaaggagaaagtcacatgccacgttttcttccagacccaccaaaataaagttcttgtgtccaaagtttaccaccgggttcttggagagaaactactcgtttgggtggataaaagctaagagtactagtactcatttggatgggaagaaaaaggagagagatgaaaagtaaaaagtttgtcactggtgggaccccctactagtacttgcactgtggagtatgaagcttataaggttcttcgtctacgtggcatacgaggaacagcaaaaatcggcgatgcactgtgaacgccctgaagatgcctcacttcaggcggagcctctccgcttggatgatagaccgattatttgagcctctccacttggatgatagaccgactatttaagcttggaaggagttgctttcctcctttctctccgttaatttgtaatctgtaatttgaacaatttgctatgtatctctttcctctaattagctctccccctgttgatatttcaaaaaacaacactcgctggaatagtggaagcagctagcaccccaaagatcattcaaatcacagatggacaatagacataggtaacggcgcttaattgattactctgtgcattagcatttgtttacctcagcttcccccaacccaagggccaaggccccaatcccaagcgtcgaccgacaacaaacggccccattgtcctgtagcatttccagtaaaaaaaaacaaccctattgcttcacttattcgagaaataagtgaaacgatgtaaatcctattgcttcacttattcgagaaataagtgaaatgaagtatttacagataaaaagtaatttataaataattttttttatgtacgtgttcttaacaatttaaaatcaaaggtcaaaaataaacttagatgaaaaaaaacataaaatcaactctaaaaattgaaaattcaaattttagctgataagtataagcataagcgaaaagatgaggctgaaagctagcagagccgcagaggaaccttgaaactgatcgaaacccaccaggtttcagccacccgtttgctcgaaatgaaccagaatgaagcgctcaggcagagccgcagaggcgaacatcacatccttgccgtattttcctcttcgattcaaataccatgcggcacgcacggcctgttggcctgattctggattccagtcgctcacatacacagccacgcaggaattcatatggcacatcaatacatatatgtacctcagcaataacaggaaaaatcgatattggaataacgggtctagaatgggccagatcggagaagataaaagatcatctagtttacaggagtactaattaatgaattgacagtactctgatcgacaggtaggatcaaacactgaaagcctgcatatatgcaggaacccgatgcaaaaacaagcattgttctgttcctgctggagcatgagagcatgcatgcatatatatatgcctgatcgcttgatcagctagcacgcgcgaacgattgattaagggaggcttgggaacatcttggttaattcagagggctctcgctttgacgatgtccatgctcatctcgctgggatcggtcgcctgcagctccacctggatcccgtccagctccctcttgaaccggtccttggagctcgcgtacagcatcttgctcctcaccttcgacgtgtccggcgacctggaaaccaagtgatcacaccgcagattcagagatccaagattagtcgaggcatgcaattcaatgtgaaggcaaaaattaattaaaaggcgctggttaaattcatatattttaccaggagatgaagaagatcttgctcttctggcagttctcgtcggtgacgaagtcgaagtcgaagacggcgtagcggcactcgctggcgggcatggaggcggtgaagtcgtcgtaggtgtcgcccggctggcccagcctgtccacgaccacctgctgcgtccgctcgtcgatcttgaacgtgatgaagcggaagctcctcttcgacttgagctcctggaacttgagcttgcactcgtcgcccacggccatccccgacgctgagttcgcctgcatgcccagatcaagcagcaacagcaacagcagcagttagacgtcgatcgtattggcatatgtaattggtcgatcgtatactcaccatggttgataggtttcgatctctgcacggcggtgacgaggagagacggatcggcgtggaggaggaggtggtgggcaatggcgatggcgaatggcaaagagatcgatctccaaggcctgaaagaggggggaagcaggcaaaatatagataagcagctttgcatggcgccatgccgccacgttaggaggaggagccgggccgcgcgtttgaccaacgatcccccttcagggccttcactactatacgtgcgcgagacccagaccaacatgcgctccaccacccatccacccatcgccgtgattgcgagacaacggacaggcatggcacggcgagtcacaaactcatcttcttgtctgcagcggctgaatgcttcagaagttcagagaatgcgcaattgcttcagaagttcatctttggggcagcaaatactgctccagaaatctataacgcggtttatttgagtcgtcaagcgcactagattcttcaactggtatttaaacgaattattgatgactatgatggtaacaaaacaactagagactggcagagaagaggcgttaacagactggcagagctccttgaatcaacacaaacgcaatgttgacacccaaaaacatcacttctcaaaacattgaacagtagatcatattaaattcccgttgtacgttacaaaaccgtgatcccccaatagacaaaattgttcggaaggatcttcttctgtatcattactggtaagctacaaaggttacatagtttaaccaaagaattttacaactttcggagcttgttttacttttgccttagtgttggtattcttgtcaccatcgcctgtctctgtggtagattttgaactagattgtttagccttctttgccttggtgtgtcttgtttcttcttcttcaataaaatcgtcatcaaggtcatctccaccccggagaacagcattgtcttccaggtgatgctcctccgtattgaaagctagaaataagcagaagaccaaataaatgagcggctactaataactgtacggaaaaaagttaccagatgtttgatagcaccatcggacaaaattatagaccatctcaaacatataagaaatcataacttatctcacacattagcatgatggcatctgcttggcgccttagccagactgctactactaaaggcgtattcacccaattacccatcggcacagattctatgttacagtatagcatcatgttatgtttctttaacaaaacaaaagaggcacgcctggcaggctagtcattttctcctcataaggttagccaaatgcttacatctaagtattaatccttaattctcacatggatagaaaaggtaaacataatctgttcttctttctccaatgtattgtcaaaacaagcgtatggtctatacatccatgaaaacacttcaatggttatttactaaatgtaaacagtattaataacaagtggatacaaagatcagctacaagaagttagtgaaagttccaaattttttaaaatgaatcagcaaaagtacaatacacatgataccgtggaggaatgttaagacagttcccacaaaatgttacagttgaggtttgtgtttaccatcatccccagaagatatcaagtcttgcctccctctgtttggacaatgcttggccaggtgtgtaacttcaccacatatcttacagcaacctccctaacaaatgtatagagttagaatccacacgtaatggagacatgcaactaaataaaggaaagataatgcaagcagaacatccttcaaagtggacattttgagcccctaaatgcagaatgttatctcagtccaagatcttgtggtgataagggacaacagagtatctgataatacctttggataaatgccgtgtttgttttcaggacaattcttgctcaaatgtccctgctgtttgcagacaaaacagcttgcgaactttgtaccccctgtatgcaaaaatcatgctaaatgtgcgaggaaatcatatggctgagggtaactatttgcaggtatcgagtatggaaactggcaactgtatgagatgaaaggatgtattatttaccattttcaatgggtttggggcacttggaaagtgagtgcccagattcaccacaattataacagaatttcttcaaattttcatcatttttgtcagggcaattcttcaggctatgacctcgttgcctgcagagcaagcaaatctgaaagaagaaaatataaatattaaattttagcttgaaaaccacaaatgaactggtcagactttgaggcaactaagtactgaaaaaaaaaatactactgactgaaaatatataactgtgacagccagaatccactgattaaaggttggaatggaagcagtaaaacacttatcaggatggcctccagaagtcaccgttttgccattcacctagagatagatacaacgtgtgataaaacaaaaaaatacagaacaaccaatacacgcactgcccagtgcccactgctaggtattgcataacgtaaataacaccccgcaacattaaacagaacaaggcataaacagaacaataaacagaaaacccatactgatttcgttggttttaacccccaataataacagaaagtcagaaagtacaaatgctgatctaaacctaaggtcaccttaattgacgttcttaggtccatggcttctatagcaaaagacattgggccgagcaaaaattatccccaagagcttgcaaaaggcagggattttgagacaaatggtggtaggcagataccttgttcttctcccagagggacttctcggggcagaccttggcgacgtggtccgcggccttgcagatgaagcaccgctccccgggccgcatcccggggacccggagcgggtgcttcgacctccccgcgcctcccccacccgccttactcgtcttcttgaacatgctcttcttgttgttcttcttcttcttggtgccgtcggcgggaggggtcgggttggcggggaagaggcccgggttcgcctcgcggaagcgcttccgcgcttcccgctgccgcttgttcgccatcgccttgggctacggacgctctctcgccgtcgcgcgtggtgctgtcctcgagcttggtatctcactctctctctctctctctctgggcggcggcgcgcggcggcgggggacgggagtcgggaggggagcaagggaacagccgagcaaggagggcttcgttttgggaggcgctgacgctttgagattcgggctcacgccttgatccaccgtccacgcatctagaagcagtgggagccactccgcgaaataacggctaaacgaggggtatttctgaaaaaggcaaatcagggatctttttgtaaaattcgcgtcaagcgatctttttagataattcaaaaaaaaaaaaaaaaatggattacatcgattctgccataagacatacttcctccgtttcacaatgtaaatcattctagcatttcccacattcgtatcgatgctaatgaatccaagacatatatatgtcttagattcattacacaatgtaaatcattctagcattccccacattcatattgatgctaatgaatctaagacatatatacatttttcacattcatattgatgctaatgaatctaagacatgcatcaatatgaatgtgggaaatgctaaaatgacttatattgtgaaacagaggaagtacaaccataagtttaataagaaaaaggtaaagataaaaaatgtaaggggagaaatctaacgcaaaaatggtccagatgtccagcagttcagcaatcagcactctagactgaagtattgaagtcaatggcaatgcaatttcctgcatcgagtaattcagcagccaaggcaatttcctgtaaggaaccaatggatttacaggttttacagctactagccccgtctattcaaattcaggtacagatttcatcagtggtacaaactggactgtccaatcaacgtttatagagagactcccagaggacaccgaggtcaacattgcctccagaaacaatgatccctatcttactgctctcatgccaagcagagctttgcttaaactcgtcagagagggcggctgcgaggcctattgctccactcggctcaacagccaccttcagcatctcgtagcacattttcatggcgtccacaatggcattgtcatccacaacaatgatatcatccaccaagtcgcgcaccaccggcctaaaatgcagagatcaaatctaagaagttttcttgaagcatgactgcctgctgggtcaatagatatttcaaataaaaccgcataaatatttgcaaatgcatttggaaaagattgatgctgacaacaggttaacattttactatggttgtaattagtgtggggaatgcatttggagaagattgatgctgagaatcggttcaatgtataatgctttaccatgtcaggtcaccaagaaaagctcgaagtccatcagcaatggtgttggttgaaggcaatgttatgatctttccagcagccttggactgggcagaatcatcagcaccctttggttctgctgccagaatacgtattgaagggtttatggccttggcagccagtgccacaccagaaattaaaccaccacctgtagtgtagccaaaagtatatgcatgcgtcaaaatagaaaagaaagacttgtgttacagaagaagttaatacagtagagtacagaccactgattggaacaattattgtgtcaatttcagggacttcctccaaaagttcgagagacactgtaccttgaccactgaaagaaaacatcatatcagaatttgcatgattcactgaaaagttcatgtttgctattcaataagctaagagtacacattttaaagtggcaagacatggaaagaaactaaggttgttaaacacaagctgtatgaaatatgtcaagtagatattgccctttttagtctaggctggtatataaaaaaaatcatgaaacctggatgaaatatgatttaagagtaatgatatcatatacagtttgaattaagtgctgatttcatgaattgatagtgaaccaaggctactatcaagtaatttcatatactcgtaagaagaagagcctatcaaagttcaccccgctctgtccatttcaaatcccaaatggacttcttttgcatcaaagtagtaagctcaggaattgggactaccagataaacaatagagtactagtgacatgttcaatccacttagactttagcagcaccagtatctaggggtatgatatgttaaagcaaacagcttttagtctctgtacaatgtgttcatgatttgagatatgaacaaactttccgcatagcaacagagcaactcaataaaaaagaacttagaacagagaaatcatacctgatagtgtttttattattgaatgggtgaacaagaatagcaccagtttcctcctgaactcttttagcaacagattctcttgattcaatggagacatcactccagataatatggccaccgtaccgcttaacattgtcaaccttacatgccggtgcatttcttggaatgacaatgtaagcaggtattccgcgtagctttgcagcaagagccactgcagcagcatggttcccactgagaagaaaccatttcaatcagttcagttcactgtgatgcttcttaggattaggatgccaggtaacattgcaataactatgaagctagcactaacctgctatgcgtcacaacgcccttggatgcctcatcatcatcaagcgcaaatatcgaattggaagcgcctcggatcttgaacgcccctctacatcatatattcatatccccacacaagcaattagcagcaggtagaaattagcatggcagatatgccaaacaacacgcgggggggggggggggggcagtgactctcacgccttctggaagcactcgcacttgaagaacagctgcttccccactatggcatcgatcgatgttgatgacagaacgggcgtcttgtgcacgtatggtgcgatgcgagcctgcgcctccctgatggagtggatgtccgcggcatagccatggctttctgcgccatcgccgccacttccacctctgctccccatcaggccctagtaagtactcgtgttagctagcaccacatcaattctcaatattgtccttagctcagtgatatgggcttcaaattcagtgactgaaatactgcgcgcaagatagtaactagtattccatcaaaagaactgcacaaaaaataaaatctatcccattacattgaggggagggcaaacgcaaatggggactacatcagtggagtagtaactgcatcaccaggaaggcaatcaacagagaaaaatatcaagaactatatgattcgagcaggcaaggtgactcaagaaactaaccgaggatttggaggagcaggtgcagaaatcttgcgcggagaggaatccgaagcaaggagaaatcgcctaaccttgagtgacagtccgggcggagatttggaagttttttttttttcctatttgagcgatgaaatccaagaacctaacgagaagaagatggcgttgtggtgattgacgacttgaggggcagccgtgcagcctgcaggccactgtcttgtttgggctaaacttatctaatgggcctccattgttgatatctacgagatcgtgtttccgagcccatttaaagcaatttgcatctgctcagcccatatcgggtattaaccctaccgattctgagcaagaaagtcttcacctgaatctttcgcatttctgcttttacgtttgctccctggaatactagattcccagagcatcgagctgcgacaagtaatagctattaagccgataataattatactcgtcaagcatttcttgatcaatctgtgatcacgtaatggcggtagatacagaaagtattctagttttgcctttagggagtaatcgatcactgagtgtgagtcattcgcagatcaccatacgtaaggaaaggatcacagggaaacgctcatcactgtcagtgttccccagggaggtcatgaaatctgctcaatggggcacggcatagtgtattgcctctattttttacaagcatttgtcgcgcttgactaaaaaatgcacacattaaggaaatcactgtcatattaattttgacaaaaatgtcatctgctaatgctgttgcatgaaaaaatttgacagttatcatctgctaaaagagaataagagaccatattgatgattggctcctgctaagggtggagatcgctctatgcgggctgattccagagttgacattcacattttgcctgggcactaaattaactacggatagatacagcttagctggacgatgacttgccacttggaatgtcggatactgcttggcttttcttcagtgattccgtaggctactgctacaatcgatgtcagtagtgacacctgcctctacctgcagttcttcaggattcatgtactaagaacccactcaggaacaaccttcccctaaacgagctgaacagctagtcttaaacaaaccagttgtttaactagaaattaagcagccagctcaactgattgactgtcaggttaagctatcgcctatcggatgacgccacgatgcagtaaaacaaaaaacagcgccttgattaactatcacgcaactcgatcggattagctcccatgtgtttgacttttggatgccaactttgcgttaaatcgtccgagtttgaatttttcgcgcgattttaaacgaagatgccagatggctcttctctaaacaacgcttaaagataccatcagagcaagaaatctctgcgtggttcgagagattagctgttatccagggagaaccgtcacctgtttttgttactactccagttaaaaataacccaaacctgatttgacttcgattgtttttgaaacgccggccggttcgcttacacgtctgtgcttgaaaacaaattaatctgagttgaatttgattcgttgtttcaagaggatttcctggcagcatgcccaaccttgttcggctgttcccacatattctataattcaaaatttgatgcgaacgattgcagacgcaagtatgctggcaccacaagcgaacgaagcaaatccaggtcaaatttgaatttaaaactttttctatccaaagcgctccggtcatccaggcgtttaaatatttattcggggagtacttgacgtgtggaacgtttaaacgggaggcgtgatttcaaattgtaaacggcatctttgtcttttgtgtatgaatgtcttagcccgaaagacgtggacagatgcattttcaaaatgacctataccctccgtttatgaatctggacatacctaaatgtccagattcgttatgtcaaaattcgttgtattatactaggttaatctatttttgaaacgaatagagttattaaaaggctgcatgttaccgtcttccagagccttccagcccgctcaaaacaaaaagaaaggccctgaaaatgtcagcaaacggtagtgatccagcccacgtattcttgaggcccaagcccaagtttgattgtggaaaagaatctactatacgcacacacgtccataacaccggaacgcgcatcagcgcatcactgctagtgtttaatcagtgaaaaatgcctaggatgcataaaatttaataggcgttcatattccagctatatgaaaaataataacgctaaagtgtcaaacaagatttggtattactcgaagcacctcattttatctgtatgttaaaggcttattcacttctcctttgaaatggacactacattatcatttattttaaaagattgcaccaaagaaaaattcctatgcctccacttcaatcctttggatcgtttgctacacaaccataagaaattttcctatgtttttcaattcttaaaagtttgcacaagtattcccatactatttctacatttttttctattattacattttgaatatcctagaaacttaacaagccctaaacttataccattcacgttttgaatattaagtaaccatcgagttgtattttttgtgggggttgggggggtgtgataaatcttctcacactttggtttgtgtttaaagcttgaaaacctcctctcccattgacccatttatttgttgaaaccacgttttcgtatgggaactagaattgattacctgatgacaatgtaaccacatcacatctatttgtaacataccatacctgttaaataacttcccattataaagatcttaaataggagtacagtctaaataataatgcattgcaatctgaaaaaaaaaaacaccagtttcaagtggtgcacttaaccatgtcacaagcatatgctcgaaatgcaatggcgcctgacgtgtaccccaaccaggctgagagagcggtcatcggtcgacgtcccaactttcttttcacctcacgctacatgttgcagcgtttgcgccgttgcgctagcatttatgaggtgcacccataatttttcctactccaatgctgcgttcgcgagcactttcgtgttgcggttttccaatacgtaaccatgcgctagagcggtcgcgctctcttttttctttcttttttcattttttaccctctttttagtttttgagcgagcacgacgatccaccccaccaccccggcgcccctcacgccgccctccccgaccctataaattcggccatgtttaaaccatttcaccacaaaccagcagcaaatcaaacgatcaaattgtaagaaaggaaaataaaaacagaagccctcttccccaaactcgagggggtcacgcgaacacgctgccaatggcggcgagcactcgagccctcttcctctcctgcttccacggaagcggcggcggcggcggcacttccgaggtgagccgccgcctcgtgctgcggccgcggtacccgtccatgccgcggcgaccgaggtcggccgcggtcgccggagagggaggggaaggaggaggaggaggaggcgacggcgatctggaggcggcggccgtgggggcggaggaggaggagaaggtggcggtgttcgaggtgtccgggatgacgtgcgccgcgtgcgcgggctcggtggagaaggccgtcaagcggctccagggcatccacgacgccgccgtcgacgtcctcgggggccgcgcgcaggtcgtcttctacccggcgttcgtctcggtgagtatcgaaggctccgtcgctccgatttttccatatattttttttaaagcatgccgcgtttcttacgggctgcttgcttcccgcacgaccagattgatcagcctgtggatagctaggtaaatttaataaggggaaaaaaatgaatgatgctttgtgtgcgacatttttcggttcatactccataccgttagttgcgggtgcttatacgcaaagtggtttgatcttggaagtaggtacacgggaactttattaaattccaggctcccaggctccgggctcccagctatttagcgcgtagagacaaatacatagctgtgtaacattagcagtagatagacaggtagcatatcagacacactgattaaagcatgtttttatgaacatgttattagaaatgtccatacgcatagtatcacgaaaaaggatttgagtgagctttaattgatgctccacaagttcagaaatacttgaaatgtgaggtgggttcgtgaaaagttctctttgcggtttagaaggttacaagtagacatctttgcttgtgacgttgaactgctagctgcttttggggatcccttgaaacatggattggcctgttggatcccaccaactccttcagctgcaagtattaagatttgcacagacctgtagtttcaatatgaagacgtatttgataaaaaaatggacgtcctgcttattgtttgtagcagacaacctctgcttctggacagaaagtagaaaggaagaacaatctaatgtgcatgtgccatgtaattctaatttacctgatattcccaaaacgactgtttcaagttctttttactgaaatcagaatttcagatttaactaactaattttctgtaccacgtaaactttgtacttacctgttttgcttggcgacttttacactgttgcactcttcattctgttgcaaagttccaaattgttcatttggtgttccttccactagatgcaggcatatgcctgattagttactactaatactacaagttggaatatattttcttattcaggaacaatttgttactcacgtttatcatctcataattacgctctctgatcagtggcgcatttggggatgcaaaattgtaatcttattccccatcattattatcctgaatatattttcggaaaaactaatattttatttgatcaagatgtgtcgcttttaatcagtatcttgaaatttattagaacgaaagggggtgccttttctattattggatgtcattttcccactgtgcaaggctgtaagttcactgttaaagataatttcatttgatccccattgtaggacatgaaacaaaccaaagatatttcaacatagtggttgcttggtcatgcatttccttatttgtgtcaactctctctgcatctagtaacttttggtcagtaatagttagaagatgctggcacacttatggataaagtacattgcaaaggactgatattacaattcgagaaataatctttgatgtaaggattgaagttttgtttacaatcttttgagttgggtggcctgtataacacaaacagtatttcagttatctctgtcaggatcccactatgagctgaagcctgtctttgtcaccgtcccattggatagtgcctctttcttcgtagcgctttatattgattgggaattaaaaagaaagactatttgtgttttggatctgttgaatttctagaaaacatatattagttccattgcattttggataactttgttgttttctgtatttgatcaacatctaacagaacattttcatagtggtaccctttttccattttttcaatagttttacttcatgtttttacattacacatgtccacatgtttcaatccaatttttcttcctttcttatatgtttggaaattgtgctcatcaatgccatttgacaggaggaaaaaattagggaaaccatccaggatgtgggctttgaagctaagctgattgatgaggaagtcaaggaaaaaaacattctagtatgcaggctgcacataaaaggaatgacctgcacatcttgtgcgagcacagtggaatccatcttgcaagttgttcctggtgttcagagagcttctgtcgcattggctactgaagaggcagaaatccgttatgaccgtagaatcgttactgccagtcaactaacccatgcagttgaagagacgggttttgaagcaatactgatcaccactggagatgatcagagcaggatagacctcaaagtggatggcacactcaacgagagatcaatcatgatagtgaaaagctctgtccaagctcttcctggtgtggaagacataaaagttgatcctgagctccacaagatcaccatctcatacaaacctgaccagacaggtcctcgagacctcattgaagtcattgagtcagctgcctctggtgatcttactgtatcgatatacccagaagcagatggaaggcagcagcatagacatggggagatcaagcgatacaggcagtctttcttgtggagtttagtattcaccatcccggtattcctcacctccatggtgttcatgtacatcccagggctgaaggatgggctcgaaaagaaggttattaacatgatgagcattggtgagctcttgcggtggattttgtcaacgccagttcaatttgtaattggccgcagattttatactggtgcttataaagcgttatcccacggctcatcaaacatggatgtactcattgctcttgggaccaacacagcttacttctactcagtttactccatcctccgagctgcctcctcacataattacatggcaactgatttttttgaaactagttcaatgctcatatcgtttatccttcttggaaagtaccttgagatcttggcaaaagggaagacctctgaggctattgccaagcttatggatcttgcaccagaaactgcaactatgttgatatatgatcatgaagggaatgttgtgggcgagaaggaaattgacagtaggttgattcagaaaaatgatgtgatcaaagtagtcccaggtgggaaagttgcttctgatggctttgttatatggggacagagccatgtgaatgaaagcatgatcaccggagaatcacgacctgtggcaaagaggaagggtgacactgtcataggagggacggtgaatgagaatggtgtgcttcatgtccgtgcaacatttgttggatcagagagtgcccttgcacagattgtacggctagtagagtcagcgcaaatggcaaaagctcctgtacaaaagtttgctgatcagatatctagagtctttgttcccctggtaagttcagtttcatcgtggtaattcaacggatatcatttcttatcaattctaaatagtcttcttcatcctttcaggtcatcattctttctttgcttacttggcttgcttggttcttagctgggaggcttcatggttaccctaactcatggataccatcttccatggatagctttcaactagctctccaattcgggatatcagttatggttattgcatgcccttgcgccttagggcttgcaactccaacagctgtgatggttgctactggagttggtgcctcacaaggagttcttatcaagggtgggcaagctctggagagtgcacagaaggtccataaaaaaacattgtacttttagatgcacatgtttgcaaacatcaaattattgacaaattttttatggcatttataggtcgactgcatcgttttcgacaagacagggacactaaccattgggaagcctgttgtggtcaacacaagactgttaaaaaacatggtcttgcgtgaattctatgcttacgttgcagcagcagaggtatgctttcaagcttgctagatctttttgattcaatgcctttattacttgtagcaaaatatcattcctttgtgatatatgaaaaggttggttgagggcatagatgtatgcctagacccacccaagttcaagtcctcatcgaggcgaattcggatgcctatttcttcttaattaattaaaaatgtcacctagttcctcctaggttggttaaggttcttttgttgtgatttgtaaaaagaaacattgctcaaattttatcggttctggtcttcaggtcaacagtgagcacccactgggtaaggcagtcgtggagcatgccaagaagttccattcggaagagagccatgtctggactgaagcaagggatttcatttcagtgacagggcacggtgtcaaggcaaaaataagtggcagggctgttatggtgggaaacaagagctttatgttgacttcaggcattgatatcccggtggaagctttggaaatcctaacggaagaagaggagaaggcccaaacagcgatcattgtggctatggatcaagaagtcgtgggcattatctctgtatctgatccaataaaaccaaatgcccgcgaagtgatttcgtatctcaaatctatgaaggtggagagtataatggtgactggggacaactgggggactgccaatgccattagcaaagaggttggcattgagaacacagttgcagaagcgaaaccagagcagaaagctgagaaggtgaaagaacttcaggtgagctatcataaaatcttttgcatgtctcctggttttttttgccgtaccgttatttggttattcacaccctccgatttttttttactcttgcagtcggccggaaggaccgtggcaatggttggtgatggaatcaacgattctccagcgcttgtatcagccgacgttggcctggcgattggcgcaggcactgacgtccccattgaagcggccgacatcgtcctcatgaagagcaacctggaagacgtgatcaccgccatcgatctgtccaaaaaaaccttcttccgatacggatgaactacgtctgggcgctcggctacaacatcatcggcataccgatcgctgccggggtgctcttcccgtcgacccggttccgcttgccgccatgggtcgccggcgctgcgatggctgcttcctccgttagcgtcgtctgctggtccctgctgttgaggtactacaagagcccaaaactgggccgttgatcatgcagtacacacgcatagcatttgcttagaataagaggtgtagatatctgttgacaatgtgctaatgtggttctaaaagaaatgtgctagtgtgtgttgtgtggcacctgaaatgtgtacattacctacgtatatatgcaccgtgtgtttacaagtgttaaatatggagcactttgccaacactagcaggtgatacgttgtagtgcaatccatctaatcttggcacttcctaacaatggaggggacaggtcgtcaatctcaaaagcagaaatgctaatgcttcgtgatgatgcccgggtttcccgtgcaacttggctaatcgacgttggtagttacctaactctttttctgggtggcatcatagtaacctaactaagcagtttagcacgcaacgcgcaattgagcacacttcgaaccaaaagatgccctgaactttactactactacctacgtggctcgcagtgggaacatttggtatctgagctgaaactttgcatgggaatttgggataatttggccacttgcattctgagctgaaagatagtgctccgactagggcagtggagctatcttgccgagagcaggcaaacacaactggttcagtcttcagcttagctacctatacaccttcgctcttgtggccgatcattgtcaagggccataacccagccaccgaattaaggcttctacctgatccactgacctcattgcacttgatgatagtatacgatcatacgactctggaaaacatgctcgatggctatcggttgcattattgaatttgttgcttgatccgccccatgaacaacagtaacccatcataaacattgggacctgtagtgagtttttatgggctccatagcctgttaaagcaaaaggttactttagatccttaaataaaggtctctcaaccacaaatctagatataaaataaccctaactattaaagccaatacaaatttaatccctcagtgagagatcgagcaggaattcctaacggcggtgacaccgagctaggatatcccctctcttcaaagtcgctgcagctcagggtaggtgtgctatacgctgttgggaagagagagggcgagggagtttaggctttttttttataatgtgaatgacatgtggatcttatatttttaaaagttttaatgtaccattattactaacatataggtcccattatatatttatttttattatttttttcagatggtgtcacacataaactccacgtcaaacaaagactaagtcaacgtgttatgtaggacaaaacaaccatctaaaaagatcaagagacttgatttgtataggttttgctagttgggctacgcattatagctggttttacaattgagggatacgattcaaaactcgactcctagacaaaggacctacaattggacgttatcccctgttaaaaggcacacggctagaccagaccagaccacctacgttgatcgttcatcgtgtccgaagcctaataaagcccaaacaaaggattttcggcccagcacagcctagctccacataggagaaagtacacccaaggtccctcaacttgtcatctaattacaaaatcgtcccccaaccgcaaaaccgcacacaaggcatccatcaacttacaaaaccattgtagactagatcactcggcggttttaaccctggttttgtccgaagtggtggctgagtcagcgtgagacccatgtgggacccacatgtcattgaaacattagtctattttcccacacttctttctatcccctcccttccaagcagatcggcaacggcgtggggagcggccgtccggccggcggagcgggcaggcgacggcgcggggagcggccgggcggcgggtgctcgtcctcctggtcatcgaggccagtggccggcatgctggtcggcaacgggcgcaagcaccaggctctgacgacgaggttctccaagacgggcgcttgtccccccggtctgcggcgaaacggcattcggcatggcggacgaaggcggcgcaacatccgggtgggggagaagcgagcggaggagggtggcggcgatgaagcggtggagggcggcggcgtccctccccctggtggcgatggagacccagcggcccttccacaggcggcgcaatgcacggtcatcggcaccaccatatgccggccgttcttgtgctgccgccaccgccaagccgacaccgacgccggcggcgagcgcggggaggcgttgaccgagctggaggaggacgacaagatggcgcgcggcgctggaggactcctcatgcgccgtttgccgcttcctccactccgccgccctgctcctcgtcgccgtccgctccatccctaaggagctctcccctcgcctcctctggacccccgccttcgagttcatcgccaacgaccgtggccaccccacctcctccattccacgcggtggagctcgccgacgactgatttggacttgggaggagctcgccggcctccccgcgcctcctctgggccctcgccttcgaactcatcgccgacgaccgcggccaccccgcctcctctctttccacgcggtggagctcgccggcgatgaacgatttggacttgggaggagctcaccggcctttccgcgcctccgccgtgccttcactctggctcgttcgctggcctccgccgggcctctgccgatgctcaaggggagaaatgggagagagagacagagaggagtaacggaggggagggagaagagaaagggtgttgacgtggcatcctgacatgtggggtccacatgggtcccacattgactcagccaccacatcggacaaaaccgtggtcaaaaccaccgagggattttgcaatggttttgtaagttggggatgcgttgtatccagttttgcagttgggggacgattttgtaattcgataacaagttgagggaccttgggtgtactttttccctccacatacgatattcgtgttgcggcccatgaggccatagaccatcagttaccccagcccgacccatcgtgctgcaagcctttgcaaccatcgacagttgagcaggccccccaaacgcgatgggcgtgggccgcgtggcgataatgtgtgcgccccgctcccctcatatccgtgtccgtgcacgagtgaacaacccaacccaaccgatgcgcgacgcagtgacgcaggcacagcgagttgaccggccgcgccacgtacggttggttcctcctcccaacacgcggcgggacccgtctccacgagccgccgttccctagaacgcggcggcaacgagcatcctcctccgcgtgggccacacgctgcgtttacaagcgttcacaccttcggcctggccttttttatactcccccccttccccaaggtgatcacgtctcgtctctgtctctcggcccaccgcttccatcgttcgtcctcgtctccacgctaccgtttcgcaaccacccgcttcctcctccggagaccgctcggccgccgctcgctccagcatggccgccgcgccgtccgccacctccgtccacgacttcaccgtcaaggtcagttcctcctctcggtcggcggcgctcccttctcgaagggatctgtcctgcagtgattgggatgggctttccaaaacccgaacccgctcgagcagtcgagccgtgcgtactttggggggtgggtgggggggggggtgcctgtaatccggggtggtgcttgacgtgaatttgttgagcagtagtaattgggtgtttcaccgaatttcttagcttgttttgcttggtgcgagggcgtgcaggatgcaagcggaaaagacgtgaacctgagcacctacaaggggaaggttctcctcatcgttaacgtcgcatcccaatggtacttaattcacttcattacgccccccattttatgatggaattttactactacaccgtctacacatcaacaggttgatgtaggattgttttagcggaatggctagctagaaaacttccgcaagtttttttttcccccaaaactttcagatttgttgtcttttgccaaagagaataataaactgctgcaaaacagaatatcactagcagattcagagcatccccagccctgttgagcagttgaactgaaccggtcccatatgaatcatgcaaatatcatgatacaagcacagctcattaactcattaactcgtattgtgaactgcgatactgtctttgtttggtctactgcaaagatggtccaaatcaataggtccactgctgcttattttatggaaccgttttctgcataattgtccttatctgacgtaggcagctctatatatatttttttatctatatggaaccatttcaccttacaccgctaagcattttcttcgaccaattatttcagtggcttaactaactccaactacactgagctgagccagctgtatgagaagtacaaggtccaaggtgtgtctttgacccgttgcctttgtatatctttgtatattgtaattgcctttgcatattgtactccttcaccatggaagttggaataattatctagttcatggtcacatggatcattaagctttagttattatatgtgctagtagttcttcactttaaacaattccggttgttgtggttcaaaccgctaaggaatattaccaatgtgtgatttgtaggctttgagatattggctttcccgtgcaatcagtttggagggcaggaacccggctccaatgaggagattgtccagtttgcttgcactcgcttcaaggctgagtatcccatttttgacaaggtaagttaacgcaatacttttaactcaatcagagtaattatcagtgtgaagcaaaatgatataagtcacatgttttatctatcgaagaggtgtttctgtggagtagcattgagtctcttttttttttatctgtcaggttgatgtcaacggtaacaatgctgcacccctgtacaagtatctgaagtctaacaaaggtgggcttttcggtgatagcatcaagtggaacttctccaaattcttggttgacaaggagggtcgcgtggtggatcgctatgcgcccaccacctcccctcttagtattgaggtaatgtcctgcactaccacttgcaatctctttttacaggctgaattgttaggctctcattataacatttccatactatctctgcagaaggatatcaagaagctgcttgggagctcttaaacctaaaggtcgggatctgtagagcaacctgcacttatgcactgtattcagcactgagagttgtattaataaattggtgacatgtacttcacaggttgcatttgcactatactccttgcatcctgaatctttattgtactctgtacctgtatagttttcatgtcaataaatttccttgctgtatctgtgtgtatgcatctcattggatcctttgtcggcgtgcactgtattgttcgtttattaagatagattcggccaaataaacatgcaagtatgcatttgagctgtcccaaccatggcaagcacaagaagttgcatggggggatgccttggtcatgcgttccaacagtttaagatgaatcagagcatactaatggcattgatgaacacaatctttccctaactttttcctcctgtcaaatggtattaccttgatcaatgtcatcaatgccacaaggatgctcagaaaaaatttgatttgttagatgcatttcataatcctgtgtttgtcttaaatatgactccatacaaatttcctggacatgcttctgaataagcttactatgtgtaagtgatccatttttttctgacattattagtttagtactcccttcgttttt

SEQ ID NO: 48693 - DNA, 11756 bp, Oryza sativa
ggatctttttttaggacctaactattataataagtggcttaaatcacgttatttccaattaatttactactaatacaagacatgttgtttgttgaggagcacacactgtgctgaggtccatcagaagtctaacaatcgtcttgtgacacctgaaaggaacaggaagcgtacagcaaattgggaacaggaagccgcatccaaaccttcaatgccagaacttgaggcagaagtgaaaagggcacatcagacactgcattaacaggatagcttgatcctttcaactcaggctctgtgtagttcccaaaagaaaattttttacactgacaaattgaatatttggacacatacatggagtattaacaattacatagattacgtgtaaattgcgagacgaatcttttaagcctaattgcgccatgatttgacaatgtgctgctacaataaacatttgctaatgatggattaattagtaggggtgaaaacggatcggattcgggtggatagtagtcataccatatcctataccatattttttaatcggattcggaggcggtgcggataatgtgcggatgcggatgcggagcggattattttggatgtcggaaatggtgcggagtcggtgcggactcggctcggaaacggataaaaataatcggatgtggcatgtatatacaatcgatacaacatctgatcatctgtacaatgagcaacaatgactcacaattcacatgactcatgaaagcaccgatcacatcataatataatgtcaagttgttaacgattgacttgtcttctgtccatgtaatcgacacatatagtattgacatcatgatatatcgcattcacataacacgtaagacatagaaattccacaaatattagaaaaaacaatatcacatgacatgggtgatagaacattggaggtccacaaatgatgtccaattctcatacagtactactaataagttgcatattgcatatgacataataacacatatgcagctaaggtcagaaggagatgatctagagaagtagacttcaattctgataataacacatacgacagagttggtgctggagatggcaggaggcgtcgccggcgccgagacggagacaaccaggtgactttggggtggagaaggtaggccgcggcgccggggtggagaaggcaggtggcggcggtggcgctgggtggagaagtcaggcggcggcgtgggaggaatggaagaagagaagtctcgatgaaaaaattggttgacacgacgccgacggagtcacggactgaactcctagatagattgatggataaggtggacgtggatgggctgaatgtttacacgatgaaaatgctcgtgtcaaatgggccaaattgagaggttatatgggctgtgaaattcggattatccgccaaaacgtttatcggataatccgcttaaaatagcggataatccatatccgccggatataaccgataccatatccgcatccgcatccgcatccggccggatatctaaaaacccttaccatatcctcacttcggacggattcggagcggataatatccgtttcgttttcacccctattaattaggcttaataaatttgtctcgcagtttccttacggaatatgtaatttgttttgttactagattacgtttaatactttaaatatataccgtatatccgatgtgacaaacaaacccaaaaattttccccaactaaacaaggcctcagtaagtttacttcatgatctgcccccaactaaacagggccactaaattgatcgagcagtggctgacatggaagcctgctgctgctcctatggccggaatggcgacgtggccagatgggccttgagatataagatggtggcctggcccaatggcaaagccaattggattaccagaacagaatcatcaattccaacgtggcaatctcggtacgtgattacctcgtgatgtaagcaacgaagtcatccaggtctttgcgcgacgaccgacgagccggcggcggccacggaggcgcggatggcatctccgagctcccgtgcacgttgtcgcatggctactcctccgttagaaagcatggcctcctcgatggcttcctggatgtccttcgccggcgtgacctcgttgtgcttctcccatggccgcacgaggacgccggccttgaggtacttgcagaggagctcggcgtcccatggctggtcgcagtgcatgggccaggcaagaatcagctacccgtggctcaggctctccatggtggagttccagccgcagtggctcatgaacgccgccgtggcgtcgtgcgccaggatctccagctgcggcgcccacccggtgatcaccagccccgtactcccttcgttgtgctgcgtgaactcgcgcagcagcttcgcgtggcggctgatgatctcgccggagtcctccgcgaatatgtctccgcggtcggcgtcccgcaacacccagatgaaccgctgattgctgccgcgcagcgccgatgcgagctcttcgatttgctccgctcgcagcgacgatgtcgtgccgaaggagacgtacagcaccgacgcagggggctgcttgtcgagccagtccaggcactcgtggcgctgccgctggtcgccctgcttcgacgcgttcccgtgcagcagtgggttcaacggtccgacggcgaaaaccttcttgccgtcggcggccaggttccccgcgacgacgtcgatgaactcgccctcgagcgcgcgacacgtgttggtcaggatacctctgggaggcgacatctccttggtcgccctcgtccgtctgatgtaatccacgaactcctccgttgcacagtcttccacggtgatgttggtgaggccgttctcgcgcaggatccgttggtgctcctggggagcaatcctcctagcgagcatcgacacggccaagcagtacatgacgaacgcctcgccgttgcgcagccgcgccgcctcctgtgcggcgaagtcgttgatgcggtcgtacacgacgacgacgcggcggtaggaggcggagagcttgtcgaggagagccgcgagcggggcgggcgcgccggcggtgtaggcttcccagaggggcatgaggtgggaggggaagggcgaggcggcggcggggtcgggaggcggtgaggcgtacgtggagatgccgaggtcgtggaaccggacggagcggagcgccgcgtcgtccccgccctgcacccgctcgcgggcctggcggacgtgagccgcgggcgccgcgtagtgcacgtccaccccgccgcgcgaggcgagctgcagcgacaggtgcaggagctggttgaggtggccctgcgccgggaacggcaccgccacgacggccaccggctccattgtaggctcgatgactgtgctcaaccttgatgggcagatgcggctatatgtaggctgcgggcactggcgtttgcgggtcagagtgagctcagccagtggtgaatcaaaaggcaacttggcatccgtgtggaaatgggttgcaccggaagcttccgctgcaccgctaacggctagaattgctccgatgcacagccgactagcaaataatattccacagtccacccggctccattgtgtgtcataccaccatttttctgcgggagaggattctaataactcgagtggatgtccacccgtttattgcatatgaactagatggttatgaaaaatttttaaaaaaattgacaagatatatcaatatgtaatatatcactccacaaacatgcaagttcaaattcaacttctacaggttgtaacaaaaataacaaatttaattgtaaatatacatatagtaatttgagttttgtttgttacaacttgtagaagttaaattttaacttctatgtttatgtattgatatattacatattgatctatcttattcatattttttttatttttttataactatttagataacatacaataaacgggtgaacgtccactcgagctgttaaacagtttcccatttttctgcgcctcgttcggcggcctatatatgaggttattttttcccaaagacaatgttgtacgtagtactacgtatatgcttacgtgcagacaccaccatacacatccatccatccatcctctcaagcatgcggttttgccggctgcagattggaccacgtggcaccgttaaaagttgagataaatacgagaaattacgaatggtaaaaaactccacagcggtaatttcgggtgtttggtctcgcgcggagagtcacgtccttgtcaatctctctcgtggatgggcttgatcagcccatgagcgtagccaggagccatgttggcccatcactatgcgtggacagtgcgggctgagccaacctcgtgcagtcgtgctgagctgcccagcctcccacgcacgtgggatgtggcttagccatgttggtgcacaaacattgctacgggctgaacgccaagccttgtggacagtataaacatgttgcagtatcaaatcctaaaataataataaagaagtgtggtattttgaaaattgaagattaaagatgtaggtgccaaaccaagctgttagggcatccacaatgtacttcaaaattaagtagtccataagcaatataatatttattcagctacctagcaacattgtggaattagtccataaaaaaaaataacaaaagctacccataagcatatgggttgcccatagagaataaaatatattatttgtctctatctcttctctcctactaatactatttgctatccatatagtttgtgaaggttacaatagttaaagttcatatatatgggtctcatctctatagactacttttgccatatacattgttgttgcccttagcatcctgtattatcaaagtaatattaacatacaaaccataaagtagcaaagcttttatccttccttcaaataacaaataaaatataaattgtaaattgtaaaaacatttaatgctaactctacgagttttactgtttagggaagtgtggatataaacaactccaagaaatacaatgggtgaaactgaaattcctaacaagcaagttaacaatgatgttatcctatatctatattcgtagagaatgaaaaaaaaaagaaccagagaatgcaaaacaatcagtactagtatatgtattttcttataattccccaaattcaaacagattatatgtaaatactttcaattcacaaaagtggcaaaagattccaaaaatacagttttctacattaaactaactaccaccttgaatgctttttaagcatatattactatcatactttcatttttttctcttcataattctacaaacatgaaactaagaacacactaaaacatacctttaaaagtatggtgtttataagaaattttatgagtatgtaactaactgctataaaaatgtaaattccaaaaaagatttaaatagcatatatataatctccaacaaataagataagacacatgcttaattagcgatcacgccaacaagcgcgcctatcttctagtacatctttctattattctatacacattcgtgagtatttctttctaattaatatattttgattttgaagatgtggaggctaacggtgaatttttgagctccactaaactctattaagatccgccatttggaccttcacatttcctaattgttatttccaattttttcgagtgccgggggtatatgttcgtaaataaataataacgtgtttctatatctgagtaagattgttcagaaaaaaacaaagactctgactcaccaccctcttccccgctgcccgccgaccttgccgctggtctgtcaccccggatctggacggcaccttctccgctgcctcggtgcacctgcccgctgtagtgtcctcgggggaaggaagggagctccgccgttgtgatccttgcggtcagctggcttgtcggtggcctgctcaagcagcggcgatgcggagaagaggagggaggtggcgggcgacgcgggcgcttggtcgccatctgatggggctggagcgagacacaggtagtcaggcagttcccttgaaaaaatatatatcataccaccgttcataaatataatcactttaggttgtttagcgaaatttgaagataagagaaaatattagttttcagtgattgatcaaattttaaatttggaattgttagtatccccctggtaggatcctcatagtctgaaaataatttgaatccccgtaaattgagatcagtatttcagaaatgcttatattgctgacataatttgaattctacaaatacttatatttgataacagagagagtagtacatatattttcctactgtgagcatttttcaaatttaatatattttgacgaatgattcaaatctactccctccgtccagatgtgatacatcctagtactacgaatccggatatacatgtctagatttatagtgctataatatgttacatcatgttctagatttgtttttaataggacggagtatagtatatccgaccgctcgaagaattagagacattcctgcttcatcttgtgatgtagccaacgaagtcatccaagcctttccgcgaggacccgccgtctgccacagacgcgcggacggcctcgccgagctcctttgcccgccgccgtattgtcatccctttctcaggcagcatcgcctcctcaatgacctcctggatggcctccgccgggaccacctcgctgtgcttctcccatggcctcacgaggaggccagccttgaggtatttgcacaccagctctgcgtcccatggctggtcggagtgcatgggccacgcaagaatcggcttcccgtaactcaggctctccatggtcgagttccagccgcagtggctcatgaacgccgccgtggcgccgtgcgcgaggatctccagctgcggcgcccacccggtgatcaccaaccccactccctcggtttctgcggtgaaccgggacagcagctccgcgtgccggctctcgccggagtcggcgaatatgtcggcgcggtcggcgtcgcgaagcacccagatgaacctctgcttgctgcccttcagcgccgcggcgagctccgcgacttgatcgccacggagggacgacgttgtgccgaatgacacgtagaggacggacgccgccggctgcttgtcgagccagtccatgcactcgtgccgcgtctggcctggcgtccgggcggtcgcgtcgagcagtgggttcagtggaccgaccgcgaaaagcttcatctctttgaacatcgggtgcgcggcgatctcgtcgatgaactcggcctcgatcgcccgggacgtgttcatgagcatgccggagctggtcgcgttctcttcgtcctgctcttcccggctgatgaactccacgaattcctttggcatgcaggcctccacggggtggaacttgaggccgtgctcgcgtacgagccggttctcggggtccaaccacccgatgttgtacgacatggccacgcactgcagcccgaacgcctcgccgttcggcagacgcgccgcctgggcggcggcgaaggagttcaaccggtcgtacacgacgaccacgcgtcggtagctggccgacagcctctcgagcagcgcggcgagagggacgcgcgccgcgacggcgaagctctccagcatgggcatcaggtgggacgggaagggcggggcggtcgggtcggggggcggggactcgtaggcggggacgtcgaggtcgtggaagcggatggagcggagcgcgtcggggtcccagccgtgcaggcgcaaccgcgcctgccggaggtgcgccggcggcgccgcgtagtgcacgtccagcccccgcgacgcgagcagcagagacaggtgcatgagctggttcaggtggccctgcgccgggaagggcaccgcgacgacggccaccgattccaccgtgccaatcgccatcgagtgctcttgtcactggttgcttgtttatgcttgtctatttctaggatttttaatgccccgtagcctatacacttttacaggttatatatagagttataggcacacacgcacgaacagtcgaagacaaatatgtggggaaaaagttacatcagtagcttccaattcccattgctgatatcgcgcagatccagagcatcagagattcgagggctgacacggacgcacatctgttcccgccccctcgcgctcatccgcccttcctagaatgctcgtcagcaacaacggcgcttccagccgctggctcaatcattgtcagagactgcaggagcgtggcgcgctcgtcatcagtgacgactaacgacggcgtcggcgggccgatcgcttgtatcgcggcctctccaaaacggtacgtaccgccctgttgcggctctgcgatgatatcgttttgtataccattttggcatgtgctctgtatctcgattctcgaggcagagaagttgttggttggttccagggaatcttactgtttaaattgtactacgactaatgcactgttgtcatgtgatgttttagttcactaatagtatatgcacttttggtgcattagttaaacttgcagcaaattcatgtgtggaactgtggatcgacgaccagggcgtcgcacatcgcacatcaggctgattggatactacagtactactcccgtgcgatgaggctcttggaccagaccggcctccttcttcgttacgtacgttacgcgaagatgccatcgtccggcagtcggcagagtcccagagattactacatagccgttctcaccgtgtggtttgtttcttcctccctcgcgcgcatgcagcaaacgcgaagaatctaccgcacggtccgcaccgcgtttaattttctgcatggtcgtcgccgtccttgctgcggacccttgcctctgcgtcgttgtccaaattgggtgccacgaaaaaaaggcccaactggctgatcaccacttgccaattgtaggtcgagcgccggcaggcaagttgctcgactgctgcacttgccaacttgcatttattgtacttactcctatcctacaaaatgtatgtcgttatagcagtaggggtaaaacgattatataaaacgaaaaacgagataagttattaacggatgattagggttcaattcattttctaactgaagattattactggtacgtaaaatgagataagttattaatggatgattaattaaatataaactattataaattataaaaaaatatataaatatacctattgtttaaccgttcattaagaatgttaattgaaaataaggaaaagtcaaaacagagatgttgaaacgaactcaaccttacaaaatgtaacaaatgctgtactattttatgggggttgctatatgttttttcgattttttttttgcgctctccccatttgctggcgcgttttccttttctcgatcttttaatctttagcgagtgtttttttatttttaatgtattttacaatttagatattttatctcaactttcaaaacattctatttaaaactttcaacttaaaattcaaaacttaaataaatcttgagttgaaagtttttaaatcttaactcgaaagtttaaattttgagtcaaaaattttcaaaatttgacttgaaagttcaaattttgagttgaaagttttaaaaatttgagttgaaagttttaaaaatatgaaatgtaagtttatatacatgtatgtatgtatgtgtgtgtattagtagtgctatttgtagtatagtagtagtactactaccaccaccacctagcagcagcaacagcaatgctagtagttctagctgcgcgtggggcccactagtagcagcagaagcgctagtaggcgctagtaataacagtagtaatctcttcatgttgtaagactttcaagcattgtttatattcatttagaagttatgtgtctagatttattaacatctatatgaatatgggtaatgctagaaagtcttacagaggaagtagtagactggtactctagtagtagtactagtagactagtagtagtagtaggagcgaactgttcatgtgcccacaccctgcgcgaccagtcgcgcattagcccccccccggaaaacttgtctgtcggcctgtacacgggccacgtgtggaggggaggaaaggaataagttcaccagccgtcccttaagctttatgtcgagtttgtataacatccctaatccttaatactagaaattttcactcctaaactatataaaaccgtgcaatttatatcttatagcagtactgatctctagtttcacttacgtggcatcctagtaacaaaaaaaaaaattataggacccatatgtaagagagaagaagaaaatgtagggtccacatctcttattttttctcttttctcttttcttttctactctctcttatcttcttcagcgagcctgggaggccgtcggtggcaaaggggggagaggtggttcaacggttctgggagagagggggaggtgtccggtgagcccgtccgagctctgccaccgccttgagctccatgcgaagggaggagggaacggggtagatgtagagattgacgaaaatcttggcatggtagacgctggacagggtggcaggtgaggatgacatgtgggcccgcatattttgttttaattttttagtttctagttttgctcctaatgccacatcagccactgcggacttaccatgcatcgagggaccttgtttgaatgattttgaaagttgggggcctcgtttgcatgattcatggacgattttgaaactcaacgacaaagcgagagacctcgagtgaactttttcttttcaccatggtagagcaatgtgagcccattagaatatgctgggcctgttggcccgtccggcatacatctaagcacctgtaggtttttgtttagaaaaagaaaaagataagaccaaatatttcgtttcaatcaccttatatcaaattttaaattgttaaaatcccctcatagcacttgattgtctgaagatgatttgaatttccatacaatggaatcagtatttcagaaatggctactgcatacagaatttgaatccgggaaatgcttatttgagaatggagggagtggtacacatattttcctacttaggccattttttaaaatttgatatgtttcgacgtaagattaatatttatagcatatccgaccactcgaagaatcacaggatattcctgcttcatcttgtgatgtagccaacgaagtcatccaggtctttccgcgaggacccgccgtctgccacggacgcgcggacgacttcgccgagctccattgcccgccgccgtattgccatccctttctcaggcagcatcgcctcttcgatgacctcttggatggcctccgccgggaccacctcgctgtgcttctccaatggtctcacgagcagaccagccttgaggtatttgcacaccagctctgcgtcccatggctggtcggagtgcatgggccacgcaagaatcggcttcccatggctcaggctctccatcgtcgagttccagccacagtggctcatgaacgccgcagtggcgccgtgcgcgaggatctccagctgcggcgcccacccggtgatcaccaaccccactccctcggtttctgcggtgaaccgggacagcagctccgcgtgccggctctcgccggagtcggcgaatatgttggcgcggtcggcatcgcgaagcacccagatgaacctctgcttgctgcccttcagcgccgcggcgagctccgcgacttgatcgccacggagggacgacgttgtgccg

SEQ ID NO: 48694 - DNA, 5535 bp, Oryza sativa
  unsure (1)..(5535): unsure at all n locations
ccgctgggcggcggcaaaggagttcaaccggtcgtacacgacaaccacgcggctatagctggccgagatcctctcgagcagcgcggcgaacggggcgcgcgccgcgacggcgaagctctggatcatgggcatcatgtgggacgggaacggcggggcggtcgggtcgggcggcggggactcgtaggcggggacgtcgaggtcgtggaagcggatggagcggagcgcgtcggggtcccagccgtgcaggcgcgaccgcgcctgccggaggtgcgccggcggcgccgcgtagtgcacgtccagcccacgcgacgcgagcagcagggacaggtgcatgagctggttcaggtggccctgcgccgggaagggcaccgcgacaacggccacggattccaccgagccaatcgccattgagcgcttatgtcgtcactgatatatggttgtttatgcttgtctaccttccagaattctagtgcccagtagcctctagacttgcaggctttatataggcacacaataatgaggctgtgtttagttccacgctaaaattaaaagtttaaagaaattaaaacgatgtgacggaaaagttaaaagtttgtgtgtgtaggaaagttcgatgtgacgaaaaagttagaaatttgaagaaaaataggtgaatagttaatttagcccctcaagtttcagcgaaggctcaatttgatccttcacctattattttgtccacatagatacttcaaatatttgttttggcttgaaatcatccttggatccacttaatatgccatatggctatttctagtcaatatttctattagaaaatgtcctttttgcccccaatttatatacatctatatactagaaaagagaaagccaacataaataaacaacattacagatctacttcccattatttcaacatgtgcacatgaaacttaagcaattgctatcgtatacacttgctaatacatatttttttttcgttttacataatatactatgtattatctataaaaaaaattcaagcatgcaatttctctcttatatatgtgaatgatgaggggtataagtatcatttatgaagagagttgttggttaaggataagtttgaactaaaatgaaaacttgaaggactaatatggatagattgaaatatcaaggactaaactgagcctcagatgaaatttggaggaccactttgcctattcacccaataaaaaatattagaatctaaacagggcaagagttggagtataagagccccatcggtagaactaaaaatcaataagcaaaagtcaaaatttaaattttcaaacttaatttttaagtagcatattcttataccagatgtgacatattcttgtatcacaaatatgaatatatgtatgtatatattcgtagtgttagaatgtgtcatatctaacattatagtttggttttttatgctactgagggagtacaacagtagccgttctcagttctcaccgtggtttctttctccctgcgcgcatgaatggtgcaaaggcgaagagtcaccacgccgcgtttaactttctcattctcaccgtggtttcttcctccctgcgtgcatgaaccgcgaaaggcgaagagtcaccacgccgcgtttaactttctgcatggtcgccggacccttggctctgcgtcgttctccaaatcgggtgccacgaaagagaggctgagtggctggatcttgtagtattggctgactgttgctcgctggtttaatttgggagtttaggacggtagcggctggatgagatggagatagccggacagggaggtgataccggccggatatatgacactgccgggagatttcgacatttattttgtagaccttgcagttgtggataaacggaagtagcttgctgcaggctgcaccgtttgattgattggaagagtgtggcattcaccccatctcaatcgatccacaactgctatttattggctggagttacgtttctgatggagagatttaaataaatgtatcaattatgtcctgcacatcagcatcattgggtccatagctcagtggtagagcatttgactgcagatcaagaggtcaccggttcgaacccggttgggccctatttaacaatttcacatttttacttttgacggtgaagtttttttttttccacagtgattttgttgctgccctggcctatgtttgacggtgaagttttttttttccacagtgattttgttgctgccctggcctatttgagctccaaaaggagagatccatggagttttttttccacagtgattttgttgctgccctggcctatttgagctccaaaaggagatatccatggaattttccctacaatctctttgttgatgttctgatgaagccgcaaacgatttacatttgacggtgaagcttttttttttccacataagcccagttagggaggtgattttgttgctgccctggcctatttgagctgcaaaaggagagctccatggaattttaccaacaatctctttgctgatgttctgatgaagcggcaaacattttttcctacattttgtcccgatgatgctacaaacaattgaataatagcccactacagaaactatattttctaaactttatttccattgggctaaatttgttcccattcaaagggaccacaaagactaattatagtcactaaaaaatttttttatccacctatttccttctggactacgacgttgataatttttttctgatggacccacaacgttgattatataagtgaaagtgatcattgaaaaatataataatttccttcttcttctcctgaaaaaatcgttgcattttttccgcacgtggtgtttttggcctgtaggaaatcactaaaatggcttgtgcatggtttcgtactcttttttttttaaggaatcaacatgagattgactattcattatttcattagatatagacgtaaaaacccactccccctcgaagtaaaaaagagctgtaccacacctacatcccccccccccgctaccgccgggatgacttcttcacgcngccctccgcctaccattatccacctccccgcctcttcctttatttttgccataaggttggagactgccgttttcttttgctcgaagatcttttgattcctttctttctagatttctcaggctatgagtaggattaaggatcataactctttcttggacactttttttttttgatagtaacctccaaaacagttctgaggaatgttgtgcacagtagcacggcaggtaataggaaccccaccctgagcatagtgccgtggtggcgccgtgcaaacaaagcttaaggcctattcgtttttgaagaatttcaaatgattcagattcttgaggattaattcctctgaacgctatttagttcataggaatgtagctatagaaaaaacaaagaaattttcctttcctacaagttgtaaagagaaggtatagtgaatttttcatccactcagaactcatggaaaagttcatatggatagaaatgtgtatgcattcatattccttcatttttcttttttctatgtgtcataattccttcaaaacagatctacccttaagggtccataatgtgatgaaaaactaggtattaagcattgaatgcactcttgctaccaggtggcaaccattgtaaaagtcataagcaactaataccttatcatagagctactaccggtacataagaaataaatatcatcatttgtacagtaaatgagtagtagaagtaaatctggcacatgcaagtaaaatattagtagaagaaaccatggagtcattgtttcgcaccgttcacaggaatcaacttttaagtggatcctaccagtagcgcaggtaaggggagtgccaaagggtgccaacacccccctatccaaacactaccaccactatacccctatgtttttactctatattaagttagctaagataagtatctatctagtttattttgtgtagcttgaaagtattatcagtttagttagttagcaagtctaaaaatattagcaagaaacatgatttacaaaactagtttgtgatttctcatatttttcaaagtaaaatagatgatacttatttgtgagattattttatagtttacattaaaagaatttagcaataaagactagttttaaacttccaatgatattattaaagagctaaaattcaagtttttcttaaagaactagtttacatattgcttgttattgacggtgactatttgatctcctttactatcaatattagttatttggtctcacggtttatctttatcccacaccccctaatctcaaatcctggcttcgcccctgatcctaccttacttctcactcacacaaataagcattgtgggtaacttcatatactactatcacctgtatcttgggcccacgttactactgagtctggcaagatacgttgctcatgccctaaaagaaacatatcgctgcaacaaagtgacagatgtaggatctggctagaaaaaacatcacaaccagttcagacatgagtaacatagaaaagttaagcccggccatcgtggccgccgcagccgccgccgccgtcgtggtggtggcaaccattgttatccttgaagtcaccatcgagcaccgccgccactggatccgtccccttcaccatcaccgccgccgcagcctccacctcctttgccaaagagatggaatatataagctagtatatcatattcttgcaaaaaaaaaagcattatcacaaattccaagaaagatataccatcccaacttcaattttagcaacaactaaaggcatgttcaaatcactgccaaaatgaataatgatatggtttagaaacatccatatatttattaattttatcaataatggtatgctttaaattggcatctatgtgaacggggccctaaatcactcggtccgtggagcgaccggtgagtcacgtgactcacgttgacgatcgttgccttctgcggacgcgctcccatccggcgccacctccgtagttgccacctccgcggaacgcttctcgccatcatcgttgcaccgtactgcgtcggagcacggctgctgcggcgcctgcgccggcggcgtcatcatcagccgttcttgctcagctgcagcagcggcttgagcctgatcgatacgtcgttggcggaagagctccttcacgagctgccaaagcacacgcctcgcgtgcatctcgggcgtctcctgcgcgggccgtggctggacgacggacggcgacggcggtcgtcgcatcaccagtgtccgatcaaaggagttgccggagttagtaggcgctgccgttgccgggcgaggacgcaatggcgtcggagggacgttgttgaatggccgcgcctgcggccgctgcacatgcgccgggcagttgcatgccgccggcgcccgttgcgccgacgacttcgtctctccgttttgttccacctccgccccctgcgctggcatcatcgcttgcggctgttgtgccgacgtcgtgtgtgccaccacctctctcccctg

SEQ ID NO: 48695 - DNA, 25135 bp, Oryza sativa
  unsure (1)..(25135): unsure at all n locations
tgtgccaccacctctctcccctgtagatgctgcgcctggaggttgtacgccattgccgcctgctgctgctgctgctgttgcagaagcatctggtgatactggtagttgttgtacgccgctgccattgccgcccgctgtcgttgtaccggcgacatctgtccgttgcttgccacctgcgatccctgaacaacaagcgcctgctggccgttgcacgccggcggcggccgttgcgaggacgaggcctgcccgttgtctgccaccaccatcccctgctggccattgcgtgccgccagctgttgcagaaacatcatttgccgtctgttgtttgcggccgtcgccatttgccgtcgcatcatcatctggtcgccgtataccacctgcccgttcggcattcgcatcgggccattgaccgtcgcgtgctgccgaggaggaggcgccgttgcgtggccggccggacgtgccatcgggtgcccggctcgattgtcgtgcacggccgttctcagcggcatttgcatgccgccggcgccgccgatgtacgacgcgggcggtggcggcggcgctcctcccatggtcagcttccgctgctgatgcggcctctgcgccacggcggcgtgctcctccgcaggcctcttattgcccgacgcctcttcgctggttcccattgccggcccgggctgcggcgaggagaattctccatcggaagaggcgatgctggcgattgcttggggcccgggctgcggcgaggggtgctcgacgagctcctccttcggctcgaaccggaacccgagggggaccttctccttcttgtctcctctgccaccggtgcccctcttctcctctccttctgccatatcggctattcaacctgcccaatcgaggttgcctggataatggctcaaataaatttttataatcacccgacgttaagtttgcaatttgagatgaactcaaactctatggatggcaggagcagctggagtccggaacaagacgggtttgattccaattcaattccaattcaaatcggtaaggaaacggtaagaacatgagcatatctatatttatacctataattaaaaaaatacgcaaggtttccgtaattttttttatttttcaccttttttctttttcttttatcatttcctttttttctccgtccttttttttctttctgtccgcttctttttttttcttttttatccgtcctttttttctttatttccgtccttctgaacctttttattttttttattttttttctgtttttttccatccattgtttttttcgtccgcctttttttcttcaccttttttctctttttttcatccacagtttttttacttttttctaggcctttttactgggttttttttcatactttttttctttgtttatgtttttttagttgcattttttcgcatgcggtaaggatttttttacgtgccatattttttttgtcgcccggtgttaacagtgaaatttggtaagtccggagtagtcatcggctttgaagttctgagattagccgatgagagttgtcaagtcgtcagttgtcggattcttgctatattcggttaaggagattgatctactaaatgaagcttatccagaaaagaccgagttcaaagagaatgcggcatggcaagttatctattaattagaaataatttgttagtttccttttatctttaggaaagtttctttcttgtccggcaagaacttgtatcaacacatgggtataaatatgtacacccggggtctatgtaatctatcttcacgatcaatacaattcggcgcatcgccaccttttaccttttctactttattttatcgtccggcggaacttggcacctgacgcggggctgcatcggtgttcgatctccggctaaggggtaagtccaatgtttcgctggcccgggcaattgtatcatttacgtcggcgtcgttcaaggctgcatcagtacattcgacctctttgattgctctggtttggatgatatatttgcctacctatttatcatatgtctatgttaatctagtcttagcatatcaatttagctctatcgactgcttctctttttagggtttctgccggtatcggctaaatcgcgttgttagattagattagcttagacatctaccaccctccaccctgaaaactcagtcaacggcttgattgcctagatattatgtttcttttcatacttagtgctgcatcaattaagtttgatctactaagtcgtgtttagaaccataatctctaggctgcttcttgattgccaataagggtttcatcgaggtttcagccaatgagttatctggatgttgcatcagctcataaggattgtatatacatataagctggatttagccgatgacaacaaaggtttcactgtttaatctaatcttgtggatttcatgacatcagacctccagccgatgtgtgctctaaccttcggatcgatgcttatttatcatatcattatttgccgattggtttatactggattatattgttattttatttcatcatcatcagccgattgcctttatatcattatctacattggacatatagccgatcgcttaaaccctatcgctatcggctggtatcggcatcggctattatcggctatcggctggaactactccatcggcttgtcagccgattggctgtttgatctactgtttgcatatcttgtcagttgcaggatcaaactgactggcatggctgcatctcatcaagatttggacctgcacaggagctaagcagatctcccaggccggtgtgttcaattttttcgtcaacacccggctaaacactagcgccaccacctcgtcgatctgccttcccatgcgttccctcctccaattgattgccaaaaatcaattccccgctactccctaaccattttactatgatttccccttttaactccgctttaattcactgaatttaatctccatttaaaattcaccctttttatcccgagttttgtcgcttcgattttaataaaaacggaaagaggatatctcccgagttttgtagctccgattttaataaaaacgaggggattgagtgtatcaaaaaccctcaatcaattttggaagatcgagaaagattcaaccggatttgatggggaggatttgatcggatttgatggggaggatcggttttggcatgtacgaacacgacattgtcttacggaggttgaagacaacagtcggctctgcgagctggacctacaactccagttgacaaggaaggaatgaaatgaacttttggtacaaaatcaaagagtaaaatgtatagcgatccaaaaatatttctacccgttgcaacgcacggatatttttctagttatataatagtgggcattttttctagtttatataatagttttaagaacctcagcatatatgtacttttatggcattggatttactatggataataattaaagtttgattctgaatactatgccaagtcaaaccacgcgttataatttgagacatggcatagggagtactgtatcattatatatgcaggggtgaaaacggtagggataaatatcataaattccggccacagatcgcttccacattccaccagccaattcaatcagccatttcattaattgtctaaaacattgttgattactacaccggtgtatgaaaaaatgaatttaaacagggagaagcgacagttgactctggcatctttaggacctgactaacaaaacaaatcagctgcacctgcatgaggagaatttcatgtacaatattgtggtaccttgggcctagtttgaaattattttttccaaaacttgagttgaatcttgaaagcttgtaagcaatcccttatttagggtgatttctgttttcctgcaactgataatcgtctggaaggaccatacattggagttttcagcagcacacactgaagagcacttcggacgccgtccactgccagggtttgagcaagattgacaaatataagcgacaatatgaaatcagatacttccttgtaagttgccaaaaaaaaaacaaaaaacaaaggaaggaaaagtagtcggacacttctaacttgttaagcaagagcatacatcactatatcagcgttgccatgcgcttacattacttgatttttccatttctgaacagaaaaacatagcaagagcgcttggctcatacagtttactacaagaaaaacatgatatctagtggtgattgatcctgtagggagcgatcaaaagcattcaaaagttgctttctattgatactaccatgccttaccatgtcatatatatcattctgaggtgtcatccgctgctcaataatatcggatcggctaccagcaaataattgtgctattgtcccaggaatatctgaaagtacggtattagtttgactgcctttacttgttagattgctggggggtaggatcatggcatttcattttgcagattgacgtgccaaccactctgatctggttaaaccacagtaccttgtgctacttccaggccacataaggaaattccagccaatgggagatccaccgacaatataagatccttgcaaacattgtcctgatttctttgtagaatctgttacactcggtttggcatcatgcttaatgtccacaggattgagtggtaccttctcaccagaactatgcataaaggatgcagcctggtctgctggacgaacttgattcttctctccgggtgggattttccctgcaggcatatttctggcatctcttgatgtaggctcatccatcagttttacaggcccagctgcagttgggagatcaagtcgcatttccttggataattccatgagaacttttatctctgcatagtgtgaaccaagggaagattgcttaaacttatcatcaataaacacatccagatataacattaagctccaggtgctcaacagattttgtaggccaaacaacagggatccactttggttgaccttttaactttacagataacatgtacattttcaaattgctaattatgattgggctaatgcaggatattatgaataagtacatcagtagccttttttacactaacagaatgaccgactaatgcactatatttcacttacttactaatgtagggtactaggcatcttattattggagtatgtaaccgatagttatgcttgcattaagaagcctaatacaatacatcatgtgacaatataagtaggaatttgtaaaagtgtataatgactataaacaacatgtttacaagttatagaaatgtaacaactgatgaaaaattgcaagtgtccaatcacaagggttttagatatcttaacagcacgaagtgactatggactacatctacagagaggcaatgactgtcaaatcacctgaggtaatcttagtgtgcaaaatatcaagagagaagtgtgcttttatgaaagaaggtgaaagtaaaattgttcgagtgatcaacataatctcctataccatactgatttctgtacttgcgagcatgatgataaaaaatagtcaaaaactcaaaatgtaatcaggacgttccgcatgtctgttcaaaaacaatataaattaggatttacctttcaggatctcaagagcggcatctttcttttgggtatcagtgcctttgcataacttcaaaacaacaaggaaaaagtaaacattttagagcggattcatgttcttcccagaacaaactgcatttacaattgtcaaaccaacagcaagcagggatatcaatttggtgtaagttatgatacaataatatgatttttctctggtccttgggaggtagagaggtatttttagtgttaatcgggaagtatagtctctactgagagcgaggtatacctcttgattaacaatatggggtaaaactctcaatacctcccaaagccacacatcagccatgaaaatgttcatttgcatagtaggacaatggtggcattaacaactcagttcagaatcatcacaccataaatttcagctagaaagagattacgcgcctaattgtattgagacttggcccaaaattcaacttcaactttaatttaaattctcccagagtttcaccagcaagcacagcacggagcaaatagcttcgagctctcgaactcgaaccattgatcacacttatccacgtcaagcaaaatcatcccatacacgttgcgctagaacacgggaacatgacctgttcagttgattgtgctgctgctgctgctgctgccatggcagagcagagaaatgccactcaacaaatatcttagggttcgaggtgggggagacctgaatgaagcggccgcggaggttggcgacggctgctctgatgttgtagtagggtgagtgatgaaaccccacctcctccagcttccgcttcttcggtgccgcggtcgaagacgtcggcggcggaggcgggggctttgggtcgctggtaggcgtggactctgacggcggcggcggaggaggaggcggggtggtggtcgtcggagcgaccatcgcggtagcggcggagcgtggggtttttctgcaaccttccctgcctactttggaacaaaggaatttttatcccctctatctcaagaggagtgtcagagcattagcggtatatagatatatagaacaccattaatattaaataaaatttaaataatatggataagaaaacatagagattcgtctgatgatttttatacaatatataggatgcatgtaactctatagagcccaagtccaataagtgttaaggtggatgtttgtaaaaaatatcaattttttatttgagatatcaggtctaagcaaagagcccatttgctccatttggtgcttaagatctacatttacaatatactgataagattcccttaggatatcccaataacatggttcatagataatataatattacatcagtcatacagtaacattgtacaataaatcaatacgaagaaaataatgaaagatatccattgggctattcggcaagcggacaacatcggctgtggctatgctaccgctgcgtgtgtgcggcattgttggtgcagctacagcgcaaccataaatctagtagccaaacaaaccctatatgcatatggactacccatataaaataaacaatactcctattatctatctctcctaatgttatctcgtgtatattactatatttaaagtccatgtatgtgagtcccatatatattaatcactttttgctatatacattgctgatgctgtgattactcttattcccacattgtagatactgctatactccctccgttccataatataaaggattatgaccttttacttgtactgtttgaccactcgtcttattaaaaaaaattatgcaaatataaaaaatgaaaagttgcgtttaaagtactttggataataaagccagtcacaaataaaataaataataattctaaattatttttgaataatataaaatcctaaaatataacactttttagttatgcatataaacaagcaatcacttattcatatttcttaccgcagaagcttatatttaaaatctgctttgaggctttttttggaacaacatattattgaaagaatttaagaggtttgcattcctctagaaattttccgtatagacttgtttgagacaaaggaaagatgttgaattaataaatgcatcaagaaaaaaaaaatctcacagctctttaactgtatggcgcaaaataatcgttggacagctgactatggcaaaataaccggaactggttcgacacaacttttcatgggcctctgggcgcaccgctcacacatgccgatacaacttcccatggcccatcgagaaccgcgagcgcctcaacttcccctgggcctccccgccgtttcgtttccgttctgctctcactgacaaagtggcccacaccgcagcaggccccacctgccattgtcgtgcggagaccgtgtccgggacgaactggagaggcagccgcccacacggccacacgtctgtcggcttatccgggtggggaagccatggccattggccaccaccacccaaggggagcgcaagcgcagaggacaagagcgcctcctcgtctggtctgcttcggccccccgctcgctcctcctgccgaagcactcactcttcggctgctcatcctcctcctcctcctcaggtcagcaagattcatccggtttcacttggattgtctgggatttggtagttgaagcatttggctattcttgttttgcgcatgctcctagttcgtctgcgtgggagaaaatactgaaaagggggtagttcgtgtgtgtgtgtgagcatgccccattgtttggcattttgttggagctgtatatatgtgtcattggctagaactttgcaatgtcactacctgcttaagctcagcaattgtgcttcagttcgtgcaaccttttgtactaagctgaacttttattttttcctctcctggtacctacaataaccttgtctcagatgcaaaaggatctctttagtaaaaggcactttgcttcatgtagtattattgctgtcagatgctggcaaacattattggggctcggcattcttttctttctcgaactcaaattagcagtttggaagagtgcgtcctacaagtagcaatcgtataccgcaatagtgtgaagtaagttgcaaatcaaatgcatatggcaatctagtatattgacaacttttgccgctatgcaagttttttgggagaacttaagctccccaaatataagttgcacgttttgcggaacttgcattgtccaggagaacccccaacctcccacaaaaactttgagtgacttaacttaagattgatgatttatagggccttctgttccctctaatatagttgcgcatttttgtacttgtactgatttctttgtttttaagacaggtcaagtttgattcttctcttgttctctttgttctttataggagcagaaccagacttgccacgaaggatttgataatctaggggttcgggacgagatgatattttcagtcagcttatttggtagttcccaccagtccattcacaaactttacaggaaatgctggtcaagtaactcacattctacactgaatgtgctttcacttgcaaaaactgtgggtcaaagtatgagaatgaagaggatacgtgtcaagcctcatgccactgacctgaagaatcgcccccaggcccatgaggataatgtgttctacaaattggtttataggctccctgaaaacctcagctggctgttggcgtcaccagaaatggctagaagaccaccctcaaagaagaaactaaagaaggaagaaatggtaagtagtaatcaatttggtgtgatcttggagtgggaaggagttgttgtggaagatgatgatccagatttggagcctcgagtttggtacgtgttatcacttgaagaggcaaagtcttttcctccagatgcagtgctgaaggaaattgaggggatgaggactgatcaggctattttagaagtcttacattggtcagaagatccacaagaagtacaaaggctggcagcacgcaaggaggtaatatataaaacattacgtggtagattctaccaactgcgaccaggtgttcttgatttcctgaacacccttgtggattttgacattccaatagcaatcacaactcctcgcccacggttgagcctagaagaagggataaaagctgttggtcttcaaggctactttgatgctatagtggcagcagaggatttctgccgagggaaacccgagggggagatgtttgaggtcacagcagggcaacttggtcttgagcctgatgtttgtcttgtgctgggtaactcaaattcgacaatagaatctgcgcatactgctgggatgaggtgtgttgcggttgcaagccgataccctgcctatgagctccaagcagcaaaccatgttgtaagatggcttgatcagctatctgtcgctgacctgcaaaggattgccaatggcgagattcttgggctcaggggcagaagatctgacatggacatggacatggagattgtgatcgaggagtgatttttctatatgtatggtgtgctaatattgccctatgtatatagctccaattgcaacctaggtaatgcattacattttgttaacagatcaagctgattaacattggccgttagcttgttaactgcttggtttcttgtaatgcagaaatggaacttttgtagcctagatgctttcgatctctagaagaattggaagctaagaaaaactcccaatctgtatctcttttaccaatgtaatatataatttatatagattattatgccttgtattttgttccactccaacttttgtgcagaaatgaatggagaagatctaagagcaatactggtaagctctaaataattttctatctaaaaaaactctagataactgaaaagagttcagctgttgtatttgcgacttcaatgtttccttagaataaaaacaataatttctaattctgtaaaactagtctttgcaggatcacaaaacattaggtcaccattcattgttgtgcaggattatcttaagcaaagttacatgtggtattcctctattttcttccttcccaccagcatctataattctgagtttctataacgtttatttttccttagcaatcaggttgagcaaaactcaacaaacttcagaacatgctgagcttactaatataatgtttatttttaacacacatcatccatgatcaactttactcacatttacgccaactgccactcatgacaaacggaagaacttccgaagaagaagtaagtatgtgggattgcttgtatgcatacaaaccaattagtttgtagagagtacctttgtacgaataaattcagagaaagcatatggtggaggcaatgcagtgcccaagttcacgtgtagagcttttctcagaatcacatttcagcagatctcatgccgtcatgcagtgcttaaaaaaaatgtcgacaaggccgcatacaatgaataggtgccacattcctgtacactttaagtgactgatcatatcgcataatcgctataaggtggggtgatgaccgcataaaactgcttacactttaagtgaccgattatatcgcataaacattataggtgggtgaccgcacaaaactgattaccgatttgatacttttttggaacattgaattttcatgtgagacagtaagcgtttcttgttcttttgtatctgcacaaacgatgaaataagatgcaaacaatctactacagatttgacagccgtgctgattttgtttcacatatgtactgtcataataattaaactcacaatagtcaactgtgtaaaatgtttggacttgtttctttttttttctttccttttttttaaaagaaaaacgtcaaacttcattgctaactggaaacacatcagacatcagagtctccccagtagaaggacgggtttcagaaaaaccaagtgtgaaacttgtcgatagcccctggtttgcactttgttattaacatgctaagcgtgtctatgatattttgccttggatctgatacctttgtcttcagttgatatgcctatttggatgttgaactgcataatttgggaaatgtatcttgtacacgcaagttttcacgtgtatacaccatacacagtaactaatacataggaatagaaatcaactaattttttttagataatggattataaaaaacccggcctctacaccttgtgagggtgtacacagcctaaaagtcacaaacacgagtacataagactctcccgttacatgggtaaaacataaataagttttaaagatggataacaagtaagaggaattaaaagctaagcttcaatccttttctaaagttccacctaaaagtagagaagagctccatcatacgcttctctaaaagcttggacttcgcgattacttcaatgacttcgtcttccttaagaagcaaagaccgaagccttgacaactgagttgctttgaaaattacctgagagagggtcgagattcatccacgccttcctggacttagccttttcaagtgaatgtctcccgctgctgcccatcaacctctcgctagccctttttggtgtcatcgacacctctccaacattagccagctgaacaatcttttcctgctgcacccctgcctcattttcctccaattcctccctctctaccctttcatacacctcttccaacacatcttggacagccacatccaagatattttcagccatcatagaaaaatccatttctttcgctaaatcagcaccttcctgtgcctctttactcccttcacccctatcatgattgtcatcggttaccatatcatcaacctttgacatttttggtcccttctcccttccttcattgtcttctccactttcctctccctctacattaccatcctcttcatctccatcccaatcctccaaattaaactccacttcttccccattctcatcgactcctttcttctccacctcaaattttaactcaaaataatgatccccaattaccacatcaagcaccttaggaatcaattttgggttaaggatagccacaaacaatatcccaaaaacattctttttagtagttttcatatcaaccaattatgttgcccctaaaagagagcctactgcccataaagttaaatattcccttagtttcttccttagtccaaaaaccttaacccataccttaggtagaagaaaaccctcttcttccacaaaccactcttcaaactccaccctcactcccatggctacccctccttccttcacatctgcacccccaaagttgatggcccattgcaattcgccctttgaagggaaaagaacaacaaaagcgtccttcccgtgcggcaccggctcccacttccatttagttggacacaacttgtggagaagagtgaccaacctttccaccgaaagagcaccaccaaccacacgcacaagagccttcttcgtgtttttcttgttcctttgaagcggttgatgtgggatgtgctgaaaccctaggccttcaaccgcatacccaaccgcctgcaccaccggctttggaagctttaggactggacatttgtggttgacatgctcgctacagtcgcagatatcgcaataaacatccaccttacaatcagcaacaccatgtcccttttgagtgcacctagagcaaactttcacccgtgcaccacccttttgatcatcccctttcttgtcgctaatcacccgcggctccttatcgaattccaacaaatcatcttcatcatcatcaaactcagaaacataattctttcctttcttgacttctgaatttaccgagacaaccacatctcctaccttgatctgacccggtttcttgcttcctcctccaccttttgcctcctccttcgtctgcgtcatctcaccggtccccctgctgccgccgccctccttcattagaaatcaactaatggaatagaaattgacatcccaagatcatattacagccctccccgacatccaatgttccagtggacgactgacccccccccccccgtcaactataaatcttttctatttaagtcgacaatcgttgatttaatcgtggaaaagggctaattattttcttgagtttttgccggttgggctaaaaaaatagctatggtgcaaagccaaaacaaccatcctatttaaactaccgataatgatgactcaagcttcttttcctatggagaaaaaggacctgggactgggagaggcaccggatgatgtcaagggaaaggataggggtggggaaatagaagtggatagtgatgccaacagtgatgatcgggtcaagcaagaaaagagccgaaaaggaattgatcctggatgctaatgaaaacacatctttttcgtttatataacttggttaaaaaacatttataaaacttgcccattaaaacattatacaggctggaccattgatatttcctaatggttggcctattacgctgctttgttgcgtttcttttctagtaccttatgaatatgggtaaagtgggtattattatctctatacccaaaacttaaatggatgattcatctttactcataacctcccaaaacaatatagatatgggcaacaaatacctagttgcagccacagcagaccactttgtgatgcagcaatgttctctctatgttactattcactcaatctcgttcgagagataattgaacttgtgtgcaatacacaagtcaatgagcgttagaaatgtatttcgactagggtttaggcccatgggccaagctaagcactaggattcccggttccatggctagtggtccctgagcatcttctaggaatattgggattattctttccttcgtgaagagcgttgtctaagttttagcttgaatttcctttggcaattgtatgctcttcgaattacttgagagcttcgcgcgctttatccctcaagtgtattattgaagagttttcgatcctttgaggactcgactttaggccatcgtatttgatatgcagaaatccaatggtcttcaataaaccaccaatatggtcccttgtatccttggtggctttctttagcggatggggtaattgatggggatctctactccaacacttattacttatcagctactataaaagaggagtttcatccgttcgcctttcctacctccatagcttgcatggcatatacttctcctctcctgtaacaaaactgaataacaagtaggggtgggcagaaataaaccgtggaccgaacaccgaatcgaatcgagccgaactagtggtttctccagttttcgggagaaggctcaatttttactttgcgctgcttcggtcctcggtttagagatcagttttatcacgcatgaaccgaactcccaataaaaccgaagtagtcgtcctcagcggctggagcgcgcactatatcccgtcccgtcgtgagttctgggaaatgttgctccatttgaaggatgcataagccctcataggcccattgtgtacataatgttcttgtggggtctgagcaaacaatggcccaaccagaccactagtacgactgcacctccatgggtagagacagagcgcttggttggcttgatcggtagaaaccgacaccgtacttgtcaacgagtgatactcgcggactggatgaatagagtattaaggtacgttggagcaggggtctacgtagtacgacatcaaaacagacaaaagacaagaattatactggttcaggccccttatcaagtaataaccctagtccagtttatatgtgattgatgatgatgagaacagattacaaagagagtaactgaaacaagtgataccgatgagatcgtagtcgagggattcgacgagatctcccggcgagttggttcccgtggactctggcttcgtaaactttggtgagtgtgttggtgatgagatgcgatgccctttgcctctccctaggggtcccttttataccgtggaataccttaacccccaagtaaaacttggagatatgtaaaccgacacgatatactagagattttaccctttccgagtaggacttcggaaattcctaaacttatagatatattttccataacttgagataaattcctaaagcgtatacggaaacaacccgtatacgtgaatgtataccttatcggtatattccataagtcatatgatagagggtatgccttatccgtaaccctgacagtaccgaagttattcgatttatctgggctcattttttaaaaaaattttctgatgaaatcggttggtatttttcaaaaaacgaacatccacaaaaccgtacaaaccgaactgggaaccccgaataaagcgaacgcccacccctaatgacaagctgaaaaaaaggccagaaccactcaaccaatcttatgtatagctaatataattttcaaaaaaaaataaaaaagataggaaaataaattatatgtttacttgatctattttgttgttccataatagtgcacgggtaataattaaccagttgtttaaataaatattatcatcaacgaccttctgactgtttttaaccgaattaaaaaaaaataaatactatagcacggtggatcgttggagcgaaaggtttatattaacatcaacatggtagtacatacatagcacataaagtatttcgttggaccattagtatagctagcgttgcggtcctcctgcgaaactagcttggcgaagacactagcgacagtgccaccccgtgccaaggcccaatggtcgacacatatagtatggtctacgactctactctactgcaggccaacgaagtgtttagttgtttacctaattttttttgacatatacggatacatatttaaagtattaaacgtagactaataacaaaacaaaagcaaaattggttatatagcatcgaaagttcacgtttttggttttatagcaccgaaagttaccggttcactttaatagcatccaaagttcaccctgttcctatttttagcacttccgtcaatttttccgtatgtcttgatcgttattgatccagccacacacatgatatgatatttctacccctcattgacatgcattatacttgtacttgtgaggggtagaaacgtcatatcgtgtgtgtggctggatcaagacggacggaaaacaatcgagaattgacggaagtgttaaaaatggaaacatggtgaactttgagtgctactaaagtgaaccggtagtattcggtgctataaaaccaaaaacgtgaactttcgatgctatataaccaattttgctaacaaaacaaattatagattttgcctgtaaactacaagacgaatctattaagtctaattaattcatcattaacaaatgtttgctgtagcaccatattgtcaaatcatgatgtaattaggtttaaaagatttgtctcgtaattcacatacaaactgtataattggtttttttttgtccacatttaatactctacgtatgtatgtagatatgacggaatttttgaaagttggaagggaactagacactgccgtgatctgacagagttacacagaagcatgtcaatgtcgtcgccatttatcgccactgatcagagaggcttcaatttatcgctgacacggatgtggctaaaaaaaaaaactgatagcaatccactgcggtagtcaaccaacgaagggtcggggaatcggtgatcggggatcggtcacggtcacaccctccagcttctgcgctggaggaaaccaacaaataaacggatgaaccaccccgtgtctcctctccgcgccgcaagcgggacaaccggcggcgacggagccaaccaggcaaaaccacacacaactagccggatttacaaaaatatactgtttgtggatttgttttgtaaaaatataccggatgaagaatgatttgcacaaatatactatcagtatcgtggcttgaaagagcgataccgagtttcgcgacaacaaatgcgataccgccactatcaactcgtgagggtgcatttgagctggcggtgtcacttgtagaaacaacgagaccgccacatgaaggaaccgacccgttgttgcgtcggtatcgtggtgtgcaagcgcgagagcgaaatcggtctcgtaatcccaacgcgcgagaccgagcacgtcgtgggacccacattggcgaaacgaccgggcacgagtggaccgccggtctcgcacacgcaaagatatcggtctcgctgtcccaatgcacgagaccgacacgcggtatcgctctagcaaagcgagagagcgctttgttatcgctcaatcaaaaatcgataccggctataccggcgaatacgtgcatatcgttagtgaatacggccgctgaatcgtgtccatgcaggccacaagtgaacatgccgtatatacgaatatgcatacacatatatatagccctcaaagatcatcttcttgttggctcatgcatgtatacgcatatacattagccaagcatgcatgtatatatggctgaacacacatatagatggacatatgccagtacgtgtatggctcatgcattccattagcaggtgggacgcgctctcgcgctgtcaaagagactgcttggggccctgccggtctgggttcgcgtcagacggccgcgaaattgctctacgatcgtgcgagaccgagtcgttctcgagcttttggaatgcgagactgatgcattagcgctcccgcggtttcaattagcaatagcgttggcgccttcgctaatccatgatgcgatatcgcgctctcgcttaatcaaagtgcgacgacggtatattttcgcaaatcttcccctatttagtatattcttgcaatttcggtaaaaaaattgtatattttcaatttttttctctactagcaatgatgtccatgcgttgcaacgagtaaaggtagttttaatcatgtatactggtgggaaaaaaatataaaggaataataataataataataataataataataataataataataataataataataataataataataataataataataataataataataataataataataataataatgaaataaaattgcagtgacctttggtcaatcaaaaagataaaaatatataattaattttccattaattccattagctaaaaataatataatacgaagtaggaaagttattctcaaattttagcaattttcaaaaagcttaaatagagcaaactaattatataaatgaaaacaaatttaatcacctaaataaaacaattagacctgtaattgaaaatctgttgtcagttcagttaaacatgagcctgtgggtgtgtgtggggtatatatctctcacttatatgtcgtggtctttttttgacatagaaaaaatacccgtgcgttgcgacgggtaattaaaattataacaaatataaaaatattatatgattaaggtttagttttacatgttatgagctctttaagaaaatatatttataatgaaataaaaaagttcagctgaagtgacataaagtgaacttgttccgtacggagggtacacatggtcaataaggcggcccaatagcgtgggcggcctaggaatagaatcggggaggaacaacttaagcgacctaaagtgaacttattccgtgtgggcggcctggaaatggcgttcggcctgacgcgggagaagccagagccgtccgatctgatagacggtcattccgacttatataaaagttcaacagcccaaaccctaaccctaaaatcatttcccctcctcccctctctctcaaaacaatgtggcagcggcccgacataccgacatccctgcgacggcggtggcggttcagaagcgacggcgacaccctccccttccggcgtcggcgttttcttagtgttcttgaatcttatctagtattcttgtagtagtgttttctttagaatttaggtccaaatttgatgcggtctctcattttttttctttcctttctttttttatcttttgccatcggaggggtattaaagcgggatcgatcgcacgtgcgatggcatttctataacccataagccatacaaattttcttaattaggtatatatagatattgaatcggactttccttttttttctttttttcgccattttttcattactacggatgtcagaaacatctttaattttttttaccacgtcacatataatcagattcgatttttttcgccgatttcttttttacgcttttttttgcggatggacgacggaaacactttttaatttttaagtagtagacatagagatagagatagagaaagagaaacggaaaacttttttcgcaactttttttttttggaatcggacagaaaaaaattttacgcttgttttttaccgcgtcgatggaatcggattcgatttgtttttttttaccacgccgtgtcacatataataggattcgattttctttggaatcggacatatactttttttctttttgcccttttctttaccgcgtcgacagagtcggattcgtttaattttttttccttttttcgcccttttttaccgtgtagaccgagtcagattagtttcttttttttctttatttcgcccctacttttttggatcggacttatttttttctttttttcctgtttttttccccttttttcgcccgtttgatcggactttgtttttttttacacggtttttttcgtccgcggatttttttttccgtccgtttttttatcggacatagttttttttgcacggtttttttcccacggtttttttacggacgatggaccatcatctcttatttttattttttattatataagtagtagagacgtacgtgtgccaacgactgcgagcgcgtcaagccgtcgtcaagcacggctgcgtgagcgcgcggccacaaacgcgatggccgagggacgtgtgcactgcagtgcgctgccccgggtgtacaggtgcgtgtggacggtttatatatagattatgtaaaattttaaccatgccattatatacgtcttcaatacagttagaccacatagtggtaatgaaaaggattaaaatcaaatgcagtttgctattgtaactgtctaatagcaactgcacataagtttaggctatctgttttttatccaacagttagagtgagtgctacagtaccaatataatagtaaatctctgttacagtatttttgttataataccgctatgtaccctagcctttattttattctagatcaagatgcacatatataactgcttaagttgcagttctaatatataacaaccactgcacaatatcctgatccaaatgaaagcgatacagatatcatacgtacggtacctcatcaacaccgtacagtatactaagaactaacaccttcatattttaatgtataacaccgttgacttttttccaacatttgacccttcgtcttattcaaaaaatttatgtaattattatttattttactgtaacttgatttatcgtcaaatgttctttaagcatgacataaatatttttatatttgtataaaaaatttgaataaaacgaatggtcaaacgttggtcgaaaagtcaacggcgtcatacattaaaatacggagggagtagtatgcatgaacatgaggatgtgattgaagctatcttccgaaacaaatatttttctggaccagcgagcatataataaataaaatttcacgaggatcgtattgtagttctgcacttctgcttctgcttcttgcatttcaaattcatctaacgtacgtgtgccgctctcgacgctagccaccgatagctttctggagagcttcgctgatcatcccaggtgccactgaaccagaacaagcaaactgcaacaacatacgaacagatcaccataactccatacggcaaaaaaacatataagcatcgttcagtactgcaattctacggcgcgatagaccttaccttagcttgtatcttcagtccaagaagaccatccggtgccgacgcctgcacggagagaacgtcaagacagaggctcttgatcgcgtcgaacactcgtgtcatcaccaactccttccatcggcactgcacctccaggagaaccaccttgtccgtgacggtgacattcacgtggtggtgttctctccctgcatcgccgccgccgctgacaccgatctcagagaccagctccttcccggtgatctcacagcgcctttgctgtcctgtttcggttgcgcgctgatgtgatggctcgctgctggactccaactctttcacccttttctccaacactttgaggtaggcaatcgtttcttcaaggatggatgctttgtccacctgtagtgacaaatcatctcgatgaataattcatataactttcagtataatatagaaccgttggaacactagattaattaattaaccttgtggatggaggggactattgacttcagaatcaggaacatctcattgagcttctctcggcgccttctctctgatatgacatggttcttgatgccactctcttgagttagcgctgctctactaccacgaccagtgctcatccgtgcaccacagtccacaactttcttcagcaacttctgtgactctataccggtgacgaccggcacagccatctcgtttgacttcgcgctcttccaagccatgaagcacgacacttgagaattcgcaacaccgtcgacatcattagccgccgccgccgccgccaccgcctccgttgacgacgccgggaccagttgaaaagagctggggttcacaggccagccattatcctcgagaaagcgcacggtgtccaggtccaggtccatgtccaggtccaggtcctcgtagatgctgtagagctcgtcgatctccatggtgattggatcgcggttggcgttggacacgcactcatcagagacaaccatctgcccctcttcgatggcgttgtgagtgatgaggccttcggacacgatgtcggcatcttccgtttcgttcggagaagggctagtgctcattagtacctctaagcatatcggaaactgaagctcctggaaatatgcaacgattcggtttaccaactttgggtcctccaaaacctgggaattcaatagcactccacatataattagttgtgaagagctgacttatactgagtggaacagcaaaaactacatcttcgaatgttgcaccctctagttttcataaacataacatttagtggaatatgtctacctttgcttgtagctcaaatgagaaactattctaaactatcgaggggacatcctctcattattttcatattattaaaatggttatagaaaaaattaaaaattttaaaaatagattaatatgtgataaatcacttcataaacatgtaatgttaaatacaacttctacatgttgcaatgagaaaaacaaatttaacagtgaatatacgttaactagccatagtttaatttgttctttttgcaactcacagaaattgaattagtttacatgtttatggagtgatctatgacatattaatatatcttgttgttttttttaaaaaaatctcataaccattttgatgacatgcaaataacaagaggatgtcccctcgagaatttagaatcccctcctgtagctcaatagtttgcaaaatgttattctgttcattaaaggtatgttctcttgtcttacatgtagtggtaaagcaagtatctaattattatggagaccaacctgacaagtgatgtcaatcataaaaaatacagtgtaacaaatatacacaaatttcaacatttcccacaggtaatttatcgtatgaacttaaaaaatcacatatagtagaaaaagaaaggcatcataagcggtggtaatatcatagagctaaaactgtaaattaccaggcaaacaatacgggaaaaaaacctatatcttagcaaaataagcaacaaactattatcttctgcaagtattaattagctaatattttaggaatataaattaaaatggagaggtaaattatgttagctacctacctaattgtaacatttcagggagagaacgcgggggaggggggggggtggtttgttgttattgggctattggaaaagagaaattttacagtccttaaaaggctaaaaaattctagtgcaaattttcatacctcctaatactgagagtaccaaattttacactacaaaatatggacctccagtacctttttaaaaattgtaaaatcattcattgagaaaggccaggaccccttcagccctaatagctgcgctttcttacatgttattgaaatagttataaacaaattgtgaaaaacaaatatgataataagggtatatctgtatatgcacttgcattataaattgtctttcctacctgttccatgttgtggcaggcatatgctataatgaaagtctaaaacatgatgtaacataccgagagactaccgctcggacgtccgatgcaacgcaaaatatcggacgctatcagagtactatatcagcaagctgaccacataactgctacctgatgatactatatgcatgtattgattaacatatattagtaacctttgagatgatttattttccaaaccatttatcttattgtcattttgatcatatggttgtattccttataattaaacctttacaacaagatctcatacggttatattttgattgaaaaattatatatgtttcaatcattaagatttaatgtttcacgtgttagaaataaatgtttcatatataatttgattatgttgcacattttaagctttttatccgaatgatgttttaccgttgtacacgggatcaataaatatattatgatgtttcattacttatttgtgaatgttgcacatcatattatttgaatgtttcatcaagtatattattatgtgcaactgtcataaagaaatagtaaacataagaaaatatctattaaaacatctaaataatactatgagcaacattttgttgcaacagtaaacttaaaatttattacaaagtgaaattccagttgaaacactatttctcacacatgaaaaatccatttacacctaatgaaaaacacacatatatattttttcattagaaatataatcatatgagatcttattacagtgatcttgctagaacatggaaaaacaccaagtgcaacattacaaataactatgtgaaacatcaaccaatatttattgaaacattccattaacactgtgcaacactaaaaagagtcagaaaaaaagtcatcggaatacaatgatgtgagatcttgttccgaagatttaattataatgaatcaaattatataatttattcatagtttggataaatagttggaggaaaaaaaacgtttgaattctcaatcattatgaatagttttcctaaatctgactgtatgcccctatcccaagtgatgtgaacgtccgatttttgccttccgcccggacgggtgatttgaagcattttccatggaatctcgggtgttaccgaatagtgctttactgtgctagactcaaaatgtgagatggtaataacataaaaagaatgtgggatataaaaagnnnnnnnnnnnnnnnnnnnnnnnnnnnnnnnnnnnnnnnnnnnnnnnnnnnnnnnnnnnnnnnnnn

SEQ ID NO: 48696 - DNA, 880 bp, Oryza sativa
gatccgtgaaactttgttccattaatgacgaactcatgtcactcatatgcatgtttgggaagtgcttaggccgactcccagtgcttggtggctatgactagtcgggcagagtgtttaaacgtaatgagtcatctgctcggggaaatcaaaattaacaagagaagaaatacatattttaaactgcttgaatttttctcgagtattatatttatatcagatactactcatcctatatgtttgttctgcaggatccagatccagatatgcataaaagggattcatggctttaagcttatctcttacgctacaggaatggatcagtcagaacatcaccaccggctcgcctcgaccgccgccgattggtgtttccgcctgcacggctggcctttatgccgccgttgttgggcgtctatgtcttcaccgaccggccgcctcgtccgccgccgactggtgcttccgcctgcacggctggcctattatgctgccgttgttgggcgtctacgtcttcaccgaccggccgcctcgaccgccgccgactggtgtttccgcctgcacggctggcctattatgctgccgttgttgggcgtctacgtcttcaccgaccggcttgccttcgccgccgccgactggtgtttccgcctgcacggctggcctttatgccgccgttgttgggcgtctacgtcttcaccgaccggcttgccttcccgctgccgacttgtgtttccgcctgcacggctggcctttatgccgccgttgtgggcgtctacgtcttcaccgaccggccgcctcgtccgccgccgactgatggttccgcctgcccggggggcctattatgccccccgtcgttgggcgtctacgtcttcaccgaccggcttgcctt

SEQ ID NO: 48697 - DNA, 5959 bp, Oryza sativa
  unsure (1)..(5959): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtgcggccgactacagcaagacggcgtcaggagctcttgccggcatggcaaggaaaagcttgctggcggcagcaagatgacgacgcacggcttgggagggacagagcggcatggaatgaaacaattcacgtccttggtggcatgttttgaaagtgttgcgaattgagtggcacatcctgaaggtggtgcaaatcgaatggcatcttctaaaaattctcctaaaccatttgtaatatgtgataatacaaatgccggcatgtttgcaatggaaaaagatacaattgcgtatgtaaatcgggacatgtttatatgtgtttttaagtgagaccgtcataaattttaatatcgattcgtcagttccaacaaacatattgtcatgggcggatcacccaaaaaattcttagcctaacacataaatatacgtatgtgagcagaaacttttgaaaaaaaagaagaaaaaaagctcgtttttaatatattatgatgcatatttgatccatttatacttttagctttgttatatataagttggatcacccatataaaagttcgagatacgtcattggtatagttaaatctattattaattagtcattttcatttttaagggagtattgtttccagtttataaattaattacatttgaggtcaaatagtagtatttttttgcctcaacaaattgattgagaaatgagaaaaataaaaggaagagaggtctggtaggaaaaaaaataaagaaagaaagcagagcacgagaacagataagtcataagtccccattttcactttctccttcactttccccaaatccatccgctctcatcccgtgtcctttactgctgtctagctgtctcccccgattcaactccccaccaccggtcacctctagcatcgctgtgcttcttccctgtctgctaccccacacaacaatccttgagctccttccctacttgctgcgccccatcttcctctcgtggcggcatccggttatgcatctgggctacagctcagctcaagtagttgacgggggcggagtggcctcggcagcggcgtggagtggattcgacggtgatgatctgcttccgagccaagtctgatgccgtgcacggccgcctcctggttctcttccgcacgcagccaaggccacgacagcgagcctcaaccttgcgtggcccacgagaagcaggcgcaaggccggttcagggtgacggctagggtgcgtgcatggtggtgctaattctgtgctcgcatcacatgatggcggtgatttgccaaattggtaagccatcaatctgatttgcttagggatttacccagaaatttgagttctaaatttgggtattttttcgttttagggttttgaaatcatgcaacgtgcggccgaagatagaaaccggtgagacaatgattctggtggctggagttttgctttatttgggtttgggatctaattcgaggaaaatttggaatttagggtttgtgcaaattgggtattttttctagaaccaatttttgtatttttgtatgttgtatatatgcaagttgtcctagtgtaacacgaaccggtttaaatttagcccaatttatgtaaaatcctgatcggaaccgatttggtgcggacttaggattaccttgactttttttctccatgtcaaattgaattggatctctgattcttttgtgcattggccagcgtatgtgatgaactcatacggatacggacacaatcagggacgacgcacgaaatttgtggcaaaaacatgttaaacttttataataggaaaagaagtagagaagagatagagagaaatagagatgggcacgctataaataaaactataaataagttggtcgaatttccatatccgtgcccgacggaattgcatcctgacgaccaaaaattataatctgatccgatttgtagtgcgtacgtactctgaattctcaaataggcatagtccgtggttaccacgtgaaaattattcccatcttttctcctcgtcaaggaataatacgattttcaacatttgcaggaacaaatcacaaaacatatcctccgcttacattgcccatcgtttcgtttctgcccccgacgaatttgatttctttcctcgatcctcctcctcgattaatctggttcaattcttttcccctcatttggctcgattccaacctggtttgatcagttcttggaacttgaaagacagaaactgaagaggatggggtccaagaagaggatgtcaaggtacgccaagaagcacgaggaggccacgctcaagttcgacgtcgtcgggtacagcctcaacgagggcatggccgccggcgagttcatccggtcgccggccttcgccgtcggggctacgactgggcaatccgcttctaccccaacggcgccacggtgaccatctcaaggctcacctccgtctccctggagctcttgaccaagaattgcaaggtgcaagccgcctatgacctgcgattcgtcagccacgccaccggtcagcgagagtgtttcttcgctatcagagccaagaatgttcagtagcaccagatgccctaagcctcagcgctcaaatccgatgcaaagatatcgtctggagaaggaagaatcaggctacatcaaggacgattgcctgaaaatcgagtgtgtcctgaccgtagtccataaaccgatcgtgtccaacgccaagggacgatccgaaatcgaggtgccgccatccgatttatcggatcatctcggcaaattgctggaggaagaggaaaccgcagacgtggatttcattgttgggggatcgaagattgcggcgcacaagagcgtgctcgcccgtcttcaaggcggagctctatggagggatgaaggagagggaggcccgtagcgtgaccgtggatgacacgcagcctgacgttttcagggctctcccacatttcatgtacaccgactcgttgcccgacatggacggcgttgaagatgccgactatgttgaaatgatcaggcttctactcgtggccgcggatagatatgccatggataggatgaagttgctgtgcgaaagcgtcctcgatgatttacttgatgcggagacagttggaactacgctagctttagctgatcagcatagctgcaacaaccttaaggatgtttgcgttaaatttatggctacttcaaaagggatggatgctgtaatggcaactgaaggctatgataatctcaagagaaattgtccttatgtcttgatagatgtgttggagaaggttagtaataagcttcgtagaaattaagatcaatttgtgaatcccatataggccaagttgattctgtgaatagcctgtctgtttttcaagactagatctgtttagacaacttatacaacaatggtatcacagttatggcattttatggcattagtagtttaatcgatctacaaatcattgcaagcatgcatcttctgttgctttaatttttctttttctgattggttaatccggaacatatgtgctcatgttttactgctacaatggcaattttggataatcctaaaatcagaggattttctagactgtattgcatgctttctgttagtaggttaccctgtaaattcagagtaaaatctagcaaaacatcttttacacccgcaagcactacgtatagatgttctttaccctgttgaactttatggtggtaaaatgtaggcatgattaaccttatgcattgaattttgaagctaaacaggggcaaggcaatacatactacattggccttgcttgttgtaacgaatatattttcttcatcgaacatgtttagcctctttgaacatgaagattaaatgtctttattttggtagaactgaaaattcaaaaaaggtttagtgttcaaacatcattgccctttaacatgaataaatgaaagccaacctgataatttctctgaacttcctaaaagctcattttgaattgcctcctagagatacatactgtcgtctgtcaatattgcatgtggagcttttctattcatgaatttgagaaatagtacgtaggagtacctgttaaaaaaatgacttgcaccctataaaaaaagaaagacttgcagctaatgtttttcatgaaaaaaaggaaagaaagacttggtatgagactgaatagttaaaaagagttctctacctggtttatagacaatattgcagattttcctccgttggctcaaccaaagaagcaaataatcacatgaatatcatagtagtcaaccgatcgatgtagttgtgtccaatacaacagcatcactaaaaatatctcataagaccgcagtaagtactgatgacgcaaacgaccagcaatatattcccaagactgcgtgtactgagatgatgcaattattcgaacaagcaaattcacatctgtctttgttgaagtcatacttgaaacttgtatacttgtgggcaagcagaaattcagatcaactgatgagggctcgctcaaatttgtgcgatagagagagagaggggaaacggaggatgaacctgatggcgtgtaccagcgctggcggccgcgggggactgcctgcgacgaggtaaaaaagcccgcccatatgcaatcgggaaataactacaaagcagacgcccgatttttcccaaaataactcaggcatcatttcacccctcgtaaaacaatgttttagcgcttagtgaaagaatatttcagttcttgaaaatagtgaaacacaatttgatcaccagatgaaataattttcttcaacgtatgaaacaaatgattaaagtcattgaaatatcaacaagatccaagtgaaattgagaaaaaaaatgaaacaccataaaaaaaactccacttaggcattgtttagttcccaaaacaagaacttttcacccatcacatcgaacgttcggacacatgcatgaagtattaaatgtggaaaaaaaacaattacacaatttgcgtataaattgcgagacgaatcttttaagtctaattgcaccatgatttgataatgttgtgttacagcaaatatttgctaatgacggattaattaggcttaataaattcgtctcacagtttgctggcagaatctgtaatttgttttgttattagacaacgtttcatacttcaaatgtgtgtccatatatccgatgtgacaccccaaaacaaaaatttttggtaactaaaccgggccttaatcacttcgatctaactaataaaacatctaaatacatagattggaattatcgaaaaatcacccaaaaaataccagctagatacacttcttccttctctccagtggttagctagatcgtcgtcccgagccgcgtcgcgagggcggcggctgcggctgctacggtggctgtcgggtcaaggctacgtatctggttgttgtcaccgtcgccgcaaccactagtgaacctgttcggtgacatcgccgtacggatgaggagtgagtcgagaagcgcctcgtgtggagagaaacaatgtagagagagaaggggaatggataagattgagagagaaggagagaaaagggcagtgggacgcaaaagcccgatattctctttccactcgaacgcctgatcgagccagagcattttcatatgtaatcgtgttcattcaccctatacgggcctccgcaccgatccaaagtaacagagaaatagggcaaaaaaatcgtgttcataacccgttctcgttaccgattcgacaccgaacaaggaggaggaatttaactatttgccacttttaggtttggcaattatccaaatacccttattaggtttgtactttttttttgcccctcttaagagg

SEQ ID NO: 48698 - DNA, 6524 bp, Oryza sativa
agatggagggcagtgagagactaacgagtgggtcccacaacatttttcacccgagtttgccacactggcatgctacgtgggcaaaaatggcaaatagttaagggaccacctcttaagagggggaaaaaattaagtgcaaacctaagaagaattttggataattgccaaacctaaaagtggtaaatagttaaattccccaacaaagcgatgtgtttttcctagtgtcaaccgaatatgactgggctatctgttcgtttctaatgaaaagagtggatgaaattttggatacttgtagcacgcttttcaaactgttaaacggtgcgtttcatgcgaaaattttctatatgaaagttgttataaaatataacattaatctatttcttaagtttgtaataattaaaactcaattagtcacacgatattaccgtctcgttttacgtgaaacacttaatctttatctacatcttcatcttcaggagattcgggagattaatagtacgggacttggctgagtttggattgaattggaatccaaaaatcattcgatttgtttaatccaaaaatccaagaaaaagttggatttccaattggagggggcaaaatataaaaattcactgcctagggtttaatgtaggagatcgaagaggcgtctcctcctcctcgccgtcgtcgctcaccatcttcccccgcaaccaccgccgcgccgccgccgatcgcctctgctctcaacgcacccaaggttagtatccatcagcttcaccccgcgcttcctcctcctccgccgcctccgcctccgccgccgcaagaagagctagcttgcctctttccccccagatttgatccgatccccccaacctgctctgatcgatcgattcttggaaatttcgcagccggggatggtgtccaagaagaagaatacaacggcgtcgaggcacaccacggagtcagaggaaggcacgcactcgttcgagatcgtcgggtatagcctccagaagggcatcggcgtggacgagttcatcgaatcggccaccttcgccgtcggcggctacgactggtgcatccgcttctacccccacggcaagggcgatggtgccaaggactacatctcggtgtatctcgagctcctgaccaagaactgcgccgtccgggcggcctacgacctgagattggttaaacatgccaccgggttgccaatgagtgtctactctgaaacaactcacagaatgttcaattctgatgacagtagcaaatttgctccgccttatgcgactttcatgaatagaagtaatctggagatggaagcgtcaggctacattaaggacgatcgcctcaccatcgaatgctttcttaccgtcatcgtcaaggaatcgatggcgtctaataccgtgaaggcccatgaattaatcaatgtgccgccgtcagatttatcggaaaattttggcgaattgttggagaagggggaagggtcggatgtgactttcgttgttggaggagagaaaatcgccgctcacaagatcatccttgcagcacggtcatccgtcttcaaggcggagctctatgggcagatgaaggagaagagggcccggcgggtaaccgtggaagacatgcaacctgatgttttcaggggcctcctgcatttcatctacaccgattcgttgccggacatggatgatctcagtgacgacgactactatgagatgatcaggcttttgcttgtggctgctgataggtatgccatggacaggatgaagttgcagtgcgaaagcatccttggcgagcatcttgatgtgcagaccgtcgcaactacattggctttagctgatcagcataactgcaatggccttaaagatgtttgcattgaatttatcaccaatcaaaacaagatggatgatgtggtggcaactgaaggctatgctgatctcaagagaacttgcccttctgtcttagttgatgtattcgagaaggcaagtaagttccgtagaatttaaatgctaatgaaccccttcttcttaggtggtgtctaggagtaggttctagttcttaaattgtataaatagcatgtctgttttgcaagagcagctctgctaacaccgggggttatatgtgctgtgttaagttatgatctccttttggggaaaagtgttagatgaacaatagttggatatcgatgtaaggatctgtcatagcctcaagctctcaagtgctgagtcgaacaacattagaaaaaagttccattccactgagtgtgggaatatagcagcataactagcaacacactgatgctgtcattttaatattctgttatatattgcctgcagagacatggcattttgcggcatgactagcttaattggtctttagtgccggtatgatcgtttaattgatcaatcattgcaataattttgtatagttgaaatttgtttggatgatcgtgttcatgattaatgtttggttatctggttagctgtaaggcttttaagtttcatctggcgttcgagtccaatggctaaacctggttatattgcaccaagtctatattaacgaataattactccatagctttgcgtgctcatgttttactgctacaatgggaactttggatagttcataattatcagaggattttattgactgcattggtgttctattagttatgcagagtaaaaactaattatcttttacaccagcaagcacaatatagagaaattctttaccatgttgaaccttatgaaggtggtaaaatgtaggcctgaacagcagtaaacttgaaattttagagctaaacaggtgctatgtaatgctgttctgcattgccccgattttttaatgaatgccctcttttccatccaacggtgtcaacgaaggttgaagatgatgtttggcctcatagaactgaaaactcaaaaatgttttgtattgaaacattgccctttagcctgaactcgattacttctgatcttgttactgttaaatgttaggatcaggtgtaatctgtagagcataacctgattacttggtaaggcaggttaatatgtgcatagcatttacttaattaggtatatgacatacatcatttaggaacttctgctatttgtttagtggtgattagtgaactctttttttaagggaagattagtgaactcatgagactcgcaaatagatgcttgattagtttgtattgcaaaactgtaagaactcaactttcagaaatattggaagcatttagccaagtccaaatgtgattttcattgtttctcttaactttgaatattcattctacaattatcctggcctgaaagctatcttgtgcaattcaaggtctaacggtcattgaattctcatttgttttacatttttataaatactagaaaaatgcccagcccatgcgttgcaacggggaagactattgtaatcttattattattatatggcttagttaaggtgaaattcattgcgttaaattcacttgatatatattttgttagaaaatcatgtgctacaattaagagtccgatcaacttaaattagcatgcgagttttttaaaagagattttttatatgatttcttctatatatttcaaaaatgaactaacttaaaaactgactcaaatatggatttgtgtttctaaaagcgaacgaacttaaaaaccgacttatatacagatgacgtaccaaaagtacaagcaaaagcatcctcaatttttataatagtagagatggagattatactccctccgtctcataatatacgggattttggatggatatgacacatccgagtacaacaaatatgtcgatgtgtcacatccacccaaaatcacttataaaacaataatttctactctcttcattttatattatcaaacgttttagccctttccatagtagttttactatatttattgaaaaaatagcaatttctacattatcaaattaatgttgaataaaatataattattgctatatttttttataagcttagaatttgactagaaaaaaaactcagaacatcttactccctccatttcaaaaaataaagcacaatcacccttaacacaaaaattaagaaactattattaccatattttcgtttgaatcattttaataaatataatacatacatccaatagaattagaaaaattgagagtaaataatttaataaataatatttattagaaaataagtgctaatttaattacatgtattaatgcatatgctctgtattataaatatttttcaaaaaagtagttgaaatggagagagtataggtgggagtaattaataaattcaagcacatattaacggtcataattatccttccaaattaagcacacatgcagaaataacgggtgcaataaaaaattgcaactttctaccgaatgttaatatgcacatccatgcatgacattaaatattattttgtttcaaagttctctgaatatttttttaaaaatacagtataaacgcagacactcataatacgcgcacacacacaactagctctatgagcatattcggaagactaaagccgatatatatatcttgacatgacgaactcaccatgaatatcttgctgtagatgggtacgatatatctctaaatattattttgtttggaggttcctcacaaatgaaggtaattatgaattatgaaacgaaaatgcatcacatcaaatttatatatttcaaaatgaataacctctgttttaattcaaaatgtcaaattctgacatttaagataatggttagtaaggaaaattctgacatttaataaaaatgtagtaaggacaattcacaaatttaaggtaatggttagttgcacacagtgccttattccccataaaagagcaattagcagctaactatgatgtacggtgtttgtttttgaaatgaacatattcatgaacttttttggtgagcaccttctggaatcaaatcgacgaagcaaggggtgtaaaagaatgacttctccatgcccctattgtactcatttaagcgattacaacctaagtactgaaccttggagctcctcagatggtaagctaccacctcatctaaatccatcaagtagatgacctccttgtatggatgaaaccccagcaagtcaacgctaccaaatgtccacatgctcatctcctcttctttgttcttgctaaggtctccgataatgttgatgttatcatcatcagagttccattcagcactgtcttggtcttcctcctcatcgtcatcgtcatcagattcatctaggatccacattttgttgatctttgcatgatgccatcagaacaaaccttctattagcttggttaagggacaaaggttcacatcatacttgaccacccactttgtcagctcatgtgattcgtcgagtgcccacacccgaagttgaaaattctgacgttttgcatagtatatcccggtttctgatcttccaagaacatcttatgtgtatccgccaggtccatcaaatcttggtgttttgattacacggtacttagcacccaaaattgacagcctataaaacaccatgagaataattattttgctgtatagggatatgatttcaatgaaaatagctcagtatgaaaaatgttagggtttaaccgtctattccaatgcgatagaagatgatggatcacataatcatacaagaaaagacataatatatcaagtctaagttgagttatatgacaacaaccggtctaatgaaaagcttaaccattaaatggggttaaacggggtggattaattgtcttcatgtactttaaccattaccgacacagattactcagtaaacctcaaaacaactgcaacaacgaaatatagcactgtaactgtaaacctcaaaataacaacgaaactatcttgctagcacaaatataggatgactagcttaaccattctactgatgagtaatagtttactcggtagaaaacaattgtaaacctctcaacgaattaactgtcttgctagcacaaataaaggatgactagcattatacagatttatcattttaacatcatcactgatcactagttcgtgtacaaccaatgatcgattggtttctggttagtgatgagattttctacacatttggcccttttgcatttaagaaatcaagattaattatacctgaatagttggcaaccctttttagttccggttgtgcaaccggaacgtccaatctgggactaaagatgcgcatctagttccggttgaaacaaccgggactaaaatgcataccaagtcaaaaaaatgtgtgggatgtgggattcgagctcaagatctcttacctcagctctcacgcgcgttaccatcccaactaatacacacatctaacttggatagaggtgctttatttttaaactaacattggaggcatctttagttcgagttgatgttaccaaccgggactaaagatcaatttttattccaccaatctcaccaatctggactaaagatacttttagtcccgattggtgttaacaaagatcctccatctttaatccggattggtggga

SEQ ID NO: 48699 - DNA, 55897 bp, Oryza sativa
  unsure (1)..(55897): unsure at all n locations
tggcgtggccttcatggagaaaagccttatcctcccacctcccagtcctcgacgagaatacccacaatgtgtgcacagacggtggccattccgctgtagcgtccttacccacgagtggacctttgtggcacttcttcttggtaggaatttcaggcaaatcagggatcaggaacacctcatagtgcagagactctgcagggtcgaagacgaggtactcagcactaatgcatagactatcatattctgtgaacggtggaagctggacccatcgatgcgtcgcggggttgcagacaaatagcttatattgttctgagattttgccgtggtacaggatgaggccattgcagtggtccagtaccttgttaaatcctatagcgtcaatgggtaaaaacttgaaacacccatcaatcccacagcccgcggagtagctagggcgggagaagaagtgcgtcatgtcatggtcaaggtagttggaaaagatgccgtgcactgagtgtgtggcagaacatgtgggagcagcagccgattggtgtcgatgatagtgcaccattccttggacacatccttgcagggaggcagcggagcacttttatgaacacatcgtcagggagacggtccattgcacacccttaatttcctgggtacaagcagcatttgttagaattttattttattttatttagtctggagagaaataggggttaaaattaggttactatccatggtgcatgtgttatgtttattctctcatacaggtatggtacaatacaaagcaaacagtacaatgcaaagaattaattcttgcaggaaaaagtctgcctaagttattactaccttctaaagaatatactctctccgtttctaaatatttgacatcgttgactttttagcacatgtttaaccgttcgtcttattcaaaaacttttgtgatatatgtaaaactatatgtatgcatataagtagtatatttaataatgaatcaaatgataggaaaagaattaataattacttaaattttttgaataagatgaacggttaaacatatttaaaaaaagtcaacggcgtcaaatatttagaaatggaggagtatatgaacaacacatgcatatatcgattgcgagtattgtcttgaatgcccactcggattaaaaaaaaacttaaatctttttttttgagcagaaacgacggcagaagaactgccggaatttaattgaaaggaggaaaaaaccaaaagtatttacaatcccattgaagggatagaagttcagacgaaactaaagaacctcagggaggtttaaaggccgtctttcgcaaatctaagtcctgctttatcaaataggctacttcgctaacggagcaagacacgttttggaaaatcctcctattcctctctagccaaacaaaaaacttaaatcttatgaataacaacaacaacaaaaaggaaaacaaagaaattcttgatcggcacggtcaatcaattcatacaagagcccatccaatgttggctgacctaatttctctcttaatttcaggttgatgcgatgtcatagaccgaatttcccctattttaattacacacaagagtatagattaaaaaaaaagattaccaactacacatcaattgaattgaacacaaactagatatccatggatctgaatctgtacattagatatgtcgcgcatgtataaaagaacaacaaaaataaaatccataattcgcaagggagaactatcctatacatccagatgtaaaagtaactagacccgaggcgaagaggacgttcgtacctgcaagctggagaccggcgtcgaggatcgacggcggcagaggtggaggcggctcgatcaagcagagcacctcgcggaggcggaatcaccgaagaggtcgaggaggatgagaggggagaggggcggcgtttttgggggaggagacgagatcgtgggaggcggatggttcgttattctctcatcagtgtagggtttatcccgtgcgttagcttcccatcggacggcctggaaatttccacgtcaatactaggctccgcgctcgactgctccattgggatattattattacgagtaaattattatattggtggtatacaaacatattaggtggatgcaatttaggccatgttagccttacgatatccatccaataactaatagcaaatcaacaactagcacacgcaaggttcatgctcctagtgtaacgtgtgctatacgctggcactgctactgcatggcattggcatgtagtatctcagtgctctctcactcatcacaatacatatagtagtgcaactagcaacttgtttttcgaaattaaatatgttttcttataaattaattatttgatctatgatttgactacatcattacattcgttgcaattaaatctttaaaacaagatctcacacacatttgtattttgacggaaatcctccccataggtgcccgacggggggagaaaagatcggcccctacccttccacgcctcccacgcctccaccacgtatccccaccacccgccccaccgttgcaacaaatcacccacatattacggaaacgccctattagggggatctgttccatttttttgttccacaagaaatatttcagctagtatacttatgatgttttactatgtatagatcaaaagttgcagtgaattaattcgagcgttcaccgcacagaggcgatctcgaacactacctatgataataaatccaaaggaaaggaacaagcaacgaattgagcgcagtagcgcgaaagaacaagctgcttcttgtttagggtcttgactcttgaatctgagagggagaaggcttcccgcgtgtaccaatagaacgtgcgcatacgcatgcgcacatcacacatgtgtgcacgtgcgcatgcacaacgagggacaatactatgcttatagaaatgcgatattacgcatttcaaatcggtttaggtgtcaaagtacctaaacctcactgaacctatgttctagcttcgaaaacaggccttctcggccttttttctcaatacacgtacccccgtacacatgacaccggtgtaaacaccgctaactctacctatattcttttgcaacaaatcacccaatattacagaaactctctattaagggaagccgtttcatttttttttgttccaccaaaaatgtttcacctagtgtacttataatgtttcactacatatggatcaaatgttgcagtgaattgaaacattcttttgctatttgctgaaacattgtttttatataaggtaaaacatcgcccgattttttaggaaaccctttgtttcatacgctgtagcaaaatgtttaatgaggtgatttggttgtgtttcagctttttaaacaattgaaacattttcgatctacttagtgaaacaattctgatctacttggtggaaccccgatttttgaaaaaaaaaatcgggcgcctgattcgtaggtggccccgtattttgatgaaaaatatatatgtttttcctaaaaatcaatcattgttgcactatttactgaaaaaaaaatgtttcactatttgtgcaaatgtttcaacttacttaatgaaatatatttcatagagatgcaacatataaaaaatattgattacaacaataacaactgttacatgacacattaagtcctaacgaatgaaacataaaaaaattatatgaaacatacaatatattttcatatatttgattttgttgaaatgtttttatatcatgcatgaaacattgagttgtaattattgaaacataaaaatatattttttgaaacatccgaaaaaataccacgtgcaacattagcaaatattttgtgaaacatctaaataacactatgtgcaacactaaaaaaattaggaaaaagtacgaattaccccctaaactagcgcggtcgaccgaattaccccctaaacccgaaaaccaatcatcgttcaccctgaacttttaataccagacaaattacccctctcgacccaatccaaagcggttttgtccaacgtagcgtacttatggcaatccaatcagcattttatttattaaaaaatgtgggacccacatgtcatacccctcttcccctctcccttctatctctcgctcttcctctctcttgttgttcctctctcgtagcgcgcacggcagtgtggggacgggtagtgggtgtgggtggtcggcgaggcaggtgttctgtgccgcagtccaggagggagtagcgacggcgcgggatatagaggcggcgtccgcgcgggacacaaaggcagcgacagcgaactcctccgccgggagggagcaacggcggcgcaagacgcagaggggaaggtccggtcttcttcttcgtcgtctggatgggagtggcggtgggcgacggtaggcagggcagcacgcacggcacggcggcgcggacggcggcaggtaggcgttcgacgccgcggtccggtcttcttcttcgccgttgggatggcgctcgggatgggggcggcggctggtggcggaggaggctggaggcgaggctcgggataggggggacgggctggtggcggaggcggcagctagaggcctgcctgctgtcgtgcgtgccactccgagcatcgccgtctgcaccgaccaccctggtggtcatggccaacgacctcatcgtcgtcaccatcttccacgagctacgccatgtaaccggagacatgccgggcgttcatgccgacggcgaacgagctgctctccatgagccacgggccgccgcctcgcctcgcaccgcgcgtgcccgcatgctaccgcccgtccacccccgcgtgccgccgcccctgtgcgctgtctgcccgtccgccgccgctcgccgctgtctgatataaccatgcaagatctttatataaagatgtaattataatgaatctaatggtataattaaatcgtaggtggataaataattgtagagaaacatgtatttaaattttgaatatttgaatatgcatggacgcatgcacttgacgtgtgctgatgtgtactaactccctgcgtgcacgtgaggacttctgttgtctcgggtgaagagggttactaccatccgattttttgcgtcggcccggacacccaatgagaagcattctcgccatttttgttcgagcttaagattaatctagattattgaactagattactataatttgaattatgataagttggcataaaataagctgtgagctgtttgttttcctagattataagcggcttgttagttgttagccacccaataatctaaaaagcacctttagagttgagattatagtaatctggtttatagattgtaataatctatcataataagctatccgtttgttttagcttatttctaataatccagattataataatcctaagctgaatcaaacagggccttagtatataaacttgtaaaatgttcatttcagtacacgaacttgcctagttggtgcgaacgaggaccaaaataacttgacaatgttaattttatgaagtgatgttgattagaatgtgacttgcatacgtgtagtgagtatctataggatattcaatatttataaatttggtctccattttattcttcaccatggaaatgatgaatttcatatatttctaacctttgtaccattgcttgtctttttattctttttctactatcactatatcatattctattctttattgaagaagtgtatgtctaatagcaaacttctaagagatatgccctaaatcaataagattagtaatgtagtgtccttttcgccttcctccgcatgcacaagacaagttcatgcaccaaaacgagcatttcacaagttcgtgcactaaattatacccacctgacaagtttgtataccggcgatgcaatttactattattattactttactgaaacgattgttcgtatatttactgaatcgactgatcatcatttacaatatttttttaagctattgtccggcttggaaaattctgctacattttcttttggtaaattttgctacaggtatagtttgccaaaaggcccgcagcccgatggcccggcacatggcactagaatttgacctagtccaagaacggcacggcccgactgttgttgggctcatgttggcctagcctggccgttgggccatgcccagcacggcacgacctacttggttgtcggctcggcttttctctcctctcctcatcctcctcacctcctcctccaccgctctacttgtgagagtgagaaccgagagggtagaggggtggagagataggagatccatgaatccgcctcggatctccgtattcttggggccatcccccgttagctacgcctctactagcattggcacggaggccaccgctttggcagccgctgatgtcgtcgaccatagtgctcagcctgctgctgctattgtcgatgggctggtcgtgcctttgggccggtctgatccaatcaaattttggatgcaatgttaggatggaagtagttgatccgagctggggcctcgttgtcgacaacattgaactattgttctccacggttgcgacgtcttgaaacttggttgatcttgatagatctggttgttggcggtgacatactctagttgggtcatatatagcagagccaaagttgttgaagtgtccctcatcgaaaaacccacaatgacgatctcttgagaaagatagagataataagggtcctgctttataggagaacgcatttcgatcaggtcatatctcccaaagtcgaagtcatcgaggagtttgttatcgaaagaatccgtctattgaaacccatcgcatcgaaaccttgaagcaccaagtccccctacctagcgcaccacttttgacggactatacccatacaatatttgtagagtttggggatcgttggaaccaggatatacgcgagattgtagtaaaagagatagaagacaaagatgtttatatagattcaggccccttaaatgacatgtaataacccaactcctgttggccgaaaccggtgttttgcctttatatatcagtatcacacaagtacaatattttagataatctaatctagtagcatggtggcatggagctctcacaaatagccaacggctagtgcagtctttgtcctcgaatatgaattcggcgagattggagatagctctagatcccttacgtcggcatctttggctcccacatttggtttgtctagatctatattggcttgaatctggcttggcatgtcctttctcctcaggagtcttgtatttataccgaagatcattttcctttccaagtaaaactaggagatatagaataccttatctttcccaactaggattctaataccttcttattccgaaaagataatttacttctttatctaccatatttccttaattaaccttttttatctacatatttacttaattaaaggatcttatcttccgcgactagaactctaatacattatattgtagtatatagtattaatgtattccatgaccccatctatagaaggtataccttatccttggcagttggcactggcaataagatttatttttcaagaaatctacagcgagaggcccgatttgaagagaaaaaatggggctccatgatactgcatgcatgcaagactaactagtttatttttcttttctctcatcacttttaatatttttttctcctaaactacttatccgatttacgatttgatcgtaccattgaatttgttacaattaaatttttacaataagatatcacatgattatatcttgataaaagaaaaatatatttttcagaccgttagaacttaatgttccctatgtgatagggacatgttttaaaatgtacattgagtgtatttcacaaaatttatttaactacttgccccaactctctctctcctatctatccatgcatgcatgcatggatttagcaacattcaaaatgatttttgtcttaaagtacttatctaatctaccatccgataaaaccattgtattcgttataattaaatcttcacaacaagatatcgcatgtttatgttctgatgaaaaaaaaaacatatatttcattctgttaatactcaatgtttcatacgtgataggaacatgtttcaacgtgtcttcactgtgtttcaaaaaaaaacaattaaatgttgcagtgactgattttataaaaaaaacaattaaatgttgcagtgactgattttatcgtttcactatgtataacctaatgtttcactaggtgtcaactgcaacatttgaccgactttctttttgcccctattgtctctcctctctaatctatgttccaataacattattgtattcgttataattaaatctaacgttgttcgttgtaattaaatcttcacaataaggtattacataattatgttctagtggaaaaaaatatatgtttcagtccattaatactcaatgcaatgtttcatacgtgacagtaatttgtttcaacgtgtctttacaagtgtttcaaaaaaaatgtaagtggctgatttttttttcactatgtataatttaatgtttgattcattgatggtcaactacaatatttgaccgatcaatttttttttgagaggatcgggcaccgatttttttttagaggatctggcacccgatttggaggcgcctccaatctacatggttgattttatcgacgcatttgcttcagaaaattcttcagcttagttaggactaccactaggaattcttcagccttctaactatcgaggtctacgaataggaattcgaattcttcagccttctaactatcgaggactaccatatatatgtgtcggattctagataaaaatgcagtctaccttcgtacttcggcctatcaaatctcatactccctccgtttcacaatgtaattctttatagtatttcccacattcatattgatattaataaatctagatatatatatctatctagattcattaacatcaaaatgaatgtgagaaatggtagaatgacttacattgtaaaatagaggaagtaaaagacaagcaaacaactatctatggaatactccctccatcccaaaataatccaactcctagctacaaatttagacatacataaatattgcttgcacttcagtaacaatgcgacagcatcctgaattttggacaaactgtttataacaaagtgaagcacaatacatgaccatgaaaagcgctgcataccagtaatttagaataaatttcagaataggggataaataatctgggttgcctttaaccttctgttaagagaaggcccagaacaatcattctgaaaatagggacagaagcagagaggtatactgtcaatcacagaaccacctgacaaacacttcctccattctaatcatatattacaacaaaaaaaaattaatttgacatagtactataattatcagtacaaactgagcacaacgtcctgcctccagaaatatagtgcttcctactattgcatcttgatatactattgcatcttgatatactattttgttataaaaaattaatttgacatagtactataattatcagtacaaactgagcacaacgtcctgcctccagaaatatagtgcttcctactattatcagtacaaactgagcacaacgtcacgctgatatactattgcatcttgatgccctctttttggttccatgacaaattggctcaaatcgcaaattggctatggtcagggcccctgattcagggacatgagaaaaataaaaacatgctgctctggttgatcaaagagaagcactcagtcctactcaggggcggatccaacgtgggtgcagggggactcgagtcccccatacacccataagacccatggatacccccggagcacctccttcaattttttcaccataaatgataaattaaaggtccctaaatggctggagattgaagaaactgtgtaattgagtcccctccaattttttgttcctggatccgcccctggtcctactggaagttcatttaggtttctaaaacatggattaggaaaaataaatatgaggttgtagtcaaaacatacaaactcttgccaaatacaattcctggcaagttaattttcaaggaaccacaatagtcaccgacaatactaaactaagtcaatgttattgctattgatgccactatgctccctcaacaccgcgattttgttatgttgatgctgttccattgcaacggagcaggccatcagagttatgttaatgtaggattatcttcagtatccaaattttgatcaagggcgcacaaaataaattttgcggaaggacaacaggttatatgtcagttaatggaaacaaagcttgcaaagagataaaataaacctatctatcatataaacagataagcaccacaaaggtgctcccaaaatgtaaagagtaaactgactacggtacctgatttaggaagagaagaaagaatacccatatcccttataaattaagctaacagctcttagactcatcttgtggaacactaccccttgacattttgttgagcttcgacatctgcgccacggcatccgccaagacagaaggtgccattctttggagatcctcataccctttgctcgccactacacccttcatcttctttgaacatgacataaattcgatgcaagcatccttcagcttgtcgcattgatgctgatcagccagtgccagcgtagtcgcgacattgtgaacattaagattcttgcaaaggataccttggcatagcagctttagcctatccacggcgtatctgtccgcagcaacgagcaggtgccggatcatttcacaattgtcgcgtctctcgaaaccgcgcgtcacggggaactgatcggtatagatgaattgcagcagggccctgaagacggcgggctgcatatcaacgatggtaataggctgtgttcccggctccctcagcagcccgcagagctccgccttgaacactggcgaccgcatcgcgagcacgagcttgtgcacggagaacggctcccccgcgacatcgaaggtgacatctgcgccctccttgctctgcagcaggttggcaaactgccgcttgatgtcgggcggcggcaccaagatgcgcgggaaccgggcggtcctcgacacccgggggtctctcctgacgacgacatggaactccatggtgaggcgatcatccacgaggtagggctccacctcgatctggcccctggggatcatcatacagtggagggccttgcacttgtcgccgaacgccagggcgtacctgaggaagggctgcggcgtggaggccaccccggtgcgctggtcgacgagcttgacctcgcaggagacccacacgcgcggggtgggcgcgtcgccgaggagcctgaggtaggcggagacgtcgtcgatgccggcgacgccgtagccgtcggcgtagaggcaggcgacccagtcgaggccggcgacggagaaggcccccgacctgatgggctcgtgggcgcccatccccttgtggtcgctgtacccgaagatgtcgaacacgtggacgccctcgccgacgacgtccggggcgcacgtcgacaccgtcttccaccccggcgtgaactccgggggcccgcacgccgccgccgccgccgacgacgacgacggcatatctaggtgcggggcggcggggcggaggggatgggaggggatcgggcggcgagcggcggaggtggaggagacggcggcgaggggaggggatcgaatgcgaaggggatttggagaaggcggcggcgacggagacgagagaaggcccaaatagggaaacaactcggagacggaccaacacgatgccttttgcccttttttgggcctagtttggatggcctaatgccgacccaattaggcggcccatgaacttaaccccattcagaaaaggaaaaaggccttacggttataaaggcgaattaaatttaaaaatatattgtttattttttttctcagaaatattcgggatgaaaatttttagcacaactataccttcgtcgctgacgaaagcaatatggtattgctgacccattgcgtgagaatgatggggtgacgactgatgactagggttctctaaaccgtttttgagtggataccgtcaccccatggtttggcggttaccacataattatcgtgaaaaccgtatgattaccgtgagatatatcatagtttcaaaaattaagaaaattatcgcacgtgataaccgcacggtttgtaaactttagtgacgacgcgcagcttgggtgggagcgtacggtctcgcacagcccatttgcgagaccgcacggcatggctgcccaactcaccaacaggggcaatggttaatgtttaatcacattgattagcaactaattaataactaattattattaattaatttaattaggataattaatcactaattaagcggcaccgttggacaagacattctatcgctttttctttatgcgacactgttctgtatcgctgtttccttatgcgagacttcgacctgtgtttagatgggactaaacttttaaatccctatcatatcggatgtttggatattaattataaatattaaacacagactattaataaaacccatccataattttggactaattcgcgagacgaatctattgagcctaattaatccatgattagcctatgtgatgctacagtaaatattctctaattatagattaattaggcttaaaaaaattgtctcgcaaattagctttcatttatgtaattagttttataagtagtctatatttaatactctaaattaaattagtgtctaaaaacagagactaaagttaagtccctggattcaaacaccaccttcatgtccatgtaatttttgcgcaatagttgtgacgcatacttctgccaaaaaaaattgtatcccggatatttttgagaaaatacaaataaatgaacagtatatgccagattctgtttttcctttttattggaatagtcttctgttttgcttaggattttcctgtcgtaattttccctaatcttcttatttagtgctacatggtaatctactgtgcacatattgttcttacacgggaattgatactatatgtttcgtcagatatgactaattttatttcttcctatcattaatgatgccgtttcaatctttttcaggttattatgttgttcatgatatgctgaagaagtgaagatcacctgaaagtaggctgtgacataaggtaaacatgattacattagcagagggagtactagaagtagagttgttagagcatctttggattaagtaaaaccttgatttaattggtttaaataggtaatttgctatagaaaatcaatataagaatttggttcagaactaacaagagtttggtatcttgtccaaaatgggtattaagtaaaaaaaaaatgctcagacatgttggtatcttcatccttgccaagggcaatggtgttacagacttgcatcaccccaaaattaagcacagttccaggagaaacattgaaagaattcttaccaaaggaccaaaggtgataatagctgatttgtgctgaacgaataaaggcagcatcaacttgccccagtttcactttgatgcatttaatagattaactcaaatacagtagtagaatactcagattaataaaacaaaatttggagaagaaaaaagttgccacaaacacagcacgttcaatgtttcacaatagcttcttaggctggaatcataaaattggcatatatataaaaaaaatctactgttggggctgcactagctgatcaaatagaaatactcacttactcagtcctccaattttcaccttcatttctcaatatgcatggctcttagaaaacaaggacatataatgagcagcagaaatctgcttctgaggtctttaaccacttccctgagaaaaggaagtaaaagccaaaatagactaaatatagcctgaatgatcctaaaaaaccctcgaaggagataatataataaagaacccaaagcagacggtatcctactgcaagggtggtcttaggcataacatacagacatcctagaaaatttactccagtcaaatagtattcctggaaaaataatagcaaatttcacaatgaattgattttttctacctttgttccactttggtttggatcttgaaaaaagtttatcgcttggagcaagttttgttacaaattttgcaactggaaaacaagctcggtactgatttgcaaaacctagtctaatgtgcaagttaggtatgtgaatttacccaaaagttaattctaaacacaataggtgcaagcaataccagtgtttaagttatttctatttatatagagagtaaagtaaccacaaggacctgatccagtaaaagtagacagatatccatattacttataaactaaacgaattactgttaggttcatcttccggtgcattgctctttgtcatcctcgacattttcttgaacctgcccattttttcctttgcctaagcgacgagagaaggagctgtgttttcaagatccacaaacccttgggatgccactacatcatccaacatgtttggacatgacataaattcaatgcaagcatccttaagcatgccacaatgatgttgatcagccagagccagtgtagttgcaacgttaccaacacgaagattcttgcaaaggatgctttgacacaacagcttcagcctgtccacagcatatctgtccgcggcgacaagcaagtgccggatcatctcgctgttatcgtctccctcaagatcacgaattgacggcaaccaatcagtatagatgaactggagcagggccttgaacacaaccggttgcatatccacaatgctgataggctctgtcccgctctccctcatcggcccgcatagctccgctttgaagacaggagaccgcatcgccagcacaagcttgtgcgccgggaaggtctcccccgcgacatcgaacaccacatctgccccctccttggactccagcagatcgccgagttgctgcatcatgttgctcggcggcaccttgatcctcgggactggtctagctctcgacaccctcggctccttcttgacagtgaccacacactccagggtaatccgatcgtcgacgagatacggcggcgcctcgaattcggtcctcttcatcttgagacagctgaccctgttggattcatcggcattgaacaccttgaatgtcttggcatccggctgcgccggcgcagcagaggaggcgaggccggtggtctggtcgaccagcctgacgtcgcagcacgcccgcaccttgcttcccccctggctctggagctcgaggaaggcggtgacgttgtcttcctcgtcgtcgaggaggatgacgtgggtgtccgggaagaggaggatggcccagtggaggccgccgacgacgaaggtccccgacgtgacgtgctcctcgcggcccctccccttcatctggctgtaccccacgatgtcgaacacgtgggtggcctccgccgtgttgggcaccaccgtcgagaccgtcctcggcaccgactccatctggtgccgcttcatgccgccgccgccgcgtcggaggtggagggcggacgaacggattggggaaaaaagaaagaaagaaagaaagaaagaatcgaaccaccggcggcggcactgcgaaggaaggaagggcgggttagtacggcaagccggagcggcggaggggaggggagagggtggaggggatcgaaccttgagaagatcgccggcggcggcggcggcggcggtggcggatggaggggaagacgaggacgagggagcccaatagcagattgggccgagcccaaacggaaggtggtaatatccgcggtgaattttagacggaacggaacggagttttttgcggattttttttttgttgggatttttcggttagctctgctccgatcaggagtggaattgccggctggcgctataactgatttttttttccaaaaaaagagagagtaaatttaacctaaccctaggtattatatggtgtaagttgcacaaaactatagggattttggtatataaaaaataaccctaattattatatagttataaagtttcacaaaaccactattgatcattttgatatgatctatcatatttttttctataattatatctccaatttattgttttttattaatcatacaaatgatatatccatgtaactgaagttttttttaaaaactttgatatatgagtatatcagatttattaacaacgtggttttacgaaacattagaaacataatttattaatatgtcatgtcaatcactgtgattttatacaatttgatcctaataggtgggattttataaaattgataaaaaataattgagatttttcattcgtcttcttgaaatagattatattattatattggtctgactttgtgagaaaacccaacaccaacaagcacagctcgtaacaccatgctgcaggcggcaacaatcatcaaaaaagcacaaacaccagacaataacatactccgtatcaccgtagaggaaactacagacagattccacggcttcacttgttatagctgctccagaatcatcccaatgtctagtgttcttcatttttttaaaaaaaagctgctccaaaatcgctttgtgccaccattctagaataacttgatcttcttattttagcaagatgctatatttttataagaaggatatggaattataaatgacatacaaaggagaatttataagagcatttttaaaaacccaatcatttgtaagttctaacaggccacaaaacccagcagacactagccactagccacgcacccacactctggacttattcttctcattcagcagccctaaacactccctgaaatcgacaagattttttcggagggattgctaaagggtattcaaacaagatgtgattagtagtttcaatcttattacaaaagttttccctcctctatgaggaaacattcctatatagtatcggccacttagagtcaaaggatagtacaccccccccccccaccccatcactttgttctaaagcacatggcagcttctccaccacaagagaaaatgcttgtgaacaaggtttttgtatattctccaccacaagagaaaatgattttgctcttccacacctccaccatttctgtatattctatacattgtatgcatttagtgaacaaggttttcttcctattataggccaaataatataactttgtccctctccttcccctcatcaaactgacacaagttaatcatactctttagttcagcaagctcttctctccgctcataaagatttcttctaaacaccagcctccaattacccccatcatgcaaatctctcatagtggcagtgcaactctcataatgtaattttcactacatggcagtatgcaacatttttattttttttaatgtaccaacagttctcacttatcttgttttaaatctaattgttcagttatttctttatttttgatatatgtagattgatttccatggagctcctacagctgtttgaagggaagaagaagagaaccatggagaagaaaaaagagagtcattgatgaaataataaaactgtgcttgatttcaggactcatggaaggtaataatcaattcaaaattgcatattaaatttgatatatttgcagtgcaaattatagtgcaattttcactgaagggtattgcaatttcttctggaatgcatttttagaacttaggggagcccaaccattgcatttttgtatgatgaaatatctgtactttttttagatgcctaacagtttgtttccttttgattttgataggacaatgaatataccccaaaaattctacaaattttgcagctaaatttgtcattagttaaatctgatttcctgattgttcagattttaatttttgttatatggttccttttcatcagtggcggatccaggaaaaatagtcaccagtgtcactctcaatttttaacactaactagttgttcaaaaatttaacactaactgattgacgattcatgattgtacagggctatatgctagtagattgtaatggattaataatagattgaaaaaaaatacagtaaacaagttaattaacaatatatgccaacgaaatataaaatgtcaacaatagttacctattatacttccacctccaccctacgagtaattcccatgttttgaaagagagctatcacgtcgtcatttggaattgtagctagtaaagctttctccacgaaccataagatagcatcattcataaattcatcactaatacgattccgtagtgctgtcttcacaatcttcattgctgaaaaacatctctccactgatgccgtagcaataggaagaactaacactagcttgaggctccgatagaccaaaggaaaagcaagatgtttttttgtatcgaccatcaacttagccagttgtgaaatagtgcctaatttcccaaatctttcatcttctcgaacattgtcaatgtaaatctgaagctcatgatcaagatccttcaattgccttgcatcaaaatcatccggataggactttgctagctctattagatggtcatgcttaaaggaatcgaaggaatcctttggactgaatgcagccatatgagtaagcaagctagaatttatctcattgaaacgatcattgaactctgtgagctgcaagtcaataataggattcaagcaatcatatctataatgttgataattagtgcgattagtttttctccttggtttatgccgatctacatactcttcttccatgtccaatttagggagaccgtgctcttcacaaaatgagtatgatctctccaaaagagattcccaaccatcatcccgaacttgttgaaatctttatttggttaatttcacctctaacatggcctccaaaatatccttgtctttcctttgtaaagacagtgccagagcatttgcatgtcccaagataagcaacatcaagtgcaaatgaaacacgaagtcaaaatccttgacataatccaaaagaccacgtgcttgacattttttcccatcatttggaccatctttctcaatatactgaagtacatcaataatgtcagggaacagattatttacactcttaagagttttatagtgagaacagcaacgagtgtccccggctctttgaagagactgctcttgatttagtccagttccactgctaagctgccattgcttattgctttcgttactctctcttgttgactttctcgtatcatatcttttcgtttgcaagaagttttcacatgtatgttttgataaagccgagaaaatgaatatatggagaaaatttaaaactgggaaactttatatgaagcactagcttttatatgatttttactcaaattgcatcttacatacttatatattaaagttcagagacacttgtatttaaaaaacttaactgcaatttttttaatacaaatcatttcctgcttccaggactagaattagacccaatatgttgtgaaattgggagaggtgaaacacaatgatggctgaaaagcgaagaaattgaaacaacacttgagaccattgttcttgatttgcttcgtcttctttccccttgcacatcgtttgatctaccaccgtgtgtttgatttccagttctagcatctcccctctcatgtgttttggatctctctctatttttctgtgttgcaaggtattcatttgggccatgtgaagataagtactctttatgttttcccttcactagtaaatgctcatgtattgcaacggactactgaaaatagcaaaagtaattggtctcgaaccaagatttttcatcttaaaaaacaaaaagaaatgtttatgctcagaaaattaaaaagctgcagcctaactacagactcacccaaatccaaatgccttttcctttccgcactgaaggagacagtattagagcctgtttggaggagtttctagcagctgcagcttctcctagaatctccagttgccagaagctcccccaaatagtccagcttcttacccagattctgggaatctggaaaatatactagaagccagaagctgggttttccagtttctccagattctcaccagctagcttctcagcagctgcttctcagaattttaagctccccaactgttatagagcacatcagtacaaagagcaagcatcgtatttacatgtgttttaccgatattattgcctaaatgtcagtgatgatggtgatggcagactgatcaccactactaccattgtcttttcatagtagtaccgataagatcatgggctgctaatatgcgttctcaagcaatttacaggaagaggcaatcgtgaagatgctaccttttatggccatgtccagtgaacatcttaatgcattcttatttgttaagtctacaaaaatactaggatgcaatactgtaggatgcatgtgaagtctcaacccaccgttgatttagaaaaatgaaaccaatactcaactcgatggtagtgtttgtgacacaatacgttgagggcttgttcggattataggaatgttcggattataggaaggaaaaaataggataggaaaagtatatgaatataaaaggaatctaagtgtaaaacagataaatgaaaaacaaaggaatacaaaagttgagagcatttagatcacaggaaattgattgcctaggatttgcatgcgggaagaaaaaaagagctcgaggtggatggatttttcatgtacttttcctgtgaaatcagcatcaaaggaaactttcctttggatttcctacaaccagttttcatgatccgaactacaggaaaggaaaaaaattcctatacgcagtattcctccaaaaatcctatgaagttcctctaatccgaataaaccctgaaagtagagggaaataacattatgcaccatttgcaggacatatcaatataccaaattaaaaatatggcatgtttaatcgcgtcaattggtggctggaaattggcacaaacatcactcctaaactgactgaagacatgctgacacgactggatgaacctgttagagcagagagtataataactaaaagctactacctctatcttttaatatatgatgatgttaactttttgacaagcatttgactattcgtcttattcaaattttttgtgcaaatgaaaaaaattcaagtcatgcttaaagaatatttgacaataaatcaagtcataataaaataaaagataattatatttttttaataagatgaattgtcaaatatatctcaaaagtcaacaacatcatatattaaaaaacagagggagaatgaagcagcatgctgaagtagtgaagggagattataattatgcaccaggcttttttttgcgatagcagataccacacacaataatgtgacgcaattacacatgtcattttctaatttgatatattgatttgtcgtgtaaatggcacataatgttatttcccttactattttagcttcacagctttattgtacctgccttggtctcagtatcacaagccatgtagcatcttcatgtgcttggagttgcgtgaaatgatatagatctcacagcttcttccattcacctcaacattgtttcagtcaagaacggtttgtgccaatttctagccgcctacacaattgcatatggtctatgggtggacacagatacaacaatttgagtgtggacagctatattagaaaaaaaatgcccttacaatataccttcataattgatataacaatttagagacataaagtaaccattttaatttcggtacaaacaactagaaatgatgcttccaattgaaggggagaaataaactactagattggcacatgagtgtattccaaaaaaacagaacagaggtagaggttgttggtcatgtggattgggggggccaagtgacataaatatatgggtataagtgtggagtcgaaattgactgggggccttggcccccacctccttatacattgtatcctcccctccgttttctatgttgattcccataactactacaatttcagtattgtgcatgtagaaattgaaattattccaaacaacatcacaataagaggaatatacttataaacatttgcatttagacttctaattttgataaatattcaaacattgttgaagcaaatattggtgtacacctttatcttatagtgaaaaggtaacaatgcatatgtcaaagccaaacattacgtttcaaggccaggggttcaagttgacaaccattgtttgataaaacagtgctaagaatggtacattttagaacgcttctattgatgttcacacaacatgattatagctaagaacattagtttttctttatcttttgaaatgtaggcaagaaaatgccatatatatattgatatagcaagagagttcaattagcctctactaatgcatttttttggtacacttaaaatgtctccctggctccaaagcccattgatcaagacggacaagcgaaaataataagaatttccagctggcgctattttagtgagtgcttcattgaaggctcaattgattttatctttgggaatggcaggtctttttacgaggtatgacagaaatattttgggaatggtagtgcccccatatgtgaaaataggctttttcaggtaggataaaaactacctgcaaacattttcgatttttaatagcctatggttgcaagcggtccatttattcgtatgtgaaaactgattctgacctcctacaattcttccattttgtagtagtgtgagcctgagttctaattagctagtcagataagctatttccttgttcttcatgagcacttttctcgaaccgctaaacaatacgcttaattcgtgcaaaagttttctatatatttttttaaaaaaatcaagtatattcattttcaagtttattgtatttaatactcgattgatcatgtgcaaatagcttggatcattttgtgtggctttttggcgtgttttgcgcatagcttcttgttgtccaccactcttgcatggttgcgtagtttgtccactttgatggtttgatgtgtagttgcaaccatatgccaacattttcctagattctcttggaaaggcatcaatgcggacgtaattggatcgttgtttcttgtgctgctcggcaaagcaacaatgtagttggtttggtcaattgatttgcagcatgtgtactgtccaaactctattttcgattattagccatgaaaagaacttaatattttggcggggtctatgtatcccggatgggatttttgaaatatgttgcaactgcaccttcgaattggagccgatatgttgattttgcagtatattggcgtgctctgttgttaccaacttggaagagaagtaagatattttcagagaatcagagaaagtttgagaggaatagaggaagagaagcagagagaaagacagagttgtagagagagagattgagtttgtattgagttgggaattctgtctttacatgtcctccctcccgattctctctctctcctttatatacagctagttaacccagtttccacccttatacttcgggttgggcctagttacatgaacaggccgttgctgggccgtactcagaacggagccagcgaccttagacacttgttcctgttcgtcatcagttgtgccggatgtaacattcccccttccttgaaacacagtttgaccccaagctgtggtagaaggaaagcgatgccttaactcctcctgatcttcccaagaagtggtggatgacgaagtaccataccagcgaactaaagcttgaacaatcattttatcaccacgacgacgtagccgctgttgaagaacctctactagagtagccagatgcccagaatcaggatccaaacgtggtaatgttgattgaacaacttcagaggcagctactgctttctttaattgagacacatgcaccactggatgaatcaaactggtggcaggtaattgtaacttataggcaacagaacccacgcgctgaagaatctgaaagggcctgtagaacttgaaagccaacttctaattagcacgagtcatgacagattgctgcacataaggttgaagcttcataaaaacccaatcacccaccgcaaacacgcgatcagtatgcttagaatcagcctgactcttcattcgttgttgagctcgaaccaaatgatgatgaatcaagctttgcatgttatgatgatcctgcatccaacattccaatgcactaggcaccccaacagaatccaccgagagcccaaaatgacgaggtttatgaccaaacattgcttcaaagggagtcaacatcaaggcagaatgaaatgaagtgttgtaccaaaattgagcaagagataaccactggctccatctagatggacaggcatgaacaaaacagcgtagaaacatttccaaacactgattcacgcgctccgtttgcccatccgtttgtggatgataagaagagctcattcgtaattgagtgccagaacgccgaaacaattccttccaaaaaatactggtgaacactcgatcacgatcagaaatgatggcctgcggtagtgcatgtatagaatgaattctgtccatgaataattgcgccacagacacagcagtgaaaggatgggataaaggcaggaagtgagcaaacttagtgaacttatccacaatcaccaaaatactattataagaggctgaacggggcaatccttcaataaaatccattgatatgacttgccaagcatgttcaggtatttgaactggttgtagtaaccctgggtaaggcacatgttcaggtttagcttgttgacagactgcacaactttgcacaaaatcctgcacagtttgccttaaacctggccaagcaaacagctgcttaactcgctgataggttacttgaattccagaatggccccctagagcagcagtgtgcaaatttgccagaacttgctgctgaagctgcctattattgcccacccaaacacgtttcttgaaataaagaataccattctgcaactcaaaatgagtagaatgagatgtgccttccttaaaagaatgcaaaagctgaagagcttcgggatcagacttataacccaaaacaacatcctgtaaccaatccggtaaaccaacagataatgcacttaaaattggaagaccatcagaagatctacgagataaatcatctgcggctccattctccaatcctttcttgtacacaatacgataacgaagacccaacaacttagtcattgctttatgttgccaagagatggttaatcgttggttatcaagaaaggccagactgcggtgatcagtgcgaattaaaaattcatcatgttgtaaatacgggcgccaatgatcaacagcgagaataatagccagactttccttttcataagtggaaagaacttgagtccgaggtcctaaagccttactcaaaaatgccaccggatgctgatcttgcataagcacagcaccaatacctcggtcagaagcattagtctccaccacaaacattttctggaaatcgggcatgaccaacaccggtgctgatatcagactctgtttcaaagtgtcaaaagcttcttgatggtgttgtgtccagataaaaggctgccctttacgcaataactcagttaatggtttactaatgatgccaaaatgtcggacaaacttgcaataataccctgccaaacctagaaagctacgcacatctttaacagatacaggaactggccattgccgaaccacctgaatcttttctggatctgttgaaactccatcagcactaatgatgtgccctagataagacagttgagtttgtgcaaaagaacatttagacaatttgactcgtaactgatgcttactcagagtctcaaacacctgacgcaggtgattcttgtgctcctccaaagtgcgactgtataccaagatgtcatcaacaaagatcaagacattttgacgcaattgatcagctaaaactgtattcatcacaccctggaaggtagctggagcactcgtaagtccgaagggaagcaccttgaattcaaaatgaccattgtgagttttaaaagctgtcttagcctcctcaccaactgccatccgaatttgatggtaccccgaacgcaaatcaagcttagaaaaccagcaagcaccagccaattcatccattaactcatcaattattggaagaggatacttgtttttgacagtgatagcattaagatggcgataatccacacaaaacctccatgtgccatctttctttttgactaacaaaacaggtgaagaaaaaggactagcacttggctgaataattcctttttgtaacatatccttaacctgtttttcgatctcatctttttgggcaggtgtataatggtaaggcctcacattaactggcacagccccaggaattagaggaattgtatggtcataatctcgagcaggaggtaatccactgggttcctcaaatagatgagagaattcctgtaccaaagactggacagcatctggaattgaggataactggtctgtagagtcactgagggtagcacataattgaaccaaacctgccactgagtcgatactgtgcagatgctgtaagtgctgactagaaatcaaggcacaatcagaagtattggactgtaccccatgcaacaaaacctcatgacccataactgtcaagtgaatagacttatgctgccaatcaatttgcattggactatacttagttaaccaatccatgcctaagattgcatcataacctcccaaggccaccactttaaatgtggtcaagaacttctgaccactaacaaaccattcatctgaaggcatttctttctgacaatgcaacacctctccattggccactttaacagacagaggatgagctaagaactgaactccagtaagacggtcagccaattgatcactgacaaagctagccgaaccaccagaatctacaagcatcagtatattcaacccctgaatttttccttgtaaccgaatggtagactgagaatcagtaccctgaactgcatgaactgacgtagctaacaaggaagaatcactatcttcagaagatatgccagcctgatcctcatttgcattgtcaggaaatagtgcaaagagctcctgaatagcgtgaagctgaactgttcctgaacatttatgtgtcggcgaccacttttctgcacataagtaacacaaaccttgtgcacgacgaaacgatcgaagtgcactaaccttgtcagaaagattagtaccccgattgagctctccgcctttcttctcctcagatttcaaaaccttggttggtggcaatggtaatggatatgcatttttaaacttctgcgatccatccacaaatttcctttgctcttgattccgctcagacaactcctcctgtaatagaaccaaaaccagagcagactccaaatcctcgggacaatgtaacaaaacagctttgcgaatgtcaaaacgcaacccttctatgaaccggtgaaccaaattcaaagtgttatacataggatcatacgtcaacaactgattcatcagatcatcaaaccgttcataaaactcgctcactgaaccggtttgtttaatctgatcaagctgtcgaatcagttgccgatgttgatttctatcgaatttttggttcaccgcttcacagaatcgactccaatcgacaaaaacttcatgagcacgagatgaacgtagccaagacgttgccctccccatgaagtaaatggtggctacccgaacccacaaatttggatgagttccataaaccccaaaataatgctcacaacgcatcctccaaccctgtggatccgaaccatcaaactgagggaaatccaacttcggtagcctatgattgaacccttgctccccatgcaaatcccgatttccccgactcgaatttgcgccaaactcaaccccatgaggaacagaaaattcagtgggaatctggtacgtacccttgaccggaggtggcccgagagtatgaactacccccggtgccttcccccggtgaaaatttgtgacgcggtggccatctggaccaagatcgctcgccgctgttccggaaaacaacggcggcgtgctgggcgtaggaagcagaggagcttggtgacccccttcctccgtcacccttgacgcctgcgaggtgttcgacgaattgccgccctcctcgctctgcttctccaacttgaggacatgcagcttcagctcctacatgtcgtgctacaacccttgtacagcagcatcaacttgaggtcgccatcccgccacagatttgtccagtttgagcagcatctcttgtgtctctccttgcttgacgaccatggttccaattgccgcttgaatctccaacagagtcttctcgaatccctcgttttgcttcgccatgtcgtcgacttggatctgaagacgagttttgaactgaggtttctccaggattgcggctctgataccaaatgttaccaacttggaagagaagtaagatattttcagagaatcagagaaagtttgagaggaatagaggaagagaagcagagagaaagacagagttgtagagagagattgagtttgtattgangtgggaattctgtctttacatgtcctccctcccgattctctctgtgtcctttatatacaggtagttaacccagtttccgcccttatacttcgggtggggcctagttacaggaacaggccgttgctgggccgtacttagaatggagccagggaccttagacacttgttcctgttcgtcatcagttgtgccggatgtaatatctgtgaatttccatcggatcgtgtcatcgggtatttgttggaggtgcaccatgtgcagaaaggccaaagatagacaaattcatggaaatgctgcaaagtggtgggagagtagggatggtaactccgcgacccatctattgctggccggtgagtgtatctttgactatcatgtactcccccccgccatcaacacttggaagagagttggtactacaactgagggtttgaatgtctatatacttggcaccatttctgaagtgatctctattgcaacattaaagagtgcaatgtcttcatcacacagaactggtaaccctagccatggtttgttcggctatgtccattcgtaccaaagacatctgacatgtagggcacaagagaagagttgcaagtcgagcaatcctagctcttttggtctacagacccattccagttcactttgtattttccacataacatgttctctcctcgagcccataggaactgggtatcaaccgatacatcgggtctcagcactcagctagtcagtgggattgaattatatccatgtggaaattaaaatagtgtaagtcttgctcaatgtgtttataatgattaaacaaatcacaacaaataaataataattatatattttttcaataagacgaatggacaaatttaattatctataaaagtcaacggtgtcaaacattaaaaaacgggagagtagaattctactcttaaatctaccaaggatattgaatcatactactacagaatttcatcatctcaacaccaagcatactgattcatattgctacagaatattgtcatcgcaacaccaagcatatcaattcatacttcagaatctcactatctcaacatgtattagatggtatagatgataattaggctggttcacagaccagaacaggttcagataaagtaccaagtccaagtatctcacaaattccgtgcaaaagtactaactagttataaagggtgtatcaacctttaagttttgttagaggggatagcatttaacagtaactccaaaaaagaaaaacgaagtactgatacatgtttgtgttttcataagatattaatgtaaaatgtgttctcaacgcatgaatgtacaatgatgcttaaaaaaccacataactgtacaacaagaggcgtgctccttattaagtcatgaaacagtgtattgcagggttcaaatatcaaaacttcaaaaattcaattctgaaatacaatagaaacataggcttaagataataacaatatgcacaggcctaagagctaaacagggccctcagttaacatcatttatcccttcaacattgtcaactaagaccatggagctcaagtatttcatattacagctggtaactttgtgattgctgatgtagaatatttgcctaacgctacaagctatttttaagttagtctctgtattggacgatacccatcttctccctctaagaactctctgaggttgttgatcacataattcataaccaatcggaatggtgaaaatgaatttccaccaaaatacaatcaccccagtgacagcaccaacataattccaatttatttagtattccatatccactaaacaactgcatcctatattattcttgactctgttttgttgatgtgcatgagaccataacagtgtaaaacactaaatctacatccgatttagaccatctggactgtgatatgcagtattaagcatgggaataaacaggaacaaatatgttgcatataatattataagaaaaaagttatataattggaacatagacctttcacagaagcaaaacgattcatatgttcagttcatcaacagataaaaccagtaagatttacccaaaaattattgatcaaactagccattagaactcttgtacgagtttatctaagaagagagcatgctttaaaactcttgtagccagtaaaatctgataggtaatcttataatgaggctcctcatccatgtgttcaattcaggatgagctgctctagcaaaaggtagatcactgatgatgaggctcctcatcatgcatttaagaacccaagctgatcactgatgatgccacaagaaaagattgtctgctctctagaaatcaaagactagcaatctactcattcaggtcaaaaactaaactaaccagagacagtctaagatagagttgtgccgctcatgcgttataacatttgattctttcctccaatacatcaactaagacagaagtgtatcttttttttcttgagattcttataaccttgtgttgccaacacagtatctatcaccgctgaagcggtcataaaattcaaggcaaacatccttaagcttgtcatagttgtactgatcagctaaaggctaacttcaaaactaagaagaaatcctagtgggaaaacatcaagcttgtagggaagtagacatttaatatatatattcatctcatcaagtcctcagcagataaatatgtagcaaggtgttcatgcaaatactaaactaaccgttaatagctttagcttttgatgacctgaggtcctgactaccttgaaaactcactcctaataaataaacaggttcattaaacaggaagctgctagtctaccttttgttgagcatactcatgttcacaaatgcatccaccaagactgaaggacaatttgttttgagatctacaaacccctgtgtcgccacaatatcatccattgaagaagaggacataaactcaatgcaagcatccctgagtgacgcacaatgatgttgatcagctagagccaaggtagctgccacagtctgcacattaagattctcacagaggtcactttcacatatcagcttcagcctctccatggcgtaacgatccgcggccacgagcaagtgccgaatcatttcaccacggtcatctcccacaagatcatcaatgatagacaatgaatcagtgtagatgaaatggagcagggccttgaaaacatcaggctgaatgtctttgatgggtaagacctgtgcccccgcctccctcatcgggccaaagagctccgccttgaagaccggtgatcgcatcgcgagcacgaccttgtgcgccgcaaaggtatcctccccgacatagaatgtgacatcggccgcctccttcgattccagcagcttgccaagatgcgccgcgatgtctgacggcggcaccgcgactttgggggaagatttggtctgagacacccgtggctctttcatgacagtgacaacacactcgatgtcgaggcgatcgtcgcggagatacgccgatgcctcgaccaattagccaatgaagcaaaactactggaatcatagcagcttaacactttgggcaatgtctttgtcactgaagtagacaggccggtggtgtggtcgagcagcctcaggtcggaggacgcgtgcacctcgacacctctgttgaggagatcgaggtagacgtggatgtaatcggagctcccatggccgtcggagtagaagcggatggcctagtcatggccgccgacggagaaggcgccggaccggacgcacttgccgacgcccatccccctcttctggctgtactcggtgatgctgaacacgtggcttccctccgccgtctccgtgatgcacttcgacaccgtctttgcgcgcgccatctggtgaggcggcggcggcgagggtggattgccggtggggagggaatcaagaagcaacggcaacatgtcagggtggggtgagagaaaaaagagaaagcacatttggagcaagaagtagtggggagtggaggggaagccatgggagcgagcgaaccttcggaggatggccggagaatggggcggcggcggcggcgatgacgacggcgatgagaccgcagcggagttgttttcgtctttttttttttcgtttttacctctttctgattatttttatctgactgatagatgggcttttttaagtgggccgggctaggcccatggattttgagaactactacaccacaggattctgtttcaacgggagatcaattataacgctgacatcacctcccctgcttctagcgcttcgtcattccaatctcccatttccaaccatgtcattaaacaatatactcgtacaggtctcctacgatgtgtgatgcacatatgcctcgtaagtattaggtaccgtatatgattcatctatgtactgtacatgatacttagatattagacatacatgttacctaaattctaaattctagacatggtacatatgagtaccaggtctaatatttactcaggtaactggtctggtatctatatgtatgaggtctgatatttagatactgggcctgatactcatgtatcggatttgacgcatataggtatcgggtttcatatctttatgtatcgggtctgatacttagataccggatctgatactcaggtactggatctggtacatataggtatcggacgtgatatctatatgtatcgggtctaatactcaggtattggatctgggtacatataggtaccaggcctaatatttatatgtatcggatctaatatttagatatcgggtctgatacgtgatactcacgtattggatctgatatttataggtatcgaataaaaagaaaaaaatagtgtgtattacacgattattataattatgctaatgcaatttttctgttccatactaaatcttaaaagcatcacaaccaaaaataaaataaaattaaaaacaaagcgagaaaaaagggaaaaaaagttttaaaaaaagtcacatgaacggtccaggtatagatgaattgtagttaggccaacagattcacatgcccaaacggtccacatgggccggagacctgtttgtaaaaatcttgtgcaagaaaaggaaaaacacatgcatagtgccggcactctgtgaaaatcatgcgcgcatcgtctttctgatcgaaatagcgtttaccattagtgacttaagtcatcccgttcccacggaatagtgttctctatattttctcatggatttttaggttggattgctatttgtgatgcaaagcgagatagaaaagaaaatcaaaatgtggtataagcctataaggtggaattacttgtatgaatctaaattcagattttgtaaaacagacggattctataaattggtgtgtggctacattggtaaacaccaatgatcctatttttttactctcactgaggtatgttgtcggtgtacggggcattgtgttcatcagttgcctagtacctttattgttttttttagaaacatggtataatttaggcactcatatactcacgcgcatactcatccttataaacgtgcacacactcatcgtatccttttgagcacctttgagagattgggtttgtgtcatcacatccacatacgcctcactattcagtgacgaatctattgcccagcaaccccaagcagttgcccgggctcgtcggtggataatccactaaaatttcatataattaggaaaattgagatagaatttctatagtaaataatagctttagtgaagttagcccaggctctaaaataattctagattcgctacagtcactatactattgattggtacatcgcttatcactaaaaagaataattaggtgaatacaaacatcccctgccaaatgaaaagattttccctacagctaacacattactctcagtaaaatagccaaaacaacaaaatgaggggaatagccttttggtgactgctatacagtcactaaataacttgtgacggcttgccgtcaccaaatattggatttcgtgaccaatcaagtgtgataggcgttttgtgatggcatactgtcaacaaagttcttggggacggcattctaacttttcgtgacagtaaggggtagtcaccaaagatccgatcactggtggtgtaccggatctgatgaagctgccgccccccatgcccttgtgccggctgtaccccaggacctccaacacgtgcacgccttgctttgtcttcacggcggacatcgacttggtcctcctcggcaccgccatgcttgccgctgcaagagggggagcatggtgtttcagaaattggagaggaggaggaggggaggagggggaagtgacggaccagacgaacattgcggtgatggccgccagcggtggcggcggacgaggaggaggagaagacggtgaggaaggcaaggcgacctatttgtttcgaacctacaaatgcaacgcccacaaggccagaatgcacaagtggcccaatggagtgctgctgaaattcagtcacatgaaattactcattgtagaatgtaagtgtttttttttctctgttataggtggtttttgttttattttttaatctaaatttgacctttctgcatgcaattttgtaagtttttatgagctataagttaattttcatataatatatttaaaatttgtgtatgttagaccctttggaacaaaggaagaggattgtaagattcgtatggattgcttccctacatccctccataagaaatttaacatgagctcatatctcatgtttcatttttcctatgctagctaagtccaatgcacattatctcttcccccccccctctctctcttctcttctctctctctctctctcccacacacacataggatttcctgtaaaattgctgtgtttcaattctaaattcttatgcaccagctaacacgatattacttctattgttcctatgttttgagatcatgtagtattgcaatctatttccacgtttttcctattccgtgttaaaatcttgcattcaaatgttgaattattagtgctcactggattgaaaatattgaaatagtccagctttgttatcaattattttatttgatcataaaaggtcttactctacgttctttcaccatagtaacgatatatacgaattgacgtggtttgcccgtcagggcacacttttgggttcccgcaatattgaaatcccgctgaataaatacattccgcaccaccactttcacttcgggcaccaactatttttccaccgcacacactttgactagtcagggcatttgaggggagaaaagaaaagaaaataacccataccactcacctctcttccagatatcttctccaaatccaccaccatgaccccccaaaatccaccattgcgagtgctctcactacaatctctggctaccctcccacccatctccggcgttcgtcaaccctccaccaactagggtgtctgtttcgatattggtggaccggtggcggctgtctccagcgagatctgaggttgtagcctccggtgagcgcttgatgttaaaatagatagcacgcatggatttcttatcgtagctaagtagcaacaggcagacactttggtgaatgatcccataaacattttggactgctggttccttcagccgtcttgtacttatccacataccagcgcatgaggcttagccttctgaaaaatatatagcatattctattctaatttttcctttcacaataatatataggattattgtgcagtggaagctttttctatgataaagggaggatataataaaggcccagctagctttcatcaacaaattagccagataactagcttgaacaaagcaaaggggttttttcttcgaactagagttattgctacaagaaagaaaatgtaattaatattggtacgtactgatgaacattttagatcaaatccataatcaatactacagcacagagtttcccaacagttgaacaacacaaaactactttttgtagataaagaaaatggtttatcggcaaaaaaaaactaaatatttgattaagcaaaaatattttgcagacaactatggagtactatatttgtgaataagcaaggatcaccaaacaaaaacatgttttggatttcatactagaaatttataattaaagaaaggtactgtttgaccactctaagatcaaatccattatcaaaagtacaccaaacattcatagcataaacaaattattaagtaccagtacatgattcagatcatatgctacaaaggcacatatatataagatttcgttctgtatcatgcagaattgcagattgaccatgcaccacccatgagctggttcagttcaccgcagcggcaccaccggcggctggaggcggaggcggaggcggagagtcgccgccattgctatcgccgccgtcgtcgttctgctgctgctgcaggtaacgggatatcagctttgccctcaaagcttccatcttttcaatcctaaaccttatcaccagcgtcgacccatgtccttcagagacaagcctgtagcattcatcctctagctccctgatacgaccatcaatcctgctgatctgcacatatatataagccatccataaaataccatcacgatctgctcattaacgcatgaacatctatcacaagaaatggatgaaatcgatccatcaaatcggaacaaggatatatatataaacctcatgctccaggcgtctcgggagctggtccagcagcggttgccgtcgcagtggcggcctcggtggctgcggcggcagcggaggcggcgccgccggagctgcagcctggttgttgttcccctgaggcgccgccatggattagagcttgcttgctagggatagaagataagttgggtggatgagagaagagggatctgtgttggggtgttcatataggacggaaatcgagatggctgcattaactcatgattggctgtcaccactcgccaaaagataagcattaattgtattacaaatttgagaatcaccagtcattatcttcctgttttggaatttatatttaaattagacttaaaaaaaaatactcggaagttacaatgggtaaagacaatatgagagcttagtttcagtttacaatgtgtaggcaatataagagctttgagttttatcgagcggaacaagagctattatgggttaattattaaattgaaatattaggatcgctatatatacgctagctataatttttctttggttttctttttctacatatacaaattgctgctattgtaatcaaatctcatatcgcgtgggaaacttatactatcataattgtattgtgttttgtgtggaaagcacaatatagttgggaaagttggaagaggaactatcaaaatagaaaattaccagtatcaatgggtagccgattgatctatgaatagccgataattcatgatggaaacattgcataggagcactatacatgcatacgtttgcagttagttacttagcataacaacatatataaaagctctaattttgattgatttttaactaacaataaggatgatactagaaatttttttaaatccgatgagattagaaattagaatacgggaaataaacatatgatcacaaaataagtttttccatctcatcttatctggtgacatcgatgggatgcaatctccagcggcggaaggggcatctcatctgcatctctatcccctaatccctcatgccatgttcggttaatcctcgtgaggaaaggattagagtggattaattttacacctattgtggtgtggaattattttccttcaatcccctccaaactgaataaggccttatggagagtacgtagaagctaccatccaacggctgctgttagttgtctatactctataccagcaaatgacacatcattaatttggtttcagattgacaagcagcaaccaccagctagatctgttaccgaattaaacaatggttgaggcccacgatgatcaggtatttttttccgaatgactcgcaccagatagtgcgaagtttatattgataaagcaggaaaaaaaaacaagattacaaccttgggaggtcataaccaggaatgcgaagaaaaataaccaccactcacgcaacaagccaacgacagcacgaacacaaagaccccaagaaggctagctagcatcgaactaaacgccgctaagcatgaccatccgccgctaggccaataaaggaactataactgagatcacccaaaggaactacagacgatgatcaggtatttggattgaatctatccattgatcttgctatccttctcagtatagttctcctaatcagagtacacgaaggaaggcaaagaaaaatcgggaatagacgtactcgggaacatgcgcgtgatgccgggaagcaatgtacgaagaaaagtagttggaagtggattttgtgttttttaagtactatcttgatcgggtgggcacaatccttgtgtgggatggacaatagaattggagcgcttaaatgagtggtggtatattcgcaggtggttagtacatataattggtaaaggcatttacataattacaccgatggatcttgacatatatactccctcctctcccttgagccaaacttatcacatgagtctgaaataatgctagtcgactacatacaaagaggaggattggggagtggggggcaccatttgctccgctgtcaaaaaaaaaaacatttaggttgaatatgcataaaaacagttgaaaaagttttgttacgaatataatctcgtaatgctgcattctaacttataccgtaggcatccattgaattgagcaggtatttgctatgtccgtcaattacataactcattaatgattttacaatataattaaatatagtttcagtacaaactgaagtaccaatattcattttgtggttatttatggggaaataaatactaaggtcatcatgaaatacacacctgcacaaatattgaaagaatttactgcgcacacgtggggaaacatattatacagttagtatgtgttcaataattatgaagttatttttagaaactgagtatagtcagtgctcggtttaccttgttttcgtcgatagagctggggacgaaagagatgctaggtaagtgaggttcacagtagtgagagtacagcagagaaaaattaagcaaaatgcagaaatttagacaatgtgtctatactagatctcctgtgttataggtgattatgctaaacagaaagaggtgtttatttgtcccagggattcatcaagttcttgctcctcaatctttcccgtgattaattttacctggcatattgttatttcattttgaaaaattcttgcatttctgtctaccctaacctcctgtactgccaccaaaatgacgatgtatggaacccattccagatccttgtttgtttgttgtgtaacgaatcttccataccaaaatgctcccatactaaaaaaccagagaatatgcaagtacaatattatgaagtttaaccaatgcaagaaaatttttcatcgaacaaaataatgcttttgattattgatactggaaattgaaatcaattttgcaactaaagagagatatagcaaggtatactgcatgaccattttggatcaaatccataataactactacagcacagagcacattaaataaagatatatgccaagtattccattaagcaaaatattttgtagagaattatggagtacaacatttctcagtttgaagaagcaagtaagtttcatcgaacaaaatatatgtttcagattattactcatacgagaaatttatagctaaagaagggtactgtttgaccactctaagatcaaacaatccccctgtcgaaacatgaattcggcaataataaaacggggtagcgcacgagacctaaaagtggatggatgtggagacaaaggatttagacaggttcaggccctctcaatgagaggtaataccctactcctatttggggatttgaatccgccgggtgtgtattgatctgacgatcaggttgtctcatatatgccccctagagggcctcctgcccaccttatataggatggggggcaggattacaagatagaaaccttaaccaatacggtatcggtttcctaaatcaggactttaggccgttccgtaatatacaaggaaacataacacccaagtcatgatctgttacatattacatagatataagttatcccctataactagtcggataaccatgccgtgtgggtatggggtacccataatctccacagtagcccctgagaccttcacagtcggaaagataaccttctctcgaactagattactccaaagccgagtgcttcaatcatcttcgtcatggtctcccgagtacttttaccaaatctgaagactgtggagggctgaaaaatatagtcaggtgcatcgactagatgcacctaataggtgtaacccccgactatgtggttaatcgaacaaaccaaacatatagtcaaggaataaataatccaaccaaccgagtggttttgataattatagtcaaccaagcgatttaatattaatatgtagcatatgcggtgtgaatccctgaataatatgatccaagtgatataccgactgctttgtaaaatatgatgagtgtaacctaaagttggctacattattgaaaattcacatagcaaaatagctataaagaagcttgtatgttgtgaataaagaaatttccaaagtattgggcatacgccatgcgcacactgctttaacagacgtgcttaagtccctagaagacacatggttccaccacacctggaaatatatggcatatgtggtataaaatccgagtaaataaactcataaaggatttaccaaccgcctgaaaaatgaccacaatatataatcagcctaagccataatattggtcaataaaaatgcacacttacgtggcaaaaagcaacgatattgtatccaatcaattgcttaaaaacccaaacagcaccatgactatattaaaaagtcagcggggcagctatataaagctttactgtttgacaccttttaagatgcattgtaccaactcctaaaaagttgagtaactgcggtataaaaggattttaaggtattgggcacttgatcacgcgcactttggcctaagcaaaaagtgcctaagtccctaaaagaacgtgacaggccacacctgaaaatatgggctgcagacatattaggcctaggcaaaaaaatatgccttcgataccctttaaaggatgacgcatataacatgctcccgagtaacaaatcttccgggtaatatagaccaagcgtagctcatatgaatagcttctgatctgagtggttatcccttatgggatactccaaaatagatgtaacaatcgaatcccgactggcgcaagtattcagttgataacccttacggggaataataaatagtccagtctttgagcatataaaatagacccatgatcatgaattcatgttgcatgtatccggagcaagtccaaattgaagatataatacttgtatttgagctagtaagcccctgagcacgtagtcacaattgttcattgatggtagctgacgcagttggcatagagacaagacaaccaatatagagagaatattgcccaccagaggtggcaaaaatattggtggtagtgaagatagtgataccaatcaaaagtactgaagtcgcatagccatggaggcgaagaaaccagtcggcaacagtcaggtcagctagcagtgaagatgtaggcgcccaacaacaacgaaagaacagtcggtggtgacaaaagcaaaccgacgatgaagacgtagacgcgcatcaacggtgatggcgaaatccaccaatcatgaagatgaagaaaataatcggcggcgacaaacgcatccgacggtaatgatgattagcggcaacagagatagctgactatgatgatgaagtttcccatcaacggcagcagagtaggctatgttgatgaggcttgacaagatgttgatgaagatgacgatgtcggtgatccagtcaatagcgatgtagcagccgatgataacgatgagatcctctatcggcagttgcgtagtaggccaaccgtgaagacaaataattggaggagagttgatgttgttgcccaactcgtctaaaccgaaatatttgaagttgttgaagtagaatgtctgttccgaagcaaagatgaagataatgactcctggagttgactcattggatgattaattgatttcttcagcttgacataaaatttgtcaaattttgagccttatatttgtgtagcccccgactctttggttagttgggaaacaactgaacatagagtcgagaattatagcttcttgtcgtcgagtagtcattgcttgattgaagatatgtgttgaaggtgtccaagtagaaatcctgaatattggagagtcacttgttgtagtaaaatatcatggcattgcatgccgagatgtcgaggttcacaaagacgtcgtggttggtgaagtagtaaaacttgcgaagtagcagcaatagaatttgccagtgccgaagataataaagatgaagtcgctccaccatgatgacaaagttgcatcgccgtgatgaagtgaacacaagtcggcggcaacagaagcaaactggtagcgaagacgcgcagttgtgaagataaaagcactagtcggcggcggcataaccagtcggcaacggaagacgatgatgtccatcagtagtggtagctgtataaaccagacgtagaggtgagggcactagtcagcagcagacgagacgaccggcggtgaagaagataaggccaatcaacactggcagaatcatgcagccatggaagtgaagaaaccagtcggcagccatggcaaacgtaggcagcttgtgttgaagatactgatgcctattagtagtgacagcaatgtagccagccgtgaagaaggtagcatcagttggtgttataacaggccagccgtgcaggcagtgacaccagtcagcggcggatgcggcggccggtcggtgaagacgtagacgcccaacaacggcagcataataggccagccgtgcaggtggaaacaccagtcggcagcggcgaaggcaagccggtcggtgaagacgtagacgcccaacaacggcggcataaaggccagccgtgcaggcggaaacaccagtcggcagcggcgaaggcaagccggtcggtgaagacgtagacgcccaacaacggcggcataataggccagccgtgcaggcggaagcaccagtcggcggcggacgaggcggccggtcggtgaagacgtagacgcccaacaacggcggcataaaggccagccgtgcaggcggaaacaccagtcggcagcggcgaaggcaagccggtcggtgaagacgtagacgcccaacaacggcggcataaaggccagccgtgcaggcgggaacaccagtcggcggcggcgaaggcaagccggtcggtgaagacgtagacgcccaacaacggcggcataataggccagccgtgcaggcggaagcatcagtcggcgccggacgaggcggccggtcggtgaagacgtagacgcccaacaacggcggcataaaggccagccgtgcaggcggaaacaccaatcgccggcggtcgaggcgagccggtggtgatgttctgactgatccattcctgtagcgtaagagataagcttaaagccatgaatcccttttatgcatatctggatctggatcctgcagaacaaacatataggatgagtagtatctgatataaatataatactcgagaaaaattcaagcagtttaaaatatgtatttcttctcttgttaattttgatttccccgagcagatgactcattacgtttaaacactctgcccgactagtcatagccaccaagcactgggagtcggcctaagcacttcccaaacatgcatatgagtgacatgagttcgtcattaatggaacaaagtttcacggatcggagtttactactcgggtacttttgcaattattaagagcagaaaataaatttatctcatctctatgcttttgatttattccgaataatacttggcaccttgcgttactcggtccatccaacgagcccccgggtgctaggaatcggcccaaaggcaaccatccattggcaaaccaaacggaaagcataggaagatagaactccataactcgataggtacttttgtactcagattatgtcgcaagcaatcaagataaatattatgaaaattgtttaaaaaatacgatataacatctatagcccccgactcactagtcaacggcgaaccagttgatgtagtgaggcaaaggaaaagacaaaatatcatataaagaatgaaataaatgatgacttagctttgtcgtattccctcgatgacagcagaagtagccgatgtgggaataaagcagtccatcaatggtgacaaaaacaccagtcagcgctagtggaaccaagccagtggtgtagatgatgaagcccattaacagcggcggagtccgccaaccgtataggcaaaaacaccagtcagtggcggcagaggcaggccggcggtgaagtcgtagacgcccaacagcggcggcataataggccagccgtgtaggcggagacaccagtcggcggcgacggaggcaggccggcggtgaagtcgtagacgcccaacagcggcggcataataggccagccgtgtagacggaggcaccactcggcggcgacggaggcaggccggcggtgaagtcgttgttgttatcagcaatggcggtggcgaagacaagccgacagagtggactcgcggccgatcgaccggaaagctgagacgcctcgactccatgaccagcattaatcgcctcaatagtgccgcgtaattatatgcgaacaacaacaaaaaatagcaagagattaatctgagattaaaaatcaatatgataaataatgataaaaatcagattgagtttccccctgactgatttggatcaagtcagagaagaggagcttgaagaagtggtcgacggaaaggaagtgaaaactcccgaagcgaaaacgaagtcggcgactcatgaagttaattccatcgtgctcgttgataggaaactcgacgcaacccctacctggcgcgccaactgtcgaaacatgaattcggcaataataaaacggggtagcgcacgagacctaaaagtggatggatgtggagacaaaggatttagacaggttcaggccctctcaatgagaggtaataccctactcctgtttggggatttgaatccgccgggtgtgtattgatctgacgatcaggttgtctcatatatgccccctagagggcctcctgcccaccttatataggatggggggcaggattacaagatagaaaccttaaccaatacggtatcggtttcctaaatcaggactttaggccgttccgtaatatacaaggaaacataacacccaagtcatgatctgttacatattacatagatataagttatcccctataactagtcggataaccatgccgtgtgggtatggggtacccataatctccacacccccttatcacaagaacaccaaacgttcataaacaagttaaaatctagtacacacttcgttctgcatcatgcatgtattgatcagatcaactgtcctgttggttcagtttatcgcagcagctgcagcacctgctggtggtggaggcggaggcggtggcggaggtggagcctctccgccattgctgccatctctgtgtgcatgctgctgcacatacaatggaatatcacttgtgcccgttccagctttcctcttttcaactgggcaacatatcctatgcacacacctaaccttctgcactcatgcactcggctgttataaaccctccgatcctgatctgacggacacgatgtaggtggggtgttctttttagaaaaacgcccgcatcctctatacagatttccagatgaccccttaccttgtttcctcttctccgtgctccttcctagatcgatccccatccccaaatcttctccctctccattgacgaaccatgcagtgagcagcaggccggccgcatcaccggcgcatgtagtatgttcatcgaatcatgcagctaactagacattaaactgggcggaactcaagcagggtcagagtccggctggcctataggcaacggtggggtagcgctcaggtcaggcccaagctgccttgatgccgtccttcaccaccggcacggccgtactgctgctcactgcctggttcgtcgctagctatagatcgaatccatgttatggtggtcgccgcgatggcaagcctcccgctggccgcattggatgcactcggagcatttctccattcttttcgttcaaaaacttctccattcaagtatttgtgctttgtgttaactgattgcaaaattatccgtgattgcaaaaggcacttaaagttgaataatgagttgtgtccatttcttaatttatctcgttattttcattaattggacatgacctacctagcttattgtaggcatggccgctgtcgtgccatgtttttttcctcaatcaggcactgctgctgcttgcatgccaggctctacgtgccggagaagagagacccgctagccgcgataggaaacggtaggcacgtcagtgggagacgattcttcctgccgcacggagaggttgaaggtttggggatgggtgttaacgccaaaatggtgtaagcccgaaatcatcatcggcttagtcactatcagcttcggcatctcggaatcagccgatgagaattatcaagtcgccaacagtcggattcttggaggattcggttaaggaaacttatctagaagagaccgagttcaaggaggatgtaacatgacaagttatctattaattaggaatagtttgttagtttccttttatctttagaaaagtatgtttagtgtccgataaggactttgtgttttccttttatctttaggaaagtttctttcttgtcctacaaggaagagtatctacccatgggtataaatatgtacacccggggtcattgtaaagtatctctcgatcaatataactactctcggcgcatcaccactctcttttccgaagtttttacttatcaaccggcggaatttggcacctgacgcggggctgcgtcagttcagttcgatctccggcgaaggggtaagtcatacgttccgctggccttggtgaatctatcggctacgttggtgttgttcaaggctgcatcgcttcgatctcttggatcgctctggtttggatgatatatttgcctacctgatttatgaactctatctctaattgcattgtgtttagagacgcatcagtttagttaggactgtcttagttaggtccgatcttctgtcttagccgatatatctctagaatcacaatgttgttctaaatagatttgttatatccatcatattagatagatctatcggctcatcgagtattaaattatcatatacaatttcgtgctgtgtcggttaggttcgaccttctagattgttgttgataatatagatcttgttaagccgataggtttatgctagtgttttatcggggtgttagccgataagttatctggacattgcatcggcttataagcttgctgtgctttggggcacagggcgcgtacgaggtggtgtcggtggcattggtgcatcagcctctgggactgcgggctggttgttctcgagaggtgcatccattgattagctacttcctccgttccacaatgtaagtcattctagcattttctatattcattgatgctaataaatctagataaatatatatgtctagattcattaacatcaatatgaatatgggaaatgctagaataatttacattgtgaaacggaaggagtagctagcaagggctagagattaaatttggatggatggatggagaagagggatttcttgatgtgtttatatggaaggcatgcaattgttagttacagtaattcatggatagctgttacaactcaccaacagataagcagcaggaaaatgtagtcacgatacaaattaattaattgtcttccaaaattgagggtcacacgttattctcttcctgttttggaatttacatttgaatctgaagatatttcagtactatagaattttaacgctaaaatatatatgcattcgtgcttaatacagttaatgagttatgtacagattaatgagttatgcatcattaatgagttatgaggaatcggggcaatcctcagagacagttccggcggacccatttttgcttgctgcaggcctctgcagaaatgctctggagcgctggaagcagagctccgtgcttgcgctgatggattggtgaaagcgttccagtggacgatgctaccgatcgtggtagaaaccgactgtatgtcggttatccaaatgctgaatgagagagggagagatctccccgcaaaaaaaaaaaaaaaaaaaaaaaaaaaagagaaagggagagatcgatcagaactagccaatcttgttcaggaggcaaaactcatcatggaaggggacagaaatcttcattaagaaagttcagcgcagtcagaatcggattagtcattttcttgctaataaggctagggttgagtccttgtccggtttctggttggaagaggattgtaagtccatattacagctaggctgtgatgactttttaaatgagtaatacattatcttccccgcaaaaaaaaaaagagttatgtagctaatgaacctgtacttgtgcaattcattggttgcttacatataaaatactgtgaattctataccaatattcacattgctacccagctaaaaacaggaatagaatttgagatttttgcgaaaacatcggtacacggtttctattttggaggggggggggggtgttcctgtttcaacagtatcaagattaagatcgaatggacaagagtatgtacctagtaatttactattactttattagatgaactaaaactagtagggtatatataggcctttttaattcatttatctttgaaccgtactatcatgtttcttatttaacaatattttaagtaaattaatcggttatttctcacgcaaattaaatgtgtgcagagagagagagatcagagagatgctgtttgactttcaaaccagtgcactagagcttgtgtattagtgttgaaactaaattagatgacataagttgaatgaaaacaagattaattagaaaagctagaggtcacaactaacaatatactagtacgcatggattccctcgaaattttaacaaaactagtaattacgttcaaacggaaatggaaaggaatgaagatgagatattgagataaaaataatatagtttttaagaaaatagattaactatgaagacgagatgtgataaaattatgccagtttaacagaggactagctactcacaatgtctaatatttgtttgaatgttccttgaaagcaatccttagtcattttagtgcacatcaagtatgaatgcatagaaaatcagaaaacacaacacacaggggcacacttcattcttgatgttgaacgctaattaagattattccacactaaaaatttaggcatgacgcactcatgttgaacgctaaccccacacagttttcgccataatacttgttcacgtttagttctcatggtttacgctttgccagaccttgggaatattactttatgtcgatcgtctcgtatttttaccatgggtggtttggctaagagagatggaacaagattgttgttttctattttttttttctaaatataaagggttacaaaggaaaacttatgaattgcatttttaacattttaagggcaaataaatttcaagttttaaacttttgggatatgtggtatatatggttttgtgatatattatattgtgttatgttgctttcaaagggtatatgactagcaaatcatgcagctagccattaaaaagggaaaaatataaatcatttccatggacatcactaatagctcaaaatagccaactgttatagacgaagtcctgagacaagtgtaagatctagtctaacaagactataacggctcacaattctaagccatcattgatatcactgatatatactaatcaatgatggcttgggatagcgaccatcacagatagtaagacttatttgtaacggtttgtaatcctaagccattagagagatcagataacagtaacaacagataagccccctaatcatcgaccaatagtctgtgtaacggctgcccaagccaaagcatgatatgattttgagccgttagtgatgagtggtattgtggcagtgttagaaaatgtggattataaactttatgggaataataatcctattatgaacatgcatgaaactgaaacctaattattattttcttcctagaaataagcaacaggaggacttgcaactacagcattttcatgggggcaaaataatctcccatcccgccccttgggaaagtcccgtttggagaacagggatccatattgccatccctacatgaagccatcgtcattctatctttcacacacactaaacattaaatctagcacaacctcatatcataagtggaataaacaaccatggcagaagtaataccaacacattattttactaaacaaattaaaaccactggaattgatgatattaaaagggcagtactattacatccaatttggtctgatatgaattaaagttcacacatacagtagagaatatagcatgaacctaatatgcccaaacaacacaactaaattgtatttattagaataaagcataaagctaccgtcgacatgtaactatcatttgcgaagtatgcaaacattctccagaacctcgattagtagaattgggtataaactcttaaactgatgatactctggtgttccagtcaccgtttccagtgtgttcggattggcaatgaaggagaagcatgcctgtttgagcatgtcgcactggtgctgatcagcgagaagcaatataaccatcacgctcttcacatcaatatccaggcaaagcttcgtctcgcagatggccttcagcctttccagcccataacagtcagcagcacgaagcaagttatgagttgtgttatcaaaccacatcaatgggctagggttcatcgacgaatccatcacttctgcatacgacaatatgatatacatataccgcaagaatcagatatacatatattgaagaaatccagaaggtaattaattacaagatcagagtttctcgaattaaaaataaaatataactgatgcgatgatggtgtacaaacataaatactcgacattatagacttatatatagaggcaagctatcgctggagctagcaataggaactcgtatgtgacttacgttcaagttgctcttgttgttggtagatccatcccggctggatccacggccgatagatgcgctaccccatgacctctggctgccgggatcgcagaagacgagggagagagggaggagaggagggggatccacgagctcgccgcagccgccgctcaccgtcgccgtggctgtgatcgctcccgagggcggcggtgccaaatatgtcgcctgctcccgaggttgggggcggcaaatccgcactccgcggtcgctacgagggcgggggctgcagatctgctcgtcaccgttggcggggagacggcggatccacgcgctggtctcccactcccgctgtcgacactcctgaggttgggtaaagcagatccgcgcgccgccatcactctcgaggacgggggtggcagatccgctcgccggccgcccgctcccgccgccaccacccgccggccgcccgcccgcttgcccgccatcgttggtgccgtagtcgtccctcgtcgcactcggtgaggaggcgaagagaggagaaaaggagagagcaaaggagaggagaggaggaggaaggaagggagagagtggagaggagttaaaaagtttgaagtgatgagaaaatatctctgagaagaggaagggtatttttccatgcggttcacttaagagacctacatgcaaaaatgcggtcctttaagaggaccgcatgagaaaataggctcattttttcatgtggccccttaagaggcccatctacgaaaataaatttttggatgcgggcctcataaagagtcatttgcgaaaataagggttcgattttttgatgcgacttattacggtccacttgcaatctacaagggctctcgtatagaaaaatctttttttagtagtgtgtattccacaagcatatcattaattagcataaagaacatatgcatagtgtgtaagtgtgccgaaaattaaaatccaagcgtattaatgtaagtaatcatctgtttccttgttagcaatcgatctgagcaaccaggagggcatatgatgattatcatagcattaattaaaactgacatgtctttatcctaaaaaaacaatgtggtgcttacaatgtgatttccatgaatgtttaccttgctcacatgaagatatatcatgttctggatttgttttgatagggagggagagatttcttgttatgttaacacatgcactagcagcagaatacaactgcagctataagcattagaactcacatgatgcagagggctacttttgcattgtggattgctactattcctacttttctttccaaagtaacacacaattaattttactaggaaaaatttgggcatccataatacattaaaaattaaaatcaaacaagaaacttgaaccggctccaaacggatgccaccacaagtatagacccatacatgcaatcatagatagcatatatgcaaaacaaccatccgcgtggatcttgaatcttccacgccactctaggtgagtaacccactaatgaatgcatattcgctcgacatgcctttgcattatggcgggtatccaaacgcatgtgatgatttttggtatcagccactacaacattactctgaagaatctaacctatatacctagattacaaggaatgactatggttcaaaaattatcaaagaaaagtcataacatattaaatagctagatggtaattaatttaataggattaatactcttcataaataattaaagcataatagattgtaaagagtagatcatgacttgccttatggatcaagggctttgctaacgttatcgtcgtgttcttgctccacctagctcttgcagctctgcggttctatcgctgtgatctaacataaatacacaaaaacaacaataataaacctacaagaaaatactacgaatgaacggtaaaagaaatataaatataaatataaatataaataaataaataaataaataaataaaaatatatatatatatataattttctatgtcactctaggtgagtaacccactaatcaatgtgtattggcttgacatgcctttgcatgatggcaggtatatgatatatccaagtgtgtgtgatgatttttgttatattagccactacaacattactctcaagaatttaaacctatacctagtttacaaggaaccatcctatgacattatcaaagaagaatcataacatattaaacaaatagatggtaattaatctaacaagattaatactcttcagaaataattagaaaataaaataactatagcaggctagctttgtaggtgtttgatatagtgcaaggagtaggtcatgacttgccttgcagaacaagggctttaatttgctaacgtcagcgtagccttcttggtccacctagctcttgcccctccgacgattctatcgctgtgatctagcataaacacacaaaaacaacaacaaataaacatacgagaaaatactacaaatgaatagtaaaaaatataaaaatatataatcttcagtgtcactctaggtgagtaacccactaatcaatgtgtattggcttgacatgcctttgcatgagatatggcaggtatatccaagtgtgtgagatgatttttggtacattagccactacaacatttctctcaagaatttaaacatgtacctagttttcaaggaaccatggtttgacgattatcaaagaagaattaatcataacatgtattaaataaatagatggtaactaatcaaacgagattactcttcataaataagtacaaaataaaataactatagcaggcttttgtaggtgcatgtttgatatagtggaaggaggaggtcatgtcttgccgcccggatggttctgttggtgtgatctagcatgcatgaacacacaaagcaacaacaaataaaccaacaagaaaatactacaaacgaacagtaaaagaaatatcgaaaaatatataatggagcagcaattaattaataaagaaaagctagctagtgaaccgaaggttaaggatcattttatgatatctgtggtgcacatatggacagggtgaggtgaagagttgggtgtaatatggtggactattgagaaccagaactgaaccggcttaaaattgagtgaacccacataagaaccggttcggctcagcctcgggctaaccgtgacagttcatcggctcggctcggctcgaccaatgcaagtagctagtaggaacagtactgccgcctcttccacgtcgatcggctcggctcgatggacggagcagaggcggcggcggaagtcgacgtccacaagatcgaatcagcggcggccggagcgggagacgacgaagcgacgaccggcgagagagctcgggtggaaatcttggccgatccatggaggcgtccagcccgaggtcgaggaacccatttccgcctggcgccgtttgtagtcgcgccggtggctaagctagctttgcgacggtgccggtgaagacgaacgaagagggagctaggggggaagtgaggggaggaaccattaccggccgggtcgaggcggcgccgtacgctcgcgagacgagactggctgcggcggcggcggcggcggtggcggcggaagcgggaatttgggggaatggatcgagagagagaagagaagcttcaggttttccacggtggcgccctcgcctcgccggtttaaatagctcggctgagagaggagggatcgacggcggcgacgagcttgggctttccgttgagatgcatgctggacgaacgctttagggtttttctggggacccgaggagcggagcgccagcagcaggtagcgcttgtgtcggcggtctggacaagcggccgctgcttttcaggctgggctgggctgggctgggctgggccgagcgcctg

SEQ ID NO: 48700 - DNA, 20034 bp, Oryza sativa
ttttctccaccaccgacctcacccgcgccacctcctctcccttaacgacctcgcccgcgtcacctcctctcccccgccaacaccgcctgcgtcggcttttgctgcgtcatcaccaagaactccttcctccactggatcctcaccatcaaaccacccgcccccactgctcagcttccttgacattggcagcggctctgtccccatggagccgccccacccctgtgctcccctcgcgggttcatcgccaccactgccctcaatatcgtcgatttcacctaccctttcctcccatcatccgtggatctctcgtgccaccatgacatcctcgacagtcgcgcccttgatggatatggattcattgatgttttagtaggtgaaattcgatgtttcatatgttacaccaaaatgtttcagtagtagttcaaatgtgtttcatcatttcaagagattgaaacattttcgatctagccctgttcttttctccaacaaaagttggataaacttttggatacttgtggcacgcttttcaaactgttaaacggtgtgtttcgtgcgaaaactttctatatgaaagttgttctaaaatatcagattaatcaattattcaagtttgtaataattaaaactcaattaatcacatgttattaccacctcgttttacgtgaaacgcttaattttatcttcatatttatcttcacgatattcaaacaccacccaggataaagatgaaacatttttttcccgattagtgaaacaacacccgatttttgaaaaacaatgaaaaacaaatagggcgtctgatttgtagttgcttcgcgcctttatatacctacatgtcacagatacacccgtatatacatacaatatgtagtcttgtagagccagaacgattgggcatacttcatatatatctacacacaactatttaacaccctagaggggatgtccctcccctagcttgtttgtccaccaaccatccaaataattataaatttttttaaaagaatttgacaacattcatacatcatatacattcatacccgaatttattcttttattttctcaatatgtaggtcgaaattgaaattgatttttgtggagtgacagatgtcactatattccacattatcaatgtttttcatttttttaatattgtacttgattatatttgaaaaaaaaggtacacgaggggacattctctcgagagattagaatccattcacatgaaaatagcaacgacggacattttcactagttgaaaaacattttggacaattttctgctacctgatagttgtgcacataaggtagcttcttatgcactttgttttattccgtaaggccttgttcggtttggagaggattgaagaggataagaggggattgagggagaataattccacaccacaataggtgtggaataaatcccctctaatctcttcctcatggagattaaccgaacaaggcctaaaggaagagttaagcttaatctttcctttccctggaaaaacgaggggagaaagtaaaacagctttctacttaaaaaaccagacatgcacacagcacaacactttcaagttgaaccaacgaaagtaatttttcatcgaacaaaatatgctctggattattcatactggacaatcatttttttatgactaaagatagctagcaactgcatgaccattttggatcaaaagcggccgtaatagttactataaagcacagagctcgtcaaacagtcgcagaacaaaaaaaaaaaaacaaaaacaaatagtggattaaccaaaatattctgtagagagctatggagtacaatattcttttagtttgaagaagcaaagtaagtatcatcgaacaaaatatgttttacatgatttacatcattaattattcatacctgaaatttatagttaaagaagtgtactgtttgtgacaactctaagatcaaaacaaacccttatcactaaacatgcataaaaaactagttcagttctaggcatcatgaacgctgtccaaactgatattcaagtaccagctgcagtgaactgagctagctagactgtcgatctgatcaatccgttcatgatgcctagaactaaactactacctccgttctaaaatatagtaatttttagctatgaatctggacacacagttatccagattcataactaaaaatatttatattttaaaacggagggagggagtagttttcaatctgttcatgatgcccagaaatgaaggcatgccttcattttaatcgcgcgctagctctagctttcgtgatgatcaacctgcatatatatggcaatcagaatctcccgtacgtgttaaggaataaatatgacatcaaatgtataatcgttggatcgggacctagctagatgcaccacgatgatgtataaaacaatactatatattaatctcgtcagaattacctctagcttttggatattgttttcatttattccagtttcatggctaacacagaagtcttagtgcactgttttgcaggtcgaagatcactttctcctctctctatatatatacatatgcacacattaatctcaaaaaaacatatgcacacatttacgtgagaaatcagcaataaatttatttaaaatattgttaaataagaaactgatcttactgttcaaagctaaaaaatctaataaaaaggggtaccctactaagtttagtgcatctaaaagcaagcgcacatacttgtttattctaattcttgatactgccaaaataggaccgccacacgccacacggtgggttgctattgtcgcaaaaatcaattgaaaattatgttgcccgacctgtttttaaccggtgtagtatatgtggatattggtataaaattcaaaatatttcaaatataggcaaccatagaattgcacaggtatttcctccatcccaaaatacaatcatttcttggttcttttgcaaaaactaagttaaaggaaaaatatccactttagtcactttagtggtctacttttaaatttttaaaattgcttagattatttttccaaagtatctcactacaaattttatgcgttggaatcagtagcatataaatgcttatattgtggtataaattctaaatcctagaaatgtttatactaccaataaaccctattgggacggtatcagaggtgctggtacataaaaaatgcacctatgaggctttcctcatacaaataaaaacggacacctatatataaccaatcattggtgcctgtccattaaaaagccaacaccaatagtcatagatgtcggttcttataataaaacgatatctataaacattacatgggtgccagttcttataataaaccggcacctatgagtgcaacgcaatatatatcggtatatatctgtgtatgtgttttgtaccgaactttttcatatgaactcagataaatgaacattataacaaatctacagagcttgatgagatttacaacctagtagatcactttttgattcgaggtcgtttggatgtatgaaaatgtgttataagttctcagatctatttagatctatttaaaatttctcaacaacaataaattaaaatcatagtacaggtattccatgttttcttctttcacacacacactacacatgaaatggctgttacattctgcatgcttatggaaaatggcaattacattttttaacctggaaaatgacagtaacattttttttaccaggaaaatggctgttacattttttgacttggaaaaccactggaggagatgatgatattaaaagggaagtactgctatatattacatccaaaatggtccgatataaagttcacacatacagtagagaatacagcataaagctaaaatgcccaaacaacacatctattgtatttagagtatggcataaagctaatattcacaaataaaatcataattcatatattgcccaaatttgactgaatagctaccgtcgacatgtagctatcatttgcaaagtatgcacacactctccagaagctcgattagcagacttgggtataaacttttaagctgatcatactctggggttccaatcaccatttccattgtgttcgatcggagtggcaaggaaagagaagcaagccttgtttgagcatgttgcacttgtgctgatcagctagaagtaatataactatcacgctcttcacatcaagtatccaggcaaagcttcatctcgcagatggccttcagcctttccagtccacactcactagaacggataccctcatctcaatcgggcggtaagccccatctcaatctggcacagcgtccgtcacaggctagaagtcgctgatgtgaagagttatctcaatcgggcaaacggccgtcacgaatgaatatatctcaatcgggtcctaagtaaagcccgtcacagatagctttgacccagacgaccagtcaaactatagcccgtcacagatgacctatctctatcaggccacaactagcgcccgtcacagatgactactaacctttatcgggcctaaactagagcccgtcacagatgatacacatctcaatcgggcctaaacttactactgacctcaatcgggcctaaactagagcccgtcacagatgactactgatctcaatcgggcctaaactagagcccgtcacagatgaactcatctcaattgggcatttatttatggcccgttacagatgactataatacacaaaaaaataaattttgttttttggctagcctcaggcctttgctagccatgcccgctgcaaaaatgacagaaacaaacacagatatccaatatccccagctccccagcatcacccattcatatacatatggattcacatacacagacatcaacatatttcacacaaccacacattcacagccatctcatatttcacatccattcacataattaacatccattcaaatatttatcatgtttcacctacaaaaccgagttaattggatcaaatatttatttagcaagtcttaacataaacatatgaaatatatacataaatataaacatcacagttacatcctcatagttgcataataagtgttcatcattgcctaaacataaaggctcaacattgttcatcattttagtttaagcctaaacattcctttggggttaattatttcgcagaggatgaagctggctatctcctcgcgaacctcctcaaagctggtaggcagagacttggttattgtgccctacattgtcataattccagattagttgatcgatcatatataagtactaaaatgtagttagtctatcacaattgagaccaccgacctcaaactcaaccaaagtcttcaccttttctctatacagaaggcgcatgttgtggcacacatggaatccgcactggtcacctatttgttgcttcaccgggaagtctttttttgtggatgagggtgtcatgtcctgtcttcctgaggcctcctctttgcacgtattgggcccacgcttcatctatcgctagttgaattggggtccaatcatatgcgttcttatcaattctggagttcaggtagtgacatgtactccacttaggtgttatgaccagaaggatccaatgggcactacggcattaatatagtgaaagttaattaagtactcaaggaatgctgttgtgtatatttagataacacacttactattgattataggcgcacataatgtactcgatccttgtctcggcgggaccacaaggtgtcgtagatgtagttgaccattccttgacggtcattctggagatttgtgacagtgaccacttgtggatcaaggaaggcaacttccggtgcatgcttctgacaccattgccaacttaacctacacataggataaacgatcttgtaagcaagttaaaccgattgttattactagattgagttgggcgacaatacttacaaggagtagcacttaaggaggcttgtgtccaccgctcggagactatagaggtcgaaaagatccttgaagttgactacgatataatttgttgaaccaaggaatggctttccatcgtgctctccaaggatatcggtagctttacttggcttcctgacgttagatttctccatgtagtataagtgaaggtccttgcaagcggtgcccattgcggcaagcacgtcatctccaaccaatggcatgcctagttggaactcctgtggaacgacgtatttcttcttgacctttttgcccttagtctcttcctggcccttacccagatctagcttccttggagctagaagcgaggcttgcacctttcctccccttcctctccccattgcttcgggtttatcgagagtaattctctaaggggaagagtgtgccttcctgctcttcttcatcggtgggggttcatgaatcgccttgctgtcggcctccgttcggtcctccccaaaatccgtgtcgtactgcaactgcacatcgtaagattgtgcatgacgatcttgagcaggaggggctgaaggagcagaggcgagtctctttggtggacgaccgcctggtgcagtggttggcctcgctgtaaccctgatctcaatgaggtccttgggccattggatgaaggtaccacgggcatttcctagtgagaggacctcgtcgttcggtggatacttcagagggaacagctcgtattcgggcttcaccgaatcgacttgaacttttgcacagtcggccctgagttgcgctccatgcactcttgtctctggggtcggcttgtacacaagtccctcggctgctgaaaccgtgaaggtcggtatcaccctaactgtgagggtgcagctcgttggttcctgcgatagttttaatattcttttagaatattatatatcatatggattcgttaagtctttcatgtattgagtaagttcacagttaccgttatgtggtcgacggcactgtcgaccgatgttggattttccaccaactcagttgatgcgcaactgctttgttttcgggtgggacttcctaactcttcgtgcgcagcagcaacggcggcctgggggttctgttgctcttctcgaatctcttgcctaatcttggccctcatcgactcgagctttttgtcgaattcagatgtcagctcagctcttatcgacgcccggatcttggctttcaaggcgtgcatctttctccgccttgttggaagtccgcttcttgtactgccacgcgaagtctggaaatccatacttccagggaacagaagacccaacgccccgtgtccgtccacggtattccttgttgcccaacgctttcgtgaggaggtcgtcctcgtgtctttgagagcaggcctcttgcgaggcttgttgctcggcaaccaacttcttctgcattacaatttagtgggtttaaataaactgcacgatgggaaacaatgcgaacatctagtttgactagacacttacaatagcttcgtatactcggtgatcttctgcatttggcatgaagattgtgccatcataattcttctggtacctggccctggcccagttcctagcccgagggtgtgggatatcgccaaacacgagcggtgtgcacgattcctccgcttcttcatcctcacgctgccattccttttccttaccggcatatccggtggtgccaagccggtgcggatgctggttcctggtttggagcaagcgatatgcctcgcttctagctctggactcgggggtcgacttcttcgcatggaattcctcccagacctgttccgtgatccaaggaaatttctctcttggatctggattcgccgagttgtatacgaactcgccgactagcttagtcttgaagttcttccaagcattgcccataaccttgaaagcagcctgcctgagacggtactcatgcaccgcaggataatcaaagctctccttgaacgttagccaagcaatgtccttctctgcggccggcacgagcttgatgtcatcttgcagaatactgaatttctgcctccctatgaccccgcagatagacctaaatcggctcaatattttccttggagatgtcggcaaccctacggtgtccaccgctgttatgcggaaccgttccttagggattttgttccctgtcctaggagtacgtgcccttgaggacccactagttgtcatcgatattggttcgccttgctgaaacatcgtatactttttttttctaaataacaaaaatacacaattgagtgctacaatctattacaatgaatttaatgtcccttagaaaaataaatgaaacatataaataaactaaattgcgcatctcacagtaataaaacgaaccacatttcatctatttactaaattcattaatgcaccatgtataaataaacgaaattgcagaatactgaattgtgcatctcacagtaataaaacgaaccacatttcatctatttactaaattcattaatgcaccatgtataaataaacaaaattgcagaatactgaattgcgcatctcacaataataaaacgaaccacatttcatctatttactaaattcattaatgcaccatgtataaataaacgaaattgcagaatactgaattgcgcatctcacaataataaaacgaaccacatttcatctatttactaaattcattaatgcaccatgtataaataaacgaaattgcagaatactgaattgcgcatctcacaataataaaacgaaccacatttcatctatttactaaattcattaatgcaccatgtataaataaacgaaattgcacatctcacagtaataaaattaaccacatttcatcaatcactacaatcatctatcacaaaattcataaatgcaccacatttcatcccaacatcgacatgtctcactcacagttcaatcacatatcatccacatccacatttcaatgacatgtcattcacagttagcatagggcggcgcgatggagtactcacctgaggacggtcggtggggctcggtggcggcggcgccgggctcggtggagggcgttgccagttggtgaaggcggcgttgggctcggtggaggcagcggtctcggtggcggcggcggcgggctcggcaaaggaggagtttgcagcggcggtgtcgggctcggtagagggcggcgccggtcggtggagatgccggtctggtaggtcggcgccgtgcgggcggcgtcgggctcggtgggggtcggcgacgtgcgtcggtgaggacgcgggcagcgacgacgaggaaggccgacaccggtccggtcggtgtaggggctcgagggaggacgacggcggtggcggcgggctcggtggcggcggcgcctggctcggtggagggcgtcgccggtcgggggaggcggcgccgggctcggtggaggcggcgagctcggtggtggcggcggcaggctcggtggcgacggcggcgaagtaggagttggcggcggcgctagggttctaaggaggcaggaaactgtagcgggacttagaaaaattttcgatccgatctgagaaaccctagatatagtagagtgatgagtcatctcaatcgggctttgccgtagggcccgtcacagatgactcattggtgacgggctccatactaatgcccgattgagatgacattcaggcccgtcccggatgactcatctgtgacgggcccaaagataatgcccgatagagatagattaatctctatcgggcttgaactaaggcccgtcaccgatgactatttttccatttttccaaataagtctttatatctgtgagtacaaaatatatagctgttgtataataattcattttattagtcataatacattttcggatagtaaatgatttcaaatggaaatatggtcaacaacaaagttgatcctctcatcaggatctacaacttttattttggtcatttgtctatataactttgtttccaacagcttgaaattgattttgacaatatgacaaatctaaatagcatttgtaaatactaaatgatttcaaatggaaatatggtcaaaaacaaagttgatcctcccatcaggatctacaacttttattttggtcacagaactcaatagcctcctcggtcgtgtaaccttcaatgatgctcccctcgggtttagctctgttacgaacgtacaacttcagaactcccatgtacctttcaaacagccacatttcccttcgaaaagccgggccacatagttttgtttgcttcaccagatgaacagggagatgaaccagtatatcaaagaaagacagtgggaaaaacatctccaggtgacagagggtattcacaatatccgtctgcagcccatctatatcttctggatctataaccttatgtccaattgcattgaagaaggcgcacagacgttggatcgtgtgacgcactttcggtggtaggatgcctctgatagcaactggcaagatttgtgtgattagcacgtggcaatcttgagacttcatttcaacaagttttagatcgtccaatttaacatacttatcctcgctgaatagcccgatggaactttaatatccttcaagcatgataacattgcgatcttctcatccttcgacagtgtgtggcaggctggagggaggtacactttacctgtctctgcatctcgtataggctggagttcactgcgaatattcatgtcctgtagacaaaggcgcgtgttcaacccgtcctttgtcttcccgggaatattcagcatcaggccaaccaaactctcacacacattattttctacatgcatgagatcaatgcaatgacggacatcaagatctttccagtaaggtagccgccaaaatatggattttttcttccacatacccttctcctttgtcttgctacgttttcttttcttcccaagctcattgcttatgttcttgaccatattgtggacctcatctccgaacaaatctttaggagcaggctgaagttctctcttaccgttaaaatttttcttctttcttctaaatgcgtgacgtagcaggagccacctccggtgacccatgtataccatctttcgtgatttcttcagccaccggcttcgtgtatgttccttgcaatcggagtatgccttctttccttttatagtttgtccagaaatattaccgagtgcagggtagttattaatggtgcagaacaatagaactcttagcttgaagttctcctgaccatatgcatcccaagtttctacaccttctttctaagaatctccagatcgtcgataataggctccaggaatacatccatatcattgccgggttgctttggaccttggattaacaagcacaacataatatatttccgtttaaagcataaccatggtgggaggttatagttcgcaataagaactggccaagtgttgtgagtactactcatgtcaccaaaaggattcatgccatccgtacacagacatatcctcatgtgtctagggtcggcagcaaagtctttgtgttttcgatcgatattccttcattcaatcgaatccgctgggtgtctaagcatactgtcattccttctctccgtggcgtgccaacgtactaacttcgcttcgttcgggttggcaaagattctcttgaaacgatcaatgataggtagataccacacaacctttgccggaccacccctctttgacttatttccttcgtcagcacttttctttcgcttgtatcgagaagccttgcagacaggacaagcatccaagtccgcatattgcttgtggtacaatatgcagtcgttaggacaagcgtgaattctacggacctctaactccagtggacacagaacctgctttgcttcgtatgtcgtctcgggcaatgtgttctcaataggaagcataaccttcaaaattccaaaaagatctgtgaaactcttgtctgtccatccactacttgccttcagcttcattaggtccaaggtaactgacaacttagtgtgttttgctttccatccagtatacagaggcgtctcgaaatcacttaccaacctgctgaacttcattccatctctctcattctgggctaggtcctcaatgtcacgtaacatgtcttgcagcagatcgtgatccacatcaaccatttcaccgcccaatggagaaggtataaacatgtcatgctcatcttcatcttcttgattatgtgcaccacttctgtctgctgctgctccacttcctgattcttgctctccatgcttcacccaacatgtatagccctccataaatcctcgttgtatcagatgaccgtgtacgtcctctccgctatcaaacatattctcattcttgcaatctgcacatggacaacacatgtaatcactgttttttcttattcgatcctcctccgcggtgttcataaaatttattacgccctttctgtactccgtagaatgacgtttcaaatttttcgcatacatccaacttcgatcaattgctacaaaataaaaaaaaacaaattagaggcacatattataagatcattattgcaaaagtaagacgtgatgaaattgctcaattaatgattaatattactcacttgattgatccattttgatcacctacaggaatttaatttctgttttccttggaaaaagggcaaaaaatcgccccctacagcctcccaccaaaatagtgagcagtgggatacaattacactaggtagtggggggtatttatactgtgcaacaaatatctataacggccctaaaacaatcaaccgtgacgggcatacaagtaatctctatcgggccttaataaaaggccgtcaaaaaaaagtgttatctgtgacgggcactacacttatctcaatcgggcctctagttggagcccgtcacagataaccctcatctgtgacgggcttattttagggcccgattgagatatggaaccctcatctcaatcgggcctcaactatagcccgtcacagataagtgtcatccgtgacgggttttatttttatgccgatataccatgcctgtgcgaccatatctcaatcgggcgaaacttcggcccgattgaaattacttccttgtgacggcccacaaattccagtcttgttatgggccgtcacagatggaaggatctgtactagtgactgtacctgtcagcaacacgaagctagttataatgagttgtgttatccaacaacatcagtgggttggggtttcgtccacgaatccatcaatgctaatatgctgtgcatatagtgcacgaaacaggtacatcaaggaaaagctagcaggtacttagttttaagatcaaagtttctcgaaatgaaaataattaaactatatattggatgccatgaaggtgtacaagcatatatatgtactcaacattatttgacttgtatataggcatgctatcactggagttttctataatataggaaatcttgacttaccagagttggtagagagaaagtagctagagttgatcaagctgctcctgttgttgggactgatggggagggtgcctttatataaatcctgaaagtgtgtattccggaagcataacattagcatggctggagccaattgtagaccatattggataacgatcagatgcaaagtgtgtaagtgtacagaaaattaaatcccaagcttatccatgcaagtaatcatctgtttcattgttttgcaatctgagtactagctaggactaggaaatcatatggcgattatcatagtatagtaggtaaaactggccatgcctttatcctacataaagtgaaactgccattcattgtacttctccctatatatgtgatgcttatatatataccatgtgaattccaagaatgtttaccttgctcacatgaagagaaattctgttctaatatcttttgacgggagggagagatttcttgttatgttaacacatgcactagcagtagaatacaactatagctataagtatattacaactcacatgatgcagagggctacttttgcattgtgcattggtactattcctaccttttttttccaaaggaacacacaattaattttagtaggaaaattttgggcatccgtaatacattaaaaattaaaatcaaacaagaaacttgaaccggctccaaacggatgcctatctatgaggtttgacttggtcagttgacatagataacaccttagccctagattctcatttactgcactacttgagatgggaaggctcccatgtctcagaaacacacggtaacaatgttaccgagttccagtacacggtaacagacacacggcggcttcaattcatctgttatcgtgcgcatttcccgggtgttttacgattttgcgtacagtatggccaaaaccataccgtgtgtgcctaaacacacggtaatgttcccgggtgtacgtgaactcccggtaacatacgtattaacggaatcaaatggaacagtgatttaccgtgtgttcccagaacacccggtaacatttggtattattcggtagtattttttcccttggtaattaccacatgttactattagcatttccatcataaccataataccatcgagcaggagatatgttcatatccaatagctggtagccgggaacttgcaagacctagggaaagcctagaagcggtaccgctaccggttgtatactgttttggagttgctttcagacctctaatgttactacaacaaaacctcatgtataggcacttttgtagaggcattttacaaattgcctctaaaattaggagttttatagtgtagacactttagaggcactttaaaaactgagtagaaaacttttactctagagacctttagagacattttcagaatattttattaaattttatcttatataggcattttttgtgcactttaaaatgtgtctgatatgtaaaggcatattcttgaagcattttaaactctgtagagacacttcttagaatgataagtatactaagggactaaatataattaacacaaggcacaaacatataagtaatgacatgatgttgggtcggttagtgcattaaagataaaaaaaagtttgcccaagagatcttgagtagcattggttgatatggttgtggtacaatttaaatcctctagaaaatgcgtctaccctcttgtagacattttatgaaatgcctctgttgtagagacaattcaccgtaaggcacttattaggaatttttaaaaatgactctaccatattgtaaaggcattcggaaagtatctctgtagtattagaaagatgtctctatttcttgtagtctgtatagattaaggtggtatgacaaaaggcctcgttttgtatgcccctcagaccggtcactaagccaactacagaccttcatacttgcatatagtgggacaatgtaccaaagttggatcaagcaccaactatccaggggttaacctttatatttgggaatgttacatggggaattccctttgcgcatcgtaggaaggcgggaacgcgatgagcgccgattgtgcggaagaagtggcatcactgttgttgtcttttcttgcgataatatagtttttatgccttcaaattagttcaagtagtttttatcctttccaatgtaatggtctatataaggcccaaggttaatggagaataaagcaagcaagattgatctacacaaaatcctatccctctcttcctttgtcgatcgcagtcacggctccgggaaggtgagggtgtcagcttcgccctcccatcgagaacacgaacaaccttcggagatgtggtgtcaacttggtatcaacaccttagtattatcagcttccatcgaggaggtgttggtgtattttctgctcccaaatatatagaagagaggggaagaaacccaaagtaaagaaatcacctccaagagacgtgaagacaccaggaggtgacccatccaagctctacactgactgcatcttgaagtaagtaccgatgcaatgaaatacttttgtaatcttcatctttatttttttcatttgcaaatcttcatcttcatattttctttgttttgtggctagattcaatgaagttggtaaagaactactcttttcttgggattgcagtgggtctctttttagtaatggtaaataattttgtgtagtgtagggtacagattgttgatatatagtatgcacatgcagtttcatatgcatagaattaacagtactttgataagtttttctcatggcacatgtctatttttttctagtttgttagtgcaaaaataatcatgtcaatggaagttgaagatcatagttggatgtatagtggatggaatgatagtgatggttgtcattgtgaagagtcggtgcgcaacacaaatggttttgttgagcgtgttttcagtggagtacctaatgcagaaagatttggagtaatgtgtccttgttcaagttgtcgcaatagaatttgaagaaagaaagatgtaatgagtatgcaactctgtcaaagaggattcatgcctgattacactagatggatcaaacacggagagtctcctgttaggttatttacagcagtggaaacttataatgttactgaccccttagatgacatgctatgcaatttgagtgatgcaatggatacatattttcaagaggatgagccaacagcagatgccaaggcattctatgccatgctatctgcttcacaagaacaactccatagtttcactcaagtgtcacgatttacagcagtcacacggcttatgggaattaaatcacagcataatattgttaggtttaagggtttgcctaggtgcggatctagaggtagacaacagttgtgaagttggggtcttgggtagaaacaagcgatattttagtaagtaaattaatgcctcagatagcgagcgaatcgtcacggaactggtaaatcaaacaatgtaggcacacgttggcacagttctgtaaataatagatgtctcatccggttgagctgaactcatggcaatattagtgatgaccttagagaataaacgggagagagggagagagagacgtgagagacataccttcgcccttagaggtcgatgcggccatagcaaaggtgtggctgggtttgtgggtgcttccggggtcagcggagtgcacgatggcgatgacgacgacaaggccgactggcagcgtagatggtgagcacgatggcgatggactttccctcacttcagcgcaaatcctggggttctagggtttgtggggagcgtgtgtgcacggcaacgaacgttggttcgcgtgcactggcagctccccctttttattgtgcactgtgtgagaggggcccacagccatcgaacggctggcgcccccgatcagggtgcgtagaggaggagtggggatcggtttcccgatcccccggagatcgcaactaacaaatatatcttcagaatgcatgaataatttacttagcctcattggtgatatattgccaacaggtcacaaaatgctatccaacctgtatatgagtgcaagagtcttctaggtggtttaaaaatgccatatgtcaaaatagatgtttgcataaataactgcatgatatactacaaagaggattcagagaaagaaaaatatgatatttgtaacgaaagttgttacgtagccgtggaagagggatatcaagggacaaaatgaaagctagtgccacacaaagttatacgttatttaccatttataccatgaatgcagcagatgtacatggagccagtaacggccaagcacatgcggtttcacaaggagagtgcttgtgataatcctgatattgtggtccacccattttatggcgaagcatggaaacacactttccaggttttgcactagatgcaagaaatgttcgtcttgcaatagctgaaacggagggattaattaatttaacgagatcagtactattcataaataattaaagcatgaaatagtaatagtatgatctgttggtgtttgataaactggaaggagtaggtcatgacttgccttgcaatcaaggtcttaatttgctgacattagcatagccttcatggtccacctagctcttgccgctctgatcgatggttctgtcattgtgatctaacatatatacacacaaaaacagcaatgaataaacatacaagaaaatgctacaaatgaagagcaaaagaaaatgacgaaaacaatataatattggagcgacaatagagaaattctggagaaccgaaggacagaacgagttcaaaggttaaaagattattttaggattattaggttctatggtgtacatagggacagggtgaggatcaagactagagtgggtgtgtaatatgactgatcaggtggtgttattttcttctgaagataaagataaagattaagttatttacgcaaaatgaggtggtattaacatatgattgattgagtttaaattattataaacttgaaaaatagattaatatgatattttagagcaattttcatatagaaagtttttcgtacgaaatgcaccgtttagcagtttgaaaagtgtatacacgaaaatcttaatcttcatcctactcttgtcggagaaaagaagctgaagtggcttaaaatttgagtgaaccgggagcgaagccacacatatacaagagccggccggtttggctcgagctcagcctaaccgtgatactgttcatcgggctcgagccacatggctcggctcggctcgatcaagtagctagggatcgaagtcgacgtcccgcagatcgctcgtcggcaagaatcagcggcggccggccggagcgggagacgtcggagcgacgggagacgcacgccagcgacgagctgagagagctcaggtggagctaggggcttgctacggcggcgaagagggaagggagagtaggggggaacctttaccgagtcgtcgaggcggcgccgcgccggcggcgagagcgaggagacgggttgcggcgcgcggatgcatggtggaatttgggggatcgagaagctccaggttttcacggtggctggccgggctgagagcgcagatcgacggcggtgacgagctccggctttgcatcgagatgcgtgctgggcgaccgcttagggtttcggtagaacgggcgcttgcggcggcggcggcggctctgcaggctgggatgggccgagtgggccgagcgtctggattctcattacgtgaaaaataccaagctgatttgtttcataaaatgtagctgcaggaactcatgtgttgtaaaatccccccaattaattgtataattcattttatttttatctagctacgcccaacgcaattacatatatgcacactcatgtatataatatctcactgagtgaaaatgtgtagattaccttggattgggaataagctaatgtcccataattgcttatattgtgatataatttttttagatcctagaaatgtttatatttttggtacggatatggagtatttaccaggttcattaattacattattcattaacaaattcccaatttgattaaccagaatattaataatacaattgaaacatcatgggaacacatgtaccgcagtaaaaaagaagtcatatgcccaagcacgccggaaaacatattttgttcaatcaatatccgtttatttttagaaaataagctagagtgtttgcttaattaatacatactccctccgtcccaaaatataaacatttttagctatgaatctggatagtgtatccatattcatagctaaaagttgttatacactggtggagaagtggtttttactcccggttcgtaacccccctttagtcccggtttttcaaccgggactacgaatccgggactacagatggtcctcttttttcttttttattttctcccgaattaagtgggatgcatatccccaaatcccaaatcaaagtaacatcccaaatccacatcacaaatctttaagttacttatacacataaatcaaatacatcacaaatcctaaaaaaaattacacaaatcaaattacatcacaagttctacaaaattcatcgcaaatacatcacaagttcacatcacacacaaatcaaatacatcacaggatcatgcaataaatcacaaattcttaaaaaaaaacc

SEQ ID NO: 48701 - DNA, 9857 bp, Oryza sativa
  unsure (1)..(9857): unsure at all n locations
cggccctcaaccggcggtctgaccgcccaacacacggcggtcagaccggcccactcggaggaaaccggcagacttccaaattttggcaatctttcctattttaattctaggtgccaaatttgggtgtaaacacatgtccccctgcctttttgatgaacaacgtgaatctaaaagcataggacatgtttttggtcttaggacgaacccaattaccggccatagtacctcctaagcgtcttgccaaacactcgggaagtattttttcaagtatttcccgttgattgttcgctgaaaacgctccccttgaagtatctccaaaaagtacacgttccctcgaacaatgccgcacactcgataaggaccctcccaactaggagaccacttaccgaactccttggatcgagtacccaaaggcaaaattatcttccaaaccaagtctccaacttgaaacaattttgctttcaccctcttgttgtacgccttggccaccctcttcttctctttctctatctcttccaatgccttcaagcgcttgtcgatgactttatcaaggttgtctcccatcaacatcttgtaatcttcacttgacaaatcatctcgcttgacataacgaagagagccaagatttacctccaccggtaaaacggcttcttgaccataaaccaactcaaaaggagtaactttagtggcaccatgtttagatattctatgcgcccacaatgcttcaaaaagcacctcatgccacctctttgggtattcctcaatcttcttcttcaccaacttcaacaatgtattattactcgacttggcttgtccattagcctgagtgtagtaaggagaagaactcaacaatttaataccataagattcggtaaaactcttcacttccttagacataaaagaagcaccttgatccgtaattaatgtttgcggaataccgaatctatgaataatatgcttcaaaataaagtcaattacctccgtatgagtcatattcttcaaaggcacggcttcggcccacttggtgaagtaatccgtagcaactagcatgaacctatcccctttgacgacgaaggataaatttgaccaatgaaatccaaagcccatcctcggaacggccatggtttgattatagggttcaacatagcggcgggtgccaattgaacattaccgaaccgttgacaagcctcgcatcctctataatatttgaagcaatcatcaatcatcttcggccaatagaaccccgctctcctaagcaaccaattcatcttgtgggccgattgatgagttccacaaattccttcatgtacctctcccatagacactttagattgatcttcatctaagcacttcaacaagacaccatctatgtttcggcgatacaaatctccatcaagcaacgtatatttgaatgcttgccgccgaactttccgatcaactttaagtgtgggatctttcaaatattgaatcagaggaattctccaatcctattctgtatcctggacacaaatgtccgaattcacaattaattcggcctctaaattgattgaaacgtgccccccagcgttctgcccataaccggtcagaccgaccatgcagggccggtcagaccgctcggggtcgccggtgagaccggcggcatgcggccggtcagaccgcccctggtcaccggtcagaccagccgtgcaacgctggtcagaccgcccctggtcaccaattttgccaatttcgcacaaagatttaaaatcaagcaccggctcttctaatatcagaaataatctcctcttcacattatagccagatgcttgttgtgccaagtcatttgctctagaattatcacgcctaacaatatgcctaatagcaaaattatcaaaattggcaataatatccaaacatgaatcgaggtacctatttagtgatccgtccaagcatttgtatactccggcgacttgttacaccaccaattccgaatcaccaaaagcctccacgtacttagctccaaccatctccataacttgtaagccgaacaataaagcattgtatttggcttgattatttgtacaataatactccaaacgaaccgatgcttcataacacattccattaggtgaaaacaaaactacccctatgccttgaccttctttgcaagaagaaccatcaaaataaatcttccaaggtataacttcaactaagcaaacctctccctcataagcaacatctatatgatggtctactataaaatcacatacagtttggcctttcatagatttcaatggttcataagccaaatcatattctatcaaagcatatgcctacttgccaattctcccacttagaattggcatttgcaacatgtgtttaataacatcggtttgacaagtaactatgcatgtactagataacaaataatgcctcaatttggtacaagcatagtataagcataaacaaagtctctctataaagacatacctcgtttcggcatccaaaagacggcggctcaaatatgtaatgatatattccttgccatcttcctcttgcgtcaaaacggcaccaatgactttgtcctcggaggcaatatataaccgaaaaggctttccggctttaggcgctcgcacaacgggtggagtagacaaatatctcttcaactcttcaaacgcctcttgttgttttgccccccatgtaaaatcggcttcctttttcaagcgaagtataggaacaaaagcatcgattttacccgctaggttagaaataaacctcctcaaataattcaccttacctagcaacttttgaacctctttcttgcatgtcggcgctttgaaatcacgaattttttctatcttcttaggatcaatctcaactcctctctcatgcaccatgaatcctaagaacttccccgctgacacaccaaaagcacatttaagcgggttcatcttcaaaccatactggcgcatcctctcaaaacctaatctcaaatcggctatgtgtcctttcataccatccgatttgacaacaatatcattaatatagatctctaagataatacctagcaaatcatggaagatcaaattcattgtcctttgatatgttgcaccggcattcttcaacccaaaagtcatgacaacccactcaaataaaccaacaaaccccgggcacctaaaagccgtcttgtacatatcctcttccgccataaagatttgattgtagccggcattaccatctagaaagctaatcaccttatgacccgaggcatcattaatcatgatgtcggctataggcataggatactcatctttgggagtggctttatttaaatctctaaaatctatgcaaactctaatcttaccactccccttcttctccaccgggactatgctagaaacccactccgcataacgacatggcctaataaaccccgccttcaacaaccgatcaatctcctctttgactcggtcatatagcacaggattaaaacaacgaggtggttgcttataaggcctaaaacccggtttaattggaagccgatgctcgacgagctcacggctaagacccggcatctcatggtattcccatgcaaagcaatcaacatactctttaagtaactcgattatcttaaccttataatcggctctcatgtttttgtttacaaaagtcggccttggtttagttccatcacttatgtccacttcctccaatggatcggccgatgtaaacccttgtccaagcttctccacttcatcaaaatcttcaacggtttcaccaatatcgttctttgtagaccgatattcttgcacactttttttaaccactctaaattagcctctttactcattatacaaatttatatggcttagccgtgctacactagccgactttacagagataggtacaaatttgccatcagagatactaataaaatcataactagaaagatccctccccgataagcattggatattcccatgatgccactcaaaagtagcatcggccattgcaacctcggccgatgtatccgcttgaacaatttcaacatcatcgccgtcccattgaattaaacattgatgcaaggtagaaggcacacaacaattggcatgaatccaacaacgacccaaaataacattgtagttaccttgcacatcgacgatgaagaaagcggttggtagcgtcttgtttcccacggtgagttccgccgaaaagatacccttcacctccgttggttcaccattaaagccattgagaatcatgttggtcttcttcaactcatcatcctcacacctcaacttcttgaataacgaatacggcatcaagttcacggcggcacctccatctactagcatcctagagaccggcttcccatcaacatggcctttgagatagagaggcttcatgtgacggtttgactcatcgggcttctcaaaaaccgcgtctttaggacctaatgagaattgagcaacctcggcttcatccatagcacaaaactccataggcaacatacataccatgttgatatctatgtcttcttttggagatggttcacttttatcaaccgattgttcttccttttcctctacatcaatcagttttgccttctctatggatttaggccttcaaaccagtgggggtcgcaactcattgaaccttttatctctttgctcttcggcctctttctctcttaactcttgggtccaaagacgttgcaaccttctcttttgagtagccgtcaaatccctaggcatccacctaggattcagctctattccaggaggtaaataatgccctctattaactttgtttgaagatgatgaagtctccacatcgccctttgcaatcctcctgtcaaaccggcgctggagcccggtcagaccggtcgtagaccaccggtcagaccggccagatgcgccggtcagaccgacactgggcgcacggttagaccagcctgaggtgccggtcggaccgctatcgagtcggcggtcagaccggcctaatggcccggtcagaccggccgcacgaccgcggtcagaccggccagaaggcctagtcagaccggccgactgcgaggaactggtaccggcttcggattttctgttcggggacattccaattccatctccagtaggtattggcacatcatgagaccccactttaatagtaatcacttccgaagtcctctcctccaccttgacgcgctttccttccctcttttcttcattagcccgattcttaccataaatcagctattgcttggtgaagacaaacgctcatgaattggcctccgtggtcctccccaccgttggttgaatcacattggaggcatatgattgaatattggcggtgttgccccccatggcataaagcaaggataaggataacccggcggcggcattggataagaaccccatgacatgtcttgtggataatgatacgaaggtgaatgcgaccatcttggtgaatgaccaaatcgctccctaggaggtgatcttggtctcttccctttgttgcgaattttctcaccaccttgcttctcatatttctccaaaagcatatcaaaagtcaccttggtcttcctaggggccttagaagttgaagctccactcctattctccttccaaacgccaacctccggcttctttggcactatcatcttggaccttggttcaccaatgatcacttcctttcccttagcagatttggcttgctccggctgaatcaacaccttcttatcattgaaattaattgtattcaccgaaaaaggatcatgatcaagcttcatcttggagccatcggtgaacttcaatcgtccttcatctatggccgattgaacctgtcgtcgaaacacattgcaatcattagtagagtgagaatgagaatcatgccacttacaatatgctcgacatttcaactcttcttgagaaggtatgacatggcctttaggtaatctaatttgtttctcttgcaaaagataatcaaaaatcttctcacacttggccacgtcaaaactatacttaaccttactttgccgatctttgcgaggagtcggcattaggttagagcaaacaaaaggcttatttttgttagtccatgaccattcggcaacataaatatcatgatcaccctcttcctcactatcactagcctcagggtaatcgaccacattaacattaggctttttgtcaaatggtctagcaagttttctattatccttaacccggctttcttgagccagagccttttgcatgagttgactaacatcaagaaattgttggccatctagtctttctctaagaggagcaactaaaccattaaaagcaagaccagccaaatctctatcatttatattcaaagtataacatcggtttctaacatctctaaatcttttaatataatctatgacagattcattatacttttgcttaaccgatgtcaaatcacataacctaagctcagtttctccagtatagagataatcatgaaatttttcttctaattgagcccaagtatgaatagaatttgccggtaaagaaataaaccatgtaaaagcattaccggataaagataaagaaaacaagcgcaatttaaaagtatcactattagcctcaccacattgcgccaaaaattgacctacatgctcccatgtggtcttaccatcctcactactaaacttggcaaattcgggaactctataatttcgaggaaacggcacattatcataataatcaggatatggctttttgtaagttctagcacgattcctagtttcaatcccgaatctattcctcataatttcactaattatatcctccatattattaggcccttgttgatttagcggtggattcggtggcctaataggttgtgtttatggtgcaatatgattatattggccttgtctagtatcgggaggataccccctagaaacatcgttataagaattaggaacatgtgggggaacttggggactacttgtagcagtagatacaggaggatcaaatgttttaaagtgatacaaataactagcattaatcatcggatctattccctgtatcggaacaattgcaccggtctgaccggcccatggcccagtctgaccggcgtccagatgcgcggtcggactggcctgagacccggtctgaccgccggggtaatacccggtccgaccggccgtttggccggtcggaccgacggctgtgtcgcggtctgaccggccgtcaggcccggtcggaccggtcgtgaacgccgtcccgtcggttttaccacccgtttgatctataggaggttggttagcagtggtagaggctttatcttttaatgtctaatcgtccataagagaaccgaatttattccttaaaaactcatcaaatttacccttaaaaattacatctaactgatctttaaaaacaactataaatgaatctattgtagatgtaatttgttgttggatagattgtgatacttcatcattgcttaccacgtcgggagcgagcttgggacgtggtccgggcttgatggtcacgccttgacgagtcctagtacttgctctcatcaacgcctcccgtgtgagctcgttgatgtactcctccatagctttacgatcttctccttcgaagtcttccaatgcgaccggtatcacattagatggctccacctccgtcttagatagcggcttcgtcatggcgaagtcaaagttgagttgacgatgaacggatctcctccccagcagagtcgccaaaaatcgtgttggcaactttttgtgacaaattgacaagcacgatcatagcaccttaagccttgcggtgattctagagtcgtcaaccacctcgatctagcaaagagctaaacctagatgggttttgataaataaccggctagcggagccgatttctagataactacccgtctcgtgggcaaaacggaaggttttcaggacaaacctataaagtgatgtcgcactctcgcagcggcggcggatggtttacggcgcaaaccgacaaagatggacaaactaagagaaaactaaaagcaatatgaaaaacgattcgattgattgattgtagattggttttttacaatgaaccggccatgtcccttatataggggttggtcttgccctctacaggccctcctccacgtccagctcggggtagaaaccaaaggaaacctgaaacatgccttctcgagcaaggaaacctcgagacccgacgaaacacagtcggactcggacctgccggtcagaccggccacacaccgccggtatgaccggccctcaaccggcggtttgaccgctcaacacacgacggtcagaccggcccactcggaggaaaccggcagacttccaaattttggcaatctttcctattttaatcctaggtgccaaatttgggtgtaaacacatgtctgtggggtatctcatatttattaacctatagcaaaaaaggagttggcattaaatttttatgtaattttaatgatactaataaatcatgtaataaatggaagtagcatacaggtattgcaaggaattttctatcttgcgcttgtggcaggtaattatggtcggacgcatagtgtgaatgacctcctctcatttcttgccttctcctcctttgaaggcctcctcacaagatattcgacttccctcaacttcttttaagtcccctggagatgatggagagaagggattggggacttacatgtgggtcccactattttattatattttaacggattgtaataccatgtagacaccacgttagaaaaaggcagttaacgtgccacgtggatgccacaccagggaaaaccacgctcttaaagaagacgaggggtcattttgcactggaggggccagtagtatacccgattttacggttaattagtgatacgaatcaaatccaacttgtaatcaaattggacctttttccattgagaagcgattcgacttggctacttaagccggtcataatcggtttaacagatatgagcaatccttgggtttaatttgtttcagctagcccaacgtatttgattaatttggacggcggcaatagaaagcccaaaccgaaaccgccaaatatcctaagcgtaactagcccgtattccttcgtcgatctccccgttacgtccttgatcgcgatcgagttcgtctgccaccttcgccgatctccatatctcgccggcgcgcgccgaccggagtccggagaccatgcatgctgctgcttccgccgcatcctcgccggtgagaacaacagtttgttcctagaaaaaattcagaaaaaataattggggttcaaccactgatcaacctcatgcccaatgcccgacaaagaacataccctgttgatgtttgtactgaaatcactccggacactgcaaaaccatggagatcagacagctcagttagctgacgatcgagtgatagattatgaccatcgaattagagacctctgtctatcaaccaggattattactcgtcgtgtaattgcaggatggatgaatgtatggatgccatattgctgacgcttaattacttcctgtgacgtcttagaatccgatcggtgaagaagaggagtcgagagattcgagagatatgcagcgtatggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 48702 - DNA, 3548 bp, Oryza sativa
  unsure (1)..(3548): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcaaggcggcttcggtgccgtgtacaggggatacctgagagagcagggcctcgccgtcgccattaagaggtttgctaaggattcctccaagcaagggaagaaagagtataggtcggagatcaaggtgataagccggttgcgccaccgcaatctggtgcagctcattggctggtgccatggccgcgacgagctcctactcatctatgaactcgtccccaaccgcagcctcgacattcacctccatggcaatggcaccttcctaacatggccgatgaggttagtacctgttctctttaacttcatctaaacttcctttgtgatgttaaattaattggcgtgttaaactcagctaacttggtcttaacttgtcacagggttaagattgttcttgggcttggatcagcactattctatctccatgaggagtgggaacagtgtgtcgtgcaccgtgacatcaagccgagcaatgtcatgctggatgagtaattcaatgccaagctaggcgacttcgggcttgcaaggttcatcgaccatgccgtggggatgcagacgatgaccgccgtctctgggacaccaggctatgttgatcctgaatgcgtgatcaccggtagagcaagcttagagtctgatgtttatagcttcggcattgtcttattggaagtggcatgcggaaggaggccaatgagcctacaagataaccagaagaatggcatcttccggttggtcgagtgggcctgggacctgtacggacaaggagatgttgtctcagcggctgatgagcggctcaacggtgattacgacgtgtcagagatggagcgtgtcatcgttgtggggctttggtgtgcgcatccagacccaagcgcatgaccatctatccgagcagccatggccatgctccagtctagtgggcaattaccggtgttacctgctaagatgcctgtgccaacatatgcgccgccagtggcctcagtggaggggctcttcacatcgtccactggaatgtcgtcctcaagtgcagcacaatcatcatcgacgaccagtggctacatcactcacacctcgagttcctctaacacatccacttcagctggttcaaaggactcgtcttcgttgctcaaacatcaatacttatgatgttcaattcatttgctttgttactaattttgacttgatgcttgaatgggatgtacaactcgtgagccattgattttccatttagagtagtctaattgccaatgtgagtaatgcatgtgcatttatgccatgatttaaattttactcccattttagtttttctagatagatttatcctgccattttctcttcaatgtctgactactataaagtgcataccttgcatgttttaagtgaatatcctagtccttagagggctgaattgtcgaagttggaagaactttaaaatgaaaaaaaaaaccaccaagagaagagaactcttacatacttcacatagtttgcatgttttcacttttcagtgaataacgcaaaggtgtaaacaacatgaactaaatataataagctaaattcaatagagatggaacatggcctctacagactatagacaatagtacaaagactgcttattttcagtagttcttatgcaattgtctcaaatcgtggatatttatgttggatacttcggtggtggaatcaagaacatccaagcaaaattgttaacactacaaaatagtaccagcatagtagttcactcactatgacctgtagattttcagctggttgttttgccctgtttttcagcttttcaaccaaaaggttgttctccccaaatcttaacgaaaattcgggcagcgctctttgtcagcctggcaaaacaaataataataaattagacattcatgcaagaaacatgtcatccaggattgacaactctgctacctcacggatcgatcaagtcaaatttggaaataaaagagttggttatgataggttcagcaatgggtttgctgctgcaaaattctcaacagaatctgatagaacaacccattggaccctactccttccagaagaaaggaaagatctggaaacattatatgatggcacagtagctagtgacccattctctttcacattatgtccttagccatgatcaaacgcgcttggtcaaaccaaccagtaccaggatgattgacagaagagtaacgagaacgaattttgacaaagagaaacagctccagtgatttacgcattcgaaattaaaaactacaatagttacagcaatttttcatctataaaagtccatgcatagcctcttttgaatgtccaagttagctattcaacattgatgcaggattgtgcttacctaaaattaagttgaagcccttacattcttttgttgaagggacatcagaaaacgttaagaggctaaactaataaatacgaagatacccaaccttagaggaaagttagtgttggacaccaaattgggcatttatcacatctaaattatctcacgaaaaaacaatttttttcacattggacaaaacaaaaaaacagcagtactattgtgaccaatcaaccacaagcatttttcacattaagttgaggttatgaggtaacggatgcaaaaccctcatctagtcacctattggaagaggaagctccggtagggacagtcggcggcgatgcactgtcgcagcctagcgtcctccgccgggcggtgcagcatcgtcagagaatccgctctcaccgccggcgtgaagtgcctgacaaggtcccgccattttggaattaggatagttcccttccagacctagctagcagcaacaacacctgcggaggcgggaggcgtggaggagctacaggatacttcgccaaccggaacttgctcatcaccggagatctcggtcggcgcgcggccgacgaccagagctatgcggcagcggcggcgacgcggtagaatacgcttcagttgcggaaagaagaaaaagcttaaaccgaggatggctatagttgggccgtgcaacgtccggataacattttattggggaataagtccaccggaggcgagactttttgagatcccttaaccacaaaaccagaaatgtgtatccctaaactcacacaaaccgtgcactcaaggtcctatggcagtatatatgggtggtttcgctgacgtggcatcctagtcagcaaaaaaaattaaaaaagtacgtggagcccacatgctagctacacatttttttttcttctcttttctt

SEQ ID NO: 48703 - DNA, 6576 bp, Oryza sativa
ttaattttttttgctgactaggataccacgtcagcgaaaccacccatatatactgtcataggaccttgagtgcatggtttgtgtgagtttaggctatatatttctggttttgtggttaagggacctcaaaaaaatctcgctgttaagttgagggacctccggtgaacttattccttttattggactaactcaagtcctaaaatgggcttaggccaaagtttttgaagagcgggggagtatgttgggacccccgtgggggtgggacaagtctattttttgtcggagccatgtagctcggaggcaccgttggatctggcatgggaggatgacgatgcagaggaatggggaaggggagagtgaactggggaggcctcaggtgagcattgctgcctccttcttgtggatgagctaatgtggtaaggttgggatgacggatcggtggtggagctcacggaggaggagcaaggcaacagtgcagctctccgatgatcgcaccagtgttgttgtccccatcttcgttgtgaggatggcatctcatccttgcccacgttggctcgagtgctggccatctcgagctcgctacagagggcggtttcagtgatgtggatatggggaaacaacacacggcatcgctcgagacccctatgtcatgggcctattgggtccactaggttttttgtttttaaaatttttcaactcaatgacatgcgggtcccattaagtttttattctattattttagtgccatgtaggatgaacaattccacatagacacatgtgatcttcgctaccgccgttgtgtcatcgccaccgaagcctcggaactcccgaggccgacattgccatcgacgagctcccaagtgccagatccatgtctttgtcatcactgccgaggtcccaagcgccggatccgacgccgttgtcggcatcgctgccagatgtccctacagctcccgaggccagcactgccagggagctcctgagcgccagattcattgttgttgtcatcgctgccgaggttccgagcgctagatttgcctccgctgagtttctgagcgccggatccgccagttcccaagctcctagctcgcacctgccgtcgccgctgccagaagctcatcaacgcctttgcaagcccgtcaccccgctccggccatagtcatcttcgccggcggatctagagggggagaagtagatgcggagaaaagctaagtgagagagggagagagaaggagaggagagtggatcggggtaggggaatggttataaagaagagggttggctagaaagttgtttttgcattcaggtctcttaagtggctcgcatttgataatcgatttcttcatgtgggtctcaaccaaatagcatccaaatatttttatatgcggatgttttcttggcccgcttgaaactaagggcccctttgatttggaggaaaaacataggaattttagaggatttcaattttatcggaaaattttctatgaagccctttaaaacaaatgattgaatcctatccaatcctctgaaatttctatagaatggacaatcctatagagattttggaggaaatttagcaagagcttcaacctcttggtaactttcctttgagtctacatctctcattcaattcctacgtttttcctgcggttcattcaaacggtcattcctgtgtttttcctgcgttttgcaatcctctgttttacacttacattcctatcaaaatcttacgttttttctatttctacgttttctcaatcctacgattcaaaggggccctaaatagggggtgcctcaataaaagtcattttcgtagtagtgaacctttccgtcttcaagtgattttctcttcagtttcctaagtaacccagattatcatgtagattcaaaggcacataaattacagaattcagaaaatgaagcagagtagctttaagattctcactagctaaagctgcttcttaaacctccagctctttaaacagagccattgacttggtgctccaagctagagctcagcatttcggtcttcagtcccatatgaccaacaaacaatcgatcgttgactcaacgcaatctcttctgaccccgacggtcgaaaactatggccggagcacagaaagaagtaattcaatgccaatttggcacaattaatacaagtggaagaacaaatattaccaataaatcaacggcaagattgtgttacaattccttgttagaccgagccggcttctcgagtctctgtttgctagtggtggctggcaccagctgctcgagtgatatcgtggacatcagttgaacaggctaatgggtagtagaggtgatccatccacctgtgtattaattactaaaaccattggattgttacccattttatcctttatttaatgagaaagttcttgaccatttatgtcaaaacgaagtccatgacgaacattattaaataaaaagagattaattatgtggcatcacttgtagtgttgctgttaggctcattgttttgtgagtagcaattcttgttaccatttcttcaaactagttttgatgtcacatgagaatgatattgccaatttatttaagttttaatttttttactatcatccttcagtagcaccactaccaccatatagttgttttgtgatacatctcggtctctcaactcttagaggcatgtggcaatgtttcttgaatgttatcgaaaaagttaagaaaaacaaaagctgacaacgtagattaggtttctatcaataacacacaaaaaaaagcagaccataaaaaatacaattggatttggattcacgcactaagggcaaaacaacatcggtggaagggagaggaggaggacgcgacaaagagccactagcaggttcgccaaagattcctccaagcaagggaagaaagagtatatgtcggagatcaaggtgataagccggttgtgctaccacaatctagtgcagctcatcgggtggtgccatggccgcgacgagctcctactcgtctacgaactcgtccccaaccgcagcctcgacatccagctccatggcaatggcaccttcctgacatggccaatgaggttagtaactgtcctctctaacttcatctcaacttcctttgtgatgttaaattaatcggtgtattaactcagctaagatggttttaacttgtcacagggttaagattgttcttgggcttggatcagcactgttcaatctccatgaggagtgggaacattgcgttgtgcatcgcgacatcaagccgagcaatgtcatactggatgagtctttcaatgccaagctaggcgacttcgggcttgcaaggttcatcgaccatgccatggggatgcagacgatgaccgccgtctttgggacaccaggctatgctgatcctgaatgcgtgatcaccggtagagcaacctcagagtctgatgtttatagctttggctttgtcctattggaagtggcatgcggaaggaggccaatgagcctacaagataaccaaaagaatggcatcttctggttggtcgagtgggcatgggacctgtatggacaaggagatgttgtctcagcggctgatgagcggctcaacggtggttacgacgtgtcggagttggagcatgtcatcattgtggggctttggtgtgtgcatccagacccaagcgcacgaccatctatcagaaccgccatggccatgttccagtctagtgggcaactactggtgttacctgctaagatgcttgtgccaacatatttttagataatagaatttaacattccgacctttgcttaaaaagagctacaaccaattattacaaagtagcactctagaaaagagtgtaggggaggggctcagtggaggggctcttcacatcgtccactaggcgctgccggtgaccttagtggaggggctcttcacatcatccactagaatgtcgtcctcaagtacatgcaacacaatcatcatcaacgaccagtggctacatcactcacacctcgagttcctctaacacatccacttcagctggttcaaaggactcgtcttcgttgctcaaacatcaatacttatgatgttcaattcatttgatttgttactaattttgacttgatgcttgaatggatgtacaacgcatgaaccattgattttccttttagagtagtctaattgccaacgtgagtaatgtatgtgcatttatgccatgatttaaattttactcctattttagtttttctagacagatccattgacttggtgctccaaactagagctcagcactttggtcttcggttccatatgaccaacaacacaaaaatagcaactcgtattgataacaatcgatcgttgactcaacgcaatctcttctgaccccgacggtcgaaaactatggccggaatacagaagaagcaaatcaatgctaatttggcacaattactatacgtggaagaactaaataatactccctccttccctaaattttgacgttgttgatttttttaaatatgtttgaccgttcatcttattcaaaaacttttgtgaaatatgtaaaactatatgtatacataaaaatatatttaacaataaatcaaatcataggaaaagaattaataattacttaaattttttgaataagacgaacgatcaaacatactacctatatattttaatgtatgacaccgttgactttttaaccaacgtttgaccattcgtcttattcaaaaaatttatgtaatcatcatttattttactgtgacttgatttatcatcacatattctttaagcatgacctaaatattttatatttgcataaaaattttgaataagacgaatggtcaaatgttattcgaaaagtcaatggcgtcatacattaaaatacggagggagtatttaaaaaagtaaacggcgtcaaacattttgagatggatggagtataaccaataaatgaatggcaagcgtgtgctacaattctttgttagacgagccggccgtcttctcgagtctctgtgtgctagtggtggcatcagctgctcgagtgagttatcgtggacatcagctaaataggggtgatctgtccacctgtgtattaataattaaaaccattggattgttacccattttaagttcttgaccatttatctcaaaacgaagtacttgacgaaagagagattaattatgtggcatcacttgtagcgttgttgtcagtctcattgtttagtgagtggcaattcttatgaccatttgttcaaactatttttgatgtcacaaggttggagacctatttctggacatcaccttaccgggggaatgagaatgctattgccaatttatttacgtttttaactatcgtgcttgataggcaccactaccacaataacgtttctagcttgaatgtgatcgaaatagttaagaaaaacaaaagctgacaacgtagattcactagaacgggattggatatctctaacgggcttaaagcatcatctctttcgggcagggagcaaaggtcagtaataagaaaatatctcaatcgggcatccggccgtcacggatgacacatctcaatcaagccaacataaaagcccgtcatggatgactctcatctctaacgggcctagattatagcccgtcacggatgactctcatctctaacgggtctagattatagcccgtcacagatgagtataattcaaaaaaaaataaattttgtttttttgttagcctaaggcctttgccctcactagtgtgccttcctggtcggtcaccaatccagactcgtgtgcacccaggatgaattttccagtcggtcacccatcccgtttaacctcacagttctttggagattggcttccgagaaagaaattgtaatttgttggtatgagtattctattaatcctattaagcactgggccaggatgtcacaccctagcatcgcctattcatatacattcattcacataacacaaccacattcacataacatccattttgatcacatatttcaccagcgaatctgagttaattggatcaaatatatatttagcaagtattatcatgagtaggaggcaaatcagacttttaagaaaaaatgaatttcgaattgaattttatgatactaaatgaactcatatgaaaaagctatcaaaaacaaagttgtagaacacattgagatctaccatttttattttggtcatttcaccatccgggtttgattgaactatataaattttgtattttaaaatataagaaattcaaatattttttcgggtagtaaatgatttcaaatggaaaaattgtcaacaacaaagttgtataactcatcaagatctataacttttattttggttatttttctatataacgtctttttaacagtttgaatttgaatttaaaaatatgacaacttcaaataatattttcaaataataaatgatttcaactgaaaaagtcatcaacaacaaagttgtataactcatcaatatctataacttttattttgttcatttttctatacaacatttttttaacagtttgaatttgaatttgaaaatatgacaaactcaaacaacattttcaaatactaaatgattt

SEQ ID NO: 48704 - DNA, 1869 bp, Oryza sativa
gtttataacggcacaaaatctgctctagagtcattctagaattgtgacatttatcctagcgataatataattatcgcggctcgccgtatgatggtctagttttgcgtctctttgccaagacacactttagcctttgttttgacatatactcttcaaatgaatttctaaaagaagagattgcccgaagacctaccaggcaggcctgagggcagtttcatcttttcaaaagttttctcttcccaattgaagaggataggttaaaagaagtggctatatatctaacttttgacagataactatgtaacacctatgtaaattaaaacttgcgttgtaacacaatcggagaggtggagagcatatgccccctagctggcatggcatcacgatttcgacgcctggtcacagagcactccatcaactttttattcctgatcatgcgcacaaatctccaggccaatccaacggaagaaaatttgaaagtttttcctccacttttcttaacatagtaaaatagtaagttcttttggcaaaagaccacaagtccataaaacaaagtgtattttggcaaaagaccacaatcccgtgacaaccgtaaactatagtgccttagaacaaattttgccttaggctataagccaactaactatatctaaatgtggagcagagagatgaaaaaaagtgttagctctcatgtaagagctagctctacacagtacacagctataagataaacacattaaatatataatgagacaaagaaaggataagaaaagcatagataataaaataacttgtctatttatatatgttaggtctaatactattttaagatggacttacttagcttatgactttgtatcataaggaccaaacgagtattacatagcttaatatccacatcatctgcttacctctttgttttgacgtactcttctttcgtcacgtatttacaggctgttaccctagcgcgagcggatccaaatccgtccaaagtcattggttaagttcgatcaccagcgagtaaatagttccatcaacttcgcttgtatcatcgtgattaaactttctcggataagtatgatattttattaaggttgatgtaagcgatacctatatgatatattgattctatttttaactgcatcactatttagagtcgtattggcttagttaggactttctcggtttttatgcaatgtttcatcggagttctagtcgatgagttatcttgttactacttctaaatgttgtattggcttatactcaaactcgcataatcactagttaaatctctttttatgaactttacccttatactatttcggtttggtctgatctatcaagattgtttttataaagaacagtttattcataattatgcatagtttagttatggccaataatagcacgaattttattgtttgtctgattattatgtgaatctcaattgagcctatagctgattgatcaaaaccctatcatatcggctggcctagccacatcccattggcttactggctaattggcaccttgatcatcgatctattcaaactaactggcacatccttaactcgattgataggaccggcactggacctaagcagatctctcaggtctttgttgttgggaatagtcccacattgcttatctagggggagttgaaccaacttaaaaatggggggagtccttcacctcttgagctagcttttggggtgtagcaaggctttctcctggttgggccaacgtctcccggttttgggccaacaagtggtatcagagccaaacccacaatctctagtgcttgtgcacactcagggtggtgtaagcccaaagcccagtggaccgcgggtgtgaggcccgtatgtgcct

SEQ ID NO: 48705 - DNA, 4578 bp, Oryza sativa
caattttttttaaaaaagaattagcaaatccttaaaataatagctaaagtgtgttttgacaaatgatcacaatcaaataaggagtgttatctctcattcaaaaggtagctctacaaatatataggatgaatgcattaaatacataactgagacaaagagagaataagaaaagtagagacttgtctgttacgtactcccttcgtcccaaaataagccaatctcgaactatatatatgtctagattcagtatagtccgatatatgtactttgaggttggcttattttggaatggaggaggtatgttagatctaatgctatttttagatgaacttagttagcttatgactttgtatcataccacatcatctgcttacctgtgttttgtcgtactcttcttttgtcatgtatttactggctggcgcaagcgcgggtccaatccgtccaaaggtaaaaatggcggggggctgatcggttactttaaatccgtactccagactgcattgtcacgtaggaaggctcccgagcattgtctctcatttctccccagctagtcacgccgatcagtactggaagtctatcactagctagctatatcgttgtcacccttgcgcgccgatcgacgccgcggtgatggccggcttttctttgatcagttgcgctgtgggtatcatcttcttctccgtttgctacctgcctgcggctcctgccgccgccttgtccttcaactactccaccttcagctcggacaaccaggaggacttcacattcgaaggcaacgcctccatccacgacgggtgtattgatttcgttgcgaacgggacctggggcaggggctacaggccctacagcaccggacgggtgtcctacaaattgccggtgcggctctgggacgctgccaccggcgaggtggccagcttcaccacaaccttctccttcaacatcacgccgatgaatattagcgacaagggcgatggcatggccttctttctcgtcagctatccatcaaggatgccgctgaccgccgacggcgacactctcggcctcgtgagcaacaaacccgaaaacgctccggccggcggcgaccaattcgtcgccgtcgagtttgacacctacccaaaccccggcttggaccctaacgctaccggtgaccacatcggcatcgacatcaactcagtccgatcgttgacgaccgaacccttgaccaactccagcctcatcggtaacatgaccgccatcgtccactacgatagcagttcgagcatcctgtcggtgaagctgtggataaatgacacgacgaagccgccttacaaccttagctacgaaattgttgatctcaagaaaaaattgccggagaacgtcaccatcggcttctcggcggcaacgggcgcatcagatgagctacaccagctgacttcttggtacttcaactcgagctcgtcgttcgagcataagcatggacgtgccggggttgtagcgggagccaccgtcggcgcgacgttgttcgttgtgctgctcttcactgctgcagctatcctcatacggcgacgtcggatcaaaaacaggaaggaggcagaggatgagcaggacataagctcggacagcgaagacaatgacggcgagcccatcgtggagattgagatggggactgcgccaaggcgattgccatactatgagctcgtcgaggcgaccaagaacttcgcggtggaggagaagctcgggcaaggcggcttcggttcggtgtaccgaggctacctaagagagcagggcctcgccgtcgccattaaacgcttcgccaaagattcctccaagcaagggaggaaggagtataagtcggagatcaaggtgataagccggctgcgccaccgcaatctcgtgcagctcgtcggctggtgccatggacgcaacgagctcctccttgtctatgagctcgtccccaaccgcagtcttgacgtccatctccatggcaatggcaccttccttacttggccaatgaggttattaattatccgtgctaactttctcatctcaactgcttcgatgagtgtcaaatctaattctatttttatcttgcttaattggttgtttccacaggatcaagattgttctcgggctcggatcagcactactctacctccaccaagagtgggaacaatgtgtcgtgcaccgtgacatcaaaccaagcaacgtcatgttggatgaatccttcagtgccaagctaggtgacttcgggctcgcgaggctcatcgaccacaccatcggtataaagacaatgaccgccatgtcaggaacaccgggctaccttgaccctgaatgtgtgatcaccggtagagcgagtgccgagtcctacgtttacagtttcggcattgtcctactggaggtggcatgcgggaggagaccgatgagcctactagacagccagaataacggcgtcttccgactggttgagtgggcctgggatttgtatggcaagggagatgttctcatggccgccgacaagcgtctcgacggcgactacgattctgcggagatggagcgtgtcatcgctctcgggctctggtgcgtgcaccctgacccaagtgtgcgaccgtctatcagagacgccatggccatactccagtcgagtggaggccaactgccagtgctatcggccaagatgcccgtgccaatgtacgcgccgccgatggcctcgtttgacgggctagctgtttgcgtcatctacagggatgtcgtcgtcctcaggtgtgacgcagtcgtcgtccacatcgacgacgagcggccatgctattcacacctcgtgttcctcggtttcctccgattcaaccggttcgaaggactcgtcttcattgctcaagcatcagtgctagtgtttagtgtttgttttttaatttgcttgttcttagtttagagttgatttggtctttggtgttgcctaattgccgatttgagtaatgtatgtgtatttaggccatgatttgagtaatgtatgtgtacttatgccatgaatcttatggcactgtagtttctctagaaagatctgtccggccattttctgttccagcattagaataagtcgagtgagggacatgggcaacgatagtagctactgcagcagcactacaattgaggcgaatcaaacgatcggcccattacaattgaaggggtggtcgccatcctcctcatgggccattgcctacagaacgaattgggttgggacacagccgctaggaaaagcctgatctacatgcctatccccaatgcattaaatcaactttacatcccttatgtttccatcgagtttaaatcgcatctctgaaccgcaatacaagaagtctagacccacaacttgtaaaactaacttaaattaggttcttcggcgatatagataggtgatttcgctgataaatataaaaaaatgcatacctaactctaaggctataaatagacccctccaagagaacatatattgtaagtgagtttcaataaatatatttactttctttgtgtacacttagaaaccactgtttgtcctcttagacaacaccatgaaaattcagaaaatgtgcaatattgtatttttatcaatcctaatttcagaaaaatcctttatcaagaaaatgttggaattaatggatgggccttagcccactcgaagattaattctttggaaaatcacaaaagctcacctcatgagatggcatgcgtgtggagtttagtaccaccttgcttattttaggagaaggggaccttcttaaaagggaggatgccctcctagccacttgaagcatgtgtggtggagagaagagggggaacacacgcgcgcgctcgctcgccgggcagggcaggcggcgcgcgtgcacgacgtacgcgtcgaatggtccgcaaaattggctcctcacccttgcgcagatgcagcctccttttgcagttttgttttgctgcaagaaaattcggatttgttttgttgtaggaaacattccgaaaaatccggtgcgtgaaaacggcgtggagtccagataagttacgcgcgacttatccggttcggttacgcggagtggagatcgtgcgggcgccctgatcaagcgacctatctctatataaaccgagccgctgccttcacgcaacacacgtgaaatcaatctagggtttgcctcctcctctgtgttgtgccgtcgctcgtagactactccatcccgatcgtcagcgtgcaccggcaatcgggagagcaggtctccggaacctctgccttcgacgtcctgcaccgggagaaggcggcaataaggtttttgggaagcgctccgcgcgactgctctctgtttgttcgcgacggctcgccttcctctccgctcgcgtgctgcacgccttcgtcgacgctcgcaacagcgagtagttcctgccgagcaaccggtctttccgccacctcggtacgtgttcgacatgttgcgcatatttgatctgttcatgttttactgcttagtttacatgtgtagatctaatgatgtgttactgctagtatacatctgcaatgttatgatttatttatggaatatattaaatcattatatgcctatattctcaaca

SEQ ID NO: 48706 - DNA, 15449 bp, Oryza sativa
ctatgaaatgcttctgggtgagtactggtaaacctgaaggaattcttgctgctgatcagcataagcaattcgagaaagccactactctctttgtgggatgcatcttagcgttcttggcaatcgtctggtcgaggtgtatatgcacatgaccaacgctaaggagttgtgggatgcactgaatactaaattcggtgctactgatgctagcaatgatctgtacatcatggagcagtttcatgactacaggatggctgacaaccgttctgtagtcgaacaggctcatgaggtacaaaccatggctaaggaactcgaactccttaagtgtgtcttacccgacaaatttgtggccgggtgcattattgcgaaactacctctatcttggagaagtttcggtactgcactcaaatacaagagacaggaatactccgttgaggggttgatagtgtctcttgatgttgaggagaaagctcgggaaaaggacgccgcgtctaagggcgacggtgggcagtccagtgccaatgttgtgcacaaggcccagaacaagagcaaggggaaatacaaagctcagcagaccaccaacttcaagaagcagaagaagaacaacaacaatcctaatcaggatgagaggacttgctttgtgtgtagccaacctagtcatctggctaggaagtgtccacagcgcaaggggatgaaggcacctgcagggcagacttctaagtctgctaatgtgaccattggcaacactggagatggaagcgggtatggtaatttacctacagttttttcagttaatcaatctactaattagtgggttgatactggggctaatgtacatgtttgtgctgacatctcattgttttcttcttatcaggtcgcacggggttccaccgtcctaatggggaatgggtcacatgcttctgttcatggtgttggcacggtagatctgaagtttacttcgggaaagatcgtgcagctgaagaacgtgcagcatgtcccttctatcgataggaatcttgttagtggctcccgtctgactagagacggatttaagttggtttttgagtctaataaagtagtcgtgtctaaacatggatattttattggtaaaggttatgagtgcggaggcttgttccgtttttccctttctgatttctgcaataagtctgtgaatcatatttgtggcagtgtggatgatgaggctaatgtatggcactcacgtttatgtcatattaattttggcttgatgtctcggctttccagcatgtgtttaattcctaagttttccattgtcaaaggttctaagtgccatagttgtgtgcaatcaaagcaacctcgcaagcctcacaaggctgctgaggagagaaacttggcacctctagaactcctacattcagatctttgtgaaatgaatggggtgttgacaaagggtggaaaatgatatttcatgacgttgattgatgatgctactagatttttctatgtgtacttgttgaaaacgaaagacgaggctctagactattttaaaacttataaggcagaagttgaaaatcaacttgacagaaagataaaaagacttaggtctgatcgtggtggagagtttttctcaaacgagtttgacttattctgtgaggaacatggcattatacatgagaggacgcctccctattctcccgagtctaatgggattgccgaaaggaataaccgcacactgactgacttggtgaatgccatgttggacaccgcgggactacctaaggcatggtggggggaggcattgttgacctcgaatcatgtgttaaacagagttcctaacagaaataaggacaaaacaccatatgagatatggattgggagaaaaccatcactttcttacttgcgcacatgggggtgcttggcgaaagtcaatgtactaataacgaagaagcgcaaacttggacctaagactgtggactgtgtctttctgggatatgctcatcacaacattgcctatagatttttaatagttaaatctgaggtaccagacatgcatgttggtacaattatggagtctcgtgatgctaccttctttgagagttttttcccaatgaaggatacacatagtagttctagccaaccctgtgaaataattcccagttcaatcacaccaccagaacaaactgaacatacacatgaacatgtcactgaggaggatgacagtgaagctcctcgaaggagcaaaagacaaaggacggctaagtcttttggtgatgatttcactgtgtacctcgtggatgacactcctaagtcaatttcagaagtatatgcatctcctgatgcagactactggaaggaggctgtccgtagtgaaatggattccattatcgctaatggaacttgggaggtgacagagcgaccctatgggtgtaaacctgtggggtgcaagtgggtgttcaaaaagaagctgaggcctgatggtaccattgaaaagtacaaggctcggcttgttgctaagggctatacttagaaagaaggcgaagatttctttgacacttactcacctgttgtcagattgaccacaattcgtgtgctactttccctagcagcctcacatggtcttctcgttcatcaaatggacgttaagacaacttttcttaatggagagctggatgaggagatctatatggatcaacctgataggtttgtagttgaaggtcaagaagacaaggtgtgcaaattgttgaagtctttgtatggtctgaaacaagctcctaagcaatgccatgagaaatttgatagaacattgacatctgtaggcttcgcagtcaatgaggcagataaatgtgtatactatcgccatggtgggggtgaaggagttattctgtgcttgtatgttgatgacatactgatatttgggacaaactttgaggtgataaatgaggttaaatcattcttgtctcaaaaatttgatatgaaggatttgggagtagctgatgttatcctaaacattaagctaattagaggtgagaatgggattacactcttgcagtcccattatgtggagaagatcttgaatcgttttggctacattgacagtaagccttctccaatatcttatgatcctagcttgttgcttcgcaagaacaagagaattgctaggaatcaattggaatactcccaaatcattggctcgctgatgtacctggctagtgcaactagcctgatatctcctttgctgtgagcaagttgagccggtttacctctaatccaggagatgatcactggcgtgcgcttgagcgagtaatgcgctatctgaaacgtactatggaattggggcttcactattctgggtatcctgcggtactggaaggatatagtgattctaactggatctctgatgtggatgagatcaaagccactagtggatatgtcttcacactaggtggtggtgctgtttcgtggaggtcttgcaagcagaccattttgacgaggtcaaccatggaagcagagctgacgtgtcacaccctgaaaattcaaaatttataaattgttgtttaattggaatttttagaaataattttaaaagcctagaaaagaagatctaattttaattaataaattccaatataaaatggggccagataaaatttcattaaatactttgcttaattctataattcctagatttttctgggatttatttgagctaaggaagtatttttaataaatggaattgcatttaagaaataatttaaattgaaaaaggttttaaaaagtctcttttggctttgggccgaaagtcggcccaaaaccgctctctctctctccctcggcccaagccggcccagtccgtccgcgcgcgcgccctcgctgccgctgacaggtggggcccacctgtcaggcccgtcgtcttcctccggccgaaaccctagcgcgccgccgccgccgccgctttccaatccggccgttcctttccttctccggtcgaattgattgaggggaaacaatctccgggatctcctctaccttttctcctttggaatctttggctaaatcgttttggaaagcgttggattcgagtttgtctcggattcattcttcccgatctttccttcctcgtcgtcggccgccgtgggcctttgccgccgcctccgagcccctttaaaagcctccccggtgtctcctctacccgccgccacccttgccttcgcctctcgtcgtctgaatcgttctagcgccgtgtgccctagctttgccgtcgccgccgccgctccagccgtgcgccgccgttgtttcagccatcgccgtcgctcgggaagaccgccgtcgtggtcgccaagtcgtcgccgtcctcgtccgccccttcgctgtcgccggagatcgccggagcttcatcgccgccgtcgacccgaaggtttcctccgtttcctcctcgtcgccgtcgccgtccgttgatcttccgccgccgttttggtcaccggtgagttcgccgtgtcgtcctctacgtgctggtggcctccgtttgcgtcctagtgccgccgttcgccggcgagcgtgcgccgcccgagctgtccgctccgccgagcccccgccgctgtcggtgacgtcattgccgacgtcatcggggtcgtccgccgtgagccggtcgtggaccgttcgatctcggccgtccgttttggattggatcgatctcggccgtccgtccgcgtgaaccgccgcccgtgcgcccggtccaccgaaaccctagcccgctgacgcaataaaccttcttttccttttcaaaaataattcattattgcgtcataattcaatttaaaccgatataagtgtccttttcaaaaatatccacatgtactgttcatgcttatttatgtgttgttttggtgattttgctcttttctgtttagattccgtcgtttccggagagtccgttttcgccggagaagaatttgaagagttccaaggccagcaaggcaagtcacacatatcccaaacaaccctttgagcatgttgatcctatttaaagctattgtttcttttcaactattgcatttattttcgaatgtcattgggtggaattaacctattgtttgttatagcccttttgttcttgattactttattccttgataccttgggttataataatttgactggttgaactttatttatattggttcaactagatattagaaataattgcttagccctgcttagaaacattagcacactattgggataactcatgattcactattatttcgtgatggcttattgatagttcacgatggtcaatcgtgattagttaattaattaatgtgccaactaaaacctgataatggtgggttgtgagcacatggttttgatggtcgtgctcatgacaattaaggaccggttcacgagtttcggttgtgaaacattaatcgtgccaaccacaagccagcatgggcaacggctttatcttttgtatagcatagttcattgcggggcaccagactgagaagtggcggagataagcccacgggggtcgctggggagtccatgccttgtttataaggggtgattatgatctaggaaggtgcactgcagtggattgtgttgtatgcggggtattgtcacaactcctttccgaggtatcgtggtggtattgaggcacatggtgacatgatgtggggttgtgtcttgtgggtacagtggtacacctctgatcagagtaaaactattcgaatagccgtgcccgcggttatgggcgggtctaacaatgtctttcatgattagtttcacacttctcaccatagtaaatgatgctttaactggtaataatttgattagctcctggtttggaatggtatattcctggtttggagatagaactgtgcagccgggatggttgttcagaatggttgggcctatacaacagggtacgttgtatagcgttggattaatattgttttgttacttaactgttttattaaattctcaaaggtttgctaaatgctgcttttgcaaatgaaaccctactatgccatcctttgttatcctgtgcacttgcatatttgctgcgtggcttgctgagtatgtcatatactcaccttgcaatcattcatcagaggaagagttctacaatgaggctgatggtgtggaggattaggagtagccttggtcaagctgcctgtggagtggagccgtctgcgccgtttatttcattttccgctgcttagatctttattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcgtgacatgacggcactggatactgctactgttgaggcagaatggctgcgtgatcttttaatggatctgcctattgttaaaaaaccggtgccggctatccttatgaactgtgacaatcaaacggtaattgtcaaagtgaatagttctaaggataatatgaaatcgtctagaaccgtgaaaagacgattgaagtctgtcaggaaattgagaaactccggggttataacgttggattacatccaaacagctagaaacctggcagatcccttcacgaagggactatcacgaaatgtggagtccagataagttacgcgcgacttatccggttcggttacgcggagtggagatcgtgcgggcgccctgatcaagcgacctatctctatataaaccgagccgccgccttcacgcaacacacgtgaaatcaatctagggtttgcctcctcctctgtgttgcaccgtcgctcgtagactactccatcccgatcgtcagcgtgcaccggcgatcgggagagcaggtctctggaacctctgccttcgacgtcctgcaccaggagaaggcggcaataaggtttttgggaagcgctccgcgcgactgctctctgtttgttcgcgacggctcgccttcctctccactcgcgtgctgcgcgccttcatcgacgctcgcaacagcgagtagttcctgccgagcaaccggtctttccgccacctcggtacgtgttcgacatgttgcgcatatttgatctgttcatgttttactgcttagtttacatgtgtaaatctaatgatgcgttactgctagtatacatctgcaacgttatgatttatttatggaatatattaaatcattatatgcctatattctcaacagaaaaatactaaaaaagtaagacatcataacaagtacaactcagtattattaatttaaagctttatattatttaaaaacaacattatattcagtaatttcgaagtgtatattaacttaaggaaatactagaaagaaagtaagggattaaaagtattagattttattctgtatacctatgatattgtaattaccaatttcaaaaattcaaaactatcggtttcattcttaagcacttaaaagcaaagtataaacacttatgcagaacatacatataatactgttgcaaatatatgtactaaccagtgggtttagttaaggccttgtttagttcccaatttttttccctatagaatagctaatatggtccctaaaatttcgttcctgggtcattttagtccttaatcttttatattattcaaacaagtcctttaaatttgtcacgtgggctgatatagtcctcggtcccacaaaaaattgccacatggacataccatgttaccctcctatgcaaaatctgtatgatttgtccaatttatccttatatatatcataggagaataaaaaaaggaaaaaaagtttatatatatatatatataccccatatatatatatatatatatggggtatatgtaagagaaaaatatacgtcaaaagggtgaaaaaaatggaaaagtatttttttcctatggttatgtctaattcacccttacatttatttttctatgatatacgtaagggtaaattggacaattcatcatagattttgcatgaatgatgacatggcattccatatgatgattttggtggacccaaggattattctaggccttatgacaaagtttaagggtttctttggaccatttaaaaggttagagattaaactgatcttacagagaaactttagggactatagtagctattctccctttttttttcccaaaacatcacattgaatctttggacacatgtatggagcattaaatatagataaaatgaaaaactaattgcacagtttgcatggaaatcgcgagacgaatcttttgagcctaattagtccatgattagccataagtgctatagtaacccacatgtgctaataacggattaattagtattaataaattcatctcgcggtttccaggcgagttatgaaattaatttttttattcttatccaaaacctcttccaatattcagtcaaactttcgatgtggcatccaaaaattttatctatatataacactaacacccagaaagtaaggcaagtggggtaagcgtaagccaaaacaagtcacgtcaaagaacctaagaagcacggcagtaccttcttctgttcatgcagatgcatttatgcatttccaactcgaatgtgtgccactgccagtgccactagcatatatcaaatcaacatattggctcgttcctcgaattcgagacaatcattgtactccaatcgctagaaaacaactttaaacactatttttattataatatatatatatataaacaataacaagtacattttaagactactctctatatatagtcccatatttttaagataaatattttagaaattattatagttgaagattctaaagtttgatctctttcatgtaaaaaacgacaagtattattaccccggatgagtagtataattacttttagagtttaaatttatcttaaaaattatagttatttcttttttttatcttctcatctcaacgaataataacagtctctcattgaatttgtatacctactttctatttttaacaaatcataaacttccaaaatttgtacacctattttctaatttctaccaataaaaaacttccaataatttatttaaaagtatttaagaatacttatattttactactgagagagtagtctgctacccacactacctgcctgaaaataataataataataataaaactgataccaccaccactaccaacatagcccctggtttttaccctcaaattgaaaaacgtggaataacaaggagaatttggtatcattaaattaaggaacaacgtaatttacttacatctccgaacctggtatcgataaattaaaggtggaacattatttttccatgtatttaacccagtaatccgatctaacacatgatcaattaggattactctccgagttaagatctaacgcgaaataactaaagatcatttcctattttgtgagaaattcccaacacaatctttcttttagaattacacagtacaacgcagacactcacaacgcacacgtactcacccatataaacatacgcacgcaaaccctacccctatgagcatcttcgaagactggccggcaaattctggagagattgacgaagtcaccacaggcgcctcgctgtcgacgggtacgtcgcctaccactgaaagcacaacgccgttaaatcctagaaaattcgctcccacggggagtcgaacccaggacctcaggtgctactgagactcttgtaaccattaggctacatgccctttcgcaatcttatttatactagcaacatatactacttatattgtacctaaaagtccccttttttatacattgtttagctatagtcctcctaggctgttcctttcccaactttctcaacttctactctttcgtttttcatacgcacgcttttctaaactgctaaacggtgtgtgtttttgcaaaagttttctatagaaaagttacattaaaaaattatattaattcatttttcaagtttttaagactaatacttaattaatcacgcgctaatggaatacaaccctattatccgtggaactccacctcccgaacgtagccctagtcaactatgcaaaataccatcaagattttagatcttctgtctatggatatttgatcaagaggagcaggtaaattttatacatttttttataagattaggtgaaaaacgacgaaaaaattgcaatcaatccgcaggcctaggccaatgacgtccaaagcttcacctttttttttatatataaaccagcttgatgtatatataaaaaaaggattttatcattcttgaaaatgtatcagaagaaaaagtgaagataccaacaagaaacggaacttacgcttaacttcgtcatttaaaattattaggaaaatagacaaaatatgatacatttcagcaccttccgaggagccagagctgtcagagtcatggtctcatggagcctagttgatttgccaagcaccaacttgttaaattagcagagggagatctcgactggtctctctgagtggcgactggccacctgctgatttgaatactactagtagttttccgtttttggcattggcagtattgtccggccgctgattctgctcacagaccggccatggccgccggcgtcctcatgacaaaaccgttcatggctgctgcggctgctgctctagtcagcttgctcgtcatgctgcgctgcttgcctagcgtcgtcgctaccactgtatctttcaactactccagcttcagcaacgcgagcaagaacatcaccctccagggcagcgcggcgctcgccggcgccgaatggatcgagctcaccaaaggcaaagggaacaacctgtcgagcggcggcaccatgggccggatggtgtacacgccgccggtgcagctatgggacgccgccaccggcgaggttgccagcttcaccacgcgcttctccttcaacatcaccccgaaaaacaagagcaacaagggcgacgggatgaccttcttcctcgtcagctacccgtcgaggatgccgtacatgggctacggcggcgccctcggcctcaccagccagaccttcgacaacgccaccgccggcgaccggttcgtcgccgtcgagttcgacacctacaacaactccttcctagaccccgacgccacctacgaccacatcggcatcgacgtcaacgccctccggtcagtgaagaccgaatccctgcctaactacatcctcatcggcaacatgaccgccatcgtcgactacaacagcaattcgagcatcatgtcggtgaagctatgggcaaaaggctcaacgacgccttacaacctcagctccaaggttgatttaaaaagcgccttgccggataaggtacccgttggtttatccgaggagacgggttcatgcttagagcatcattacctgcctacttgactcttgaacttgacggttgatcaaaaatgctcatcgggaccacattatgatggacgagtttgagacgcagccatctattgagcaataatgtgcattcagctgctattcaccatggtaacaatacttgtacaacgacgtggtagaaagattataagggatgaatacgaggacaacattgaaggccatgccttatcggaaaattggatggggacggggccgaggcggttcccgtaccacatacttgtcaacgcgacaaagagctttgcggcggaggagaagcttgggcaaggcggtttcggcgcggtgtaccgtggcaatctgagagagctcggcctagacgttgccataaagaggttcgccaaagactcctccaagcaagggaggaaggagtacaagtcggagatcaaggtgataagtcggctgcgtcaccgtaatctcgtgcagctcatcggctggtgccacggccgtgacgagctcctcctcgtctacgagctcgtccccaaccgcagccttgacgtccatctccacggcaatggcaccttcctcacatggccaatgaggtaattaattaactctcattaatactccctccgtcccaaaatatagcaatttttagctatgaatctggattttgggacggaggtagtatatcagaatctatttttttccaatgtgcaatcaacaaatgtcaattgaaattcaactgatcaactagcttggatattatcataggatcaacattgttcttgggcttgggaatgctctgctctacctccatgaggagtgggagcaatgtgtcgtgcaccgtgacatcaaaccgagcaacatcatgctggatgaatctttcaatgcaaagttaggcgactttggtcttgcaaggcttattgaccataacgttggggtacaaacaatgacccacccctcagggacgccaggctatcttgatcctgaatgtgtgatcacaggtaaagcaagcgctgagtctgatgtctatagttttggcgttgttttgttggaagtggcatgtgggaggagaccaatgagcctactggacaaccagaacaatagcctcttccgactggtggaatgggtctgggacctatatggccagggagtcgttctcaaggcagcagacgagcggctcaacaatgactatgatgcaaccagcatggagtgtgtcatggctgttgggctctggtgtgcgcatccggaccgatacgcacgtccatctatcagagctgccatgacggtcctccaatccaatggaccactaccagtgttaccatctaagatgcccgtgccaatatatgcaccgccgatggcctcgtcagaggggcaactttcatcatcgacaggaatgtcatcctcaagtttgacaataacatcaattacacctcgctagggtggcaagttttctcactcataggatatgtatagcaagacaacttttgtcatatctagatttttatccatacccacaagtcgaactacctgcatccctacacctcagttcctttcgcatactttagccggtttgaagggctcatcttcgttaattgctccgtacagtagtattagccatgtttggttcattttacatgttgtacatttacaaattgccgcttgaataggatgtacagctcgtgaggcaattggtttgctctttagagagctgcctaattggcaatatgagtaatgtgttcagtttacatcatgctttcagttttccaaccatttagttattttgtccagaaaacttttccttcaatttcctctccaacaatccaaccaaaccgtccatatctctgaccgtccatatctcttcattaattttctactgaagcagttcttatgcaatcgtctcaaattgtggatatttatgttcagtacatacaccggtgttgattgaacgctgaatcgagaacatcgaagcaaaattgttaacacacaaaaataacaacagccaattgtcagatttaagacataagagattcatgcagcaagcatatcgtccaagattgacatctctgctacttcacagagtgatcaagccaaaatttgaaagagaagagagttggttctgatagggtcagcagtggctttactgctgcaatttcctcaacaaaatctgataggcttttacggtgtttgcattccaaaaaaaggtatagatccaacgctccataatcataggtatcatgtaaaaggtatttaaccattggtattggtgcttaagtactaagggtaaaaatataattttactagtagagaaaaagggtagaattgtctcccaaattagaatcggtaccgcgtaggtactaccatacgaagttaacatttcccctttaccagctttacaggttattatttgcgtattttctcttttgcatggttttatctagatttacgttgtgtttgagttaagtcatttagccagcactagcattacaggttcttaagttgcatcattttatctagagttactccgttctttgatgttctcatttacgtggttttctctatatttatgttgtgttcttataacctgtacatgtcaatcagatcttgcctcctgttcaaatgctcgaccatgccagatcttcttcctcgaccgtgtctcctcatgggtgcgcccgttcgaacactagaaaaacaccataggaggagatctcgtttactatcccacaaaaattccagtcccttatataaggagtttatgaactacatgaataactaatcaactatgtgaataagcataggataactttcagatgcgctagattgagcctagtcatcgaccgggctatcgcattgtcgacgtttgatgtctcgactacggtgtttgggcaatatggagatcgtcggtgctagggtatacgcaagactgaggtaaaagagatggagacagggatttttatacaggttcgggcccctgagctatcaggtaatagccctacatcctgttggccggagccgatgttgctttttattcatgataatcacaccagtacaatgtttggggtagcctatctaactgttgtcgacatggcggtctgacgatctgactcgtagtcgacaacagggtagccttcctcctcgaatccgtgcccggcgagatcagagatagtgctttcgtctctcctgacagtatccggagacaccgtagggtactagccgtgtttatccctgaagtcgatatccggcggcgtgtcttagcgtatgtaggcttctatgttgtggcttctatgtcgattgtgttaggtgttgatcccttcatggtgggtgtatgttgattgtgttggttctccctggcgggtgtccccctgtcctcctaggggggcttgtatttatacccataggtgtccccttgtccaagtagaactagggaaaccaatatggatacaatccgagtagtccttgtcgtttccatgtagaactctggttatctttccttattcagaactccctcgaggttagtttccatataagacatggtatgtggtggatcctgccgagatttagtcaactactattaggtatgtggtatccataaccctgacacgcatctcctcaaccctcaaccatgcagacgcttttttctctgtctccttctagtgaatgttcaaaccctagaacaagaacgaagcgaaaggagagaagaatggagatgcgatctttctgtttattttggtacagatcgaattgatcgctgctaaatcaacagtgtatctgtgatttactttttttcctcacgacgtatcaatctgcataatgatatactgatcgatggatataggtattcaattcacgtataatgcccatgttttactagttaattacgtcatcatattataataactaggaagaaagcccgcgcagatgcgcgggcagttttatgaagacaattttttaaaaaggttatatctcaccatttataagccgagaaatatattgcatactttaatatatttaagtaataaggttatctcctagattaaataaaatcactttgcctctggttacatataaattttcttgt

SEQ ID NO: 48707 - DNA, 3510 bp, Oryza sativa
aagccgattgcagtggcgagactttctttgtccgttgccttgaaacataggtcccatatcgatgtagttgtgcacctccagactaacctggagcacaattttaatgcctaatttactatcacacccttatcgagttgtgcatcggtaagtagtaagttgagcactattggtgactgtggtctccactgggaccgccttaactcccatatgtacatccctgttatacttatagcaacgtagcaaactatgttattcatgcttatgcccttcatgaaaggaaaaagagaagatggaggtgatcaaaagaatgttttttttatgttttgagagtagattcatggtatagagtaggcaccacgtgtttatggtgttaaacattatgcaatttgaaaatgagcgaagttgtaatttgacggtactaaaagagaagatggaggtgatcaaaagaattttttttttaagttttgagtagattcctggtatagagtagacaccatgtgtgtttatggtgttaaatatttatattttgacaaacatctatagtttagcgcttggtttattttcaatacttattgttgataatgacatgagacacctttactaattcgaagaatatatttattttttttaaatttattaataataactaatgcgtgggagtatatgggagttttttattttttttgtatgatactatatacgtatattttttttggttctatctttttttgacacgatggctttattcttttaccgtacgtatgtaggttttattgttccttttcaatcttacgtacttactttttttttggcgaacctattctctctcgtatgtataggtggaaagtattagtattagagatatatatctaatctaatgatctaaataacggatccatcaatttaagtgaaaatcaacggtatagatatagatataatctaatggtctaaaataacgggtccaccaatttaaatgaaaatcgacggtgagattaaacagtgccacgtggcggtttaggagcgtttataagaatgccacgtgtcgtcttgagagtgtttgtaggacgtttaatggacttttagtatataatagatagatagatatattttgttccctaccttgcccctctcttgattaacggtacacattattccatctccaggtacctctaagtacctcgcaaacggtgtaaaaagtctcgaaaagtaattgaaagctcatactgtcagtagagagttcactgtctttttcaacacggtgacggtcgtgcgtgtatgctgcaggctggaactcaggacttaattcggtcttcgatcggttgtactagatgacatcaaagctcaaatttgcggagactctttactccacggccaaaggggagtctttaaagtctttctgcgatccggatcgaattcggatcctctgcggtggaggagaaaattcagaggttgctacagtacccagcattaggagtactgtgggccgtccgatcaagaacggacggatcagaccgttcgctacagtaaaacagtgcattgatgcacagtactttcatccctgtagatacagtaaatcatcactgtagcggtactgttctgtgcattgaaacactgtccccctcacatatcactgtggccacagtgcctctctgcggtaatgcagaggatccgaatccatccggatcactctccatcgatcgatcagtggagttggcacaatatagtttcagataagctgggccattgactgacctctgggctcttgttctgcgtcaaacgactgcatgaggcaaccctgaatatctctcaagtctgaacattacgatttacttacaattatgcatgtttctccgtctctccgatggatcatggagattgtagcagcatcgttaattttggggtattgttcttttcagctcggcatggacaattattgtagtccagctaggaaccgacgctgataaaccgacaattattagttaagtcatcgcaatgatcatttccggtgcgcaatccttttccgtattaaaaaaaaaaatccttccaagttccgacccctgcgaaccaacaagtacagaacaagcaattcaataccaatttggcacagttaaaccatacggaagaactaatagcatttatatgccgtgttaacaccagctgtgttacaatgccttgttagaccaaactgtgttgagtctctctgtgctgctcattgtacttgaggaaaaggtctttattttcttacgtcccttgagttaatccctctcattagagaaatgaaaacgaattatgaaacattaatttcacacctgtcaatccccatctcatgtggattaatcgagcaatgtctttaatgagatgacactcgttttcttacatgccatcaaatagttgtaaaattgtttttataaaaaaatatcataatgcgatatatttgttggattctaccttttcagattgaaaaacaacaaattttgtttcatcttgcatatttgtaaaatgatatcacacatttatctatgttgttgaatcttttaaagatttttctatgaatattgagacaacatatataaaagagtaaaatacacggccggtccttaaagttgagcgcgggtgtcacttaggtccataatcttgtaaattgcacatctaggtccaccatcttgtttaagtgactcattgaggtctaaaagacctctgaccaggttgactggcttacgtggcggtgcagcgtggcaacatatttgcattttgccccctttttgattccccgtgtccgatccaatcccttctttgcgtggcgcacgcaggaacgcgccgacggcaacgtgcgccagcacgcacacctgtggcacccacctgtctcaaccacgctgcgcccgctgacgtgcctcgtacccctctggcagccgctcgccggtgttgcgcagcgcccagagaaaccgcacaccgtcgtcgacgggaaggagaaggagcaggggaaggggaaggcccccgctctagccagccgtgggtgcacgcgacaagtggctgcggcagctgctcaagtcaagcttgccctgccgccatggagctcgcacccgcccagctcgcgccgaactcgccgacgcctcacccacacacgcggccgcggtaggcgacccctcctcccaggcgtggccggcgacacctcccccgcgcgcgccaagctcaccgacgcctctagcaccaacgaccagcgggaagggagaccgatggatctggctgtcagtgaggcgtgagcgccaccggcacgctagctacgaagactgtcacaccctgaaaattcaaaatatataaattgttgtttaattggaatttttagaaataattttaaaaagtcttgaaaagaagatctaatttttaattaataaatttcaatataaaatgggcccagataaaatttccttaaatactttgcttaattctataattcctagatttttctgggatttatttgagctaagaaagtatttttaataaatggaattg

SEQ ID NO: 48708 - DNA, 9095 bp, Oryza sativa
gcagaaggccaggattggtctcaccgcaagaagagagctctatttgtccctcgctatcaattggcgccaaaggttcgtgtggtggagaaagaagttgccccagctcaagcggatcctccggtcatcatcataagtgatgaagaagaagaatccaagcgcacccgttccaagattgagtgggtagcaactcaagatgatgaagacgagccgaacgagcctacaatcgacctccgatgcttggaagaactagagtgacttgttaagtcgttgtcttagatcgttgtgttagtttgcttgctttaagtttgcttgtgtgtgtctcgcatgtgatttacatcagtggtgggatgtaagtgcatgcgtttgtttgcttttgagtgttaggaagttggtgagtttagtggtgtgagagtcttcagtttgtaataatgaaactcagttaagatcaataaaagttaaagtaattctctatcctaagtagttccccggtttctcttcttgtgccctgttcctgccagatggtgaatactcgcagcaacgggaatggtcccaacaaccccaataacaataacaatggagagaacccaactctggcccaagttcttcctcaacagacacagcttatgaacatgatgatgcagcaattccagaatcagcagaaccaaggaaataaccatgtacctccccagaataagttagcagaatttcttcgtgtgaggccacctgttttctttagtaccactaatcctattgaagctggtgattggctgcatgccatagagaagaagttggatttacttcagtgcactgatccggagaaggtatcttttgcatcacatcagttgcatggctctgcctctgaatggtgggatcacttccgcctgaataggactactgctgaacctatcacttggcttgaattcaccgctgctttccggaagacgcatataccatcaggagtagtgtctctcaagaagaaggagttcaggtcgcttactcagggatctcgctctgttacggagtatctgcacgagttcaatcgtcttgctcgttatgctccggaagatgtgcgcaatgatgaagagcgccaggagaagtttttgggaggacttaatgatgagctttcttacccactcatggttggagattattctgatttccagaaattagtggataaggctatacgtcaggaggacaagtacaattgcatggaacagaggaaacgtcggattgctcacttcaagggcacaacaggggagtaatcaaaagccgcgtcttactttaggaccccagtctatgccacagggaggttcttcgtctgttgttcgtccgccgcgtcagttcttcaacaacaatgctggcaataacatccgcaatcaaactccacgtcctgttgcagctccaacacagcaacagcctgccaagagggagcaaggcagcaagcccgtggtgtgtttcaactgtggagacccaggacattatgctgacaagtgtccgaagccccgtcgcgtgtaggttgtccctgcccagagtaactctgctgtaccagcatcaaaggcccgtgtcaatcatgttgctgctgcagaagctcaagattctccagatgtgattttgggtacgttccctgttaactcagttcctgcaacagtacttttcgattcaggtgctacacattcattcttatctatgagttttgcgggaaatcatgggatggaagtagaagatcttagacatcctttgatggttagtaccccaagtaatcaagcactctctttgcaacgtagcccctcggtcagaatagaaattaaaggagtaccatttctggccaatcttatcttgttagaatccaaagaccttgatgtcatcctagggatggactggttagccagacatagaggtgtgatagactgtgccaacagaaaagtaactctcaccagcaatgatggtcgagttgtgactgttcatgcattgtcttctgagtctttaaggtcaagactgaaccagataactttggaagagattcctatagtccgggagtatcccgatgtgttcccagatgatttacctggtatgccgcccaaaagggatatagagttcagaatagatctggtaccaggaacaactccaatccataagagaccttatcgaatggcagccaatgagttggcagaagtcaagaggcaagtggacgatttgcttcagaaaggatacatcagaccgagttcatcaccatggggagctccggttatttttgtggaaaagaaagaccatacccagagaatgtgtgtggactatcgtgcgttaaacgatgtgactatcaagaataagtatccgctgcccagaattgatgatttgtttgatcagcttaaaggtgctaccgttttctccaagatagatcttcgatcagggtatcaccagttgagaatcaaagaggaagatatacctaagacagcttttaccactaggtatggattgttcgaatgtacggttatgtcttttggacttaccaatgcccctgctttcttcatgaacttgatgaataaggtgtttatggaatacctagacaagttcgtagtggtctttatagatgacattcttatctactctcgaaccaaagaagagcatgaagaacatcttcgccttgcattggagaagctacgagagcatcaactgtatgctaagtttagcaagtgtgaattttggttgtctgaagtgaagttccttggtcacgtcatctcagcaggaggagttgccgttgatcctagtaatgtggaacccgtaaccaactggaaacaaccgaagacagtttcagagattcgcagttttctaggcctcgcaggatattaccagaggtttatagagaatttttccaagattgctaagcccatgacacgattgcttcagaaagatgtgaagtacaagtggtcggaagaatgtgagcagagttttcaagagttgaaaaatcgcttaatatcagctcctattttgattttacctgatccaaagaaaggtttccaagtgtattgcgatgcatccaaacttgggttaggttgtgttttgatgcaagatgggaaggtggttgcctatgcatctcgtcagttacgtccgcatgagaagaactaccctactcatgatcttgagttagctgcagtagttcatgcgttgaagatttggcgtcattatcttttcggtactcgtacggagatgtacaccgatcacaagagtttaaagtatatttttactcagccggatctgaacatgagacaacggagatggttggaattaattaaggattatgacatgggaattcattatcacccgggaaaggctaatgttgtagcagacgctcttagcaggaaaggctattgcaatgctaccgaaggacgacagttgccattggaattatgcaaggaatttgaaagattaaatttgggaattgtcagtagaggtttcgttgcagctttagaagcgaagcccactctaattgatcaagtcagagaagcccaaattaatgatccggatattcaagaaatcaagaagaatatgagaagaggaaaagctatcggtttcttggaggatgagcaaggaactgtatggttgggtgaaagaatttgtgttcccgacaacaaagacttaaaagatgcaattctgaaagaagctcatgatactttatactccattcaccctggtagtactaaaatgtaccaggatctcaaggaaagattttggtgggcaagtatgaagcgtgaaatcgcagaatatgtagcagtatgtgatgtttgtcagcgagtcaaggcagaacatcagaaacctgccggtttgctacagcctttgaagattcctgaatggaagtgggaagaaatcggtatggattttatcactggtttacccagaacgtcatcaggccattactctatttgggtaatagtcgacagacttaccaaagtggctcatttcattccggtaaagacaacttattctggaagtcgattggcggaattgtatatggcaaggattgtgtgtttgcatggcgtccctaagaagatagtgtctgatcgaggcagtcagtttacttcaaatttttggaagaaacttcaggaagagatgggttctaagctgaattttagtactgcttatcatccgcagacagacggacaaaccgaaagggtgaatcagattttggaagacatgttgagagcttgtgctttagacttcggtggaagttgggataagaatctaccctatgtagaattttcgtacaacaacagttatcaagctagtcttcagatggctccttacgaagcactgtatggtcggaagtgtcgcactccgcttctgtgggagcaaacgggagaacgtcaggttttcgagacggatatcctaagggaagcagaagaaaaggtgaaaatcattcaggaaagattgcgagtggctcagtctcgtcataagagttatgccgacaatcgccgtagagatttgagttttgaagaaggagattatgtgtatcttcgtgtcacgccttttcgaggagttcatcgttttcacaccaaaggaaaattggcaccgcgttttgtgggaccctataagattgtcagtagaagaggagaggttgcttatcagttggagttacctcaatctttggcaggagtccataatgtgttccatgtttcgcaattgaaaaagtgtttaagggtacctaccgaagaagctaatcttgaacagatagaagtccaagaggatctgacctatgttgagaaaccaatccgtatcttggaaataaatgagagaagaaccagaaatcgagttatccgtttttgcaaagtccaatggagtaatcactcggaagaagaatcaacttgggaacgagaagatgaattgaagtcagctcatccacatctgttcgccagttcttccgaatctcgaggacgagattctgtttaaggggggtaggtttgtcacaccctgaaaattcaaaatatataaattgttgtttaattggaatttttagaaataattttaaaaagtcttgaaaagaagatctaatttttaattaataaatttcaacataaaatgggcccagataaaatttccttaaatactttgcttaattctataattcctagatttttctgggatttatttgagctaagaaagtatttttaataaatggaattgcatttaagaaataatttaaattgaaaaaaggttttaaaaagtcttcttttggctttgggccgaaagtcggcccaaaacctctcttctctctcctcggcccagccggcccagtccgccgcagccgcgcgcgccctcgctgtcgctgacaggtggggcccacctgtcagtcgtcgtctaccttcggccgccgccaccgaaaccctagtttcgcgccgccgccgtttccttccaaatccggccgcccctttccttctccggccgaatcaatagaggggaaacaatctccgggatctcctctaccttttctcctttggaatcttcggctaaatcggtttggaatgagttggattcgagttcgtctcggattcgttcttcccgatctttccttcctcgtcgccggtcgccgtgggccttcgccgccgcctccgagcccctttaaaaggacccccggtgtttcctctacccgtcgccaccttcgccttcgcctctcgtcgtcggaatcgctctagcgccgtgtgccctagcttcgccgtcgccgccgccgctccagccgtgctccgccgccgttccagacgtcgccgtcgctcgggaagaccgttgtcgtggtcgccaagtcgtcgccgtcctcgtccgccccttcgccgtcgccggagatcgtcggagcttcgtcgccgtcgacaacccgaaggtttccgccgtttcctcctcgtcgccgtcgtcgttcgttgtttttccgccgccgttttggtcaccggtgtgttcgccgcgtcgtcctctacgtgctggtgccctccgtttgcgtcctcgcgccgccgttcgccggcgagcgtgcgccgcccgagccgtccgctccgccgagccgccgccgctgtcggtgacgtcattgccgacgtcatcggggtcgtccgccgtgagccggtcgtggaccgttcgatctcggccgtccgttttggattggatcgatctcggccgtccgttcgcgtgaaccgccgcccatgcgcccggtccaccgaaaccctagccgctgacgcaataatccctcttttccttttcaaaaataattcattattgcgtcataattcaattttaaccgatttaagtgttttaatccgatttaatcttcaaaaattcataactaattcatcttagctccgatttagttggttcaagtctctaaatttttctaaaattgagatctacacattaaaaatatccacatgtactgttcatgcttgtttatgtgctgttttggtgattttgctcttttctgcttagattccatcgttttcggagagtccgttttcgccggagaagagcttgaagagttccaaggccagcaaggcaagtcacacagatcccaaacaaccctttgagcatgttgatcatatttaaagctattgtttcttttcaactattgcatttattttcgaatgtcattaggtggaattaacctattgtttgttatagcccttttgttcttgattactttattccttgataccttgggttataatttgactagttgagctttatttatattggttcaactaaatattagatataattgcttagccctgcttagaaaccttagcacatttatgggataacttatgattcactattatttcatgatggcttattgatagttcacgatggtcaatcgtgattagttaattaattaatgtgccaactaaaacctgataatggtgggttgtgagcacatggttttgatggtcgtgctcatgacaattaaggaccggttcacgagtttcggttgtgaaacattaatcgtgccaaccacaagccagcatgggcaacggctttatcttttgtatagcatggttcgttgcggggcaccagactgagaagtggcggagataagcccacgggggtcgctggggagtccatgccttgtttataagggggtgattatgatccaggaaggtgcgctgcagtggattgtgttatgcgaggggtattgtcacaactcctttccgaggtaccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacccttctcaccatagtaaatgatgctataattggtaataatttgattagctcctggtttggaatggtacattcctggtttggagatagaactgtgcagccgggatggttgttcagaatggttgggcctatacaacagggtatgttgtatagcgttggattaatattgtttaattacttaactgttttattaaattctcaaatgtttgctaaatgctgcttttgcaaatgaaaccctattatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttattttattttccgctgcttagatctctattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcgtgacaagttggtatcagagccccttgaccctaggttatgccaaatggttacccatagaagccctctaaaaatattggaaaaagtagaactgttctcctccctttctcttttaattaaaccaaaataatggcacatgcatttcagcaaaatttcataatctcttttaatggttctcattcaaaatttattccagtgttattattactgtacatctattactgtactaatggctcatttaccagcaaaagttttacaatgttgttttatttaatcttgctgcaataaaataaatttagcatgttgattttataactttccttttatttcttttgaaacctgttattcaaaagcacaaaatttgtaaccttgttttcaactatttcaaattatcttgcaagtttggtttaccttatttacttaccttttactttgattttcaaattttattcaagttaatccaaaaacttgtgctgttaattggatagatgtcttaactctctcctttcacttgtctttagatgccgcgctacaagcctgagtacctgtttggtgttgagggttttgtccaggagttgcgtacgatgtcctttgccattggatttgggactgcccctttttatgcccagattcctcatgatcgtcatgaagagaagtgccgagtcaaagtcaccttaaacagcaatagtgaagatgtcccctcagtgatgttcgaagctggaggaagaaactacatccatgcatgtcaggaagtggcaaggatcgccataggagagctccgtgatcgctacagtgatcagttggccgatactgagtatcgctaccatcctcgtcaaccccagggaagtgaccgtggcagttaccttgagactgaaggaattgagaatgatgctaccacaaggcatttggttgagatgttgtgggctatggatgaaagtcgtgcggagactgtgttagcggctcaagatcgtgaagaccggaatcgtggtaagatttgcaagttagaggacaaggtggatcgtttggagaaggaactcgccgcattgaagggagaagcaccgccgcagaaggccaggattcgtctcaccgcaaggaagagagctctatttgtccctcgctatcattggcgccaaaggttcgtgtggtggagaaagaagttgccc

SEQ ID NO: 48709 - DNA, 10742 bp, Oryza sativa
gtatagcgtggattaatattgttaattacttaactgttttataaattctcaaatgtttgctaaatgctgcttttgcaaatgaaaccctattatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttattttattttccgctgcttagatctctattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcgtgacaaagacagtgacggcgctccgcaagctctcctctagttccctccgtgtcacgcccagaaattcacgaaccagaatttctaagctgaatgtgtattaaacccctgtccaggaccagccagggtacacaaatgacaattgttgacatacatatccacgttttacaaaaatataagagattacaaatgcagcggaaaagataaaagcgagctaagcctgaagacttgactcctgcagcggacgactccattccacaggcatccttgacggcagcgacgaaaccaacctcttcgagacatcttcaactgagaaggacttcaactctggtgtgggggaaaagagagcaagactgagtattacccactgtactcagcaagtcataccggaagaggaggtatgatgcagggtatatccaagggaggctaaaggttcttttgcatgaagctagcatttaaaagcagttgttgaaagcagtaaaacaattgcgttaattaatcaatattaaccaatcactgctcaacgctacaccacgttgagacaggcccaaaccaccacctgaactaaccagttccaaaagataactaggggtgagactaatcacggtgaatctggtcgaccgcccataaccgcgggcacggctattcgaatagttttactctgatcagaggtgtacaactgtacccacaagacacagccccacgacacgttcctgtgcgccgacatgccaccacaacataccggaaagaggccgtgacaggacccttcgcataaccccctctaaccgatcgcaccacaccttagggttcgcccccgtccccagcaggcaacgggcagcccccctttcgtgcctcggtgaatccggaagccgatcaaccggacaccccggccgacccaactccatcacatccaccctcgcctgggtacgtcggctagagaaaagctacactacaagcccagccgttgcccacgctggcttgtggtaagtacgataagttcttccagggcatcccgtgaaccggtccttaattgccatgggcacgactagcaaaaccatgcacccacagcccaccatgacgtgtattttaattaaccaataccattacggtggcaccaaaccaaagctatgccgataatcaaagtctatgctttaatgtgattccctttttgtgtactagtagaactaagcatggctaagcatttcctaaaccaacatctagtcattttaatacccaagttatcaatggcgtaagggaaacaacataaagctgagtaataggacccatcccacatgatattgtaaaacgatgcaatatttaatagaaatacaggacatttgtaaattgggtacaatatgctcaattgtaatgtatgacttgccttgctctcgcactgatgagaccacagcaacgtcttcgagaaaccgcgaatcgacgaaacggccgaaatctacgcgacaaacaaagcacaccagcaaaacatgctataagactactgaaacaggaaacaaaaccatttttaatggattctacacatttttatgaatttactgagacttgaatggacttaatcggagctcggatgaattagttatgatttttagaagattatctgtgtttttactataaaagaaaaacccttaatcaatttattgcgcaataattcctcccagggctgacgtcagcaaggggtggggcggcgccgacatgcgggccccactggacagaggcacaagagagagggagagggggcggctggcaggcgggacccaccgggcggcggctcagggggggagacgcccggtcggctcggctcggcctcaaaccggccgaccggttatggcgagggcggcggcgcgcgagcacggtcgccggcgacggcaaccggcggcgggaggcggcggcggacggcgcaaaggcggcggcggcggcgcgcgcacggaggcagcggcgatagggagctcgggagcggacggcgaaagagggaaaaaggtggagagaggcgcggtggtcggttatatagaggtggggaggctggacgtggccgggagcggcggttccgcggcgacgacgtggagaggtggaggaggagagagagggggagaggattcaaatcgaatcccgtccgtgcgggcgcgcgcatggacgggagagggcagggcgtggggcggcgacgtggggacgtgtgggcgcggagtggggcgcggatgcggagtaagcggcggcgtgggcggcggtttcagcagcggatggtggcggctgccggaggttagggacgaccgacaggtgggccccacctgtcggcgcccgggaggaaaggggaggtgggctggacttcggggaggggaggtgaagcgggccggcgcgggagggaatgggccgggctcaagaaaaaggaaaaaggagggaaaagaaaagataaaaaggaaaaaggattttcccagggatttatatattgcacatgctcatttttaattggttaaaattatttccaatgctctgaaaattccgctaaaaatcctgttagcgtattttgacatgtagaatccaagaaaaattccacatgccgaatccgattattatttgcatttattaatttagggtttctctcttgcctttaaacaaataatttcttccaaccatttattaattgaatttttgctagggaaataacttctgggcgcccgtcgccgctccgctcgcaccccgccgccgcgcttgccctccaccgttccgcccgccgcccattcgtcaagaaggatttgaggtccacgacggcgcgacgtcctgatcttcgagctcgtccgccgctcgcttcatcccctctaatactgcgtcgttggcaatcatgcgtcgcttcgtcgaggtccacgatagcggcggcggaggacactgatgttggcgaggcgaggccggagaacgtgacaagcgaggcggtgcagccgtggtgtgcgactaggcgctgcaacagctcagccatcggtatgacatggccggcgaaggggctgacgatgaggatgacgtgcggcggcggtgggcgatgtgacgacggaggcagctgagggatttgggggttctttttggtgcccagggctctactgaatgcaatgtagatggttagcttcggtcaaaccgggtatggaccttaatgagtcacttaaacaagatggtggacctagatgtgcaatttacaagattatggacctaagtgacacccgcgcacaactttaaggaatggtagtgtattttactctatataaaaaaagaggggcgatcctaaacgtagaaaaaaccacctcctcctattatgctatgaattatcttaagaaagataattcatagaaaaaaagctgctcatgagaatatagaaaaacatgctttttctatcttgtggcttctaacacattattttaatttcatagttatattgatgggaatttaggtgaaaaatttctaccgtctagagagccataaattatggaaaatgttgtattactataaactctcccgaacaaggacgaaggagtgcaagcagcttaaaatccacataacttccttaacgcctcgttattttctgattaagttacagatcttacccactactacaaaacattaaataggtgttgccactatagatactgaaagtactaaaaccagcacctataggccttttccaatttccgcgggttgaaattgcaaaaaccggcacctttaagcaattataagtgccggttctaaataagaaccgacacctattctataggtgtcggaccgacacctataatatattataggtgccggttttttaaaaaacgacacccacagaaatctagccgaggcggcatcggatgagccaaccagcgggccccaccacaacgaggcgaggaggagataaggttcgctctcgcgtcatctcgctctcttctctctctccctcccttctctctcatctctatcttctctctctccctcccttctctcccgctaccggcggaggcggcagcggcgaccgcgcccttccctcgctagatctagcgggaggggaggtggcggtggcaggaagggaggcggtagcagggatcttgaggggagcccgtggtggcccgacggccaggggggaggcggcggcaacgccttcccctccgctagatccggctggaggggaggcagcggcgcctccgctccaccagatctggccgggaggggagtcagcaacggctcggcggcggcgggaggggcggcagcagcaagtggcgtggctcacaggcatcggcggcggcgacctcccatctgccaaatccggcgggagggaaggcagcagcggcggcggagccccccctccgccagatccggcggggtaggcagcggcaacgacagtggcgggctcccttgtctcttctaccactggtgagcacccccaaccatctcctttgcttgccggctgtgtcattgttgatgtttgattcgatgattcaataatgtttgatgtttgattcagtgatttaaacttgttgatgaatatttgattgtgtgatgtgtacttgtctttttttttttgatttttgatttttttttttggctttaaagaattggctcgactcaaatcgagccgatcgggcttttttttttttttttgcaaatcgtatacctcaaaggtgtcggttcctaaaccggcacctttgagtcatctcatcagtgccgccttggtggtgctggttgggaaaattggcacctaaggggatttcccaaccggcaccgaaggctctttctgtggtagtgaccctggttttgttagcacgtttttcaatctgctaggtgtatttcgtgcgaaaactttttatacataatttaagttgctttaaaatatcagataaatctattttttaagtgtataataattaaaagccaattaatcatatactaattaatggatttcttgttttcgtgtcctagctacttcatctttagtaaaaacgagcatcaccaaactatgttccccggactggttggagagtggatatattttaaactttcgagaagacgttcccttgttgtttacatatcactcaaaatagttattaaaaaatttaaaagatatattaatatataatatatcagtatttaaaattcaacttttacaagttgtaaaaaaaaagtacagctagttaatgtatattgatagtcattttttttttgcaacatgtagaagttaaatttaaccttgcatgtttgtttggtgatctatcatatattaatatatcttagtgactttttttaaaaaaaaaattaactatctttatataataaaagtccattaaacttcctacaatcactctcaagccgccacgtggcatcctaaaaatactcccgagtcgccacgtggcattctaataaaatagagaaatctgaccatcgattttcacttaaataggtgggcccattattttagatcgttagattatctttaaagaaaaaaaaccccctgccgtccctacctccgtgcaggatgcgtattgtacgctccctatcaccccttctttttttttctctttgtttctttcttctttttttatctttatgaaaaaaaatccctacaaatagacatcgtacgagtaagtccattaaacttcttagaaacgcttttaagccaccatatggctcctacaaacgctcttgagtcgccacgtggcgctctgataaattagagaaatctaagaaattccaataaaaaaaagaaaaacatcgtaccatttattttctctttacacaccattagatctatatatgtaaaaaacaaatgtcacgtacgaccacacctctccctaggtccctcatctcctaacatgtacgtgcatccaaagtacgtatgtctccccacccctctcttcttccttccatttatggtagcaaaattttgtatataaaaaacacaacaactaaataattagaatatcttataatatattcgattttaatttgaactatgtttaccatattttggtatgtacatatataagaaacatatcatttgacataaacccctttatcgcaactaaatagtaataaaatattacaaaaagtaacatatatcatgccattgtaaatgatctcctattatctctcgtgctcactttcttatccatattttctagcgagcagttcagtacataaagaaccaacaaatgctatattaactatctattatatacttaaaaattcattaaactccctacagatcctcttaaactgtcacatggttttctacaaacactcatgagatgccatgtagtgctcaaataaattaaaagttcctagaaattatgataaaaaaatcaaaccattgattttcctttaaataggtagatccaataattataactgctacatctcacaaaaataaatccggtacccccacctccacccctaccgtatgtgagcatgcatgtacgtacgtacctccaccgtcctactcatctctgggatccaattctcatatcctatttttaagataacttttcctattttctacctagcacataatatatagaaaaataataatagctaaatgatcatgactctcaagttacatgtacttttctcagtttatttgactttttgtgttatttataattaaattcaagacccatattgcacatatttactatatataagttagataatactgctatctaactacaaatatttgagcaaaatagcacttcgaaaatgatgaatgaattcaaatgtgtgggtctaaagtccaagttcaatcatcaccaaagaagcttggaaccagaatgcacactctgggcctgaacccgatgaaggcggagctataagacattattagcaaggtggacactgacggcagcggcatcatcgacttctacaagttcctggacctaatagcgcactaaatgattagatgaaggacaaggactaagaggaggggaccagagggagacgttccatgtcttcgacaaggactagaaaacagcttcatctttgccaccgagccccaccacgtcatgtctaatgtatcaagagaggctcactgatgaggaggtcaacaatgatccgcaaggctaatggtgacaggtggatcaccacaaggagtttgtaattaaattcagaacaaaaatataaaacaagcaatttgattaaaatacacaaacaaaaaataaaaaacactaaaactataaaaaaaaaataacaagattccatgtagaatataaaatatcaagagtccctataaaagtataagttataaatatctaaaatttggaataataaaataagtattaaaaaaagagatcaaatacagcacgatatgagattaagcgcaatttaaaatccctaaaaagacaatttagaataaagtaatttgatttgaatacaaagtcgaattaagaatcactcaatcactaaattcagaatacaataaatattttttaaagaatttttctatctttattgattcacatgcataacaaattgcatatatatgaagcaattaaagagagggctagcagaatggtaaaaatatatatttattaccaatgaaagtttatcgagatttcttcacgaaaaagagatataataaatactcaattaacagtagagaatacattactttaattttggatagactagttcttccatgctttgcttgctctcccttgtgaacacagagtacactcctctaaactaccaagtctcacttaagtcgacggcctccacacttcagtgaatccactccccaattaggaagactctacgcactgactcgttgctccaagtcaagctggtatcaccgtgcgcaccgacgccggccggccgcggcggcgatggctggctttccgctgatcacatcagcgatcacttgcgcagtgggcatcatcttcttctccgtttgctacctgcatccggcaccggtcgccgccttgtacttcaactactccaccttcagccaggacgacgggaacaccatcagactcgaaggcgacgcctccttcggcgacgggtggatcgacatcagcgccaacaggtacggccacaggggacacagcaaaggccgggcatcgtacagcgcccggccgatgctcctctggagcagggacaccggcgaggttgccagcttcaccacgcgcttctccttcaacatcaccccgcccaaagaggacggcggcatcgacaacaagggcaccggcatggccttcttcctcgccgcctacccgtccatgctcccgagcggggtcgatgagctcggctacaacatcggtctcaccgaccaaggcccggacgccgtggcgactggcgacagccggttcgtcgcggtggagttcgacaccttcaacaacaccatggtgcacgaccccgacgccacctacgaccacctcggcatcgatgtcaactcagtcgtgtccaacaagaccttgaccttgcccagcttcaccctcgtcgggaacatgaccgccgtcgtcgagtacgacaacgtctccagcatcctggccatgaggctgcacctcggctatgggcttagtggcccccgtcaccggccggattacaaccttagctacaaggttgacctcaagagcgtgctgccggagctggtctccgttggcttctccgcctccacgaccacatcctttgagctgcatcagctgcattcatggtatttcagctcatcgttggaaccaaaggccgcggtgcgtggcagagttgtagcgggagccaccgttggcacggtaatgttcgtcatactcctcttcgccatggtagcagtccttgtacgacaacgtcagagcaagaagagggagacagaggaggcaaagaacggaggcatggatggcagcgacgacgacgatgacgacgacggcgagaccatcgtagagatcgagatggggacggggccaaggcgatttccatactacgaacttgtcgaggcgaccaagagtttcgcggcggaggagaagcttgggcaaggcggtttcggcacagtgtatcggggctacctcagagagcagggcctcgccgtcgccataaagagattcaccaaagattcctccaagcaaggcaggaaggagtacaagtcagagatcaaggtcataagccgtctgcgccaccgcaatctcgtgcagctcatcggctggtgccatggccacgacgagctccttcttgtttacgagctcgtccccaaccgtagcctcgacatccatctccacggcaatggcaccttcctcacatggccaatgaggttattaactcttgctaattttgtcttaatctttgtagtgtcaacttaattggcgaacatattgtcaaattttactcaggtttacgaacttgctaagtgcacatcgagatctctaaacttggtttagagtatcatctcggtccaaagccgcgtttgaccgtgctcttgcctatgtgacacgccacatagacgatgacatggaattttttttctcctttttcttttttttttctcctgcgcaaccgaatcgttaaccatgttcccttatacagtttcgcatactcgttcgtccagttgttagttattcacaggctgtcgcacgtgtggaacgaagaaggaaaaggaagtatccatgtgctttcctgatgggccacccttacctttcttctaaaattcatcatcatgtctccacactactgccactgcaaacagtgtacgcattgactcgatcaatcaacggggagggaacacaacacggcggccatcgatggccggcgttttgcagatcacatcgtcgacgaccaccacgaggtacaatattgtcggcctcatcttcttcttctccgtcttctgcgacgatctctactcgccggctccagtcgccttggccttgaccttcaaccacaccaacttcggcccggacgagcagacgaacatcaggctggaaggcgacgccgccttcagcgccgacttctccttcagcggcgacggcggcgggtgggtcgacatcagcgccaacaggcacggcagcatcgaagacagccgtggcagggtgtcgtacgcccttccggtccctctctgggacgccgccaccggcgaggttgccagcttcaccaccggcttctccttcgtcatcaacccgcccaaacaggacggcggcatcgacaacaagggcgccggcatggccttcttcctcgccggcttcccgtcgaggctccccggctcctacccctacaacgtcggcctcaccaaccagaccgccgaccaggtggccgccggcgacgaccggttcgtcgccgtggagtt

SEQ ID NO: 48710 - DNA, 12208 bp, Oryza sativa
tcaggaagtggcggggttgtagcgggagccaccgtcggcgcagcactgttcgtcgtgctcctcttggccatggtagcagtcgtcgtactcgtacgacgacgacatcagaggaagaagatgagggaggcggaggaggcgaacgacgacgacgatgacacggaaggcgatcccatcatggagatcgagaacgggacggggccgaggcggttcgcgtaccatgtgctcgtcaacgcaaccaagagcttcgcggcggaggagaagcttggccagggcggattcggcgcagtgtaccggggctatctaagagagcagggcctcgccgtcgccattaagaggttcatcaaagattcctccaaccaagggaggagggagtacaagtcagagatcaaggtcataagccgtctgcgccaccgcaatctcgtgcagctcatcggctggtgccatggccacgacgagctccttcttgtttacgagctcgtccccaaccgtagcctcgacatccatctccacggcaatggcaccttcctcacatggccaatgaggttattaactcttgctaattttgtcttaatctttgtagtgtcaacttaattgacgaacatattgtcaaatttaactcaagtgatcagctaacttctattttgtcacagggtcaagattattcttgggctcggatcagccctattctaccttcatgaggagtgggagcaatgtgtcgtacaccgtgacatcaagccaagcaatgtcatgttggatgagtccttcaatgccaaactaggtgacttcggacttgcaaggttcattgatcacatcgtggggatgcagacaatgactgcagtctctgggacaccgggctatgttgatcctgaatgcgtgatcaccggcagagcaagcgcagaatccgacgtttatagcttcggcattgtcctactggaggtggcgtgcgggaggaggccgatgagcttactagacagccagaagaatggtatcttccggttggtcgagtgggcttgggatttgtacggcaagggagacattctcatggccgctgatgagcggctcaacggcgactacgacgcggcggagatggagcgtgtcattgtcatcgggctctggtgcgcacaccctgatccgaacgcgcgtccgtctatcagaaatgccatggctatgctccaatccggtgggcaactgccagtgttgccggctaagatgcccgtgccgatgtacattcctccagtggtctctgtagatgagctcttcacgtcgcctgcagggatgtcatcctcaagtgcgacgcagtcatcaacaacaacggtgagtggctacgcaacccacatctcgacttcttctgacacatccacttcagctggttcgaaggactcgtcttcgttgctcaaacatcagttctagtaatgttcagttcatttgagttgttcttgattttacagtagttgatgcttggatgggatgttcagctcgtcagcgcccgttgatttgatctttagacttttgcttaattgccggtgtgagtaatctggtatttacgccatgctttgaacttttacagtcattttaagtttgtctacaaatatgtatgtataaatgtataatgccacatttctattcattcagattgccgatatacctaacagctcgttctttcgatcgtccgcttgctagaagccagttaatgttctgggcctcaggcccattagtagagtaggcctccatcctccttattgccttcaccatcaggcccatagtacaaagttaggctgggccatagcctgcaggcaaagttgctttaatcaattcctagtgattttgctatatactgtatttattagcaaattttctcccaaaatattgacatgtaaatataatataattatagtgtaactacatcgttagatttgcttcaagattcgtactaacgagagaaaaaaatcacaccgcatacacatctggggattcggtcacatgacctccattttatagaaatagcatattactaagagatttttaaaagttacatacaagttaaattttagttttatgtaaattaaaatgtattgtactatttattttatctaccaaaatttttgaagaaaatttataaacgaatatataggtagtaccattagaggaagctattagcagagaccttgagacattgactggtctctcttgagtagatagatatatatgtactttttttttccagcatcactctcgatcaatcagtggatggctacaataattttagataggatagtgctagtccttgacttatggtctcctgaaagcaactactacttgctactacaatagtttcagtcttcatataggctcctgtagtccttcgacttgcggtttcatgtgcattgcacctagctctactatcaatggtgattggtgatcagatgtgtttgtgttttggatatatatatctagatatcggtgcctaactttatacggtagtataattttttaaaggtagaggacaacaataatttatactatcaattattcaaaggatttttataactttgtgtcgttagaacgaaaccagtgcacgtgcttaaaatcaacatcagcataggctcattatattcctcgaagtctagaaaattaatcaaaccaatgttcatggaggcaatggttaattttcagtcacaattttgagaagtttgggcgcaccataaaaaaaataaaatacaccagcagttcttaaactagttaggaggtttcactcaggtttacgaacttgctaagtgcacatcgagatctctaaacttggtttactgtatcatctcggttcaaagccgcgtttgaccgtggtcttgcctatgtgacacgccacatggacgatgacatggaattcttttctcctttttcttttttttttctcctgcgcaaccgaatcgttaaccatgttcccttatacagtttcgcatactcgttcgtccagttgttagttattcacaggctgtcgcacgtgtggaacgaagaaggaaaaggaagtatccatgtgctttcctgatgggccacccttacctttcttctaaaattcatcatcatgtctccacactactgccactgcaaacagtatacgcattgactctattaatcagcgggggagggaacacggtggcgatcgatggccggcgtcttgccggcaaccaccacgacgaacaatattgtcgggctcatcttcttctgtcagatcgtcatctgacagtgctgaggaagatactgaagaagaactgagcttggaagcagagcaggacgatgatgagaagatgcaagctgaagctgaagatgcagagcagggaggagttatggaccatcaacccgcgttgcggcgcacttcaaggactgtcaagcccaacccactgtaccatgggccacagtgggccgtgtaactgaattcgttgtaacagctgtctaacagctagcgtgtcgcgtatgctgtacgttgagagcgagagagagaactatatatatgaattggggatgaactagagaggaggacttttggcaatctggtggcgaaggcggcggaaggctcaatcctgttggattggtgcataatacatcagtaatcgattgccatatatcttgttgctgttctgtgattgttctagttagattagatcctaacaatctggtatcagagcctcaatttgtctcgaaatcctcttgattttgctgtaaaattccttgcaagggattggaaccgacttcggttggattccgcgaaaaggaaacttgcccttctaggttagcgaaattcggagagtagacaagttcaggcctcggatccaggagtagcgccatggatacggatgggaagcttgatgtgttgctcaagttggtggaggggaacgagaagaagcgggtggaagcggatgagtgtacgagggcggagtaccaagagctcaagaagacggtggaatccagaattcctgtggttgagaagaaggtggaggtgttgagcgaggcgttgctcgagctgaatctcaaggtgaaccgcttggagggatagatgcagaggacagttaaggaagaagttcctcaaggcaaggttgctgatccgaaaccgaccacaccatctggtatgcgagatcttcacctgttttcctctgcttctactttcggaaacaattctaggaagtctgatcaaggaggtgaaattcccatggacattagtgctaacggtccacccatggtttgtccacaattcaatggtgataaccctcagatgtggaaatcaaattgtgagcaatattttgaagtttatggcacacatcctatcaattgggtaaaaattgcaaccctgaatttcgtgggcaatgctgcgttctggatgcaatctgttaggtctcaactgcagggaattacttgggtggggttatgtgaattggtgtgtagcaggtttgctaaagataggcatcaggcactgattcgccaatggattcatatttctcagactgggtcagtgagtgagtatgtggaaaaatttgatgggttaatgcaccaactaatggcctatgattcatcattagttcctgtttattttttcaccaagtttgtggaatgattgaaagatgagataagagtagtggttatggttcagaggccccaggatttagattctgcttgtgccatagccctgctgcaggaggaagctttagaaggtgttaaggccagtcattacaggaggtcagacccaggggttatgctcaaaacaaatagaactggacctattgtgggagttactcagcatactaagaacaatttgaatcaatctgaagacagaaggggcactgaatctgctagagctaaagatgataaggtggctgctctgagggcttataggaggtccaagggactatgctttgtctgtggagaacgatggggtaaagaacataagtgtgcaactacagttcagcttcatgtagtggaacaactgttggcagtgttacaacctgaaattgacagtgattctgataacattgaattgggaacatcaccagaacaacatggcactttattgaccatatctcaacaagctctgtggggaactgaatcaaatcagtctatcaaggtgaatggttgggtgcagggaatggaactgatcatgcttattgactcaggcagcacacattcgtttgtggatgaacaaattgcacttaagttgatgggagctagaaggttgcaacaacccctaactgttagaattgctgatggaggtgtcatgcagtgcactagggaaattgctgactgtcgttggtggatgcagggacagagtttctgcagtaatttccgactgctacccctgggaaattatgatgccatattgggtatggactggctcacaatgcacagcccaatgaaggtagactgggttcaaaaatggatggaattccaatacctgggaagggatgttcgaattcaaggaattactaatcagccagcacagtgttctcatataacacacaaccagttatctggcatgaacaggaagggttcactgttgtattttatccagttacaaaatatggccatacaggagaatagcactatttctgattcagtcaaacctatgttgttagagtttgctgacctctttgaggaaccaactgaattacctccgagaagagcttgtgatcacagcattaacctcattccaggggctaaacccattaatctgagaccttataggcacaatcctgctctcaaggatgaaatagagaggcagatagctgagatgctcaagtctggggtgattcaacccagccaaagtcctttttcttccccagctatacttgtcaagaaaaaagaccacacttggagattggtaatagattacagaaagttgaatgccattacagtcaaaacaaaatatctagttccagtgatggaggaactactggatgaactatctggttcaaaatggtttaccaagctggacttaagatcaggttatcaccaaattagaatggctgagggagaggaacacaaaacagcctttcaaactcattctgggcactatgaatataaggtgatgtcttttggcttgactggggcacctgcaacatttttgggggctatgaatgacactctaaaatatgtacttagaaaattcgtcctggttttctttgacgatatcctgatctatagtccagattttgagtcacatttgactcatgtcagacaagtcttacaactacttcagcaatatcagtggaaggttaaattaagcaaatgttcttttgcttagtcacagttatcttatttgggccacatcatcggtgcaaatggggttgcaactgatccacaaaaggttcaggatatactcaattgggagattcctaccaatgttaagaagttgagaggatttctgggattggctggttattacagaaaatttgtacaaggctttggtctgaaaagtaaacctctgaccaatcttttgaggaagggtgttccttttgtttggagtacagaagcagattcagccttccaggctcttaagacatctctggcctcagctcctgtcttggctttaccaaattttcaaaaaacctttgtggtggaaactgatgctagtgactatggaatcggtgcagtactatcacaggagaagcacccaattgcctatataagcaaagccctgggtcccaggaccagaggtctgtccacttatgaaaaggagtgcctagcaatgatcatggcagttgatcactggaggtcttacctgcaacatgttgagtttataatactcactgatcaccacagtctcatgcacctatcagaccaaagactccacaccccctggcaacataaggccttcacaaagttactgggtttacaatacaagatttgttacagaaaggggagtactaatgctgctgcagatgctctttctagaaaaccacagcaatctgaggaagagttcaatgctatttctcagtgtgttcctcaatggctgatggaagttttgcagagctatgatactgatccacatgctactcagttagttgctgccctgacacttaaccctaattctaagcctcatttttcacttcagcatggagtcttgagatataagggaaatatttggataggcaacagtcctgacttgcaacttaaaatcattaatgagatgcatgccagtccagtaggagggcactctggatttccagtgacttacagaagaatcaaacaattatttgcctggaatggaatgaaatcccaaattaaggaaacacttgccaattgtcaaatttgtgctcaagcaaaaccggatagatcaaggtatccaagactattgcagcctttaccagtccctaaaggtgcttggcagactatatcattggatttcattgaagggcttcccaggtccagtcactacaattgcatcttagtagtagtggacaaattttctaaatactcccacttcatacccttgagacatcctttcactgcaattgatgtagcaaaggccttcatgagtaatgtgtacaaactccatggacttccacaaattatcatctctgacagagataaaatttttacaagccaattgtgggagcagttatttctgagatctggcactaaattacattacagttctgcttatcaccctcaatcagatggacaaacagaacgaggaaatcaatgcctggaaatatatttgaaatgctttgtccagtcagcaccttccaaatggccttcttggttgcatttagctgagtactggtataacaactcataccattcaactattgacagaactccatttgaagccctgtatggatatccacctcgccattttgggatcagcatcagggactgtgacaacagtgagttgataacttggatgcaggatagaaaattgatgcaacagttagttcaacaacatctgcatcgtgcacagcaacaaatgaaactttttgctgataagaaaagaagttttcgacagttccaggtgggtgagtgggtctatctcaagttacagccctatgtgcaaagttcagtggcccccagagcgaatcacaagctggctttcaaatattttggaccatttcaaatcctggagaagttgggtactgttgcttacaaacttcagttgccagccacaagttccattcatccagtctttcatgtatcacttttaaaggaagcaaaggggttccagccatcagtgcatacaccattatctccaacttactctgctgtccagtatcctatagcattactggatcatcgtcttaccaaaaaaggtaaccatactgttcaccaggttctaactcattggtctgacactattccagcacaagctacctgggaggatctgcatgacttgaaggccagatttcctaatgctttggcttggggacaagccaaaactcaaggggaagggattgtcagatcgtcatctgacagtgctgaggaagatactgaagaagaactgagcttggaagcagagcaggacgatgatgagaagatgcaagctgaagctgaagatgcagagcagggaggagttatggaccatcaacccgtgttgcggcgcacttcaaggactgtcaagcccaacccactgtaccatgggccacagtgggccgtgtaactgaattcgttgtaacagctgtctaacagctagcgtgtcgcgtatgctgtacgttgagagcgagagagagaactatatatatgaattggggatgaactagagaggaggacttttggcaatctggtggcgaaggcggcggaaggctcaatcctgttggattggtgcataatacatcagtaatcgattgccatatatcttgttgctgttctgtgattgttctagttagattagatcctaacatcttcttcttgtccgtcttctgcgacgatctctactcgccggctctagtcgtcgtggccttgaccttcaaccacaccaacttcggcccggacgagcagacgaacatcaggcttgaaggcgacgcggccttcagcgccgacgtctccttcagcggcgacggtggcgggtgggttgacatcagcgccaacaggctcgacggcaacatcgaccacagccgtggcagggtgtcgtacgcccttccggtacctctctgggacgccgccaccggcgaggttgccagcttcaccaccggcttctccttcgtcatcaacccgccaaaagaggacggcggcatcaacaacaagggcgccggcatggccttcttcctcgccggcttcccgtcgaggctcccgtccgccggctcctacgcctacaacctcggcctcaccaaccagactgccgactaggtggccgccggcgacgaccggttcgtcgccatggagttcgacaccttcaacgacaccatcgtgcacgaccccgacgccacctacgaccacctcggcgtcgacgtcaactccgtcgtgtccaagacgaccttgaccttgcccagcttcaccctcgtcgggaacatgaccgccgtcgtcgagtacgacaacgtctccagcatcctggccatgaggctgcacctcggctatgggcttagtggcccccgtcaccggccggattacaaccttagctacaaggttgacctcaagagcgtgttgccggagcaggtcgccgtcggcttctccgccgcgacgtccacatccgtcgagctgcatcagctgcgttcatggtacttcagctcgtcgctggaacccaaggccgcaccgccaccggtggcgccgccgtcaccgtcaccaccgcctacctccggttcaggaagtggcggggttgtagcgggagccaccgtcggcgcagcactgttcgtcgtgctcctcttggccatggtagcagtcgtcgtactcgtacgacgacgacatcagaggaagaagatgagggaggcggaggaggcgaacgacgacgacgatgacacggaaggcgatcccatcatggagatcgagaacgggatggggccgaggcggttcgcgtaccatgtgctcgtcaacgcaaccaagagcttcgcggcggaggagaagcttggccagggcggattcggcgcagtgtaccggggctatctaagagagcagggcctcgccgtcgccattaagaggttcatcaaagattcctccaaccaagggaggagggagtacaagtcagagatcaaggtcataagccggctgcgccaccgcaatctggttcagctcatcggctggttccatggccgcaacgagctcctcctcgtctacgagctcgtccccaaccgcagccttgacgtccatctctacggcaatggtaccttcctcacatggccaatgaggtaattgatttccctaattcattagaatttttgctaatgtgcaattgacaaatggccatgaactgatcagttattgggtttggatgttgcaggatcaacattgttattgggctcggatccgccctgctctacctccatgaggagtgggagcaatgtgttgtgcaccgtgacatcaagccaagcaatgtcatgctggatgaatccttcaatacgaagctaggtgacttcggcctcgcaaggctcattgaccatgctgatggggtacagacaatgacgcacccctctgggacgcccggctatattgaccccgaatgtgtgatcactggtaaagcaagtgccgaatctgatgtctacagttttggggttgttttattagaagtggtatgtgcaaggagaccaatgagtctactggatgatcaaaataatggtctcttccgactagtcgagtgggtctgggatctatacggccagggagccattcacaacgcagctgacaagcggctcaacaatgactatgatgtggttgagatggagcgtgtcattgctgtcgggctctggtgtgcgcatccagaccgatgccagcggccatcaatcagagctgctatgatggtcctccagtccagtggaccaatgccgatgctaccagccaagatgcccgtggcaacatatgcaccgccggtggcctcatcggaggggcagctctcgtcatcgacgggtatgtcatcatcaagtttgacacaaacagcaatcacacctcgttaggggcataagtttgcccacttgtggtacaaaaataatccatgccattagattataaatgcacttgccttctacttattctcatttcagattgataaactgtaaaccaaatgaattagcatgggtcagccggcggataccttgagcagggatccttttctcagggatgccgctctcggtgaaatctagctagagatttaaattgcaaacaatgtttgactggatttgaatcaatttgaacaaaattcaagaaggacatgctcattgttgatagatgtcatacgataatcggcaaaatggaggcggacaactgcatagaacattacctactaaacttaggttttatccaaatgcatccccatctctgactgacaccaaagtatgtaacctcgaacgatatagaacacatggaacatcatcacaaaaagcatatcagtaattttgtaccacaccactaaaattcagaacaagaggtcacaaaatatattttgatacatggttcgagttgctgctatcattgtcagcatttcgtcaagcaaatagatgaattggaacttccagtgctgtttccagtcttcgttaccatggaagagcgaagtctaatgtttgtttcaagacaaaaaaaaaaggtaaactcaatcagaaaaagaaaaggtagatgaaagagagtacttttatggtacattctactgctagtatatactaccagtatatgaagggtagttttggtattagggaaaaatctgaaaagggctttttggtcatttaaattagagaagtattttcaccgggattaattttccttcggttgtttggatatcatcatccgcgtgataccgcttcttctggatacatctcgcgtcgctgctccttctgcagctccgcctgcccatcgcctcactcaagaactagggttttgggtcgctggaaaagacatgagaggaaaggatgagggaaattgattcgattcccgatggcggcggcgcggcggcgctcgcaagaggaagacatcggcgacgcatgggcggccatggatcagatttgactagtgaggaaacgtgaaatcataaaattacccccacccaattagataaaaagacaaatatacccttttcaatttatactgcagaata

SEQ ID NO: 48711 - DNA, 24004 bp, Oryza sativa
agaatgtccataaaaatcctcatgaaagaaggcacctctttcaagttgaaactcctgaaagctataaagagtaaacaagcaccaaaaatggttgctataataattggctgtaactcttttgagtaaaggccgggatgctattttattccattatctaaaaaaatatattttcacatgggaactgaaacacaacagataaatgcgcagctcaaagtcaaatgcaaacaatatgaaacaacaatggtggtgtaaacaacaggaacctcgatataataaaagtggagcatggccactgcctactgtaaacaggatagcctgcaacaatttactactacagagttattcaaatgcaattttctcaaattacggatatttatgttcgacactttggttttgacttcagaatcaaggtcatcgaaagcagaaaaaaaaaacattaacgcacaaaacattagagcacgatagtccacccaaattgtaagatttaagaaatagtcaatcattcagcaagcatgtcacccaggactgatagctctgccacttcacggagtgatcaaactaaatttggaaataaaagagttgattcttatagtgtcagcagtggttctgctgttgcaatttcctcaacaatttctgatcaaaagtgtgaaatcatagtcatgattaatatttgtaatgaataattggctttgcaaaatgatttattcgaagaattggtttgagagtatgtgtgaatgttggtgtgagtgcgtgtgactaatttgggtcaggttgtgatatctgtgcccagaaacggttgttttgtctgattgtgtgcaggtgacttgaggtcagccttggtcaatggtgaggaccgaaactatgctcagggtggagcagaggtctagtgcggtcatgataccatgtgagaaggtgactagagtcaggattcttggtgaacaacttcggtcaacggtggggatctgaaacgctccgcttttcgtgaggcgttaaaaactaactcggcaaaatcctaattgcgaaaattttcgttctctgtgtgagagtctaagttgtgccaaggatcccaatttaatcccgttgttccctctcatcgaaatcaaaaaaatcctccccctcatccaaattcctcttccgattcgagtctttgaaatcaaattctgaaattcaaatccttcctttgaatcctcgccaaatacttctacgaatccagaattattcaaatcccgcctcgaatcctttccttgactccaccctatgttcccgagaacaaatacccaagtattccttttgaatcctttccatgacttctccttgagtttcccctgatacatccctaaaccctcgagtttgaatatcaaatttgaattcgaatccaaaccctaaatctctccaattctatccaaatcagttttctctgtaaaaatctactttacctccctatgtttttggatggaccgattctcctcccccggcccatctcccctcccagcccatcatctccccccctcgcacgtgcgttacacgcatgcgagccgagagagagccgtcgctcgctctctctgtttccctctctctctctctcgttcgatctccctctcctcggcgccgatttcccgccgtcgccgcccaaaacctccaccgccttcgcccattcccgcgcgcacctcgcgaggtggccgaccggcctgtcaccgccgacgccatgcgctgccgccttgccctcgctccatgccaaaccgaccgccgccgtcatcgtcgacgtcatccatgacccccccgccgctccacgccgcacccgtccaagagtgggagaagcagctgctctccctctcctcctcctcactctccctcccctcattatggcaagggaccaagcccctttttccccttctttttccctttcccgaccactgccggcgtcaccacctctgcgccgcttgaccgaccgcgccagcccgcgctccagcggttcgatttccgccgctcgatccaccgccttcgccactcaacgcatccacgccgtcgccgctttcgcaccgcccacgaaaccgccactaccgccagccgagcacttgaccgccaaggtcagttctcccctccccaaaccgacctcgtctccgctataaaaccaagccaccccaaaccccttcctctctcgttttcactcgcctcagtcctcacacccgccgcgccattgccgccgaaccaccgtcgccgccttgttgctgctcgtcccgctctcgccgttgccgtccgttgccgaagcaccggaggagccggtgcgtgggtgacgaggagctccgggcaccacctctccctcccttcttccccggccgcgccctctcggtgccgtgccgcctcggcgtcgcgaacacctcgccgcgacaccgaccgcgccgccaatgctgcctcctcttcgattggtgagctccccaccataatcctcctcctgccgcgcgatgcgccgcgcccgccgccgctcgccatagctcgccacgcgctcttgctctgtcccggaggccgcctctcgtcgccagccaatctcggtgccgctccgtccaatccgacgccggaaacggattccttgaaccccggagatgctcccacccctttgaatcgaaccctcgtcgtctcgtcgtgttttccccttttgatctccggtgattgccgccgccgcaatccaccgtcgtcggctcctctcgcgtcgattcctctcgccgccacgctcccggggatccccatgacctccccctggctgccccaaggccgtcggccttctcctttgtctccgcgccgtgtcgccgcttccgccgccgcctaacgccgccgtgcgtgcgccgccggtgaccatcgggtcccgcgtcaccgcgtgcgcgtcgcaacaccataccggttcggctaagcccgagcccgcgcacccttcgctcttctcgcgcgcggccacgtcggcgtgctggcgagcttggtcgccgccgccagccaccgtcatacctcccctctcaaatccgtgccgttaaacggattccccctgacctcctctagctgccggcggtggccgctcgctccggttcgccgtcgctcgccggaacgcctcgcgcgtcgtcggccgtccgatcccgggcacctcctcctcctcctccttccctttcgcccctgcccgcgtggccgaccacgtggcagccacctcagccccgggcccgcttgactgggtcaagtcgcgcccagtcagcctcctccctccgtcttccctcccatgcgcgcggtccacggcaagccgtgcggctgcacgtgggcccgccgccatccgtccacccggcgcgccgcgcccgaactgcgcgcatccgaaaccctagcgcccgcctccgcgtgcaccctccccaccgtgaacccaaccaccgccatctgggtcccgcgcggtggaccgcgcccaccccgacgggcctccctctctccccgcgcgccctcatgggccgcctcctcgcgcccgcgccggcccatttggtttggccgagccgcgttagcctttgggccgcaccaatgccaccgaaacaagtctaatatacatccctccttgatttcctttttccacccttgttccataaatcaattccttattccaaaattccatgaatcattttccttggtcccggattcaatgactgtcaataatattcttgagaatattatttctataaattccataaatcatctctcctattccagaaactccaattaaactttcaaaattcatatcacccaattcgcaactccgattgactccattccacttccaataattccgtaaattgagctctatttaatggcactactaattagtctaaataggatctttcttttggtcttttgtttaggttttcgattgtttgcgtatagttgcggttatcggattttcgtcgatcgcgggttttctcgaagattcgtgaagcttcgtgaagaccttgagcaaggcaagtcaccatttgatcaattgcccctataattgaaaagtcattattattttgtttgcaacttgcattattagaatcacacacttaacttgcttggcctcggtttgcgtgccaaaccgacggacctacccagtagtcgcactaatttccgtaggtcgtactaccctgattccttgtcgctccacccttgtggtacctcggtattcgtgctctctgagcgcgtataccaaatatcccacatacaccgttgtttgtcgaaaacttgggaaatgggtttgtgaagccttcaaaacccgacatgtggtgtcggtgtgtttgaaaataaaatgaattgtgaaaactcgcgatgcgggggttgtgcctatgtggcactgtcccgtattcgcatataaggaccgattcctgtgggaaactcatcgaacataatcaaagtgcaaccacaaggtggaatgggacaccctggctaagtaactagtcggttcagggaaacctcgcatgccaatagttgggaacgccggggcggggtcggacaaaccgggttcctggtaaggcaaggacgagaagcttgctcacttaccgatcaaggtggttggagtttgatttgtgaacgcctaaaatggcctatgtttatgtgaggatttgatccttctatgtggcatgaggtaaccctgggtcggctcgggaaaggctttgttgcgaacctccgataccgacgggtgttcggaataagttcgtatcttgtgggtaaagtgtacccctctgcagaggttaactaactgttcgaacagccgtgcccacggtcatgggcggatgtgaggtttttcccgttgcgtagatttgtttgcctgtgctttgtgaaaagttgttgtggtgtgggaatcgtaaccagaatcagcctatgtggcagatggacgacctgagtggtcagaaacgaatctgtgtgattcgggatgtctgcgggcatcatagactaggcttcccgagtggaagcggattgttgtgctgctgggcagctggactctgggagtccgagaaaatgaaaaaggctctgggagctgattaatcaagtggaatggctctgggagccgagaagtaatgaactgacccgggaggtcggtacattaccaaatgagctgttgaaaaacatctcttaaagtcgaatcgagacgcaagtctcttttcgtcccaaacttagaaagaaataaatcacttagtgatttcaaaatgatttcaaacaaaagatttgcaaaacaaccttgcctctctgccaagcttgcattaaacacctaagttcccgtgacttgctgagtacgaaagtactcacccttgctctatataaatatatatatatagttcctccgccctgaagggaagataaagtgaagtgaagatttgggtttcgtcctggttcccagccgtcgcctgtggtgttgggtgttagaccgttggttccgctgctgctgctgctgttggtgttttcctcgtccgcgtcgtcggttgtattctcgggctgtctgagctgcaacctaagttaaggtaaataagtcctctatttattttaaggattgctatgattcatatttgtcaccatgggtaccagcactatgtcctgggactggtaccgagatcgcggtttcgtaggaagcggttcgcgccgttttccctacgacacgctcctgtcaggtgccgttgtacggcggtatcagattggggtgtgacaggatcgggactaaactcagggaggagttgaggtccagacagtcaaggataccgggtgacgaagttggatacgagatggcacacagtgaatggatatcgtgtgggagagatcttcgcaacgggcttcacgagatatgcgtgcaagtaccggtgttggcgaaggagattggagtgagaaattgaggaagagtatatggtgatatagtacacgtggtactgtagcatgcatatgtgtggtattgatcgatgcatgcaagtgtactgtagtggttggcagtacatggatgcatgtatgcatatacatgtgtgttggctcggtgagtccaaggcaggagcggcgctaaggcaggagaccgaggccgaccgggacttcgtatgagacggacatgtgtccatgtcgggtttgctatgacacggattgactgtagtcggttgtgaggctgcaggctttaggagactaatttggatagagtcatagtttgacgagtggtactcctatttcgagtaggagaattttcatgtataaatagagaggaagcgtgaggcttcccggtatcggttttaggaagctgagtttgagagattagatagggtttcgtgagaaacttttgaggggtgctgtggctgcaccttgtgaacaatatacttaagcaataaagatcatattcaatcatcaaggcattaacgatctattccggtttcgtaagttttacgtttatatttggttttggtattaacttgtgattgttcattttgctgcgattttgttcaagttaattcatccaaaacttttctaatacttcaaagatcagatctggaaagtttcgttgattggttctatttgatgatattttgtcacgtgcaaggaaaaattgcagtggccaaagcaagcaaataatgtgatccctatatgggatgttcagattgcatgcagagcagtacgagctgtgagcagcaaaccacaagagatcggccgggcagctggttgtatccatgcatgcaagcccgcacatacgcacgcatgggcttcaattacacctgcgtacactcgcatacgtgaccgtattttctagcaatacggccgcgtatatacatggaaaaacaaggagatgcgaagctacggtgtattttacgctatacggttaagttagctcatgcttgcccggatcaacaaattaaatttatgaagagataaaatttatctgaatgaattcaacacaatccttgcaagccacgcgcatacgaaagacggccttccgccggactctcaccggcccagcaacggaagagtggcaaggaatatcggaaaccgccatgacgcgctccggcggatgcgcacacgtacgagagttaaattctatcctgtaggcccatcagaaattaacagaaccaatatttgacgtcaggcggatcgaagagataagattaacaaaccgatcgattgatcaagtatatccgcacttctccaccgacctcaggcccctatataaggcgtcgacgtactctcggcagcctggaggccatggacgccgatcaatccataaacacccatcgacacacatgatcatccatctgtccatctcctcctggaagacaactatccaccggcgacctagctatccatcgaccggcaacgagcatcaagatgtgatctcggcggccggcgacctcgtccacagcacccctgtgtccggcaagaggcgcacatgaggaggaacaacgacatcttccttgggcagatcaaacgctgcaggagatcgtactcaaaccttcaggaggagagcaagtctctgtcgctttcttttctctcgtttcaggtgggagatgagcctgtacgcgacgccgccggggttatcgtggctgccatgactatttctgaaccatctccgctgccatcgagactcatccgcccgccgtcatccacattcatcaacatctccatctcatctcagatggactcatccattcatctacaaatcattcaagaagcgacaccaaagaaagtcttaatggccactacaggtaaagctaatttagattggttcctttcttttggttccagtgcctacgtgcatgcatggaggacggccgggtgtgctgccatcgccggagtcgtcgcgtagaccaatctgttgacgctgatcgcaagcctccgtcaagatcgatgccgctcgtcctcaagctctgatgttcgagctgccggtgacgatgaccctgctcattgctgcgatctcgcctagatgttggatgacgttgccttgccgaccgctgcctccactcggcgacgccgtggatgtctgctggccatcttcgacgatgctgccaccttcctcacactcatcgtcaaggcgctcgaggagaaggccggtcggagtgccgctacccggcactgcgacaccaccaacacccatctgccggagaagaccatcgtgatgccactccgcccgacgcgacgcgccggagatcgtcggagcagccgcggatgctgcctagtcacgctgatccagaagctcttgttgagaacaacacaacaacacggacgccgctgagctgcccgcgtccgtgaacaacatatcgtcatcacgccggtggccgcccacgccgtcctgatagagcagcgggaggccatctcgtccaccttattggcaacgcacagacgctcgccatccccgtcaagctgctggtgacactgtccgccgagtgccaccctgtcaaaggctgtcgttgtaccgacgccaagctctaaggacgccgccattgtgatctctactgtgtgaggacgtctcaccgagactcaggcgacgccttcacgctcgtcgcggtttcttcggtcaccatcaacgtctactcaatcatcttcgacggtgctaccaccttcctcacgctcatcatgaagccactcgaggagatcgccattcggagtgctgctgcccggtgcctgcacgccgtcttgccggagcgtaccacggatcgtcggagcacccgcggatcgacgttgccgagctgtcctgatccaggaggtctggacggagccgtcggggacgcccgccgagctgctcttgcacttaagctcgttacaattatcatgcaactgaggcactgccatgtagtgttcgttcttgccgatcaaacactgtcacactgcctgccggagcacgttggattacgccagagtgccattgctaggggcccgtacgccgtcatcaagactggccgtgattctttctcttcatcaagccgaggtcgttgtgccgtttgtccgcgacgctttcacttcatcatgctggagttgttcgtgatgtcacgtgaacatcacgtcggagcaccactgcttggtgcctataaaccatcgtcaagccggagtcgtcgtgccgtccgtccgtgacgtctccttctctctacaccgcatgatgagatgccatctgtctacgatgctttcacttcatcatgccaagatgagatattgtctgtccgtgatgctctccctcttcgtcgagatcaacgacgctgtattggagcgtcgctcgtccacatcaacataaagcaagaatggtgccgtttgtgatgtcagggaaccgttcatgccagatctacaccaataatttcctcgaccgttctgccgacaaggcatttacttctacaaaggtcgccgttgctaccggcaccctcatagagccccttttatgggctcgtcgtcatatcaactggatcaatagtagatccatcatccgaaggatgtgctatataagccacgttcgtccggctgctgtctgcactgacttcttcatcaacaccttcattacaaatccctgttgtataagggacatgacgggtcaggaggtgcccagccatgtttaatccggttgccgtctacacctactttcttcgtcaattcttcattactttgatcacatctagtcagaaggtgcccatccatgtttattcggctcttgtgtgcaccaactgacttcaccaactcatcttacctttaacaccattccgatgttgttgctatgacgtcgagccgtccaagctaggcgattccatgcgtgtcttcttcaaacaatctacaccgacacgtcgttcaagaccgacgaggctagacgacgagggtgcgcgaagccgacgctaaggctatgtcaccaacactggcgcacggaccgacgaggccgtggatgcgttgccggcgcccacatatatatcacacatcttcaccaacattcatcatccatggagaacgtgaagcaaagacgatgagacgaccacaagcagcttaatcgggggttctcctgcaggcctagacctgcggaggtaattaaccaggagcttctcgaggccctaggaaccagaagacaacatcgctgatgtcagatctgtccaacgacaggcaatggcacgtgtattttctattatacatggaaactgtatcttgataattcaattaataaagatcatgtgtttttgtgtctcttttatgtttattttacatttgtgtatttaggtacactggcacgtccgcacttattttctctctaaacatagagggacatattcgtatttttctaccctaaacaggttcttgttagatttgaatttgcttaagttttaggttttgttcagatttgctgaaattttgatagagctgattttcaagggtattttctcttaaaccgtttattagtttacaaatccctccggtggaattgttctttaggttgtttagtgtcaagtttgcaactcgatccaacggttggtttaagagaaatcgtgtttttaccgaagcgctgtcgtgttgttttcaggctgacggttagaccgcgagaggaccagcggtcagaccggtcaagcttcggtcagaccgaccctagtaggtcggatagaccgccaaacgtgtgttccattggcttttgtgggatgtgttttgatctattaagattcgattatttgacttccgttgacgtaatctaacattcacccctctctggtaggcttggttacttatgtttgattctaaaaaagcaatccgttggaccctatccttacaaaagaaagagcagatctggaaacataatatcacaacacagtagcgtgtaatccattctctttcacatttgtccttagccaggatcagatgcgcttttttaaacctatcaggaagatgattgcgaaaacagtgatgagaatgaattttgacagcaacagctccagttatttatacattccaaatctaaagttacaatagtttcagcaatttttcatccccaaaagtccctgcataaccaattctgaatgtccaagttagttattcaacactactgcagaagtgcagaattgagtcaccctaaagtgaggttgaagcccttaaattcctttattgaaaggggaataaaaaacacgccaaggcaataaatatgaagtaattctcacatagacgtcacaacaatccccatccagccatccttgaattctccatttgcagatagactagaacagctagcgcatgagagtatgtgttcaatggttatggttttgtgggtaaatacaaacatataggcaaagggataaatatgctgttctaaatttgtaaattagagtatcatcaacaaaaaaagcaatgcaatgatctccagggctaacaaacttcatcagacagaggacaaagaaggaaatttaacacaaatcaattatctcaggtcaaagaaggcgatttcaacattagacaagacaaaaggaaagcaatactactgtaaccaacaaccactaaggctatgtacatcctttgggtgcagagtaaggctgggaacatgatcctctgacgtagagcaatctaatctacgtcagaggaacctacgacgccaggccacggacagaccgcaagcgcacaggccggaacaagccatcatctaagaaaaaccagacaaccaccagcagcagccacatcgagtgacacgacgtgacaaggaatgcaaagcacgtgaccttaggagaggccgctccggtaggacgaatcggcggcgatgcacgaccgcagccttgccgacgccaccgcgctgtgcaggggaatcaaaagaatgcacgctcgccagcgccgctgccaccgccacgaacgacctgaaacagtcaggatctaggtactttgggcgtgacctgcggaggcggggaggagagaccggatgcttcgccgcctggaacgagctcgtaaccggagatctcgactggcgcgcggcggcgcggtagaaagacgccatcttgtttcgtcgtttgctgcggccttcggttgaggaagggaagaacaaaagctcaaaactgggcctgcgtttattgggccataaagggatcgcggtggcgtacatgagacccatttaagttggcccttcttgtggcccatatatacaatgggccagagatacctcgccgccacgggtaaccggaactaactgcggcggcggccgcgggggagcagcagaaactctgaaccagcagcaagctagcttcatgcttcaggcttcaagctttagttgctagcctgctacattgctcctcgttgcaaattgcaaacaggcgatggctgatctgatgcatctgatggcaacgggattagatcactgtagatgatccaaaaaccaatcgtttctctttgtggatttcagattcactagcatcaacttttgccctaatttcctccctccttttgacttgaactgtctccttaatttatcggagacgtttggttctcagctggatgagagtgaaactgatgaaatcatataaaacctattgcttttgcctacaacttttgcccccaggtactgtattactgttctactgttctctcaacagttgatcgatgccatctgcaccgtccaatctagcgtgtgtcaaggatccaaatatccaatatctcttccgcttctaccctcccgtgaccgtgagcagctcgagattagtttcttctcgaccatcgaaccctttcccgctgcttctgttcgccgccgccgtgctccagcgcctagggttttcttcgccgccggcgagtgctccagctcctagggtttcttcaccgccggcgagtgctccagctcccagccctgcgcgtcctcctcgccggacgctgccggtgacgtctgggccaagctaggtgcggccaccctcctcctccccccttcctttttcttgggtttcttccgcctcacgggttcttgattcttgaccttttcgttggtcttgggcccttggccattgcttgcacagcaggtctgtagtgccctccgattccgtgttcccggaggtggagctggccgaggacgacgccgtggtgtgctcccgggtcaccccggatggcggcggggaggtggtcgcgtggtgcaagattaggcgcggcggcgacgtgtcggcggcgacgatttggaatctgaggtatctgttgtgattggtggttggtttatccccttttcgctgctttgctcttctggactgtacatcgtaggcaagatgcgctttttttttttttgcaatcctgttttattggattgggggtacaaatgccattcattgatgatgcatgtttgggcgaaggctataaaatgcagaaaagttcttactgatgcgatggaatgcgagttgttgtcgtttggattatgtgaattgttgcggtgtcgcactatccaaaattaaagaaaggtttcctgtggataaaaaagattcaaatttcctaatgattccaaagtgcctcattttcttatccataagaccataataactcagtttccaaacttttgaacctgattgattttgagtcgtgctgatctgaaatcgatagatgtgagcccctgaagacagggaataggcagagtggccatgggtgagttttttcttttttagggggtggagggaactgtgttgcaaccttccgttaatccttttatcaaattctcgctgatgttagatgcctgtcttgtcatccttgtaatgtatgtttcattcgaccgctatcttacgttaacattatccatgtgccattgagaaagcttggatgcaattattgtcgatggaagagttatccagcaagaagcagttgacatcaaaccggggagtgaaattgttccagggccccagaaagatggtgagacaattatgtattttgagtttggcattttgtgcatagattggttgttatgtttatttagtggtcttgtattttttttaaatagactattttattcctttatgaagccaaatgagtgtttacacatgactctgaatatatgtactcattgagtcatttggaatgtttattgtttcctagacctttctgtttagaaagtgaaacttctatggttgcatgtttgtaattgtgcttctgaaaaatttaccaaattacaaatggttttccttttgtgatttcgttatgttggacaggtgaactgtaccactatgtaatgcatttatgctatccattttcttgcagggtatctgttgtacacctttgatataactggcctgaatgactaggacaaaaataatatcaaggtattttgttgaaatgaatgttgatcaacagcaataacctgggtgcataaaagtcactaacttctatttaaatgacgatgtcagattgtgctaggtattgagaatgcaaagtgcagcatatgcttaaatttgtgggatgatgttgttactgttgcttcatgcctccacaacttctggtacttttgccaattttcctagctacttttgatttatctcaaaattctgattggtgcttattcctgtattccttttaagcaatggctgcttctttgagtggttaagaaggtcttcagctaattcgcgtgataaaagttagagtgctgcctgtccacaatgtaggacgacagtgcaattagttggtgggaatcacttcctacataatattgaagaggtgtgatagttgggtgtgatgacttaactcctcaatactgtttaagtgctacatattgtacagctgagatgtttatttatagttctgcttttgtaggctatactgtaagttttttcatcgctacagcggtctgatgaggagattgcattgttggagtcatatgccccggtcaagacaaatattgtgagttcaaaatcttactaagaaattgttgattcccaccattttctcaatggattgtatcaagtgttgtgccagtctcatatttgccagcactgatatttgtccctgttatctgccataaaatcgaatattgttttaaaatcatcatctttttttcaacttgtaaaccttattttttttcctacaaactttgcccatgttactgtattactgtttaatcaacagctaatcaaggccatctacaccatccgatgtaccacgcggcaacgatccgtcccctcttctgcttctaccctcccgtgagctcgtggttgaaagttacatttgtcatgaatttggattatcattctattttgaagatatccttgattgataaatgcactgccatgtttcagataacattttattctcttatttcccccaattttccttccatttggcaattctcgtggtgttggtttgtctgtactgcactttgacacattatatttaatttacaagacttgccaggtgcctaggattgtctttagtattcaacttttgacaagataatagtggatgaaatgaaaatctgtttacaattagtactggcctcttaataaactaattagtaaaacaaaattccccaaatggtgggctcattccgttagtcgggtacttataattgtagaatttcctttcagtgcaggttgatctagaatcatggttctctctctaagtcctattttgcttatcgaatacttgcctcttaataaactaattagtaaaagaaaattccccaaatggtgggctgattccgttagtcgggtacttataatggcagaatttcctttcagtgcagtttgatctagaatcatggttctctctataggtcctattttgcttgtcgatgatattgttaaatgttgccatggaatgttagcatctgatacatgggcttctcatctatagacatgttgtgcttgtcattacctctaaccatatcatgttatttaatttatatcacatgattgaaaatgcattttagcatgaatgactcataaccgatttagaattttctaacttacaattagcaaaccatggcagcacaatatggtatttcaaattttcatttagttgccctacttgagaatgagtttagtggtttggttggattgtctaagtgcaaatgttgctgtcatttgtgggaatcaggaaaatataaaatgccatatataatatcctctatattttagttcatagagagtatagtttccattcactcccaaagaaaatatgggtataatccggagcaaataatctggaagcagatatgaatatggatattttttgctggatatgaatacaaatactatgacgttggcgaaagggcttgtagcctagtggttacaagagcatcagtagcatctgaggtcctgggttcgactccccatgggagcgaattttccagaatttaacggcgttgtgctttcagtagtaggcgacgtacccgtcgacagcgaggctcctgtgtagtcttcgaagatgctcacaggggtagggtttgcgtgcgtgtgtttataggggtaattctaaaaaaaaaagaaaagaaaatactatgacgttgtttccagtggatggggatacaaataaagatgcatgcttattgtttttcaaccacatttgcttaagcaatgattggtctattccagtattactattgttggcccctttggaacatataattgatatgccttttgcatgactcttctcaactaaaatgcattagattgcatcatgtctgtggttcacaatatgttacatatgttatctggaaagaatataattaaatttgctacagttctgtgctattgttatgttatttttgcattgttgcatgtggtgtttgggatccaactaaaactaagttggttattttattatgtaatctcaaccgatatacggaatttatatgttgtgtatattcatggttgttaaattgctacattatgttcagtatatatacagttttttttggcttcaattttatgccgtcctttccagctttcccgccgcaccgcgcggggcaccctctagttatatttgttctctgcacttctgctaggctgcttagctaccactagccttttactacccagctgcagataaactaaaacatgtatatatgaacatgaattccctaaccatataaactaaaacgcctccgatgatcgaaccatatcttggtccatcgatttaagtggaaaccaatgatcagttgttttattttatttattatatttatagaacaattactccctcggttctataatataatgtacaaccactttctttatatgttccataatataaggcatgcattcaattaattatgacatcttcttcattaaattattaattttttaaacaattcactctcacattctctaattctattggatgcatgcattatatttattaggatgatccaaactacaagatgataataactatttctttatctttgggttaatgttggttgtgccttatattttggaacggagggagtaatttattagagtcacgtgacaacttaggtgtattttgtcggaacactactactaatagtctcagtttacttgtagtcaactactgttggttgtagcttggtggcatactctacctacctatcagttgttgatgttactcgcggagtatcgttctttatctttggtgctagatgacatgcatgcatgctcattggatatcagctgattcttatattaggtacattgtgcatgaaatgtcttgtaagcaatatgacttattagcgatcggtggatagtggtttgtatgtagaactcgtatacgtggggattagtgaggacatacgattccacatgtggaggggagtatcgtggtgggtatacctgattttttttctttgagatggagatctaatgggtaaaattagtaggtccaccgatttttttttcctaatttattagaacaccatgtggcggtttacgagcgtttgtaggagaccacatggcggcttgggagtttttgtaggaagttaatttaatgaacttttagtatatgatagatagatatagatgtacgtttacaccaggtcacattttctctgctgtttcctaattggttttactttcatgcctagttaattaattatattagctatagggttaaaccaatctgcatgagcacacagacagtaaagtggaggaggggattagctaacagttgcttgcacaagcaggtggacagaaagacatgcattcgctttaatcacactgctctgaatgtgacatttctgtcatgccgctcatgcatgattagtggccggagtaggagtacacgttactagtggaaggagaaaatcttgttgtcggaggctgccgcgaacgggtcatgtgcacacttaattaccgtgtagtcacgtccaaattccaaaaacatagtaagacgttgaagaggatattgagcaaaattcgcatacattatattaattattatactcacgtcacatgggctggagcctatttatacggaggaggagcaaaggatcggatgaaatcgaccaagatgacgaagatagcaggtgttcttattttagttcttgttatctgtccaactattacttccgctaccgaaacccggggaggtaaatccatccatccatctcatgttttctcacaatctagctgagcttgattctctcttcctaattagtagtaattacttgtgcatgtttgtattgtgttagcgcttctattcctaattaattacttgtgcatgcatgcgctaattaattctgtttgtattgtgttaacaggccgggatgacgaccttagtgacgacaaaatctggacatctctgattgcattccactatcctggattggtggttccgccaatctgcatcgaggacattgcaaagaaatgcgggtggaataatctgacccctgcatgcgtgatggaagagatggacagctgccactaaggcgaccaccggccactctccatcagtctcaggctgacaggctctcagccataataattaataagctgtaataaggggcctaattaatatgtactacttcatgcctctgattttgattgcaagcaccactagccatgcatgcatgtcgtatattctaatagaattaattaatggtaataatataaagctagctagatgtgcctgtgggtttgatttttaatcactaggagtaatagagtagtactcctctatcagaatgtcagggtgcagtcagaaccccttgaatttggacgctacaactagctactacttaattaccgatcgatttggggcaaaaacaactactgtttgccagatcagagagatggtcatccaccatggtgaagaactagcttaacagcggcacaagcacgacctcgtccaagaacccgtgtctagctcgtgtggccggccagccggtcaccatggccgtgcaaatcatatatacaagtcatcgcttgtacaaagttttcattgtttgattaaacaaatctgtacaggacatggtgatacagctggattactcatgatgtacttaaaaaccaacttgcttcaagattgcccatggaacataacatcaaatcacatgccttactttacatttattacctatgaaagtaccttcttgcaatgtttatcagagcataagcccatgttcacatttttacctttgaagtacctccttgtaatgtttatggtagagaaagatccatactatcaaagataagacatatatttttacgtagaaacaatataaatacataattataagtgattgaatttaacatcacatatgctttaaatttctaattaccaggctaattttgcacactccaacatgtccatacatttttcttccaaaacaacttcatgcaggtagcaccctgaactacttctattctcaccctgatcagcactgagatggcctcaggaagtcaggaagcagtgccggcagtagatagggaagccaaacctgccatttgaaattccctggaacttaaggagacagctagtgcacatgaattgcatccaataattaatcagctactacaaaacaatgtgagaattgaagtagaagtacgagaaatataagttaatgaaaggaaactaagtactgtctcacgacatgattcaagataaataagggggataagaaaatcgcaaagaaaaatcggtttggaataaaagattgatttagtagtagcattttgtcaaaacatctttgggcaataggagcatcaccgatttgttatctttctcttttctactgttgcaaatccaacaaagaattgtgaaagcaattataattattttttttttaaaaaaaagatggcgtagagttttctcaaatttttacaagctttacttcacaaagcacatgacttatcagctatagccagaagatcgcatgattgaaactgatttattctagagagtaataggcaatcatagaaccatccatgacatgcaatcggcaaccaacagatgatggtctatcactcctccatatgttcatctccagcatattcgtgtacagcttgtaatgtacagtcaatagtggcaccttttatagcatgtgtacatgccaacctacaaacagaaagatgaaaaggaacattcagcaacgcgcaaaaaaagatccattttttattcatacagtttgaaaacttttgaatttttacctagcataagaatctttttatatgggtcaagctttaaaccaccagtgttatagtactacctatagctaagatataggtatacttcaatagtcctaattaaacttaattcggtaaaaatctacatagaaaaggttgtgtgctaccatctacggaatgtggaaaatcatttagatttcgatacaatggagttctcaagctgctaaataaatgaataaatttgttcaacatatttttcctaaaaaaatgatgcatagagatgaagtgctgattaaattaccaaaaagttggattgtggtcatcactttaaatccaaaattcataatgacttgcttaaatatagttaaaaatcgaatgtcagtatataattaattgattttgttggaagcctttcatgttcctaggaataacgttaaacattatttagtagagtgtgaaaatcatcatttcagctctaatctgattcttgggagtagcatgtgcgtgagtccaaatttcttagtggcaagcacatggcatgttcatttgtatacatatccgcaccagaaaatacatataattgcccacaaattcaaactgtatgtaccatcgctagctgatgagctcacctcgttaacatgtcaatctgcatatcaggcaaataatctacgtcgttataagaaacaagaataaatttatattataagtgacagtaatgagtgcagcttggaaggaggacaggcaggccatagagctggacgcatacttcatcaaacatgtattaattgggcgtttagattttgtttaaagtccaaagctgaattcaccacgcacagcaaaatataaagatcccaaatgttagttctgttgagggtgttcaattcttcggttccacattgcagaagcttagagataataaaagtgaagattcaatcttagacatgatcaaccaaggataacacaatgaatatcaataaaaaatgtattattgtacaaatatgcatgtacaggctccggcctagagatgacaaccagggtttcatttaccgccggggccgcggttatcgcgccccggcggtaagcacggttaccgcacggtaaccgcggtaaccgtgacaaaccgcgacaaaccgtacaaaatttatcaaaaattcaaattatttttcaaatttatttgaatttgacgcggttaccgcggtttaccccttaccgtacccccgcggtaagcgcggtaaccgcggtaaccgcgcggtttaccgcggtaaatgcaaccctgatgacaacacacctgcttatgatccattcatgcagcaatatgcagtgatagaaaaatgtaattttcgaccatgaacatatatatttattactaaataactcttctctctgctacatgatgcctcatactgagcctagtgttggaatgtgcacacatatgggcattacttcgaacaagaggaggacatacggagaggcgagattgaattctcattcagtctgctccacctacttgcagttcctcttaattgtttgtggttctaggaaaattagggaaaagggggcaagaagaacatgagacacatggacaaaatataaatcaagcagcattttcttttttttttaaaaaaaagaaaagagagaagaaaagggagaaccttttacagggacaagagcaagaagccgacgtttgaggcaatggatggggtcaatctgttggcaccggattagtgagttgcatactcgcattaacgttcaaccgtagttgttgtacgatacgatgggccttcatccctgcagttgacacccttgtctctgactgccggcgccggcacgacgtacggcatgaatggtccatctggcttatgcttacctttccaaaagagaaaaaaaaaacaaaagagttgagtttattttatgtatcgtcccacgcagaacaaacttattcacaacggggtttcatcaagcaccttgaccttgtacaggaataaataaatgacgaatgaatacaaatgaagttgtcggctgaggaataaagctgcagagttagaccctagaagcttcaatctcctaagatggagaggaggcaaagccatgataaaggaagatgaaaatcatctggctggaggagcagatgttgagacttgaggccaaggtcagaaatctcggcgaatggtggaggccgtggcaacgtgaaacactgtggacaaccacgccaaatctagagatggaagtaacaaatactctctccgtccctaaatatttgacaccgttgatttttttagcacatgtttgaccgttcgtcttattcaataacttttgtgaaatatgtaaaactatatgtatacataaaagtatatttaacaatgaatcaaatgatagaaaaataattaagaattacttcaattttttaaataactagcaaaaatgcccgtgcgttgcaacgggtaaaaagaatccaatgacaatatacacttttcatgcataaccatattaatgataatgtttatatggatcgttgtagttaccacaattagaaaattggatttttccgccccttgtaccatataatggttttttattatatacggacgacggaaacttttttaactttttaagtaaaattagggattagagattagatctgttcccttttgtgattaggaatttagattgtttatttacttttctagaaataaaaagaaaaaaaagagatcgggagatggggaggagatttttttccacctccgattcgcttttgtttttctgttgccgcgtttttcttttcaggatcgctcttttttttaagttagacggacgacaaaaacatcataaattttttaagtagtaacagaaacgaacggtcaaatatattttaataaatcaacggcgtcaaatatttacctcgccaactgccccgaggcttcctccattgtcacggttcaaatcaatagcagccacaaccttccaatttagcgaatgacgagtgaaacgacggccaacaggcaatgtaacagagcgacagagcggccaccggtcgactccaccacaccagcacacgctctcgtgaaaccctaggctcctctcccgcaggccgcagccatgtcacagcactctgttgtctccatgctcatggccacgagtggccttccctgagaccatgccttcacacgacggtggaagagatgacctggccactacttaggggaggatgtgaggcgcatcatggtccggtgttattgctcggtgcgtggggatagcgcggcgcacatccgctcggctggatggggaatcggtgatttcactgtcgcattgttatcacaaagatatctacatccgtttctagccgttggatgaatagatcgaatggctgataaaagagataggaagttttgtgtaggttctcctaggtgcatctagcaaagagaataactcctcctttttatatatattagtaaagatgagtatgtaggtttattagactaacatcataccacttaatatcactggtagacaaa

SEQ ID NO: 48712 - DNA, 11876 bp, Oryza sativa
ggactaaacacattcttatgtctctgttcctattcgaatcgagactaatgcgatttttatcatccggacaaatatcaattctccggtagtgtatattgatgtattaaaatggaaggggttggatattggctaccagaaattatttttctagcaaggagaaaaagagctgcgatatctaatccattttttcgaccagtaaagcatctagaaaccctgcttcactataccgaacaattcttatcaatgggaaagtctgtaatagttatccaagagttctgtgtagaagggctatcatgcaacggatcaaacgtgtggatagcacaccatggcaccacggagatcgatatccacttctgtcattccatgtaaacgacagctccttctcccctttctagagttggttcgatttggagaaggggattgaaaaaaaaaagagtaaattgcatcgccgtacatgaacttgttaggtggtagcaatctagtgtacgaacttataaaacgcttgttctagtgcatgaacttgtcaggtgcgtgcggaggaaggcgaaaagaacactacatggataatcttattgtttttgtgattgtagaaaaagattaaaaaaagagcaatgatataagctagggtgggaaagatatgaaatatcatcacttccttgatgaaggataaagtagagatcaaatttataaataattgcagtcttatgcaaacgcactatacatatgcatgtcacaccctaatcaatatcaacttcgtaagattaatattgccaagctattttggccctcgtttgcacaaaactagacaagttcgtgtaccgaaacgagcattttacaagattatgtactaaattgtacccatctaacaagtttatgcactaccaatgcatgtgcaaatataagaagggtatttgataattgtcaaaccaaatagtggtaaatagttaaatgtcccgttggcacaagaagtgctagctttagattagtagatactagaagatctgcacgccctgttgacgtgccgcctaatttagcctgtaatatggctcatctgcaaaatatatattaaatttgcatatatctcattttatattatttgtcattctagcaaaatttcacatcaaactaggagatgtgcaaattacactgctatgcttattaactacattataatcgttctcaaaagcaatattaactttgattaacagttgtacatggcattgataaaatgtgaagatagaagaccacgatctaaattaataattttaaatgtgagaatgaccagtaatattttgaaacatacagagtaatatattaatggaatttaattttctgtttccaaagaattatgagaacaaccaaattaagattgtaattaatgatgaccaatagtttggcaaatagttagatatttccatattggaaagtacgaattacccctcgaactattgcggtagtacgatttaccccctaaaccataatactagacatttaacatcccaaactctcaaaaccggataaattacaaccctaaatcgattcgaaccggttttcagcctacatggcacactcatgacaatacagtcagcaaaagcaatggtggggcccacctttcagcgcttgttgtttctctccttctctgcccctctctctcctcctcctttgcccctctctctctcagtgaacagaaggcggctgcgagcggcgggcaaggagccgaggccggcggtgggcgggggcggaggcggctgtgggcggcgggcgaggagccgaggacgcggcgtactagacgtcggggtagcgctcggtcggctccgatggcagcggcggcagagagggcgagggcggcgggacgtggagcgagatggcggcaggatcctccttcccaccgtccaggcgctcatgatgagctcgtgcggcccggcgacaccgggggcgtacacggcgtcgcggaagcccgacttccgccttctcatcggcgtgctcacccgcgccgacaactacgagcttcggcacctcctccgtatggtgtacgacctctagctcgccgccggcgacctgagcgcacacgtcgacgtccacggggatgccacggccggcatccaaggtctcgttgtagtacacgagcatgccgatggcttagaagcacgggttgacactacgccggaccaggtcatctctgacgggcccaaaccctcacctttgacgggtttggtcttggtcagtgattagtggtcactgatgacaaaatcacctgtgacggatgaaacacccgtcacagataacccatctctgaccggtatataagtcatctctgacgggttaaaacttgtcacccgtcacagatgagtcatcagtgacgtgtcgtacccacctgaccgtcactgatgactcatctctgacgggttgtaacttacgacccgtcactgatgacaaagcaagaaatacaatttttgaattttaaacgcaacaaaaaacctcaaaaaaatattttgaattttactagccatcctatacatggttacacatcactacctacaaattcacaatttttcacgcaatataacttggatgctacaagtgagattcgaactcaagacctcaacctccatatagagctcccttaccaactcacctacttaacacatattgactactaacccaatgttattattttgtctatgcttgtctgaatcatttaacatatatttaacaccctaaatgacttcaaatgaaaatattatcaactaaatagttatagatctcatcgtgttttataacttttacatagaaaatatcttcatccgatgttgtttgaagaattcaaaatttcatttttcaaaatatatctcactttataacatgtaaattttgtgaaatgaaaatattttcaattataatgttgtagatctgattgagttctatgactttgatacggggcatgtatccatccatgtcatttgaaaaaaaactcaaaattttgtttttaaaagtagatctgatcacttgtaatgcatgttcggggatgtaaatgatctctaatagaaatgttgttagttataaagttgtggatatcattaagagctacaacttttatataggacatgtttcaatccgaggtttttttgcaaaatttaaaaatttgaattttcactcatcactgacgggtcataactaccacccgtcagagataacgttatctgtgacgtgtgttagttaaaagacccgtcagagatgagtggtctcttttgtgatggttcataatactacacccgtcacagatgacatgtcatgtgtgacgagccatggttgtgacccgtcacagacgatctgtgacgggttacaagtgcaagccgtcacagatgacttcacatctgtgacgggtcctccctggtagccatatattgaagaggatattttttcggcccgtcagagatgactcatctttgacgagttgcgttggcccgtcacagatgacccgtcactgaagcccggatctgtagtagtgtgaaccgcccgcggtgttcgtccagttgccggtgtggaacaccgcgccgaggtaggggatgtccggcgagatggggacctggcaacaacccgtcccggtgcacggcgcgccgtcggcgtgagctcggcgcagtaggtgaagcagcccgtggcgtacaggtcgtcggcggcggcgccgcgcgggagaagacgaacgtggccgttggtggacggggaggtggccgatgacgcgtagcaggcgtagctgaggccggcgtagagccgcgagctgccgtgctcgccgagagaaggggggagagagagagagagagaggggaagaggagaaggaggaggtgagatgacaggtgggccccaccatttttttaaaaaaaaaggaaatgctgactggattgccacgtgtacgtcacgtaggataaaaccgctttggattgtgccagtgggggtaattcgtccggtattgaaagttcgaggtgagtgatgtctggttttcagatttagggggtaattcggtcgaccgcgatagtttaggggggtaattcatactttttccttagatattctattataaaatttaaagttatgtttcctcaaaattgttgcgatttcattaaccaaaaagttatagactaaagtgcatatttgaaaaaacggttcttagtattacaaattctcatcgaatctttcacttcatatttgttatttagtttttcccgattattatttattttacagaaatacaggatatcaatatggttttcaccataagatatcgtacttatccagatttaccttcatttttcctatttctgcttggtcctatttgtgttattactaatttagtatgagaaagcaaagtgcaacgtgcaaatgctatagcagcaaccaatgttttaaattggctgagacactatgcgggctaaatgaaattataacggttaaattatacattaaaaacaaatagctaggaatatatatatgtatatatgtatgtggactatgcggatgccgctgagcaggtttctattgtagcacatcacaggcagatggtgcagaatggagagcagcactaatagcgtgcacatgatttggaattttggatgaagcaacagggatgatcagatggaatcatggaacggtacgagattatagaggattatcaacctgattgattgcatgcggtataccagtccggataggaaggaaggatgggcccacggagcagaaaaaaggagatcgttgatgcggcctgcggcgctttaaagttagtcaaggcgtcggcagaaaggaccccgccgaacaatattatcaatctactattttcctctttttatttttactagcaaaaatgcccgtgcgttgcaacgggtgaaaaaattctaatgataatatacgtttttcataaataatcatgtcaatggcaatgtttgtattttaatgagcggcttgttttttacgaacggtgtttttttcttgcgcgattttctcaaaccattcagaaatgacgcatttctttctaaaagatttttctaacatgatctttttgcttttttatttacaatgaaaaccatatttttctctattttttgcttttcttttctcgtgtgttttttgcctttttttgccaattattttctcgcgtgtttttttgcttgttttttttcaaatgttatttttgttgctttttttaaaaacaagagaatatagacgaaataaaagccgtgtagtaggtggcaaaaaatcgatggatcctatccgactcagagcgatttttttaatagacggtgtttttttcttgcgcggttttttaaaaccatttgttaaaatggcgcgttttttctgacagttttttccttgcatgttttattttttaaaaaagttaccgatgatggaaataattttcctcgcgcgtttttttatttatttatggaagatggaaaacctttttagcgtgtttttttgcgctttttctgacttttttctcacgcgtttgtttgaaccgtttctattctctcgtgcatttttttttaaaaaatagttagattatattagagatagagaagagatatatattgattagaaatttcgccctttccatttttttcctgtgtgcattttttattttatacgaacaagcgttttattttttacgaaccatttttttcgccactttcttatggaatcggacaaacttttttagattttttttctgttttttttcacctttataggaatccgactttttttcctgtttttaacggaatcgaatctagtattttttttcacttttttttgccttttataggaatcagattttttttcgttcggatctacggtttttttttgccacataggggaaacagaacttttgttgttgttgtttttcttttttttttgcagctttcctttttctttttatgcacctttctgcttttgttctctcttttattattatttttaacaaaaacggccccaagtaccttattgcaagattataggaactcaaatataaatataaaaattatagggactcaaaagcaaaagtacaaacccaaaaattaaaatcatataaaaatggaatgctctcgacctgtaggttctgttttattaaacagatctctaatccggcacatcattttgtttcaccaagatatgtgagatatcacggtatagattaagaatcggatctatagtcggactttttttttgtttctgagagggaatcggataggagtcggacctttttttttagcttttttttttacagacgaaggaaacatcttttattattttttaagtagtagagacagagatagagatagagattttttttcgcttttttaacatggaatcggattattttttcgccctttttttgggatcggacatttacggttttttttctcgctcgtccgtttttttggggcggtttttttgtcgccctttttcacagaatcggacttttttttgcccttttttattggacagttacggtttttttcatttggtttttttcgccggttttttgtcgccctttttttcacggaatcgaattatttttttcgccagacagttacggtttttttttgcccggtttttttcctcgctcgcccggtttttttgacggacgatggaagcatatctttttaagtagtagagaagagatagagatatatggttttgatctcctgatgtgtgctgaataggacttggtacgatttaaaccaactcctgttcggttgatttacagccaatttggagtgttgatttttttttctatagtcagattttttttatgttatgctgaaccttttttagatggaaacttgttttttttgtcatggtggggtatcgaatcggttttcaaaggcggttaatttttttccgtgttgaatagaaataggacttctttttttttttgctgcgcctctttttttttttgcatttttctgccctttttttaaattttatggtacgataggaataggaatcagatgattttttggggcgcttcttttttttttttgccttttttacgtttttttttgccgcgtcggaatcggtctttttttgccgcttttttttttctcgccgccctttttttcacccttcctattttttttcgcgctggcctttttttttttaccttttttacgttttttttgccgcgtcggaatcggtctttttttgccgctttttttttctcgccgccctttttttcacccttcctattttttttcgcgctggccttttttttttttacagtcggactttttttacacggacgaaggaaacactttgtatttttttcacagaatcgaattatttttttcgccggacagttacggtttttttggcccggtttttttcctcgctcgccctgttttggtttttttcctcgctcgcccggtttttttttcgccagtttttttgacggacgatggaagcatctcttattttttaagtagtagagatatgatattttctattttgtttttatggctaagaggatttggttaatctttgttgttttgcactgaaaaatggttgtgtttctccacgaaagcgaggaggttatcctttgctagtttgctcggaaactactcgtttgtcgtaacgtaattccgatatttctcgtcatgtaagtacgatatttctcttatttgctaatttgctcataaattagtcgtttgattccacgaaagtgaattaatcttgaaattttgatctatcgatattgacaacaccgtcgattacaccgcaaatcgttaggtgatttttgttggccaagagaaaaagcatcaacaaacagcgagtgaatgaaccaatggcttttcttttcttttttcatggtgcattgtccgagaaaattgacatttagccacatgtaaggatgggtttcgctgtaatgccattccgccaagttgtttcgctaaaatgctatcgccacgctcgcacaacacgctgcttcgccgtttttccaatttcaccggattaacacaccgaatcgcgagtgttgtgaccaatgtgcccctgggtcattctttagatcagtgagacaaaggggatcgagatgcgccggctcttgctcacggcggtgccctagatcgatcttgtcagcatcgccattccacctgtcgcgatccccctctcgccctcacccagctatagctcacggcggtgctgccatcgccgttccaccccccgccgccgctgctgcagtccccttgtggatattatgggtaccccatacccatacggcatggttatccgactagtcataggggataacttatatctatgggatatgtaatagatcatgactcgggtattacgtttccttatatattacggaacagcctaaagtcctggtttgataatattgtaaagtagatttaggaaaccgataccgtattggttaaggtttctatcttgtaatcctgccccccaccctatataaggtgggcaggaggccctctagggggcatgagacaacctgatcgtcagatcaatacacactcggcggattcaaatccccaaacaggagtagggtattacctctcattgagagggcctgaacctgtctaaatcctttgtcttcgcatccatccacttttaggtctcgtgcgctacccccttttattattgccgaattcatgtttcgacagttggcgcgccaggtaggggctgcgtcgaattacccatcgaaaagtgtgatggaatcgactacagaagaaacggcgagattaatctcgatggctcaaatcttcagtcgggagcagcgccgacggatgcgttgcggccaccacgccaccacgggcacatgggagcagccgcctatagcttgctcggagaaatttcatgcatgcatgagttgattcagcagatcaacatacagctggcatatcaagccgccgttgttgggcgtctacgtcttcaccgaccggcttgcctccgccgccgccgactggtgtctctgcctacacggctggcctattatgccgccgctgttgggcgtctacgacttcaccgccggcctgcctccgtcgccgccgagtggtgcctccgcctacacggctggcctattatgccgccgctgttaggcgtctacgacttcaccaccggcctgcctccgtcgccgccgagtggtgcctccgcctacacagctggcctattattatgccgccgttgttggatgtctacatcctcaccgttggctcaccttcgttgccgtcgactggtgtttccgcttacacggctgacctatcatgccgccattagtgggcatcttcgctttcaccgtcgaccgccttcgtcgccgccaactggtgtcttcattgttattgatggacgactttgttcccacattggccacttctgccatcaccaaggggaatattacaaagctaagtcatcatttattttattctttatatgatattttttccttttcctctgcctcactacaccaattggtcttccattgagtagtgagtcgggggctacagatgttatatcatatttttcataatatttatcttgattgcttgcgacataatctgagtacaaaagtacctatcgagttatggagttctatcttcctatgctttccgtttggtttgccaatggatggttgcctttgggccgattcctagcacccgggggctcgttggatggaccgagtaacgcaaggtgctaagtactattcggaataaatcaaaagcatagagatgagataaatttattttctgctcttaataattgcaaaagtacccgagtagtaaactccgatccgtgaaactttgttccattaatgacgaactcatgacactcatatgcatgtttgggaagtgcttaggccgactcccagtgcttggtggctatgattagtcgggcagagtgtttaaacgtaatgagtcatctgctcggggaaatcaaaattgacaagaggagaaatacatatttataaatattttaaaatacttgattttttctcgagtattatatttatatcagatactactcatcctatatgtttgttctgcaggatccagatccagatatgcataaaagggattcatggttttaagcttatctcttacgctccaggaatggatcagtcagaacatcaccaaccggccgcctcgtctgccgccgactggtgcttccgcctgcacggctgacttattatgccgccgttgttgggcgtctacgacttcaccgaccggcttgccttcgccgccgccgactggtgcttccgcctgcacggctgacttattatgccgccgttgttgggcgtctacgacttcaccgaccggcttgccttcgccgccgccgactggtgtttccgcctgcacggctggcctttaatgccgccgttgttgggcgtctacgtcttcaccgaccggcttgccttcgccgccgccgactggtgcttccgcctgcacggctgacctattatgccgccgttgttgggcgtctacgtcttcaccgaccggcttgccttcgccgccgccgactggtgtttccgcctgcacggctgacttattatgccgccgttgttgggcgtctacgtcttcaccaaccggccgcctcgaccgccgccgactggtgtttccgcctgcacggctggcctattatgctgccgttgttaggcgtctacgtcttcaccgaccggccgccgcatccgccgctgactggtgtcaccgcttgcacggctggcctgttataacgccaactgatgctatcttcttcacggctggctacatcgctgtcactactaataggcatcagtatcttcaacacaagctgcctacatttgccatggctgccgactgttttcttcacttccatggctgcatgattctgccagtgttgattggccttaccatcttcatcgccggtcgtctcgtctgctgctgactagtgccctcgcttctacatctggtttatacaactatcactactgatgaacatcatcgtcttccgtcgccgactggttatgttgtcgccgactagtgcttttattttcacaactgcgcgtcttcactaccagtttgcttctgttgccgacgactcgtgttcacttcatcacggcaatgcaactttgtcatcatggtagagcgacttcatctttattatcttcggcactggcaaactctattgatgctacttcgcaagttttgctacttcaccaaccacgacgtctttgtgagcctcgacatctcggcatgcgatgccatgttattttactacaacaagaggctctccaatatttaggatttctacttgaacatcttcaacacatatcttcaatcaagcaataactattcgacgacaagaggctacagttctcgactctatgttcagttgtttcccaactaatcaaagagtcgggggctacacaaatacaaggctcaaaatttgacaaattttatgtcaagctgaagaaatcaattcatcaacccacgagtcaactccaggagtcattatcttcatctttgcttcggagcagacattctacttcaacaacttcaaatatttcggtttagacgagttggacaacaacatcaactctcctccaagtgaagcatctacaacagctataacattaatttgatggattattgtcactgacatcatcaccagcacctctgcttcatcgaccctgacatctctgctgttgctaatggatgattatgttttcgctgacttattatttcaccttcacggttgacctactatgcaaatgctgatgagcgtctttgtcattttcattggttgctacactgctattggctggatcaccgacatcgtcatcttcatcatgtcggttgcgtttgttgtcgtcaactacacaactttatcgctg

SEQ ID NO: 48713 - DNA, 860 bp, Oryza sativa
ctgcctccgttgccgccgagtggtgcctccgcctgcacggctggcctattatgccaccgttgttgggcgtctacatcttcaccgccggcctgcctccgtcgccgccgattggtgcctccgtctacacggctggcctattatgccgccgttgttgggcgtctacatcttcaccgccggcctgcctccgtcgccgccgactggtgtcttcgcctatatggttggttggtcacaccaccgttgttgggcgtctacatcttcaccgccggcctgcctccgtcgccgccgattggtgcctccgcctacacggctggcctattatgcctccgttgttgggcgtctacatcttcaccgccggcctgcctccgtcgccgccgattggtgcctccgtctacacggctggcctattatgccgccgttgttgggcgtctacatcttcaccgccggcctgcctccgtcgccgccgattggtgcctccgtctacacggctggcctattatgccgccgctgttgggcgtctacgacttcaccgccggcctgcctccgtcgccgccgagtggtgcctccgcctacacggctggcctattatgccgccgttgttggatgtctacatcctcaccgttggctcaccttcgttgccgtcgactggtgtttccgcttacacggctgacctatcatgccgccattagtgggcatcttcgctttcaccgtcgaccgccttcgtcgccgccaactggtgtcttcattgttattgatggacgactttgttcccacattggccacttctgccatcaccaaggggaatattacaaagctaagtcatcatttattttattctttatatgatattttttccttttcct

SEQ ID NO: 48714 - DNA, 711 bp, Oryza sativa
attcctgcagccctccgcgccctgaccgtcctggcccagcagagaagagtgagattcagcagtgctccatctgagcgtgagctcaaggaggcagctaggctgccatggcccatggctccgccagaagcgctggccccaacgacaggaggtcgtgcaggcgaaccacacactcaatgcggacggcaccgccgcaggatgctgcgctgcgggcctgcgacaccgttggtgaagaactcggcggcatatgacgagagaagcggccggccgggagcgagccttccattttcgtgggttgattttggtcggcgtgggctgaaaagaagccagtaggtccgctgtgcttgtttacctccgttggatggcgatcgagcggcatagtggcatcggacgtccctctgacgtagattgctctacgtcagaggatcctattccgtaaggctatgtacatcctttaggtgcagaggccggtttaatccattatctaaaaaaaaccaaacaaccactagcagttttcacattgagtacagaggtaaaggaatgcagagccctgaccttaggagaggccgctccggtaggacgaatcggcggcgatgcacgaccgcagccttgccgccgccaccgcgctgtgcagcggcatcaaagaatccacgctcgccagcgccgctgccaccgccacgaaggacctgaaacagtcaggatctaggtactttg

SEQ ID NO: 48715 - DNA, 812 bp, Oryza sativa
  unsure (1)..(812): unsure at all n locations
acggtttccatccgaatgacacttcgatgggacagcccacacctacctccactcccggcggacacgggcgcaacgtgggatcgtggctgcccgttgctgacgcgaccagtgtcagactggtcattcttgtccaccatgtgtcattttaacaagatgcatgtttgcccttcttcgtgtaacaccttgcctgtaatggttaggataaagcctggtataaatctaaccagggctaacgtgccatctctaagagataacacgctagctccggcttgagacgagttgcctagaggctttcgtcttgacgggatggggcaaggcgtgcgtcagaccgccagtcgccacctaacccttgatctgaccggtctgtgactggtcacagaccggataaaagagcgtgctgtactgcgttacatgcagcgtgacacgcttgaccagactgtaataaatgctgttaggtgagcacagctgtgctcacttatcccatatatgtggcgcagacttctttaaggggtcggggtgcctcggccataggggagagggcaagngaacccgaccccccctcgggggaaatcaggaggagggcggacacctcaccctcgggcccgacgtccccgaaggtgccaggccacgcgggcgattgtgtctacctcaagcctctggtcatgatactcccggtcccatatcaccgacaggaacattgagcaaagaacacagacttacggagcaaagcaactacactattgattcaaaccatggtgtttatgcagctgcataggattgccaggtcctaattggctgattctgccactaac

SEQ ID NO: 48716 - DNA, 912 bp, Oryza sativa
atgctggagcaacgtccttgtgctgaaatttctctgatagacatgcatgtgaactgaaattcgtctgtttgtgattgggtaaaagaaaggtagacttttttttaaaacagtagaagcctttctttggggcatactgtataatgagagtatgagactaatctattatttatttattttttttgaaaggagagactaatctattattaatttaggatggtaaattacaggctcaaatttggttttcttttttctctacctctgaattacctgcttaaggccttggattctcctttgtttctgaaatatttgtgtgctagaaaagtagatataataacacattataatttgcgtgctttcagttagttttaagatttttgatagctattgtgtgtacatacaggctatcttcaagccaccaaaagcgatgcgaggtggaattcccatatgctttccacaggtactgcaatattccctatatgtttgcagtgaaaagtgcacatctgcaccagtttgggagatggattttcatcccttgaggggatgcaattttacttctgaactggtgaaaaaatgaacgtttttaactgtaaaactttgtcagtttggaaattgtggaacattggagcagcatggatttgcaaggaacaggctatgggccatagatgatgaggctccaccactaaatcataatgataacaacggcaaagtttctgttgaccttctgttaaagccatctgaagatgatctcaaatgttggccacactggtatgataacttattctggggacatatatatttaactgtccttgagtagtttgtctgttacagctaggtgagtaaaatgtccaattctggttagctagtgtgtcagggaggtggttggttaaatagctcaggccataaagtaataag

SEQ ID NO: 48717 - DNA, 1009 bp, Oryza sativa
  unsure (1)..(1009): unsure at all n locations
tagctcgctgctcttctttctttctttatctttttaaaatatatttatagctggcttatagcctgctagtgtacctgctctcacgtacactacagtatatactactctcacgtactgtactcctactagaagtactccactccgtactctgcacacgctcttcgtcatcatgcacatctaatcatcatcgtctcttcaattacacaatatacagcctctcgtttttctttcaaaaggatataggagtagcaaagtactataactcgtacgaataacatgaatcgcggtatttctttgtctaaccagaaaacataaataaacttttaagggcgcgcacatatatattaatattgacaaccagtagtagtagtttgaatcgcgacgagtttgcttagaatgatgtgcttttgttggaacttgctaaagaatctaggattggaaacgagctaccaaccaggaagatatgcatgtccctacgctgatcaaagatcacctatgcctaattctcacaggggctctaaaaggattaaatacactaacttttgggggttacaagtaaaactaattacgtgttgtcgaaaaaatcgtacctactcccttctccacaaaatgaatcatntctgatttacccccagaagctgattcacttgaggatagagggtgtgtatatatagtagacaatatttactatgggacataaaaaaacgtgtaattagctaagagacacagtaaaaacatgaatttgttgaaggacaccacagaaaatcggtaattagctgctggacacttgtcagattattttattatatccgaataaattggagagataaacacatgtataactatagttttaccttcaattttttttctttattcttccttatcttctctctcattctttctctctttctccctgctctttcttcaaccgaggacggctgcacagcgaggcgtgggccagtgtggcgcctcggacggggaggcgctgcgcggtcatgcgcaggggttg

SEQ ID NO: 48718 - DNA, 1172 bp, Oryza sativa
catggtgcgtcatttcaaagttgttttaataatataatagatagatagatagatagatattgcttgacagatgtgtcctatcttacaggtttggaatcctttttgttggttaagaaagcagtaatcgcctgttgcttgctgctcttatcagctgtcacagacaaaccctttggcttctcaccctcttaaccttgttcacttttatccagaccagataatatatgaggtgagtgtttttagatgaacacaatgggaaacactgcgtatgcagtcatggaattatttttatctcttagattgttaatggcatggtgtttccttttctggatgcttacacagaaacgaaatacaaatagggaagaaaaaaagaagaagaaagggatgaagtacccgatttcattgtgtttgaatcttctctgcactttccagtttcatcgtaccatttggccatttgagccctttaggctcgtgcttcgtgtccaactttgtagccaccgaattactgcaacttcgtggggattaatcgagattttgatgtgcactctagtctatcttggctggccatccaacttgcccttgtcctctacgggttgcaagtggccacgcacagttgcgttggtctacgcaccgtagatcacgccgctggtgtcgacgaatttaacttggttcaagatgtgccatgtgtgccgtgtgttgccttgtccgggaaagatggaaattctgaatgtgtggtttactagtacaaggattatttcatccaaagagggaaaaaaaatctgcgagttcccttcagtagaaaatgggtagcagaacattattgttttaagctgagttctagatgtgtggacagttttccatattcagatgaaattcagtccttaatttttcttctaagaaatggtttggttgagagggttagaaacagctgcaactgtgttttttctcctttctcaacgaaaggcaggattgctaccgtcggattgagaaggcaaataggtatttataatacagaaacgagtttacaggaggctataagtactaaaactcaggcctgtcgaaaaacacaggctgatgaatgatgattgaatgaacagagacaactgggccttaacccagtgcactcactactctgaataatgatcaaagcacttatttgcatgcatatctaccat

SEQ ID NO: 48719 - DNA, 1082 bp, Oryza sativa
cccgtggccagccgtaccgagcccggccgggggacaccgatcactcgatacggaccctcccacattggtgagagtttgctcaatccagcacgcgtttggacgcggcgtaggacgaggtcgtcgacgcaaagtgatcgggcccggacgtggcgctgatggtagcgccgcaggctctgctggtagcgcgcagctcggagggccgcgcgccgccttcgctcttccaagtagtcgaggtcatctctacgaagctgatcttgatcagcctcgcagtacatggtggcccgaggagacctcagggtgagctcagatgggagaaccgcttctgcgccgtagacgaggaagaaaggcgtttccccggtcgctcggcttggtgtggttcggttcgcccagagcaccgctggcaactcctcgatccatgaatcgccgtgcttcttgagaatattgaaggtcttggttttaaggcctttgaggatttctgcattggcgcgctccacttggccattgcttctggggtgggcaggtgaggcgaagcagagcttgatgcccatgtcttcgcagtagtcgcgaagagctcactagtgaattgggtgccattatccgtaataatacggttaggcactccaaaacgggccgtgatgcccttaataaatttaagagcagagtgcttatcgatcttgacaaccggataagcctcgggccacttagtgaacttgtcgatcgcaacatacagatactcaaacccgcccggggcccgtttgaacggtcccaggatatcaagcccccagacagcaaatggccatgacagtggtatgatctgcagggccggggccggctgatgaatttgcttggcgtggaactgacacgctctgcatcgccggaccagatcgactgcgtcattgagagctgtcggccaataaaatccttgacgaaaggccttgccaaccagggtgcgcgaggcagaatgggctccgcactcgccctcatggatgtcagcaagaagctcaacgccttgttcctgaggaatgcacttcaggaggattccattagccgcgcgccgatagagggtcccttctaccagcaca

SEQ ID NO: 48720 - DNA, 782 bp, Oryza sativa
tgacagctaatatgaaatacctggatatttagtgtagtccagtatgtgaggcttttctgaatggtagtctgcagccatctcgcagaaatggtttgcaatgtcataagcaactggaccaaaacttgcatactcatagtcctgtgtaggcatgatgaggaaccagtaagatcaagacgatatgtttgttaatttcgcctggctacatataaaacttcaggttcataaacagacatgacatacatgaaggctaataaggaaaatatgcataatctttcataaagtatgtcgtttcagaagtgaaatctttattcctggagatagtaacatacaactcaatgtatgataaggttatacggagtaccaagacgcatcaatgtgtgtgatgtgaaataacaaagcagatggtttaactctcctttttccttgtggtcggtctgatgtctctagacgaaattgagctttcttcttaatataaagatgtccaagtctcttgctcgttcccccaaaaaatagtaatggaacagatgaatcaaacatacacaatggagcaagaacttacaatgatggtcagcaatttggtctcttcatcaatcatgatgtttccatactggagatcgttgtggcaaaatcctacgcactggtaatcctctgaaagctcattttccaacgcagtgatctcgttctccatgctatccaagcagaactctttggcttcgtcagaggggcacaaattcttggcagttttgagccagttcctgatgaagatgtgcataggcattgtc

SEQ ID NO: 48721 - DNA, 5774 bp, Oryza sativa
cgccatcgatctcttctgctgtcgtcgtccttggtccaccatggtcgtcattgttgcgttcttccgacgcagcgggctcatccactgagtcgtcgcgtccttctggcagtgtcgccttgtacactgtggccgcgggcgtcgtgtagccgccattgtgttgtcgccatcttccaccgcaattggcgtcttcgtccgccccagccaccgtgggcactaggacgccaccgtcatccacgtgcgtcaccgtagtccggaggactagaggagaagaggtgagaggaaaagattgggaaagatggtgggtcccatgaagataataaaatatatatatgttacagttaatctattactccctccgtcctaaaatgtagctatttctagcacagtgtcttgtcccaaaatgaagctatttcttcacctacctcctcctctcaaccaatcacaaccattcttcttcacacactttctcttttcaaccaatcacacactttctctaatcattctcacctacttttttaatacccgtgtcaaccgtaaaaatggctttattttgggatgaaggaagtatagacaataactatactgtttgttatagatgatattactatctattatagtcagcactcagcagtggactttctcttcaaacccaattcacctcttcttccgcccgccgttggctgccccgcacgcgtagctaaaagcgggtgcaccgagagcggccacgtagtactaacttctctttatcgagcgtcaacgtgagccgactgcaccaaaatcatcagtggaagcggagcacttttccccagcgaaaatcgagcgacgaatcatggcaaaaagcttgaacccggtcctgctttctctgaatttctagctatagccactcacaggattttgctcatgtgcagtcgttagtgtgactcatcttaaacagtcacgaccatccaaattgcatgtaagtatgggtgcaagcgggacgggcaagttgattttttattctcacttccagttcattttttatatcaccatacgagaaataaactagcaaacggatttttatgcgggtagtgagactacccacttgcatctctacatgtatgggttgaattctttattcttggagcactgttttacatagaaaatagtaccgtacaaccactgtagtgatggtgctatagcacttgatttacgtctttgatctaaaaataaaaaatgaatgataagataccataccgttattaacttacagttctagttgtgactgcatgtaatctcaatccacatttttctcatctttgcagaaaataaaggaagcgaaaggaaaggaaacttagtcctatttaaaatagattattaactgaattatcatagtagattaccaataaaattataattataaactaaatatttcaacgataaacttaataaacacttagagatctaactacttttgaaaaaaaaacatattttaagagacgtgaaatagttaagcgaagttctgaaaacaacgggaccttagtgacactgtagtgtagcacaggccacataggaatcaggacagggcacaaagtcagctggcgtcggcaaatgaagggtgtgttggttgccggtcacactcacactttgtcacaactaacattaggtaaattgtggcagccacaaaagtgtggtggacaaattgctagtcacaaagtgtggcaaagttagcaagaaaattaagtctatgacatatgagacatgctattgaaaaactgtggcaagccacaactgttgcagtgaaccaaacacatgcctaacaaactgtgccaaccacgagtatggtgtggcaacgtgtggccaagtctcatctcaagcgagctaaaagaaaatctcaagggagctactcctatgtgcagttgaaaccgcaagctgtggatacatagtaatactagtttagtccattttaagcggagcgatggattttcgtatctaatatttaactgttcatttttttaaaaaaatattaaatattaaataaatagtcacatataaagtactattcatattttattatataataataataataatatttttaaaaaataaattaaactattaaacgtttgatataaatagtgtaaaattgtggtctttctaggcgaacatagtactgaatactgatgtcgcacagttggggcgaaacgagttgtccattaccattagcgaagacgacgatgctgcctcgctccaagcccccaacttgcgtgcgtgtgatggcactagctctctctgattttttttgtaacgaatcagacagccgtcaatttcatttaatagagaataataaaactgtacagaaaacacagacactagctctctcatctcacagaaacttactttttaccgctcatgcatgatatcgaatggctgggagctggctaatctgaatctcgctcgcactttgacccggctcttgcatatgcatatgtaacattagtggtagattgctgaatgtactgagattattaaggcgtgatcttgttctgccgtggtcaaatcaaacactgcaacaatcttttgcccgaacgaagcaaacaattaatctttttgtgagtgtgcgaagaacgcccttatcttttttttcatggctttattcagggatttgttttatttatttgcgatatcttctgaatctggatacaagctgttattatcagaaattatcacaaaaaaatttcacatatatctgagatcgttagtagttcatgtatatactctctacattcccaattgatcgtcgtatataatttttaaattatttctaaataatcatcatattagtatttattttctaagtttattcgttatatgtgcctaaaagatactccctccatcctataatataaggcgtggtcaaacttggcactatcttagtaaataaaatttaatttataatataataattgttagctaaatatttttaaaattaaatattaaaatgtgtgcacgctctatttataggaagatggagtattcctaaatagacattgatgctgtattcatgcacataacacacataacagggttttggtttattatcggttaattagtaaatgatacgaatgttgtatggattgagtttgttaccgagcaaagtcattatgaaagaatttattatgtactcatgcaatataatgattaactgagagggaacggatggagtattttccatgagaatctgcttgtcatgaagaaaaaaaaaaaaaggcgccatgtgtgcgcacggtgaagagccagcttgatgtcgaaagtaagcgaaaaggaaataaaatatccgatactgtgtgtctgtcgccggcttgccgagcaaacccatcatccgtggcggtcagccgctctcgcggcacggcgacgcgcgtacgcacgcacacaaaagctggggagcaccagccgccgcaaccgccacggcggaccgtgcatcatcgtgtggactcggcgctcgctcacgagtcacgagcgcgatatagaagttaaaaaggtgacataagtgagctgtataagttgtcacattaaatttatacgtagagaagaaaaataaaagaaaaaaacagggattataaatttatagctaactgtaacacgaacttagataaagtactccatctgtttcttattccatctgtttcttattatgagtcgtttgtctttttttttctaatcaaatttgtgatcaagtttgtagaaaaatacagtagcattatcaatacaaaacaaacattatatcaaaactaggaaggtggcccgcacgcgcatgcgcgcacacttatattattgaaaggtaagattattatttgttcaaaattaaattgtcaaatagattaagggcaaactaaagttgggataatggcattttataataatttaagggttctatttttcttaaggtttcttaaaaaaccattcataaacatttgagtaggagatgaattaattacttaccacttttgaatcatgtttttttctcgagtaaataagaaactattgcttaattatcatacaatccatccatatacatatcatgtagtatgtccacaaatgaatagtgcgagagcaaatattcaaaattcttgtgattaaatcgcctcatgaagacgtatgatatagtaagaaagggagggaagcgtatgtaaggaaaaaaagaagaaaggggaaaatgaaaaaagggaggggaagtgtatgtacccacgtacgtaggtgcgcacctatgccgtgggaggagaggtgggacctcatagtatttagtgttttctaagatcaatttagtctagcggtttataatattggatgtgccaatttaagtgaaaatcaagtaatatatactttgcttttttttcatataatttctaatatttgctctaatttattagagcaccacgtgacagctcgagagcattttaagaaattttataggacttaacacatgtaattagaatattaaccatgtaatatatatgtatggggtatatggtaatatttgttccagcttcgtcgatgtttatatacatgtagagagaagccattagatgtctaattaatagcaattaattttgacacctatttaccgttgttcatagtagctcttacatattcatcttatgactctgagtatccattgatccccaatttactgtttacgatgactcgcatgaaaaaaatgtactacttagggtttaggacaactgaaattgatgaattatctgatttatgtgatagctatttgagggtataaacgaatgaattgacttctaaaagttaaaatgttgtttaaaaaaagacacaatttagaaacttggaaagcatgcaaatgaaattcaaactatggaatcgggaaaaaaaaagagggtcttaaactcccttgtcttagaagagttccattgatattcgttaatattgtgctcacatttataatataatgatttctttcaactgtacggacaaataatacaaaatccaaatacaacgtaacacaatacattataattattctgtaatcaactctcggttcagcttaaacggagctaagtgttccaaaaacacaacccacagtgcttaattcttctctcgctgcatcacacctctaattttcttttcatgttattaacaaaatttatcatctccatatatgatttgacatgtagcaaagcggtagcgctgcggcgatcgtgatcaccttatgcctcaaacacgacgctttgtcacgcgtgcaaaaggcaaatgtgcatacgtgcattgtgcagcgggccaaaaagggaactttggatgctttatttattagcaaataatagatttgatgatttaaataatatccactggttttaatgtaagtgtaaattagttgatatagattttaaattgttaatttaatgggtacacaatataatgtcatagactgtattttgaaacaatgcattatttgagaatgatagtccaatgtaataaaaaatagatccaatgatttaaataatgggttcatcggtttaagtgcacgtataaattagttaatatagatcttaaattatttatttgataggtacacaatataattgtgtaaactttattttaaaatagtgtattatttgaaaataatagtacaaagtaatgagtacgacggtttaattaagtggaaattatcttactccctccggtttcattctaattgaagttttggataataacacggtctacaaaatatatctttgaccttatttttctattataatatatacgataaataa

SEQ ID NO: 48722 - DNA, 11391 bp, Oryza sativa
catatgatttttttttgtttatttaaaaagatgctcaactggttgtttgtcccactaaataacactgagattggtttacatatgaaaagtgtcacatcaccataattcaacgaatgttactttaagctgcaaaacttgtaaataaaaggtttttggatctgcagatcagaagccactatagaacacatcttatactatatagcaaaacaatctggcaatgccaaatgctggcagtgtcattagcaaggatataaacttttcaacaagagagaatttacagaggagatactgctataggggagtctacagaggagatactactggaaaaaggccaacagcagcacaacacttacaatatcaccttcagacgatgggcagaatcacgaaaaaaaagaatacatatccttggaatttcttctgtactctgcccttgtttagttccaaactttttcttcaaacttccaaccttttccatcacatcaaaactttcctacacacacaaacgtccaacttttccgtcaaatcgttccaatttcaaccaaactttcaattttagcgtgaactaaacacaccctctgtagcactcatttcattcaagtgtaattagtacctgtcagaaggaaacataaatgagctaagctagaaataaagcattccgttagatgtgatagccttgcaagcctcaaaatagcaatcatttatatttttatgtaatagcacaaatattaacagaattaatttagaatatttagtctacataaagcctttgttattccagtttgcctgagattgagggccctgttcggtgtgactagatggcagccagcagctacggtagcaatatacaatttctactgtagtcactgcagcagcagtgctgcacagccgctgtagttggccggccgaacacaccctgaacctgcaactactaggtggtagcgtcaaacgtatggtcttcaacaatgtcagtgacagatagctatatcaaaccagtatcttatcatttcattaaaaaggaaaaatatatctaggtatggacaccaggaacatggtagagactgaccaagggcaagtctagataggtctgagcatgtaaaacatagccttgattttgaaaaatgggaaacagaaagagattcaagagtcaaataagtgtgcactcttgtgggaaataattggttggtttgcttttcagctttgttagctccataattataccaatgaagtgcatgaaatcatccaaaataactgtccgaaaaactaatttctattttcacacattgaagttatgacaaccaggtaaagtattttttacactatacaaggtattggtaaaagctgttcaagcactgtcaaaggtctaaagctcaagttcattaactcacatcagtgatcaaaacttaagctgatttttcccagactacttcccctctctttggaatatttgaagagtaggcatccctgcatgaaagaaactgcctgaatggcttgttcacaatactaaaaaactggaatcaagtaccactaaaataaaatatactagaattttattctaacctggttaacatccttgatctatcctgcatgcacctaggccatccaacatttgaaaaaacttcatagcagaatttggtttgcttaaagatgctgtaaacatcatttatgtaaatgcagagagagactgagttggatggtcccaggaagtgcaccgtgtgaaattcatagattcaatgattgatttggggggattactgatgcaactatgaggcaaactcatagtttgttttcttgcatgtgtttccaatatgtaaacatgacaattcagatttgctgcataatatggatccggtagttctcatactgcactatagtttgtcaaggaggaaagtcaagtgctggtgcaaaaccaggtcgtctcgctagttctgcattaataaaacctgcacccttcgtctttaagtgactattatcagtgatgaccagcaggacaaatttgtcagatcttctgctatcctcctgtaacaatgcaaacaacttaaaaggttcacctccaatttcctgatattctgcactcttgtaatttagcaaatgcccgctttcattgcacctgccattcttccaattcccaatgatagaatcggtcctaagatcacgtccaaacacagaagcagcactagtgtagaccttccgctcatcagcaaaagtttctttgtctttctcttcttccaatgtgaataatccaatttcttcaagtgtgcttcttatatctcctttggttctgaatagcaattatcttcggcatcctgttctggagccaaagtttctttagaatttctttttgattccacccaaccttcagattttttatacattcctacaagtgcatttgccacatatacatcagaaatcaggcccatttttataatggaagcatgcagttgccttcccaaatgaatagcacaaagatcagcacaccccctcaagattcttgcaaaggtaacacggtttgcacgcaacccactctgttgcatcatggagaaaaattgaagagcttcatcactgcatctattttgaatataacccaacatcaacattgcatatgaattgatgtttcgactcctcatgctatggaaaaacctacaagcattagcaatgcacccacacttgacataaaagtttatgatagagtttccaacaacaacatccaagtattcagaaccaatcttcacaagatggccatggatttgctcaccagcctcctttgctcctatatcagcacatgccccaagaacagttgagaaggtgaaatgatcaggacgcagaccagaacgatattctctgcagaagagtagaagagctttctgtggcagtgaattccagcaatatccagagatcatggcattgattatcactagatttcgtggaaataatgtgctagagaataactgagaagcccactcaatgtgatggcattttgcatacatgtttactagggatgcactgatgaaatcaacaagtagcccaagtttaagagctaaagagtgaatctgctttcccttgtacatgtcttcaagtcctgtacaggcatttattagattagcaacacagcgctgatctaatgggtcttcagaggttcttaactctaaaaaataaccaaatgctctttcatattgtaggttcttgacacagcctgccatgactgcagtccatgatatgacatctcgggattgcatagttttaaagattgattccgcgtgaatcaacgatccaatttcagagtatatcgatataagagaattgcaaacattagtataagataaatccccagttctgaaagtataagcatgcatctgttgaacttcctctttggtctgacagatatttatcacagtaaccaaatccccttcccttaaattgagacccgaataaagaagaacctctgcgagtttcacagcttcaccctgacaaccatttgagtgataacctgagattgccaaagaatacaaagacgcatcatgccttctaactgcaggaacaagctttttgatgtactgagtctcacctgccttcccagctgacttgatcagttcagacacaacaaaacagtctcttcccaaccccgctttaagtgcataaacatgaatgttcctagaaagctcaaatgctcccagaatagcagcgacgctagcaactaccctcaatgtcaccacatccattgccatgccaactcgatgcatatcctgacaaagctccacggcatccatgaaacagttattctcaacaaaacctgaaatcattgcattccaagcaactgagctcttcaccggaattccattgaacatcctgaatgaatagccaacattgccacatttcgcatacatatcaacgaatccaacctccacaaacctatcagcacccaatccagacttgaccaccattccatgaaccatgagcccctgttctatgacaccagaccgagcacaggcgttcagcaccgatgagatgacgaaccgatttggcttcacctcagaagacaggagttccttgaacagcccaatggcctcgaagcagtgcccgcggctggcgtgcgccgcgatgacggtacaccatgacacgatgtccttgttcggcatttcgtcgaacaggtggcgacaggcagccatgagaccgcctttggcataagtgtccatcaggacgttggacacgagcgacacggatgcgaagccgcgcttgaggacgtgcccgtggacggcgcccgcgcccgcggcgagagcgtcgcgcgcgcagcgccgcaggaggcgcacgtagaggcgcgcctcggaggacgggaagaggagctcgatggggcccacgatctccagcaccgcggagacgatcccatgccccccgccgactcgggcaccagaagaggccccggcgatgccggcggcggcggcgtaggagtaggaggaatagaggagcctagatggtgcgggcttggagacgagcgcggaatggagcagtagcagagggagagaccgggacataagagaggcggtggatgcgtcgccggagatgggcgacatcgacgacggcggcggtgaagaaggacgggatctccacgggcatagtcgccggcggcgagaggggtttggagcctagagatgtgggcccaccttcgtcagagacaccactcccaaaagtccccagattcgctgaacgctctacgcctcttgccttgcgctcgcgtaatttcgtaacccgccaactaaaatctctccgtgaccgttcgatcacgtttggacggtagggattctttagatgccctggctcgtgacgtcatcatcttcttcccccaaaccgtacggagtccggttctagtagcctcttaatcaaaaatcgagatttaatccagcaaattaaccgagacggagatggggttcccgacgctgaagcggctactgtccatgcagaaggagcggcggctgcgtcagtatcagcgctggcggcggaatcggccaccgcggcaaatccaagaccgtagaagccgcctcttgcgctgtgtacacagcaaatcctcagccatggtaaaagtttgagccttgttttcttattgtttctgatgaaaatgcttcagaaggatcactgtttacttgtctagttatagattgtgtacttcctccgtcccaaaataagtgcagccatggttttccacgcccaactttaaccgttcgtcttatttaaaatttttttgaaaaaaaataaaaacataagtcacgagtagtaaagtagtattcatgttttaatcatctcatgacaacaaaatgctaattataaaaaaaattcaaataagacggatgatcaaaattaggcatggaaattcatggctgcacttattttaggacggaggtagtatcatctactgtcctccgtcttaaaatctgatccaagccccgcccctccggccttgagaaaggatcggggttgcacttgtggttgattctaactatatttcagtcctcctaatttgtgtcctcctaatttgtggttgcacttggatggcacaactgctatggttgcgcaaaaaataggataagttccccaaagaatatggcactcggaaaaatgaacattaaaatgaccaaaacttgttttattgaacatttggagtgctgatacaatatacaaccacatcccctagggagagactaaatctgtattcaatttacagtactatctgggttttacattttggatgtcacacaagaactcgattggctatttcttgccattccggtattagaaatgcagggcaatatgctccactcttccattgtttactatttccataacacttacacttgacataagattgcttaaaatacgcagctaaacacaggaggcatcagaaaagtgttaaaaaaaggggtttccaccaacttggggcaaatgactttggttgatggggaaactggcattctgcatctgatgtgtaaccttaacatcatgttgttggactatgaactgatctgcaaaatagttattgtagcatgacatgatataataaggtttagagggaaatcacgatggagttaaattgaattcagaagatggcgaaacaaagtaaaaaaaattacggttgttcgtcgtcattggtggcagaatttgtggagttatcagatcagaattaacaaatcctgtgaatggagcacgcggcagcattgaagtactacccgtatgcggtaatgctcctcgcatggaagacaaagaagggaactgtacatagatggaaaaaaaaaagatcttcatttacctaatagaaaacagtaaaaatgggtatccttcttgataacttagacattgtgattccatcatgtgctaccatgatcagtaaatttcaagaaagtgacacaagtagatgtgtaacaatacaatataaaactcaacagaagaaatgcaaccacattcaggaaggagatacaaggttaaggaccataaaggcaagtcaacagtgcattcagaatcattctttctcgctgggcctgtttagaacaattcttgatcaaagagctgggaattcccacatcaaaggaaaaatgatgtcaacaatacgcagaacctatgtggcaaatgagtcaacatattgtatggccccagtgcatccggaccacccagatcttatctaattctttactactcaaacaagaggtaaaactctgtcatactgtcgatgcatgagaagatgagctagcaaggaacctttggcatgttagccaaattcaatgaactttggatgaaaaaatgaatgtcttgaaagggcctaatcaacaagatgaaaaaaggaacaagttttttttttagaaaaagaaaagaaacaagtaattgaatctgtgaactggtatgagtatgacatcatagaacttacattggcagctcctacaggatattgcatgttgtattgtccatatcccatatttaactgaggatttgctctccaatcccagtttgcagcatatgggtggtaactcatggtaaaaatatcctacaaattgttctcgttttagagaaaacaaatatggagcacagtaagttattttgagcatctattacctctggaagtgcctttcctctactagatgtggtgtccacagcaggtctctgtgatgctagtgttcctgccaatatatttgagccatgatttgaaggaagagcatggctcccttgtattgatgcttgcgatgcggctccccacaactgaaaataatcatgcagcaaaacaaaggtctaatacaattgctcaatggaaatagttcttcttacacaatatacaagcagagagctaacctggctattaaccggagcactattagctctgtttagtggagaactgtaagactggatattatctgtggggcggaaaaagaactggttctgctgactgccgttatttgcttgggaaaaagacaaggacttggtactttgcctggttggaaaactaatttgaggtgctgagacagaatttaggatctgaaccagcggaccgttcaaagaattggtactggaaattgaagtggctgtagcgtttttaggagtagtgtcatcaaaagtagcccaaccaacatcaggtaaaggtgagctcttctgcacttcagtttgaccaaaaccttgatgaggctcgaaatctgaatcaaagtcaatcaaacttttcgatatttctaatttaacatctgttgtagtttttgaactgggatcagcagccctcggtggcactactttctgcaaaataggacttccacataaatattttaagttaaagatatcattccatttttactttgttttttgtgacatagaattcgtctgacttctgaaataggacaagtattctcaagaggcaagaccactgttaggacttgggaatataaatatggaaatccctccctagctacctaaaataatgtttccacaaaccagataagaagagcatggcaaaacctgtgagctagcttacaatatgacatatgttgggtaaagttgaaatcaagaataggaccttatgtaagaggaaacaagaagagaaactatgggcaaagcatgctaacagcaaaagtaagatcagcaggaattggattacctgtatttcagcaggagtggtagatgttgtggctttatgagatctaagagggtcaggaagccttataggcagaacttttctattagtttctttggaaggttcaaccacagaagatactgatttggtcgtatccttaaaattattttctgagcttccacctgtcttttgaagtccatccaggtattgatgtttcccagtgttggcattttccctttctgtagtggttctattcttttgatccactttagcaggtactggatgcttattgagattgttttggtcttctgaggtgcttgctgtgctatgctgtggaccgtgattatcttcagaagttccaccatatgggcctctttgaactcccctggatgaatctatattgttgtttctgtaagtgtcatcccgactaccctgagttttcattcagatgtttcgtgtgttacaaaaagaggggagagactaatgctatgtgtttaacagttatggctagcgcaagccaatgacaaataccttcgcttgtggttgatggttaccaattctttctgctgtgaaccttcggtcaacatatacaatcttgatgaagtttctgagcctatctacatcactatatgacagtactcaaacatcaacagcagattcacatcatacattaagagtctatgataatcatctggtttagtggcagacctaatgtcaggaagaggctgtccttggaagtcccaatgtttcaaatatatttccttaccacgctgaactatcaaaaatatatgttgtaagacttaaaagcagacaccaagcatatcaggatttaaattataaataatggtattaagccaacctcgtttcccccttcttgaagagcagaaacttcttgagaagtaaatttagccattgatattgattttacacgatgagtgaactcccgactgaagaataattaaagttcagtaattagacaacatttatcaggagtttattacttctgcacataaattcataattgtcatagtcaatcacaagtagttgtggaattgcatttttaaagtaagaaacagaggaaacactagaaggatattttcaccacttactgtattccgctgcaactaacacagacgaaagttgagaagcttgtgcatacgtattgtggtccctgatgatgaagaatattgtttggttatttatgtcatgaaggaatattatacatttttcatctgtcatcgtattactaccacttaacaatatatcatttcattgctaaagaaacaatgcattgttgcattcactcaactactcaccagatcatttattctagaaaagaaacatggttaaatcatataattttccagacaaaattatacatactgataatgagataatattcaaaatgcttatgaggtgagccaatgtttgataggcagttcaacctcctcagttcatcaagaagacaactaagtattatttataaagtggccaagtgggcatattttgctgcagcagatatctaaagctagtgaaaaacattaagcagtatcactgtcataattatctagtttattgttattgatccaaaccacaagtacctattactaatcggcaaccattttgcaatcctgtgcactctacaaaagttcacccagagctcattttgtttgttactaccttgttactaactcaatgttgatgtggtcaatttggtatatgaatccatacactgggaaaggcatctattatgaatttagagcacgagatctgtaataatatcaaacatcgcaggcacttgtgttatgatctcttggagccaaaatgaaatttcgttatttcgcacattcccgcatatggtaatggtggtaatgtgttattagtattaataacgtgtaaatccatatgaccaggtactagttactaaacagaaactagtaattaataattcatttccctaatgacagtttcaccatcctcaaaattcctaacccatatacaactgaggaaataagaatcagattaaccaccattaataattcatttccgtaatgacagtttcaccatcctaaaaattcctaacccatatgatttcagagtttcagcaacaattcagaaggaaataagccgagcaaagcctgaagacatacagagacagagcagctcagaaccttagccctcctcacaagatgagcaagctacagtacctttaccttccttcctaacacaccattttttgtgtccacccaaaagatcaaaattctcaaaacttttctcagagaaaaatcgagctcaccaggctgttgcagttgatgcagcggcggttgccgggcagcttgagcagggcccggatggccctctcgttcctctcctcctccttcaccctgctccccatccaccccctgctctgctccgcgattcgatccgcagcaacaacgaaccggcggtggtgctccgacttccaagagcgagatgcttcgaagatttctcgatggagtttggcaacttttcttgctgttcttggcggctttgaggcggaggagtggaggaggtgggaagagaaggggaggtcagcgtacacgtggaggctttgaaaggctcggtcaccttccactttactcgttggctggtcgcgtggccgtggtcgtgggtgctgacatgtggcgtgctccggctaattaccacaatgcccttctctgattaaagaacctgattagtggatcacagtagattacccgtttccctatggtgattaacagccctcatcgtttatctttaatttctactaaaacttaattttgaagctgatgatcgtagtttacttttttaagcattaatttaaaaatctctaagaacatatataaaaaggttttatctatatttttttctttgataagcgtatgccaatcgataaggctataaaattatctgtcattttaattccagacagatcagtggttaaaattgttgttgttattcttaaaagggtatgctgattttggtaggattagctcgggctaaccatcaaccttaatgatgtgacaagtgttccggtacccatgaaatgagcattcagtacagtatgattcaagagttattacacaaaaatggataaagtggttagctcactaactaaagttagttaaagtgacataatctccagtgatcacttagttgagctacttttgagtagattaaaaactgaaaagaggagcaatcaaagccttctagataaagaagacaaccaaagcagagctctgaaatctgataaagaaaagaattctgaagtctgattgcctgaa

SEQ ID NO: 48723 - DNA, 8845 bp, Oryza sativa
aaaatgattagttagttctggaatggttggttaatagctgtaatggctggcaaatgggaatgtttttcttctctgataccgacattttgttctagaaaactaatttgaccttgtactatattactaattattttcatgtggttcaggaaagcaacgtacaactgccttctttttacatgttgtccactgttaacaaaattaccaccattgtttatatgagaatacatgtattgtttatcacaagaaaataattatattgttatattaacaattcacaaatcacaggtatgcgccaacttatccttaaaaagcagtaaaaaggaacgaacagagcatgcaactagttttgcaaattctacacaaaagtatggccccgtttggatcatatgatttttttttttgacagaggaagcacccactacacggatgacatgaatatctttttcttggcagattagtaaccacactttctttgatgaataatactacttttttatataatactaattacaagggaattattgttttatactccctccgtcccaaaatataacaacttttaggcaatgtttggtttatgggagtaatccattagttcctccattttagttcctaataatccaaacagggataactaaaaggaactaaaagtgtatatgaggactaaggacctgtttgattcagcttatgattattataatctggattattaggagtaagctgaaacaaacaagtagattattatgctaaattattataatctataagccaaattactataatccaataatctcctctagaggagctttttccagattattgagtgtctaaagacccactactcttagatgcctctaataatccagagaaacaaacaacttgtagcttattttatgccagcttattataatccagcttacattaatctgatttaataatctagattacaataatcttaagctgaaacaaacagggcctaaaatacattaggccctcttgaaggtacttatagggactaaagtgacaacctctctcttctctctccctcggtccatgtgcttttagtcccttctagtctttggatctaaacagtaggggaccaaagtttttagtccagagactatttttagtctagggctaaatgatccttaggcacttaagatttgtcccaaaataataacaaattctccaccaatattctcttcccaatcaatcataacccttcaccgttcactttttccacctacctccacttctcaaccaatcataacccattcctatttaattttatctacttttcttaataaccgtgtctaactttaaaattctaattcggactgacagagtactataatattcattcaactttgaaggaggcaaagcacataaaaccttcttttttgggctggtttgcaatccagtcaagtcccccatatagaaggactgggattgcgggcctcctaagtaaggcccaagcatataaagaggtgcctagactttatgtaaaaaagtttgaaaattcgaaatagataagaattcaaattcaaacccccaacaatttcttcaaaagaagggcattcctaggaatcgtatcttcaacaaaaggagtatcgtacaaaagagagagagagagagagcctctttagcctttagcaaaatcacctgcctctttttgcaaaatcacctttctttacgaaaagggaacattgccattaggcccccacgcgcagtatgtgggccatacctgtcagcctcacaaaaaggatgtctttacctcgtggatttggacaatctaatggttttaaatatttttttaatcgtatccaacttctctcctccagtcctctccctcccgtagaccgtggatatcgtagaacaaacggaagaacacgagaagcctctcgaagcttccagaatcccgattccaccagattcctcccccccccccccggagccctaattctctcgcgcggttcgtcccgcgacctcccggttcctgccaatggccgacagggagaaggcggaggagacggaggaggagtacgagagcgacctcgacgacgcgcccctcccggcggtgcggcgccgggacgcggcgagcgacgacgacgaggaggaggaggaggaggaggaggaaggggcgaggccctctccgcctacgaaggccggatccgacgcggaatccgacgggcaaggcgccgccgaggtgtacgacgacgacgacgcgtacgaagatgacgaagggtacgaggaatacggggaggtgtacgaggagttcgagcaagggcgaggcgttgcgggcggagtggccaccggggcggtgcccgcagcgggggaggaggcggggatgggtatgaaggggtaagcggaaggtgaggcgtcggcggcagcggcggagggagaggaggggaagaaggggagcgagccctatgccgtcccgacggctggcgccttctacatgcacgacgaccgcttccaggaggcccgtggccatgggcgccaaaggttccggcctttcaaccttcaattgctgcttgatttgctgttgtttccttatatatctagggtatgatgatatgatctagagaacttggtagcctagtttcaaccttcactagtttggtaaccattagtgttctctgaaaccactgcttaagtgcattgcgtgttcaatagttcaattaatatcatctaagttgataacacgagtgtgtcatgctaactagtcctgtggaattgttagaagaggctaaagtttgatatttatatgtgcagtagtagtgtagtatttgatagatacaagtcataaaacggcttaaatgtatttattttcgcaattggtctattttggttctctagatttggtacggttgctcgttgttgcatctcttcgttatgatgtcctgcctaagtttcctttacaggataaccaaggtctgtgagtagcttattgagtaattccccagcatatgataatacatgggtttataacattgaactataactcgtaaagcacgcaaaacatgagctaaaataacaacacgaagtcatgtattcacaggcattactttacagagttgattgttatatgccaagtcgcaaacatgaaacaaaaatgaaactttgcctacaagtttttaaatctggtgtttcatgtgaaattgatttagtattaatgcaaattggacacacttattaaaaagtagaagcgtttaactttgaagtctgatcttgttcaagtgtttctactagaacaatacctacatgatctgaaacatggtctactaggatacactactacaatatagatgagactggtaaggtatggcatggctatgccaataccatgatacattatctctttactattttaaaaagaaaagttgtgtataatggcgagctctacacccacaagtactctagaagatcttttcaggttagatatagtttgcaagacctttaaaaaaatataatattgtagatcttctaaaaatacactattatcatgtaggttgttgatcgtttttacgtagtcatgtctaaaaaattttagatttatcattttcttaagtttaacttatggatcttatactacatttttttaatgctagttacctcatacctgaaatgattaatcagttttagtgcatcagatgaacgaatgcatcacagttgaattcaagcatagttgaaatcatctgttttgaggagggccaatcgcaaatagcttggattgaaccaaatccaaaattttaccttttcttttgcatgctcccctagtttgggaagcatgaatcttaccaagttgggcattgcttagatcaatgtcaaccaacagaaaaaagagaagtaagcccatcagatactaaaccagtaaacactccattgaccattccatactgtacatcattctataattatacacaataattatgatttgtggtaaaaattgttgatagtgtggtagaatgaattgaagtgtattgaacaaatactggaaaatttgtctcaacgaactgaataataggttgtatttactgtttttttcccttttaaaagtagttgtttgactggtgtgctagtgttccagtgtacaaactggatgctgaacccaactaagctagacaagtttgattatgttgaatgctttatctcaattttaaggaatccaatatgatactctgtttcattctctggacatccatgatctatattttaatttctgctacccatgttgtcatttcaggagaatggtgggtgatagacggctgtggaatgctaaagaggatcaagcgtgggtccatgacagatttgatgaaatgaatttacatgatttccataatgactacgtgagtatcatattgtctttttctgtgtgttgaactattgattcatctttcttaccaagatgcttcttttattgattgtactatagacaagaagaaggcccagaggtcgatttagaggacgtggtggtgcacctgttggtaaagttcgtggtggtagccgtgataatttcagaggcaacaggtcgcagacatactatcgtgatggtgctaagaactacatatacgttccgaaagaacctcatagttaccatgataacaccaagaaggttcaacaggttctgaatgataatggcaagaatagaaccatcaaaccacctaatcctcgtgatggcgatgccaacaatttcgattttgttcgaaaagagtctcgccctctttatggcaatgccaaaagtaataagagtgcaccgagagtagttcgaggaagaggctctaaacgttaccaaccacattggaggagtaccgctgagatatcttcagagcataataataagtgagtggaaggtttcttcttatgtgctatctgtgtctttgttttgttaatatagaacttactgtggtactttttgtttttgttgctcatacttcagatcacaaaatcttgaaaacacttcttcaaatgcaaacttgggaaaacaccaacatcaagcttcaaattctcaaccagaacgaggatttccgatgaagcagagctttgcatcaaatttgaattcagcttcacctcccttttacccttctaggccatctcatcaggaactcccagtgagtcagaggggggatggacaacccagtaccactactagacacttctcatcccccattggtatggagcatgtctctccaaccccacagtatggccctctcttaagagggaaagcctttgtaccgtctgctgggcatggcaagttgcatgctgaagttcctataaagggcatggatcatccttcatttcattcatctacatcatcatcaactagtcaatttcctatagctactaatcaggtcactggaaattcggctaagtccccacacccaattgtccaacaaaggttggttcaatcatttaatcaatccacaccaaagatgcctggtcagatgtttgctgcgcaatttgctagcagtgataaattgccatcttccatgcaatctacatcaacaattttgactgaaggcactgaaatttcttcacctcatggttccaacaaatctaatactagattgatggcaaagggacaacatagtgaccagggagaagaacatgcttcttttatgtatggtggagctcaagttcttgggactacaggatcacttggtgaccaaaatttccatggaacccctgcactatttccaggttcgtatttttactattcacacggcaatatagtaaccagagtgttaaatgagtaaacgattacatgggtgaggggaaaagaaataatccaatttctaaaggcttattcctccattgattagagggtgcatgctatgtgccttgagtgaaaatgtttacagtgatgttagtggatttataatctactttgaacttctggtttgattctgaaaagagtgttattttcagtagactgccaccccattggagtgaactgaaccaagtttttgtttccaaaaccattatgcaatatgcctttagtttttttttttcccatacagttatgcagtttggaggccagcatccaggtgggactggggttccctcaattggcatggctttaccaggatttgtgtctcaacaacaacttggtttgagcaattatgaaatgacttggtaatgactctttgaactcttagaatagttgtttgctttatttttctctacctccaattggtatgatgtggttatcacattgtacttcatttagatgttagcacactgctgtttgctcaggcctaatttttttgtgggttgtatctgaatgaaactaggctaccgatattggctggtgcttctggagctttgggagcaacgtatgggtcaccttatattactgtagatggcagctattatccccgaacttctgaacatgcatcttcatcagtttctttgaggtatgttagtctaatactctaatatgattcatgttgcaagaatttggatttcgcacacaaggcatatatactgttgagaattgagataatgttaatttaatgatgattcatccttttgttaaattctggttttgaggtatgatcacctattaccaacatgttgacgacaataaataatatgctatgaactactccctccgggttgataatacttgtcgttttggacaagggcacggtctccaaaaaaaaactttaaccattattttccattataatatgtataaaagtgtgaaaaaatatatgattttattaaagtactttttaagactaatctatacatgtagtcaccatatttgaaagacaaatattttaaaaatgattcataatcaaatattctaaagtttgatctcacccttgtctaaaacgacaagtaatatcaacccggagggagtagtagttaatgcccttacatagccctaatctgaggacttatattctatgatttccctctaccaatgtgcttgctttagctgtcttcctgtgggtactgccgtactggttgaccagccgtatcatcagaataggttttggtagataattggagtaacactactctcctgatctggagaggttgatgattactttatttaggttgaataataattggtttgctgcgatttttctgttttgttgtcttgtgcaactgcaagggggcaatttgaatggcatggggatacaatcattatgcatgcacctagcattttcctattatacgtagtctaattgaacaaatgatcgtcattgatttctgtcccagccttcatcaccaaccaccaacacaacatgcacaaacagaaaaatgttaatgagaatacaaaggatcctagtgcttcaatcatcctagtgctttcgatagtaatgattctttctgtttcttttacagagaacccagtgcctcttctcagttgaagtcacaagaaataactggtaaaggcatcttccatccctttccatttattttgtcttctcaattggtatttattttggggtatcttctcctatttttgccacataaatgtaccgaggccttttcctcttttgcagaggctttaaatgatgaacttagtcaacgccaacataaacctcggaggtatgttaaagtttatgtgttctgtttgctgtatgctttctgttctaatactatgtgttaataccatgttgtgtcttgttacagatattcggaaatgaactttggcaaatgaacatagtgacgatggtgttaatgaggacttcatctgttagatttgggtctgtgcaagacttctatctcaaggcctttctgggtccttgcaacacttcagtgtctgatctgtagcactttgggctgtatccagaatgaatgccaggtacgcatgacttctgttgttctttcattgtgttagactggtgttgttctgtggtcttgccctttcacccaaaccttgatcccttgagggtaacataaggaaaatcctttagcagtagacattagatgtctgttgtctttctattcatatatatctttcacttactatgtataataaggaaatttattttctggcattcacttcataattcttttatggtagattcacagtggcaaccaagtatggaacatgttttcatttgttaaggcttctgaagctagttcagagtcttattctattgattatccaagtttattatcacttagtgagctactaagaatttctgcagtgtttccatagatatctagtattttagtgaataaatatgagattgatattttctaattaaaggaggtaattgaatcgtagctaaaactagcttaacaacttgcaattgcttttggaagtatagtgtgtccgtttcttaatttggcatgctaagtccaaattgtggtataccctgaatctgtccttttctccatttccttcgtcacaactcataaacgaatacatgtctcctctcttctaactgcatttggttgatgagtgactggccatttttccacgagaaaagatatttcagcaagacactttaaatggctagatgtttgtattgctcttgtacctcaaccttggataggcagttgtcatgtatattgtgctcctacatgtgcccatgagcattttagaatcgtaggatatgctttgatttgacaaagttggtgctgctccttttcaggtttgacagttgaaggtgtttatatccttactatagtcatttgcagtgattattctgatgggcagttgctattgtgtaattaggtatgattttcgacaattgacgccatttgaatccttactatttgatggacgttctgaaccctgttaccctgtcaggtgagatttacatggtacaccgtccatgttgctattgatcatcttcacattggcatgcatatatga

SEQ ID NO: 48724 - DNA, 1926 bp, Oryza sativa
  unsure (1)..(1926): unsure at all n locations
ggtgtttgtaggggtaggtgtgtgtgtccgcgtatatagatgtgattgcgcgccgtgcgcgcatttatatgagctataatatgcttaaaaaagagtaaatttcattaaaccccacctattatgatccaatttgcataaaactacatgttttgacatgtgccacataacatgtattatggttttaaaatttcacaaaaccacaccattaaccattttgacatactcctatatcaaaatagagaaagtgaatgtaacatttgtatgatggataaaatgctcgtgattgttgaattcaaaattgtgatagcgcaaaatgattagtaatgtggttttgtaaaacgttgaaaccataatatctaggattatgtgtcacgtgacaaagttattgtgtttttatgaaactaaaacaaacaggtggggttttttaaatctactttaaaaggatactccctcccttaaaactataagtcatttgacttttatattgttcaaattttcttttaagtttgatcaagtttataaaaaaatatagtactaccttcgtcccataaaacctgacgtttaaaggttataccagtgtcccacaaaacatgtcgtttgagcaatttaatggccatctgttttgaatttttgaatatgctcatgattgctttgccacgtgtattttttgtggccatagcttcagtgtgcagagatatataagggcatctacaatcaaggatactacatgggcgccttcactaactgaagacactgtgtgggaaacacctcttacaatggagaataccctggtgacccaatgagtatccctaacccaaaaagcctacgtagttattttactgtacaatcctctcttctcccatactccctctctcttccccatatttactccatctaccggagacgacccggcgaaggaagttggttgttgtttgcgaggctacgggctggagacacgcattggtgatggcctaagtattcctattgaatgccttgcactcaatgaaatggcatccgattattattaagtgagggcaacttggtcattttcccttccgctaatttgcttttgaaaccttaaagcgtcatgctttgtgggacagaggaagtagtattttcaatacaaaacaaacatattatcaaaatatattcaatattatatttaataaaactaatttaatattttagatgttgctaaaatttttttataaacttgataaaacttaagtttgacttaaaaaaaagtcaaacaacttatcctatgataaacagggagtagtaaagtacctcctaccgaataatcccaacttcaagggtgaatctacaaaaagcgccccaagcaaatataaaccgccataaaccgaactcttggatccccgaagaagaaacaaaccatttctgggtcgcgctcccacgcccagatccccctcccatttccggaaaaggaaggaagattccgaggcggcggagcggaagggatggtggcgagcgagacgaaccagaaggcggcggcggcggggagcagcatcccggagggggcgcggcagctgctgcacgagctggcggcggggtggggcgacgtggcggactgccgggcgctggaggtggtgccgctcaggggggccatgaccaacgaggtctaccaagcgcggtggccgccggcggcggatgccgaggcagcggggaggagggtgcttgtgagggtgtacagcgagggcgtggagttgttcttcgaccgggaggccgaggtgcgcacgttcgagtccatgtcgcggnacggacacggcccgcgcctcctcagtcgcttgcccaacggccgcgtcgaggagttcatccacgccagggtgagcattatcttttggccctctctggattttttcttcttcttcattcttggctgcttgcgacaaaatttcttgctgctct

SEQ ID NO: 48725 - DNA, 4406 bp, Oryza sativa
atactggatgagacatattctactaccaatcagtacagtgttttatacaatactatggtatgtactccctctattttatattataaaacatttaacttttttcccagtcactttccttaaaaaaaactttttttctagtcaaactttgttaagcttaaccaagtttatagaaaaatttaacaacatataaaatataaaattagtataactaaatctaacattaaatacatttttataacacgtttgtttggtgttaaaaatactactatatttttctataaatttaatcaaacttaaagatgtttgattaagaaaaagtcaaatgacttatataatataaaaacggagggagtattttagaaggaagggacttatatgctggtgtgttttttttagataatatatatgcgggtgtgttgaacttgtggcgtttttgttgggttgcaggcgtgacgtggttcgaggtggatttggagaagaagaaggtggtggtgacgggggacgtgacgccattggaggtgttgcagagcatctccaaggtgaagttcgcgcagctgtggccccttcccccccaacctgctgcaccagccaccgtctcctccgcctagatctcgatccgttcccatctcaaaatggcgggggccaagccaagccaaccgcgcgtcgtgtgccaccgtaatattatcgcgctcacgcggggaaattgcagattcagcgatgcattggcattgttaccgagaccaaccaggcaaccatcgtttttactgcaccctcttgcccgcttctctctgtgtttgaaaataaaccaacctaaaataagttgaacgggcacaagttcaaaattgttatactaaggtaatgtctcattttattttaggttggtttaatttagaacgaagagaatagctccatatgcatacatgcctcggtaatctaaggctgacgcgttagtcaatcaagctacgtttgaattttcacggcgatctatattggcactaggaataatgaagagggaattataactactagaggctgtttggtatgtactccctctgtcccttaaaaaatcaatctagtatcggatgtaacacatcctaatactacaaatctactatcagattcgtagtactagaatatgttacatccgatactagatttgttttctgtgcaacggagagagtatgtggatatactactttatagcttgtgtggaaaatgaattgtttcatggggaaggtgaaggtttctgcagaattttacgagattttctgtgctccaaataggcttgtaaacattgtactactcgtgttctgaaaaaaaaacattgtactgtttgctttgctatgagattggtcgatctatttttctgagtattttccgcccgtcgttgtgcgtatggtgggagcagatttctcacccgacaaacactttacaaggacatgttttgattctgctaggccgctttgggccatcaaaatcactttcaagaagaaaaatgaacactcctgcatctcttcaactataggtcaatggtcaccagtgtcacttctgactcacaactatacatacaagacgggaaaaaaagaaggcatttcagcaggtcagagtgcttaattttgcttgtgttgcttcgttgaacaatcttgctgctgggccctctgtatccctcgcataagcagaagaaaagccactctgatacttattatcagatgccattctgttgttcatggcgtcattcactcatgcgatgacggtcaacgcatttcagttgcagcctgcttctgaactccggcgcatccaacaaattgagctgcctcgagcttcagcaacaatggagaacttttggttgcttgtaatacgttccaatgggatctgtattttcagtcatgggcttctgaatgcattacaaagctcgggaacgccatggtaatgtccctgaaaataatcaataacacaaaattgagattgggaaaaaagtacacttctagttctaatgtttctagtgagaattcagtattttcactactcactgcaaatagggaagtgacatgttccttagtgatgccgggttcgccttaacaaattcttcccattcctcagggtctatcctgccatctccatttgagtctgcttgactgaatgtctgcaagacaaaaaggagcagcatgaggatcgagtcagaaaaatcatctgaaaattatatttgagagagtaaatgcttagaaggatctttgttaactacagtacattatcgacaattgcctcgacagcgcattcggaaagatgtaggtctgattcatctagaagtgccaagaccatctccctgagctgtttcagtaagcaaacacaatctgttaatttcttgaaagggaaacaaaatcaacctgttaattgaagttcagggttaataatgaaaagtacaaattgccgtgaaagagagtgattcagattcacctcttctttctcaatatatcctgtccctcttagatcatagagcttgaatgcaactgccaagatgaggagaaagataaactgaatacgcctatttctgaaaataataagaagatgaatgcacaggaggcagggccatacacgcagtcttctctgatttaggcgcttttgggtggaacacactgagcgaccgtacaaactccccaaattcgattaccccatttctcttcagatcaaacaaatcaaacacctgccatgaaaaacatgcaacagaatgatcattctttgttcagagaagaatcaaacaagatgaccatttggttggccatctcctgcctgctgacagaatcaggactgaacaagaacaaaccctgtctgcgaagagattcgcctttctgctgttcctgaacaaggcaagctgaaactcctcctgctcaacaaaaaacacaccatgatcagcgcattcagaaggaacaatggtagtacatcatcaagaagattggcatcccagaaacgccattggaggcagctatctaatcaactctgcttaaatcaccttgtggatgaggccgtccttgatgatggaatagctcatcttgttgtacagctcgcgcagcgcctccacctcgttcaccgtaactgcaagaacactgcaaaatcatccacaatgcagaggcaaaacaaacacacagccgttgtaacttgtaacaataactgcttaactatcaatggtgttgcatatgcatcggtgatgtaattaaagtatttaacgagtgcaataaagcttccattatcttgaaaaaaaaaacgcataggtgaagaggtgctcacaggtggtttgggcggcgaggacggccggctcctcgtaccccggcggccgcttgaactgcttcgacgacgcgcatcccatggcgacctcgccgtgaaatccgaacgatgccttcgccgacgagaagaaactagcctactcagctactctccctctctctccttgtctccttgatatcatccatacacacacgtattcgcgcgaggtgaaatctgaattattctgacctgagattacggggagaggagaagacaagaagaggccgaaaattttctggagaagcgtgcggaaaaattttgtgggcgacacgcacgcctccgcctcggcgcctcgctggagtctcgctgtgtcgcagcttacgcaagcccaccgttattttttatagcgagttctccggcgctccaagtcaaattcgctaagcatatgtcgccaaaaaaagaaaaaagattgcgttttttcctgcgtgcatttggcgatcgtgtggactgtggacctctgcgctccgtgagcgtgacagcttatagcaagcgtaatatagaccgtgtttagatccaatttttttttcaaacttctaactttttcatcacatcaaaactttcctacacacacgtaaacttcaaactttttcatcacatcgttttaatttcaaccaaactttcaatttcagtgtgaactaaacacagcctataatcagctactagttctaaaaattaaaacatcatttataacctacttacacaatagtactagttagttatagatatatactatattattaatacataattcatctatttctcacatacttcctctgttttatattatataaatcgtttaactattttctcagtcaaagttctttatatttgaccaagtttataaaaaaaatcaacatctataatacagaattagtttcattaaattcagcattaaatatatctatctattatatactaaaaatccattagactttttacaaacgctcttaagttgccacgtgagatttctataaacgcttctgtcggtgatatgggaccgggagtattgcgcccggaggcttgaggcagatggaatcgcccacgtggcctggcaccttcggggacgtcgggcccgagggtgaggtgtc

SEQ ID NO: 48726 - DNA, 14286 bp, Oryza sativa
ttatgtgaagaagaaaagtccagcttggaaagggaagagtgcatgtggtatacccttaaagtataaaaggaggaccttgcccatagggaagggaggattgattttttccagatttagagcctagaacaagggataggtcggctcagactttgtagctcctccacacacaaatccaccaaaacacaggagtagggtattacgcttcccagcggcccgaacctgtatacatcgtccgtgtctcgcgtttcttccgggcacgcaatctttccacatacagagagagcttgagatctcaccctaagcccccggccgaactggcaaaggggggcctgcgcggtctcccggtgaggagccacgagctccgtcatctggcgcgccaggtagggggctcagcgtgtgttttctgagctctcatactcttccgtgtgcgccaagtttcccttgttctgcctaatggccgagcaagcaaaggcgcacgacctctctccgagtgtgagcggcgacgacggggagccaaacccacgccgtcgagctcgtactcccccacctccacaccaaagtcctaagcagggggaggcgctcgagagggttgataaatccgcagcatcaccggtcgcgggtgatgcaggagaacggcgagatggggagcgtcgcctcctcgtctacggcgacggcagcacgcctcagggcgcgcttcaggctgctggcgcgctcctacgtcacccgcccgtcgtccatgaccctgagtctccagctcagcgatggctggacgacgtggccaacttggtcatgacggcccagcagcgcctgggtgctggtggacggtccgccaccaccaagacctccggcgccgccaccaccggttccgtgtcatcaaggcggagggcgcggcgagcggcggcggctgcacggcattcggctgccactccctcgtcgacaccttcgactcgggaggatcagcatggggagccggatgcccgcctcaacatcgagcgccggcgtaatagccggcgtactccccgtgcaacggagggcgcctcctcgtccagagtgtcacctcgacatggacgtgaggaccagccctccgtgcccccggctggtggtatcggctgtagagcctttgtggcgagtcttcggaatgtccgttggcccccaaggttccggcccaccatcaccgagaagtatgatgggagcgtcaaccccaccgagtttctccaggtctatacgaccgggatcgaggccgctgggggagacgacagggtcatggcgaatttctttcccatggccctgaagggacaggcacggggttggctaatgaacctgccacccgcgtcggtccactcctgggaggatctgtgccagcagttcaccatgaactttcaaggcacttatccacgcccaggtgaagaagcggacttgcacgcagtacagcgaggggatgatgaatcccttcgctcgtacattcagcgtttctgccaagtccgcaatactataccttgcatccctgcacacgcggtgatctacgcgttcagggggggtgtgcggcacacccgcatgctcgaaaagattgcctccaaagagccccagactaccgcagagctttttcagctcgcggaccgagtggctcgtaaggaggaggcctggacctggaacccctccggttccggtgtggcagcttcggccgcccccggatccgccgctcagacagggcggcgtgacaggaggaggaagaaaaggtcggtccattccggcgacgagggtcacgtcctcgccgtcgagggcgctccgcgggccacccgaaaggggaggcctgcgagcgacaaaaagaaagaggctggtactcccagccgggagcgcccagccagcaagtggtgctccgtccacaacacctccctccacgatctcgcggactgtcgcgcagtcaaaaacttggctgagcgaacgaggaagtgggaggaggacaggaggcaggaacgccgtgagggcaagtccgcggcagttccctccggtaaacggcgaagtgaggccaaacagaaggcccccgccgttgacgtcgatgacggtgatgatgacctaggtttccaggaacctggggccaccattgccactgtcgacgggggagcgtgtgctcacgtttctcgccggagttttaaggccatgaggcgagagcttctcgccgcggcccctactcatgaggccacgcgtcgggcgcggtggtcggaggtggccctcacctttgaccagaccgaccacccaccgtgcgtcgcccggggagggcagattgcgatggtggtttcccccactatctgcaatgtgaagttggggcgtgtcctcatagatggaggagcggctctcaacatcctttcccccgcggcctttgatgctatcaaggccccggggatggtgctccagccgtctcatccgatcatcggtgtgacgccggggcacacatggccgttaggtcacatcgacctaccggtcacctttggtggatcagccaacttccgcacggagcgggtgaacttcgatgtggcggacctcagtctgccctacaacgcggtcctggggagacccgcgttggtgaagttcatggcggcggtccactacgcctacctccagatgaagatgccgggccccggtggccccatctttgtccgtggcgaccttaaagtcgcgctcgcttgcatggagcagcgcgcggaccacctcgctgctgcgaccaagcccgagggtggtgacgagaggcttggcacctccgcccccaccgccccgaggcagcggattgccacatgcgacgaggtcccggtcaaggaggttgccttgggcgacggcccatccaagaccacacggatcggtggtcttctggatggcaaataggaagacgcgctcgtctccttcctgcgggcaaacgctgacgtcttcgcatggagaccagcggacatgcccggggtccccagggaggtgattgagcgccgtctcgccgtgcgaccgggcgcaaggccggtccggcagaaagtgcggcggcaggccccggaacgtcaagccttcatccgcgaggaggtggtgagacttctggaggccggattcatccgtgaagtcatccatccggagtggctggcgaacccggtggtcgttcccaaggcgaacggcaagcttcggatgtgcatcgactacaccgaccttaacaaggcatgccctaaggatccttaccccctgcctcgcatagatcagatcgtcgactccactgcggggtgcgaccttttgtgttttctagatgcatactctggttaccatcagattcgcatggctagggaggatgaggaaaaaactgcgttcattacccccgtaggaacctattgttatacatcaatgcccttcgggttaaagaatgcaggtcctacttttcaacgtactactcgaatttctttgggtagccaaataggacgtaatgttgaggcttatgttgatgacttggttgtaaaaacgcgcaaccaagaaactttactttcagatctagcggaaacttttgagaacctccgctacggccgcataaagctgaaccctgataagtgtgtgtttggtgtacctgcgggcaagcttctcgggttcttggtctctgcccgaggcattgaggccaaccccgagaagattcgagctatcgagcggatgcgcccccccagcaaacttagggatgtgcaatgcgttaccggttgcatggccgccctaagtcgtttcatatcaaggctgggagagaaggcgctacccttgtttaagctcctcaagcgctcggggccgtttacttggacggaggaagctgaacatgcccttactcaggtaaaggcatatttgagctctcccccggttctagtcgccccggagccaaatgagcccctgctactttacttagcggcgaccccccaagtagttagtgcagcgttggttgtggagcgcgatgaatacaatcctcatttcgtgcacccccattctgtgctaacttggcccgggagcgagcggggagcatatgcccccgagtcggacggtggtctacgggcccagacgaccggagtcggacctctggccgcttgtcagacggtgctaggtgcccccgaccctcaggagggccccaaggccactgcgggaaggccgcacttaacgccttctgaccccgaggctaaccctgtgctgactcgacccgggaaagagcagggagaagaggcccccgagccgaacggaggccagaggcccctgacgaccggagttggccctttgcccgcttgtccgacgatgccaggagcccccgaccctcaggacggccccgaggccactgagggaaggccgcccctttcatcctccgaccccgaggtcatcggcacagaagacaagtgcgccccgaaaggccacttgaacgaagaacgccccggggatacggcccctagcagagaggatcggccccaccgaagggtgcagcggcctgtctactttgttagtgaggccctccgggacgctaagacccgataccctcaggcccagaagatgctttacgctattctgatggcctcaaggaaactgcgccattattttcaggcacatagggtcactgtggttacgtcttaccccctcggtcaaatcttgcataatcgagagggtacaggacgggtggtaaaatgggcaatcgagctttctgagttcgatctgcactttgaaccacgccacgctatcaagagccaggccctcgccgattttgtggcagagtggaccccggctccagagaccgtctcaatccccgaggccagcacgaacccctcgcagctgcctcacaccacccactgggtgatgcagttcgatggttctctgtccctccagggtgccggtgcgggggtcacgttgatctccccgaccggagacgtccttagatatctggtccgcctcgactttcgagcgaccaataatatggcagagtacgagggactccttgccggactcagggtggcagccggactggggatccgccgtctcctggtgttaggcgattcccagctggtcgttaaccaggtctgtaaggagtaccggtgctctgacccgcaaatggacgcctatgtacgccaagtgcggcgtatggagcgccattttgacgggatagagcttcggcatgtgcccagacgggataacatgatagccgacgaactctcacggctcgcgtcctcgcgagcccagaccccaccgggcgcctttgaagaaaggcttacccagccgtcggcgcgacccgaccccttaggggagacggatgcgcctgaccggcccccgaggcccgttggagtccaggcctcgggacccgaagggagcgctccaagctcccttagattgattgcttggatctctaagatccaaacatacctcacagataagactctacctgaggaccgcgaagggagtgaacgcgtacaacgcatttccaaacgctacgtgttggtagaagggaccctctatcggcgcgcggctaacggaatcctcctgaagtgcattcctcaggaacaaggcgttgagcttcttgctgacatccatgaaggcgagtgcggagcccattccgcctcgcgtaccctggttggcaaggcctttcgtcaaggattttattggccgacagctctcaatgatgcagtcgatctggtccggcgatgcagagcgtgtcagttccacgccaagcaaatccatcagccggcccaggccctgcagatcatacccctgtcatggccatttgctgtctgggggcttgatatcctgggaccgttcaaacgggccccgggcgggtttgagtatctgtatgttgcgatcgacaagttcactaagtggcccgaggcttatccggttgtcaagatcgataagcactctgctcttaaattcattaagggcatcacggcccgttttggagtgcctaaccgtattattacggataatggcacccaattcactagtgaactcttcggcaactactgcgaagacatgggcatcaaactctgcttcgcctcgcctgctcatcccagaagcaatggccaagtggagcgcgccaatgcagaaatcctcaaaggccttaaaaccaagaccttcaatattctcaagaagcacggcgatttatggatcgaggagttaccagcggtgctctgggcaaaccgaaccacaccaagccgagcgaccggggaaacgcctttcttcctcgtctacggcgcagaagcggttctcccatccgagctcaccctgaggtctcctcgggccaccatgtactgcgaggctgatcaagatcagcttcgtagagatgacctcgactacttggaagagcgagggcggcgcgcggccctccgagccgcgcgctaccagcagagcctgcggcgctaccatcagcgccacgtccgggcccgatcactctgcgtcgacgacctcgtcctacgccgcgttcaaacgcgtgctggactgagcaagctctcaccaatgtgggagggtccgtatcgagtgatcggcgtcccccggccgggctccgtacggctggccacgggcgacggcactgaactgccaaacccgtggaacatcgaacaccttcgtcgcttctacccctgagggggggggtcgggtgtcaggtttcgggctcgggctaaccctgcacccccctcgggtgtgcagggttagccgggggctaccacacatgcacagccttacttttcttatttcagcatttcaataaaagcagtttcaatttcctaaaggatgatctgtgccgtttttttctgaagaatcttaacttgaaataaggtcactcgtgctcaaccttgccctcgggggctcggttcggtcagctaaaatcgccaagcggggcccagaaccgagccgtgccccggggcgtggtgaactccgggggggaatcggcaaaaacccacaatcgggtcacccataaccctcggtcaccatgttcccggcccggccagtctcgacatgtggatctccccaggcactagccccgacccgagccatttgaggatcgggacttgagcacgagcccttaaatcaagctaaaatgcaaaaggaccacggcacaaatcatcctcaactcatatgcatagcaaaataaagttaacataagaaatttttcatcatttttgattgcagattaagttgatctatacaaaaagaagaaagaaaaagaaaaaattggagattggcgggggcctgggggctcattccaatgtgcccgggtcgccggcctcgtcgccaccgtcgtcctcaccgctggcgtcgccctcctcgtcggagctgggggcgaacgcgagccgaggggccgacccctcgaagctttggacgatgtggttggcggcatcccggacccgcgcgcgcgcatcgtcctcggtcccgggagggaactcctccagcgccgtccatggggagaagccggggtccctggcctggtaactcgctaacacgagttccaccgctccttgggcgaggtccctcgaggatgacttgatggtcttctcgagctcctcggggagttgttggacagcccaggccatcctcctaaggtgcggggcgaggccttccagattggtggagcgcgaaattgtctggcctttccagaggcccgcttcccgaccggcgcgatccagccgggagaccgcatcccaaagcatgccgggccctatttccccgccaagcggagggcctcggcttccccggtggatgagtccagggcgcgctgcatgtctgcgacggtgtgttcggcagctgcgaggcgggcgactaagtcgctttcgcccgtagccgccccgccgctgcgctccctcgcgtccagctccttttctcgcgcctcgaggttagcagcccgctgctccagcgcggctctctcggcgcggacgcattccagattgcggcgcgcctgctcttcctgcgctgcctcgcggagggacaggctgtccgccagccattgtgtcgcggcctcggactcctcaagagctcgctcccgctcagcaagcgcgtcctcgcggagccggagcgcggactcctcttcggcgcaggcggcctcgtgcgccgccagcgtcgcctcccggatagcggcggcggcctcgcggtccgccaagctggtctccacggcgccggcatgatcttccagcaccatggcacgggcctcaagggcctcttcgcgccgtcgggatgccgcttcagcctccgttgctcgctgctctcgggcagcggcggcgtcaaggaccccctgggcggcgtcgagttttttctttagctccgcctcccagctcccgtgttgaaggcggagggagtcctgcgcctcaatcatcgcggtggtggcgatgagggcggcctctcgctcctcctccacctctcgggcgatctccgccagcgccgccttgcgggcttcaagctccgagatgtggcggcggtgagccttacggcccacctccaccatggcgtccaccgagcgccgcccctcctcgacgcgcgctcatgcggcctcgagctccgctcgttccgctcgcaaggcctccacctgggcgctgaatccatctagcaccgcggtgtttgcggcggccaaggcttgcagaaggggctcggcactcagcggggcggcagaagacgaggagaagagccgccttggagaaaatgcgacgcggctcggcccgccagaagacgcactgagctcggggatgtcccccggacccgcttggtcctgggcgtcgcccgagggagcgggcccaggagatgcgcccgcggccttgtcgcgagccgccccggaggttgtcgcctgagcgtcacccgagggagtgggcccgagcgacgcgccggcggtcttgtcgtgaaccgcctcggaagacgccatcgcctcagcctggcgagcccgggcggttacctcccgaatggcttcttcagcctgacgagcctgggcggcctcctcccgagcagcttcttcggcttggcgagcccgggcggcctcctcccgagcggtatcctccgcctgccgaacccgagcggcctcccgggcggcctcttcagcttcccgaaggcgatctgcggcctctcgccggtcagattctcgcctccgttcctctgcggccgccggatcttcggcctcggattggccggacttgggatggcgggaggaacgcgacgggacatcgctgaagcagaagaaaaaaccggaagacaaacaagatggataagagaaaacttgctgattgggataaagggaagatggttgtgaaaggcgtgaaacgaacctgcgagggggtcggttgaacgaccaccttggaggggaaatcaggtttccccgggatggttccgtctcccccgtcttgcggagccgcttcttcttgcgttccgtctcggcctgtgatgtcggcacggccccctccgggcgcctgctgctggcacgcaccgcccgccccctcgaggagaagatgggggggatgttcctccgtgtttcctcttcccccgggcggcggcagggcggttgcttcccgagcccccgtcgcggggcccagaagcacggccccctcctggggttgattcttcctggcggctcccgccggcgccgtcgtggcccttaggagccacctcctctgaggccccgacccccatcatgatggtcagaatggaggcgcggtctggatcgcaacagagggggaggagtccttgaggaataagagacgcctccacggagctgagattcagcaccctttggaccacgatcttgaagtcatcgggagcccaatcccatctgactccccagtgggtcctcatgtagtcctcggacccggtgtactcccatgcgctccgggcgcgccgctgaagcggcgcaatccggcgacggaggtagtcgccgtacaccatggcccctgtgagcccctgagatcgcaggcccgccaggcggtcgaggacggcgtcatagtcatcccccagatctactggcgcccgccagctggagaccggcgccgggggctggcttgggagtcggaggcacgcttcgttggcaaggggggtgtagaaccagtcgctcttccaatcgtcccacttcttgcgaagggcgcaggggatgtagcggttcaacaccggcccccgcggctggaagtagcaaccaccgaccaccgacggcggcgacaccgactgcacggtgaagaaccaccggaacagccgaagagatgggcgcaccccaatgaacatctcgcacaggtgcgcgaagatggccaaagtcatcactgcgttgggggtgaggtgcgccatctggagatcgtagaactccagaacatccataaagaaagaagaaaaaggaggaaccaacccggccatcgcgaaggggaggaagaagatggaccgccccgggtaatctggtgctgggcgcgcctcgcccagcatcactatctcccggccggtggcggattccggcatgaagcggcgcggcagcccagcctgcctctcgctcacaatgcgggaaggcggtagtacgctaccgtcgagcagagcggagccccgtgccatgtcgtcggagaaagaaagggttgagaacgagtgtgtgtggcgaaggtgaggcgtagcaaagagtgagtttagggcgcaaacggcgaaggaaaggggaatagtggcgaaaggaagggagcaagtcctttccttgatggctttatacccttcccatcgctgagcccggctcctcgtttctcgtgcccactatctcgctccctcgttactcgctatctcgttccctcgtttctcgcgcccacgcttccactaattccattcgcctgcttgcggcgcatgaggtggatatgcggttgtggcagtcgagatagatcgtatcgtgtgcgcgttaattacgctcgccgaccgaagcgacgttaccatatctccagacgaaacgaatctgcacgcctagattcgagcgctgctcaagtgatgcggcagtcttgaagagaccgcccatgactgacggccatggcaccgttaccgatatgcgtggtttgagaccgttgggtttctgcccaatcacggagaccggtcccacctgtcaccaggctttatgagtggcgtcatgcccgaccgcttcccttgagaaggatgatcgccctgacataacgccgggggctactgtcggtgatatgggaccgggagtattgcgcccggaggcttgaggcagatggaatcgcccacgtggcctggcaccttcggggacgtcgggcccgagggtgaggtgtccgccctcctcctgatttccccgaggggggggtcgggttgctcctgccccggccccgagggccgaggtgccccgaccccttgtggggtttgcactatgtacataggttgggtgaacacggtagggctcacctaaccgcatttattgcggtctggtcaagcgtgtcacgctgcatgcagcgcaatgcagcgcgctcttttatccggtctgtgaccagtcacagaccggtcagatcaacggttaggtggcgactggcggtctgacgcacgcctcgccccgtcccgtcaagacgagagcctctaggcacgcgtctccagccggagctagcgtgttacctcttagagatgacacgttagccctggttagatgaataccaggcttcatcctaaccattacaggcaagatgttgtgtgaagaagggcaaacatgcacgttgctaagctgacacgcggtggacaaggatgaccgatttgtgaccggtctgacactgctcatgtcgtcagctcacagccacgttcccacgacgcgcctgcccccggcagaagtggaggtaggtatgtgccgtcccatcagaaggacgttcggagggcaaccgtgcaaatctccgtccatttatgtaaagaagaaaagtccagtttggaaagggaagagtgcatgtggtatccccttaaagtataaaaggaggaccttgcccatagggaagggaggattgattttttccagatttagagcctagaacaagggataggtcggctcagactttgtagctcctccacacacaaatccaccaaaacacaggagtagggtattacgcttcccagcggcccgaacctgtatacatcgtccgtgtctcgcgtttcttccgggcacgcaatctttccacatacagagagagcttgagatctcaccctaagcccccggccgaactggcaaaggggggcctgcgcggtctcccggtgaggagccacgagctccgtcagcttctaagccgccacgtggcactctaataaattagaaaaaatatataatttaaactgatgggccaattagatttatctcataaaaaaatatccttcctcaattactaccttacgtaagttctcgtctccttctcctcatctctttcctttttttatgtatggtagttaagatttttcttttattacttaataattaatttctacacttctatctcacgagaatggctgtggactcttgattgcgtgtcccatgcctaaatatataaaatattaatgattagatgcatgcttttataaataacaaatctatttttaactaacaatttagaaaaaagataatagttacatagcaaaataatcataattctaaaaagttactccctctatttcatattataagtccttttaacttttttcttaattaaaattctttaggtttgaccaatacatataaaaaatttaacaacatctatcacacaaaattattttgttagatataacattcaatatatatccataatatgtttttttttgtaaaattttactatatttttctataaacttggtcaaacgtaaaaaaatgacaagaaaaagtcaaaatgacaaatgacttataatatgaaacagaggtagtatatatgtttttatttagtttatttgaacggttgtttcataattagacagctaaataatttaaaatcaatattaccaatattttactataaaataaaatatgttatttgaactgccatctattctttacatgacaacccagataacatccgatttttaatttatttacactgttgattttattgctcatattttactatgtaaaatttaaaatacgtaatttgaacatagaccaacaagcaaacaacactgaaacattaaaaaagtgacaacatgtattatgtcatcttaatcattgtacataataaaaattagaaaaatacaaagtcaccatgtatgaccttttagagccatgctaaactaccaagtatcacattttaaaaattagtaaaacttataaattcaaagaaaaaataaaacatctacccaacagtttttgcttagatcgatgacctattaatattattttcaactatcaaatctacttttagaaaaaaaaatctatcaaatcagtgacatgtcacatcttgaaaaaaaacttgcaaatagtaggaaattaacatatgataatttgctttcacttaaattacttagaaaaaatacaaaaaaaaatccgctccatatgcgcccatcactacacacccactccttcccctctctgtctcaagctctacgcttttcattcctctcacgttcctatttaactaaagataaataatctataattataagtttcacgtctgatttctaatctttaactattgatatgtttataaccaaaccaacgatataagatccatatgcctatatatagtttgctatataacaaatacgacattttaacacaatcagcctattacttataggtatctcaaatgcagcctatgatacatgcccgcgcgaatgcgcggactaccttcttagttattatatactaaaagtccattaaacttcctacaaacgctctaaagccgccatgtggcactcctacaaacactcctagaccgccacatggcactatctaatctcaccgtcgattttcacttaaattggtggcccctatatttttgaccattatattagatctgttattaaaaaaataataccttcctcccacacaagaaatatataactgtttgtactaagtacgattcaaaggaaaaaaaaataaagctggcctactgtgccgcaagaaaaaaaaaaccatatacatgtacttatacaatatgcagaagaaaataaagtcaaagaaacatatgtacgtaataccatcattggaaagaaaatcgacaggatttcctatatgttttttaaaaaataaaatatatctatatatctagtatacactaaaagtttattaaattttcgacaaatgctctcaagccgccacgtgatactctaataaattagagaaaatcctaaaaattctaagaataagca

SEQ ID NO: 48727 - DNA, 1824 bp, Oryza sativa
cagggtgagcatttttttttggccttctctgtttttttttcttcttcttctttcttgtctgcctgcgacaaaatttcttgctgctcttgatttcgtacttgaaaggtagtgttcttcagttattcgtattgagtttggaactttggatgggtgactggggaatctgacgcataaattttgtttgcgaattcagagcttttttatttttcggcgagaaattcagagttgtttcactgtttgcaatcgttttcagcctgcatcgtgggaatcgtgtagtaggtagcgtcatatgaatattaatcagttgcctttctttgaaaatttcctcttgatgatgtagtagatgtactctgcagttgtactgtcgaaatttcaacattgaccttcagaaacttatccgggatgttcattcaaatccgtactcaatgaagtcatcacccaattttaattgtggcagccattgtttttgttctcttgttgactacactgtgcctgcctaatattatatctaaaaattaaaacaaaaaacttttcttaatagcttccgagagactgagatactctatccgtctcaaaatataaatgattttgaatggattggacacattatagtattacgaatcagaccagagagcctgatgagtattacttttggcagaaagcatataaattacttgtcctagtaacttgtaagcatgggagggtgttgtcattagttgacatttctgtttcttgggccctgaaaagaaagacatttctgcttcttggagatgactaatagctgtactattttgttttgttaggacatatgaaactgttctcttgctgaataaattgtacaacatgaatcattttctttttccttcataacttcttgacggctttagtgatagcttctgagcctggcagaatgctgtcgttagttagcaattatgcttgctgaagatgtcatacagttcagctactatgtttaatgatggttgtctatgaaattgttttatggtttatcatatttaattgcttatagttcaacgatccaaatatccacatgaaagaacaagtgtgtgtattgtataacgtatctaccgttctacctgcttactgaaacgaatctacctcgctgaacacagccgtgaataaaaaaaagagaagacatagttaattttggtgagcacagccataaggaatcaatttggtgtctgaacacctcaatgagcactggtttaatcatgcaagaaatcttttgattagtaagactgatgaccgagttgctaaaggtcacagaacacggcgtctgagcttcagaataaggcatcagcccgattactttattaatataatatatagggggaaaatatggcatggacaaaacaaagtaggatgggaatgttaatcttttttctcaatttgtttcttcactttcaaaagaaagcatcatgttctgtttgtgttgctgggaagaaccgaagaaggacgattcaaaaacacaaagcattacgatatgatgactataaatatgtttatataggatggtgggtccattaatgttcaaaagaacaaaaggactgatgcaaatattcctttcagacactctcagctgttgatctgcgtgatccagagatttcagccattatagcctcaaagctgagggaattccacaaccttgatatgcctggtccaaaatctgtactcatttgggacagactaaggtattacttaatttgtgtttacactgttttttagcattgcatacttgtaaaatgaaacacatcatcgaagtaaaacactaagttactaactgacaatgcctatgcacatcttcat

SEQ ID NO: 48728 - DNA, 8310 bp, Oryza sativa
tattgtttgactgacatgtgggtccaaatattttgttttaatttttaaattgttaaattttgcttcatatgccacgttaatgccacataagacgaatatcgagtaaaattagccatgtgggtgccacatcagttgaaaccgtgctccagaccgccttgggacttaccggttttaatagttcagggacccattgtatatcgttttccggttgaaggacgaaaatcgaattcgttgacaaattaagagacctctgatgaacttatttcataaaatagttttgaaaatgctcaggctcgagcgcccgatcgggtcagtaaaaattggaccctacactctcacatgcatgctattaactagtttctcattcttcttttcttcccactttaaatatttttttctcctaaactatgtatccgatctacgatccgatcacaccgttgtattcattgtaattaaatctttacaacaagatatcatatgattatattatgataaaataaaaacatgtgtttcaaactattaaaactcaatgtttcatacgtgatagtgatatgattcaatgtgtgtcttcagtatgtttcacaaaaatcatggaactacccgccactactctctctcctctctcccctccatccatctatgtatacatacatttttatgatcttcaaaatatttttttcctaaactacttatccaatctatgactatatcacaccgttgtattcattgtaattaaatatttacaacaagatatcgcatgattatattttgatgaaagaaaaacatatgtttcaatcagttaacatttgttgtttcatatgtgatagcgacatgtttcaacgtgtatcttcaccgtatttcaccgtaatatgacactgagtttgttaagttctacagtatgtcattgtattttgcttaaattctataatataccatcgtcgtccatttagattccgttagtactgtataattttgtcctaatgattgaaatatccctaggacaaaaatttctaaaatttggccgaaaattccgaaatatcatattataaactaggcagagaagttgcccatctcaaactctttaagttttacaatctgtatgataaaattgtacaatgctaacgtaggctaactagacgatggtatattatagaagttaagcaaaatgcgatgccatattagaacttgacaaacccaatgacatattgtagagcagggataaaattagtgacacacaatggattgtctctgttttttatggttgttcagttaactacctatctactatgatgcggcatttttagaaaaagttaaatcttatactataagtccaaatcttacacattaaattacatacacttataatataatttttcaaatataaaatgccctattctcattttataggagaaatatagaaaaatgatgtattatctatttaattatgagaaatatattagtccaaattaacatatatgtagaaaataaaaaataatatgaaagaattacggaaatacgtactaacgtagtcatcatatataatacaatgagaaaaaaagcccatatccgaatgctttattattgagcaaaagtgatggtattatttttatcatcttttagcggaatctatctaaccatagttaatcagcccgtgttagtagaagtctgtatcgtcatgcatcaacatatcatgagattattagttatagctaggtacaccggcataatcatacttagcatatcacgagactatcgggttatggacaattatctttagttgtgctagagaaaaaaaaagtactcccttcgtcccataaaaaaccaacctaggactggatgtgacacatcctagtaaaacgaatctagacatgcatatgttcatatttgttgtactagaatgtgccacaccagttctacattcgttttttatgggacaaagggagtaaattacaatccatactatgtattcttaaaaattcttaaaagttttcatataatattatactttaaccattttcatttacacaatagctaactttacatttttatttggactaccatattctatccatctccaagtccagtgactcagtaatcatttcgcacattaactctctctctctctctccattttctttttccatccgacagttggataaccgatggatctagcaagaaagagcctagatatagcgccttcgctcttcgtcgggtcagctcctgccttccaaagtccttgcaagctcgacatctccgaccttaatagcaaccataacaatagtgcgcatcacgataggggaggagaaaaagacatatcgattactagaggttaaggctgcgcatgtaaaggcaaagaggaggaacgatggtggctcatggagaaagagcgttacgtagagtggcagttagcggttgctggtggtatgaggaatttgttgtcgacacaatcgtttaattttttcctaagtattgatgatacgtgggtcaccagttatataaagaaatagcactagctagttttaaaatactaccttgtcccaaaataagtgtaactgtgaaaatccgtgtcgaatttttgaccgtccgtctttaaaaagtttatgaaaaattaaaataaattagtcacacgtaaaatattattcatgttttatcatctaataacaataaaaatactaatggacggagggagtggtaaataaaaatattgagataaggggggagtagtcttttttttttttgagaaccaggaatttattaaacttagaagcagagtacatgcttgagagtacaattaagggactcaaaatgattagatagaattctagcacaacagtcctttgttggataggcaatatggaaaatgttctgacaattgtaggttaggtaaggggggagtagtcgagtatcgcgtaaaagaaaaagaaatctctcgttgtctccgctccttgcgccgccgccaagacgagtcgcggctgaacaggggagggccgggcggcgatctccatcgcagcggaggggaggggaggggatcctggtgcgtcctctttctgattcatctctctctctcccaccccaccgggactggaatttgcttgcgcttctcttctagatcttctcctcctccttaatttgatagccttaaacctctcttaaataataacagtttgtttgttcacccaaaagtttggatccgcccctgttaatgccgcgtctgctgctactggcacctttgcagaattgcaggcgtagtctggtcgtcgtgccggtaaggtgagggggtgacggcgatggccaccagcgagtacgagtacgtaagagggagttcgagctcgacagcctcctcccgccctctaattggatcgttgtgcgcatcgacggctgccacttccaccggtacagttgctctcaccttccatccggtggctgtatcagttcattctctggtggtagtgcagtgtgcgatagtttatgcagacatggcaatttcagtttaaatctcctgctttttgcttgatgcaacatgtctgtttggtcttagactcttagggataaaaaaaaagaagctaaacctgctattatgcacaacgccttctgcttggttttctttgtgatgatcggtttatatgagaagcaggccacagtgtgtgtggatactagacaggggaaatcactgttgcttacaatttggaatagttgatctgtgtttgtcctgtccactaatttcagcattctctttgttagattctccaagatacatacctttgagaaaccaaatgatgagcgtgctttaagattgatgaacgcctgtgccacttctatgctcgaaaagttcccagacatagtcttcgcatatggcgtcagtgatgagtacaggtacaacatcttctcttggaattttcagtttgaatttttccagagtccttagtttgttctttctccaaaggtaaatgagaaacactacacttgattgccatggttaatgttatcattatgtaagagctgtgctgttatattacatgtgcaaaatgcctcttaagtaggtgatcaaagacgtgaactgtagatactccctgttgacatagaatgcattgtcttcagtataattataagttatttgcatctcatgtttgtgttgcagttttgtttttagagaggaaactgaattctatcaaagacgagaaaggtaccatttaatatgtacaccattttcactgagtatcttgaatgtgcttatgtgcaatgttttatgacattggcttttctactaataacttgcatgcagtaaaattctatctttatgtgtttcctacttcacttctgtgtacgtgatgaagtggaaagatttctttcctaataaggagttgaaggagcctccatattttgatggtcgagttgtatgctatccaaacttgaagactatccgtgattacctggcctggagacaagtggattgtaagatattctctccaccaactttttcttgtatagcaaaacagattcaatattcatatttttgcattgtgcaatgatgttctgtacaatgaaaccgttttgtatatcatctttacctaatacggaatcagcttagcaccactaaatatttgtctatgtgttaggagatttgtacaacttatttcttcattaaacagatcgactcagaacaaattcctttgttgtgttttttaggtcatataaacaatcaatataacacctgcttctggtcgttagtgaagtctgggaaaactgaaaaagaagctcaacaagcattgaaggtaatcaaaatgttttagagagtttatatatgcttccaattgcattttaataaatgattgttttctttttgtttcctcttctttctaggggacattttcaaaggacaagaatgagttactttcacaacagttccaaatcaattatgatgatgaaccggctatattccgaaaagggtcttgcgtttaccgagacaaggtaatgctgccaagaaagcaaaacggcatcattattaatagctttgataatactcaacaaagtatttacatagtctctactctctagtaatgcccatggtagtttttttccatacttgccatcagagatatttcaaagaagatttgggaccttgtagtgagacttatttgctagttctcttggtaggaacttggcgagatttgcagttttcagttgtttggtcatgcgtaattatatggaagtggaatggcaaaaaaaaaaaaaagagggggggacagattaaaacttgtctggattttgtaaaaaaggtacttgtcttatagtgataatcagagcaccctttatgcaatccggtgccagttctttttaagttattgatcaaagattatgattcttataacatgattgtaaactgcatactacctttcttttatgggtttgattgtggaacaatcgtagttcttggaaaattttatcttcatcctttttcctttttgtgaactattattctcatccctttgctgagattgactaaccaggaatgaaataacatgctttctgaaatgttaatagttgttaaatgcacttttgtatgctaagagcttttgtatcactgtaggtagaaacaatggtgaagactgatcgttgtggaaaccccataaaaaggacacgcttagttattacaaatgcaaatgtcgatatcataggacccgagttttgggaaaatcatccatatattcttcgagaaggtgagttgagttaactcctgttctctatatgctttcagcaattcagctgcagtcagaactctgaaaatgtacagcatcaatctaactggagtctttggttaaagaaaaatgtaggtatgagaatgttaagaagtttgacatcaaccataggcttccaccttgtaattggactgtcgttcgcatcgacatttgtaaatttgagcagttaggaccctcttgtttcttctttatttgaaagcatgatgcaatctcttttgtgtcttgttgagaactcaaattttctttgttagattctcgttgatccattcatttgacaagccaaatgatgaggcagctctaaggttgatgaatgcttctgcttctttgatgatggagtcattccctgacattgtctttggctatggttttagcaatgagtacaggtaagatatacctccttatgaccttatccactgtcttagagcaaaaacaattgaaagaaagaaaaacctttgcttgtacagaaaaaaaagtcctggatgtcatgaactgaattgattttgttttaatttagtcttcgcaagataaaaatattatgactaataatccatacattaaattgtatagcaaaggtttcatcttagacaaatatttttatatttgatggacagaaaattcatcttttgcaaatgttctttcttattttcttcttgttgtcgcagttttgtgttccaggataagactgaactataccagcgtcaggaaaggtaattactgattttatgcatttctattatgcctgtcctttcaagaggtgccattgacaaaatgattgcaccttcttttgcagcttaatcctttcatcatgtacctcacgtttcaccttgttttacatgatgaagtggaaagattttttccccaacaaggacttagtggagccaccgcactttgaggcagaacttctatgttacccaaaacaaaagatactttgtgattatttgtcatcgagacaagcagaatgtaagttattcctcctaaaaggcatatattctgacactgttaaatgattctcttcagtgaacttcagtatgtattcgtttgttcatcttcagtgaactcacgtgctacgtactatttcgcaggccacaccaccaaccaatacagcacatgcttttggatgctagtgaaatctggcaaaagtgaaaacgaagctcgtgagatattaaaggtcttctttcatcatttcggtttaaatatttcccccctcttgatcttgtttgatgctttggttatctgtagccataactctcttactgctctctgcagggaacattatcaaaggacaagaacgagttgcttttccagcaatttcatttgaattacaacaatgaaccagctgtgtttcggaagggttcatgtacttaccggcaaaaggtaatctttgttgttcccaagaagcattttgcctgacttcttgtattatttccgctgcctgctttgttttccacaagaatcttaactcgtacgtttcaaatggctgcaggtggaagaatctgcagacgcagagggtagagaaaataccacaagagaacggtgggatgtgattgtggcacacgcagacatggggacggaattttggagaaagcatccttatattttaagaaaattggatttactaggctgataaaattttctcatcaaccttttccacattatcttttcgttgttgtagtgttgtatatgcattgtccacactagtagaaaaatggctggcctctcttcattggccattcatctcgttcatttcgttcatgtgcaaaacttgtgcccctaagatgcagtttcagctgacagaattgagaatcgtgatgatatatctgtatcttgctgaatggaaaattaggctcaaacagagaaggggtacacccgtgtggtaatcatttacagttttcaaaagaaacaagaacgctatacacttatgatcaaaaaaaaaaaacgctatacacttttcagaagaaaacctatagctatagtaaatcatccagctatgcatttacctagtactaactccttttttttttacaattgtgaacagcaaaatcaggcaggttattcagcgaccttcagctgaagaacttgcctgcacaatcaaatatatatattttcactcaagttctatcttcttccgttaccagatgatactcaacctctgcatccgtaaatgttaatgctttctgcaactttctgtggcagagaacctcaacatctgccatgaagactgcagtcacagggcggtgatcagaaagcttaagctctcctctcctgtaggaaattaacctgattccctttcctcgtgaaagaatcctatcacacctgaacaggcaacagatatgatttctaagcatgaacttgagttaatcttttaaggttaattatgcaaaaaaaaagaaggcagtgctatgaaaaactaacataccatgctggtgttctccttccagattttggctcatcacttacatacttttctgagtcaaactcgtatttatatgttggggggaagctgatatctccttcgatccaaccatcaaaagtgtgtcctttactcaattctctt

SEQ ID NO: 48729 - DNA, 7460 bp, Oryza sativa
ataaaaacaagtgtgtgaacttactcatgacccaatattcccttaggcgtgctaagtccaggaagtgggttaaatactgttcttcggaggatttcttcaacatctgcatttcttttcagttcatcgccatccttttctccagaagttaggtggcaacatacaaagcaaaaatgtgtctgatgtatagacatgctgactgatattgacccctggaacattcaagaagcacatgtgcacggtgcaccaattattttctaaattttgaaaaaagaaaaggtgcagcatgaagaagcatcgtcaagccaatgatttgtagaataacaaagtagatgaaactaaatttttatgctaacatatagagcagatagaaggaagtacaaaccaacaccaaactgattaacctatgggacttcttgactaaatgatttgcgaatgttttgagtgctgttgaattgaataataagagcagtggattaaagttgatacttgccttgttgcccatatacccattgcacctacaccgacagttgatactctcaaattctgaatgtgcttccgcaagtctctccgaacccatattgaaagatatattcccaccatttgcttgcttactattcgcagaaagcatggccttttacttttaatcactccattgtcactgttaacttgatgggataaatcatcatttggaaaattcactgttgatttcaaagatgctggagttgctagagccttcagtgaagtgctagcccgaagacactgagccatcatatccaatggctgttcaggccaaatcattccaagcctttctggatgatagagtaatttggttgtctcttccagttttgatctgtctttttcataacttaagttgggggactgatcagaagtctttactgaatccatcctgctgaaatctttgcctttatgaactcttccgttggaagcagcactgaagttttcatatgttttatcatgaactacatcattgtcaatagctatatcatcattttgtttaatcaatggatgaagctcaccataattgtcactgtcagactcgctaagcaattcatctttcatcaccataacataatctgatggattaaaccttgatggtgaaggaggatcactgtgacatttatactgcggcttatctggacaaatcttattcaaagtttcacgaataatatgctcccatactgcaattggactgttatcctcagaaccaaatatgtttccagcatttaatggaacaatttcttgaaatctgaaagataaacataaatttatgacaatggattttttatatacttcagttgtagtgctgacaacagaacaaccaaccaacatcatgacatacacgaatacaaatagaaccaccaccataccatagctaaataataaaataatgtctgtctcttttgaagaaactgtgatgccaaaataatttcaaatcatgatccagaaacatttttttagttttcaaagataagaagtggagtgcttcatgcgaatctgcggcacaaatcttttaccttacaaaatagggggaaaaaaattgtgaatagtgatttacccaagaacataaatatcagcctgctcctccttatccaaccagtcttgaatgtccagatcactgggtggaaacttgcctgcaagattccatgtccctacacaaatcctgcatatagaaaacagtttgaaacatatacaaaagtatcatattttatttatttcagccggtaacaagtgggttcaattgtagcattaacctgaaatgatttgtgtgataggaatacggtgaaatgagtggctgacatcacattaattaattacatagtgacataagatgataggaacaatactcactgtaactggaagaacataactaggaccaggaaaaaaaaatgcaaagatggagaaaattctatacggctatacctgagttctctgatgtcaatatactgagcgcgaagggtctctgatttgcgtcttctaagcctgtaaggcatagatttaatttcatcccctacattgtgtagttgattgcattagcatataaggcaaacctgccatgtcagttttatcaaacaagtgcttgtgctgcacataaggcaaccaatcagccctgccttttcaaataggcacttaatgtactaaacatggacttcagagtaacttgaaaaaatattgaaagctgaatgcttgctaattatattcaattctgtttcatccattgtgataacatcaaatgtttattaataaaaacaagaaaagcatgatgtactattttgtagaacagtttaagataaaccgatctagaggcatcatcaccccagggaaactgaaattcgaggctacagtctctcgtatgtaaatgattaccaaacataaggtctttcctctttggtcaatggactcatatgttctgtctacaaaaccaaactagcctttactgctcagattagtattttagcaccaatatgcaagaccattcccttgtatgaaaatcaactagggacaactcatctaaaagatagaacatgtagaaagaaatagacttatcaaaaaaccgaatgtgcagatcttcagcagacctctccaaaaaaaaatgaggagctaataatgaaattaccaattgttcctgcaccaagtccatctaaactcgtcccttcaccatatgattcattatccctgtctgcacaaatggcataataaagagaacaatcagaatatgcatgattcaataacatatgcaagttaagtgcaagaagagcaattgataaggacatgttgttaactaaaaacaacacctacaggacttttatcaaagggagcagctgtcattagatagtaaagtcaactagataagatggtcacattaccattcattgaagcaataagaaaaaaacgaggctatgagttaagcaaaagttgcctgctttatcctcactttttgctacccattttgctcaagcaagcttagaaaagaatcgaaaaggtatcatgctttcgccaaatccttgaactccctgacctaacattcctttccttaaaaaggttgaatataccaaaagaaagccgctggtatgcagagagtactagcctagctacacatcacaatggaagtctttctcagagatattaatgaccataccaaattgccggcacttgcaattgcaatgatcatcaacttacacacaaaattaaacatgacatctcctagttctaaagaaaaaaaaactaaccaattctttgaatgggattattttttaatcttctgaaaaaaaaaaggagagtcaaatcacaaaggcgtacaagaaagagcttccattgcagtatgctggtcagcattcccctcattgcctagcaatcaaaacaacacaaattcgcacaccaaattctccccccatttttcctccagacaagagcaaagcttgagtaaactggatcaaatcagagcagctaggaaggaagaggagaggggacggtgactcggtgaggcaggttaaccttcgccgtcgagctcgccgtcgctggcgtcacactcgtcggcgctgaagtcggagtcgcccgacccggagccgacgttgagccacttgcgaagcaccaccctgcgccacaggcgcagcgcgccgcaccagcaatccacgccgcagcacagcatcatcgtctcggcgcacctctgcacaagccccttctccaccaccacccggagcagacgagagaattttcagaatcagacagcagcaacaacaagaacagcaataataaccgatttgatccaagaacgcgagcaaaaatgcaagggaacccaactccaccccggccaagaactggtacctggttctccctcctgcccccgcaccgcatctgggacgcggccatggctggctcctggagctggtggcctcggcgaggtaggagcggcgactaggcggaggaggaagaggacgccattttcgctggcttcttgagcgggtgggcaactgactgggcccgcgcctaaatgcaatgtgctatataattgaaggttattagtactaaatattttaattaattactaagtcccctaaaaactgcacgaagtacatttttctaaatattattttgcgggagtaatgttcccaaaaaaaagtcaacataacaccaacaaattctcttttataaatgtcaaaagactttacaattgtactattatgtaatgttcattaagatagacttgactatattattttcatatacctaaaacatatattttaaacaataaagtgtctagtataatgtattcatatgatttgttactactctacttttttctacagaattagtcaaacttaaagtagtttaactttaactaaaattaaatcactttatcacctgaaatagatgaagtactttgattgcgcacatgcatttttttcccaaatagtagaatgatattgtaatcactgttcgagagtagaaatgaatagattaattattataaattgaaagaatcgatttaaatagtcatttaagatttattttataatcatatcatttagcaacttgagaagcgtgttgtattaatcaattcttcattccttcaaaagaacgtgcctaagatatgtattcttttatgatctatgggagttcctttgcaattgccaatcaaatatgtgaccatattttctgtttggcttgcaagcgcatcgtcgactcgtcgtcatcatctgtcgctcccagagatgtcctgccggatgccctgctgaaaggtgccgtactgctgtttgggtctccttgatcgatgtctgctttggaaggatttctaaacgatccaaacaatggagcattttcgctagctgctccgagatgagcatcgctggacaagaaaaccacagcagatgagaccaattgatcgggattaatgtgcattgatacgctacctcgtatcattcctgtaaatacttatcgtgtactccgtattattcagtggaatcaatgaatcagacagtcacttcagtgtcttttcttataatgtgttgttggcatatcatctccttgcagcgagatcaaagttttatgttttgtgagtgttcctgttcctgtcagcgtctgaatatttgggctgatatttatgtggacttggatccttcacctgttacttcagcgaggttaatatggtcctggaaaatgttgagtacaaacaatgtttgttgcctagtggattagcagaaaggtacaatttggattgtgttactgtactgtccttttcattgccatagaaattgtttgggtgatagctcacttatttgatcgtattaatactgtttaatgatgggttgcatctaacatgcacaaaaccgtactagtaaattgttacccagggatctgaagatgcatttgtattcatctgatcctgcaatgttagaaaggttttgtagactgcaggcaaagaaatttttctgatggctccgatccttttgctgaagtcaaagtgagcttaattagttctggtttatttttatccttttccggttcaattattgacgagtgctaatattgtgtcttactgtttgtggaatttgcttgcacattagcatgcatatggtcagtggtgttgtttgctggtgtctgcgtaacgtccatcatttgcatcaaaggagagcacatggattgttttctccagtgtcatggatctcagaggcattaaaattaatctctcaagttctatctatctttggatatctgcgttctttccacaagtttcccaacccctttccctcgttttccgcgtgcacgcttttcaaactgctaaatggtgtgtttttttgcaaaaagtttctatacgaaagttgctttaaaaaaacaaattaatccatttttgaaaaaaaattaactaatacttaattaatcacacgctaatggaccgctccgttttccgtgcggtggagttgggttcccaaccccaagtatcaaacacagccatagtggtcagtggacaccatgaaagagtttgcttcttacaatttgctaatctgatgactccactactttctctaaaataaattgaccatatttcaatttgtatggttaggagtcccagtcattatcatgtgtttaatatctggtgtttgactactggcatgaattatttttttctacataaaattgtggtggaaatgttgccacaatgggctgtcaattaataataatgtttttggtctctacagattgctgacaaccaataaggatattagattttttttacataatatattaaaatgtttaactagatgtttatagaacatgctgagatcttgatgaaagcagctttcctgtaaacaactttgtttattgtgttgatcacaaatctgaactatatgctcatttctctcctcacacctaccaaatccatcatatctgatcagactcgcaagcagttgcaagcagcatattcccccaatcattatttcattgccaattggtttgaagcagtcgcattaccaccgtctcattctgataactctatgggcatttttcaggtaatcgtgcatgcacttgcagcttaacaggttgaatatgagaaccgcattatcggaaagaacacggttggggatactgaaatggttggagctttgatgccgtaattagtttccgtctgttgtttggcagatttgcaagaacagaacagattgaaaatgctggagatttgttggcacctatgaatatgatgaagttacagtactagtacagtaccctgaagttcaccggatcactagaagaattttcatctaccattaattctcagtactgggcaaggaagaatctgcttgaaggggattccttgcacgaatcatctgtcaagaaaacaaccagctctagcagcaccaattagcgtctcaacccagaactcaaaagaagttagtagacagaaagggacagttaattgttcagaaatcagtataattcagtagaagtaggacgagcatatatagagaatacagtagcacacgcaacaatcctgaattcccatgccactatgccagtgatgacgaactggtgacgacgatgagtcatcagctagccattgtgcagcatggttctccatggccgcaaagaagctagcatcggtgatactttcctgccagaacaaggacggcaagtctctttgcaatgttcatctgtgatactttatccatttatgtatttaagtgattgttttccacaatagatggccaatttgtcagtatcagattcattccaagatctaccattttgcctggccataaaatgcacatgcatcacggaaagttttgaaaaagaataacagcaggcatcttaaaacatccaagttcctggcagcaaacaggtaaagaaactttcacacaggtacattggtaaatgatcgagcttgactgccaaggttcagtgccatcaaaagtgaaatggttttgcaaggttgggtatccccatgg

SEQ ID NO: 48730 - DNA, 8507 bp, Oryza sativa
  unsure (1)..(8507): unsure at all n locations
cttcaagtgatgttgcattctcaagaatatgacaagttagctcgaccatgatcttcacattcttgatggtgtcatgatggtgtcctggcatctgccttagatgtgatgaatcttcagaaatcacgtcatgctccatgcgagtctgtgatacctgcatatgaaccagcagagaatatttcaacaaatagttccactatatatgatagatatatatttccgcatattaaaatttacttacacgtgaaaactttacttaccttcaaagtgaaagtctccaaggcaggagatgcatcaagaaaataagctaaagaaagataatcatatgttggggaaacgaccctagggactgtgtgaagaaaaacagtaaggtgcttgaggtggagaaatcttaaaggtgcgatcggcgtattgataatctgcataaattgtcgagattaatcacatttcaaggtatgactattgctatatgcataatgctggaatctaatgatataatcttaagttgcgtaatgtacctcgctaactgaaaatacagtgagagtttcaatagtgggcacaatggatggaagatttgcacaggcataataaatagcattatgccaacgaatggaagctatggttaggttcttcacatacggtagacctccatctgatagtcgtgctagattaccctcataatggaagtttaaaagatttggagctttaatttccatcacttgtgatgcttcccatccatacattgccagcttgctgagccgttgaagcaggcaaggtatcttgaggtaactaagctctttgcaatctgtgagttccaactgctctaacacaaaggaattggaaaaaaggcaccctaattcgtgcccagtaatgcgcacctcatacagaaacagacttcgcaagcaattaagtccaccagtaggacggaagacacaatagctgagataaagatgcttaatcgagcttccacctctattgaataaaagtgagaatgggaagtcgtagtagtttgccttgtcctctggaaacagcaaaaggatgagttcttcaattgccggtgtaacagctatctggagccaacaatcaagataacaggcgtcgaccaaattataggatctaagcccaaaagtcttcaagccaacaccggagtggttttcataatgtggtcaacttttccattgagttctcctattactttattcctttccaaccaattgtcattcaatcccaatgttttcgcactgaagatgagattgggacggcatctccaagaacgtagaaatatctgagacacgcatgcggtacgtgcagcatcttgtagtggcaataaggagtgtatatgataccagatgtcctaaaaacaccatagtgggagagaagttcaacattgtgcttgtaaaggtaagtgaaccaggatgtatcggaattttatacctcaggaaggaaggcccatggatttctcattgttttgacaccttggtaatcatcgccttgttgacagggtgagccatttcgtttagccagtgaagcaaccgactcatctgcaacacatcatggtgacaataggtaccgatgataatggagtataaaacatgcatacatctaatttgtttctgttatgcaacttttgggcacgaacgcatattcttctgttaaagactgcaaattgaaatactcaatcagaaaaagaaagcaacagtcttatatctactatccaagcttttttttcttccagagaaccaaagaaagattttaagctatttaacctaaacgaatcaaacttagccactaacagtagtaaagaacctccagttcagtcccaaagcagcagtataatacaccctcctctttttgtctcggtgcagcagtataatactccgtttcattaaaactaaaattttaatatattttcataatatgtttattttgtgttggaaacattgctgtatttttctaaaatttagtcgaaacgacctaaacctataatatgaaccgaatggagtatactctaaaaaagaatagcggtatactaaacaagctatggacgccagggcattaacacagaaacactaaacacgatgcaatgcgacgaagaggccgatggggcgatggatcaaagagacgagctcactacaggattggaccagccgacgtggccgcgtctgctcctgctgcatcgacatgagccgccgccgccgcttcacctcccctcttcttccccgccgccctctctgctcctcttcgattccgaaaccagcagggcggcgcgcgcgcgcggggagaccagatcaccccgatacgccgcgctctctctcgatcttgctccggtgtcagcggcaaggcgcggcgtggcgcggctgcgcgaggagaggaggggaggggagtggaatccgcagaggtgacggccaaaaatacggcagaaaattaggaaacgaaaacctgctggtccatgctgtgggccgatatttgaagcccaccaaacgaggccttaatgggcttttgtaggtatgtttgggatgtacctaggggtagtaatgggcccaattttttaggtttaaaatagagtgggttgaatttttaaacatttttaacctataaatatttgacaactacttcctccgtttcacaatgtaagactttctagcattgcctatatccatatggatgttaatgaatctagacacatgtaaatatttagattcattcacatctttacgaatatagacaatgctagaaagtcttacattgtggaacagagggagtagttagggttgtgaaagaaactatggttatagtattttactgagtaattatattctaattacactgtagttacatctaatttttttcactcaaaaacttatggcatatttttagatagtccattttaaataggtctaactataatttaggcgaatggatatttggcaaatcagttaaaattgtcatgttcttcgactccattgagccatactatgttatttttttccccaaaaaaaaattgacttactgtcttcaaccaagacatgatcaggtacatgaaaaatcaaaccaatatctaactttttttggatgaaagatcattatattgcataatgaccttgtttttaaagaaagcaagacaagacaagccacagcttcagctggacaatttaagaatggtattggttatagtatactccaactgagaacatgacacaacactgacaacttcagagacaaatctccatcccaggttaaacaagatttaaaacaagccaacacctcacttaaggaacattggaacattaattcactataaagttcacttaaggaacattaaatcactataaagtcgaacagtaatggtcttttaacacctgcagcatggcatcacctgcagggcaaggaaggccttcactggtgtgcttgggctgaaggataatttgtacggattatgttgtttgaaatgcttcttgattgtggtagtttaggtgacaaataattcggaaaagcagacaattttgttgcccaaacacgtgcgtcagaatgaatgattgcttctcttcttgttcaactctggtgagcattagctattatcttttccagggaaattgtctcgtggacttccactaggacactgatgatcaaatatgaaaatgccaaaccaaaatataagcaaaacataatagcgttgatctctagagagagaagcagtttcaaaataatacactttgtgcgagtgtaagatacaatgcatttcgtccaaaaaaaagttgcaatgcattcataacccatcatgaaaaataggtcatacccattgatagctaaatattctattagtggtaaatgacacgcccgtcgataatgaggtagacttcgtgaatctcaatatatattagtccagtcttcagagatgcttatgggtttgtatgcaggtgtttatacgagcgtttgtactgtgtttgcagtaaactattaaacatgatatactttttgcaggaagtaatattaggatattattgggctgtcatgtaacagaaatatcaatgaaattacaagagcgaacagaacatgtacatgtcgcatgaatacaatcgtagatcatatgtagcatcccagcttcaggtggatttcaattgataaagcagagatagccagaagaaagaatgcttcttgattataatataactgaacatgtaacatgacattagaacactgacaaagcacaacccatgcaataataccacaggacctaaaacagcaggtacatcctatagctaaagaaacaagccacacctagcttaagcaacaccacataattcaacatcgccacaatttaacacctaaacttcaaaggcatggcaccagctgcagggcttcagaacatctaacctgactgtagaggggactttccccacaatgtatctttcgatagccaagagcgcgtttttggcctccatgatcatttgcctacatatggggctgcactcaccaatttcgtgaacagatagcctatcaggattttcataatcatcacatattgtgtctagagtaagggattctagtgatgttgcattctcaataatatggcaagtcagctctaccatgctctttgcagagcaaaacccaatgatcttcacattcttgaggttgacatggcggtgtcctggcatctgcctcagatatgaggaatcttcagaaatcacgtgatgcttcatacgagtctgtgatacctgcataggaacaagcaaacaatacttacaaatgattccattatagacaacggattaataggtattttttgccacatcaaaatttaattgtatcaaacaggagaaaaaacatgaaaaaagaaatgcttacggtcaaagtgaaaatctccaagacaggagacgcatcaagaaaataagctagagaaagataatcatttgatggggaaaagcccccacggtatatgctaagagaaatcgtcaagcacttgagatgaaggaatctgaatggtgaaatttgtgtattgaacctctgcaataatattcagaattccatattaatcagaactcttgctatgtgcacggcccagccaaaaaaaaaaaaaactcttgctatgtgcataatgctggtatctaatgatataatcttaagtttcataacatacctcgctttctgaaaatatggtgagagtttcgatagtcggcgcaacagatggaagcttggcacatgtgtattgaatagtatgatgctgataaaaggaagataagtgtaggttcttcactggcagcaaacctccatctgatagtcctgctaaattaccatcataatcaaaggttgaaaggtttggagctttaatttcaatcacttgcaatgttgtgcatccaaacactgtcagcttgctgagcctctgtagcacgcaaggtatcttgaggtaattgagctctttacaatgtgtgagtttcaactgctctaaagcaaaagagttggaaagaaggcaccccaattcatccccagtaatacgcacttcaaacagatgcagtctttgcaagaaattaagactagtggtaggacggaaggcacagtaactgaggcgaagatgcttaatcgagtttccacccctatcaaataaaagtgagaatgggaagtcgtagtactttgccttgatctctggaaaaaacataaggatgagttgttctattgctggtgaaacaccaatgtggagccaacggtcaagataagaggcatcgaccaaattataatattcgagcccgaatgtcctcaagccaatgcctgagtggtttttcataatgaggtcaactttttccgtgagttccttggttacttgatcactttacgacaagacactcaggcccagttttgcatcactaaagacaaggttggggcggtatctccatgaacgtagaaatgtgtgagacacgcatgcagtacgagcggcatcttttagtggcaataaggagtgtatatgataccagatgtcctgaaaacacaagagtcagagaacagttcaacatcgcatttgtaaaggtaagtgaacaatgatgcatgcaaaatttatacctctggaaggaaggtccatggatttgtcatagttttggcaccttcataatcatcttcctgttggcagggtgagcccgttcgtttagccaatgaagcaaccgacccatctgcaatacatcatgtgatcatggttatggcaggtaccgatgataatggaacgtaaaattgagagtacaatgcacacataaaatttgtttctcttatgcaaattttgggcaagaaccctcccaagttattcttctgtggtagagtgcaaattgaagtgcgcaatcagaaaaaagaaagcaacattcgttccgaggtactcagattttaagctagctaatctaatcgaatcacttagctactactgtctcagtcaggaaaaaccaaactttttcttctgtctcagtctctcggaacaataggaataatgcagtatacttcatctcaaaagaataaaagatatcttcctcaaaaaaaaagaaaaaaaaagaggatagcagtatcctgattactgatttaactgaacaagctatatgtcaggccaatgtacacaatacagtgcaacgaagagggccatggaagcacggagcaaaaaagcggcttaccacgggcttggacctgccgccgaggcatggacgtgatccgctccaccgaccccatggccagcttcttctctgctcctctccgatctcccggctccgccctgccctgcccgctcgttccaaaaccaacagggcgcgcgcgcggcggcgcaggaaaagcaccacttgatccgccgcgctcgctcgattttgctccggagtcagcagcaacgcgcgacggcgcgagggcaggagaaggcgagcttgaggaggggaaccgagcggactccggagtccgtggaggtgccgaccaaccaaaaaatatggcggaaaattagggacaaaacagtcttgtccacgccgtgggccgagaatgaggcccatctgagaaggccttgtaggcttaataggtgtgcttaggctgtatgacccacaattgaaatgctactcttagggcggtttagattgatgccaaaatgaaccttaccaaaatttagcaatgttaaaattttggtaaaattagtaacattgctaaaattttggtaggattggtttaataatgttgccagaattctatacgcattgntaatatttggtaacaactaaaagtagccacatacgtgtcaattttaccaaatatggtatggttgaaaatgtcatcattttgaacaagcccttaattgtagattagtgatgaaggaatagtctaacatagaaggctgagtgctttccacgcacacttctttctttacttaaaatacatacaggaaaaactacaaaaagcaccccaaacatcacccggaatttgatattacccatataagacctttttttttcaattacatccctcctaatttattttgttttgatactttcccaactgccgttactcaatcattctcgtgaacgcaaaccccacaatatgacactactgcgaaaatatggtcgtcactcatatcggacaggcacgataaaaatgattatggaatcctcactcacagtatcatgttgttggactttggtagtcacgagtctcgttcttagatattggggtggctagaaaatgagttgttacgtttatcttacagagtttaattaacagtggctttattttggttgattcaagatgagaaaaataatatcggcatgacactatatagttgagaaaaaaatatgtatattcacgctaaatcttgtaacggaaagaaaaaatacataaaaataaacttattttgagatgaaggacataaggagcaagtaacatgcttatgactgagttcgggggtgagggttataaatcttcattcctagtacgaaaaacggaataatagttagttcatgattaattaagtaataattaaaataaaattttaaaatggattaatataattttttttaaagcaactttgttatagaaatttttgaaaaaaaaccacactatttagaagttagggaagcgtgtgcacgaaaaataagtggatagaagttagaaaaggagagtttaaggagtatttgagagaaggagaaataagaagattaagaagataggccgtgtttagttatttggctaatttttttttaagtatacggacacacatttgaagtattaaatgtagactaataataaaacaaactatatattccgcctgtaaactgcgaggtaaatttattaagcctaataaatccgtcgctagcaaatgtttacttagcatcacattgtcaaatcataacgcaattaggctcaaagaattcgtctcgcaatttacatgtaaactgtgtaaatagggttttcttatccatatttaatgctttatgcatgtgtccaaatatttgatacaacattttttatctaaacactatatataacgagagaaatcttcactcttttctctt

SEQ ID NO: 48731 - DNA, 5664 bp, Oryza sativa
tcccaacaccctctccaaaccctctccgaccgatcgatcccccaccacctcctccgcctcccatggcggccgccgcggcggcggtcggcgtcgtcgccttgctgttgttgctgccgctcgccgcgtcggcgtacggcgacgggctgggccgagcggccgtgggggtcaactggggcacgatgacgtcccaccccatactcccgtgcgaggtggtgcggatgctggcggccaacggcgtcgcccgggtgaagatgttcgacgccgacccctggacggccgcgccgctcgcccacaccggcatccaggtcatgctcgccgtccccaacgaccagctcgcgcgcctcgccggtgacccgcgccgcgcctaccgctgggccgagcagaacgtctccgcctacctcgaggccggcgtcgacgtcaggtacgtacgcgcccccactgctgctctcgctcgctctacgggtggtgtgctatggtttgcctcgcccgccggcgcggtgtcgcgtgtgcttctagtttgcggctgcatgccaagtgttcggtgttgcgtgcggcgaaacgacacggctcttactctgagcgcgggcgtgcgagctaggtgagggtatggaatgtctgttcgggcgcgtcgaaagtgttcgacggaatgccaccgttggacatgcagtttcgtgtaaccgtgatgtccgtgatcgattgatcgtgtagtgcctgtctgtctgatcgggtggtgctgtgagtgtgagatgcacatgcatgcttgcatttgtggttcatgcagaatggatagttttctgttgttgcagtgcttccttggtggctgggttaaggttcccctgtcgcctgaaagacatgagtgttaattagacatcacttacaatcgtgtcacttagataaatacagtaatgtatcctgcatcatgcaattagtttcatacttcatgcatatattgcatatgggtgtgtagcagtagccgtactgatcaggggatgtttggttgatgcctaaccttgccataactaagtttaggctagttgtggcatggtggcataaatgtggcttagaaatagttggccacaagtgtggcatgcttagctctaaatttgagagcatgacatgtgggtcccaaagttaagaaagtgtggcataacacaattgcggcagcgaaccaaacacatgcctaaaaaactgtggcatggctaaagtgtggcgtggcaaagtgtggcaaccaaccaaacagcccctcaaatctgttttgtgtatgatacctcagggtcgagagttaacgttgtaaatgttggagaaacatgctttgattggtttatggaatacagtgtgtttagatcatgttccctctgttgatggtgtttatatgcttccatggatgttgactgaactagttcattgaggaaacctattcaaaatgtggagcaagtaaacgcaggaatgagccgacaattggattaccatttctaggcttctaattgtagatgccaacggaagccagaatgaacttgtatttatgatatttagagcattttaatccttaattgtgctgaatttactgtggaaatttaggtgtgtttttattggtgaagaacagtaggaattcagtggatttcattgacttaattcctactggatttcagtgactccactttctagcaattccttttgtaattactgtgctacttaagtttatcatgcatgatgtgccaaactgagcatatctctatgaatccgatgggcgatggtgtgttgcatataaaatgtatgtacttgcctagttacttatttctgaatattcacattgtctttggtgatactctcctgttatattcactggttatgttaattgctcaggtatgtggctgttggcaatgagccttttctaaagagctacaatggcagcctaatcaatgtaacctttcctgcgctcaagaacatgcaaagagctctagacaaacttggtttaggtgatcatgtaaaggcagttgtcccactcaatgctgatgtctacaactcccctgagaataaaccagtgccatcagctgggagcttccgcaaggatatcaatgccctcatggttgacattgtcaatttcctcaatatgaataatgcaccctttgttgttaacatctacccatttctcagcctataccagaatccaaacttcccactcaatttttccttctttgatggtggtagcaagccagtttatgacaaaggtgtggtctacaccaatgtgtttgatgccaactttgacacccttgtttggtcactaaggaaggctggtgtgcctgacatgaaaatcattgttggtgaggttggttggccaactgatggtgataaacacgcaaatgtgagatatgcacagaagttctatgatggttttctgaagaagatggtcagaaacattgggacacctctcagacctggttggatggaagtttacctatttgcactgattgatgagaaccagaagagtgtactgcctgggcgctttgaacgtcactggggactactcacatatgatggaaaaccaaagttctctatggatctcagtggagatggcctagacaatctggttggagttgaagtggaatatttgccagcacagtggtgtgttttcaacaaggatgcaaaggataagttcaaagacttgccagccgctgtaaactacgcatgctcaaatgcagattgtacaccactgggctatggatcctcctgcaataatcttagccatgacggcaacatatcatatgcattcaacatctatttccaaacaatggaccaggatgttagggcatgctcttttgaaggcctcgcaaagatcacaacgataaacgcatcgcagggaggatgtttatttccagtgcagattctaagtgcttcagaaagggttgtgccactgagatttttgcctacatccttcttgattctcctaatggttgtgtccattcttacatagagtcagagacaatggaggaccggtaagtgctgataccttggggttgttggagcatgacacagtaaagaacataggaactgataccttgggttgttgaagagttgaagctgcagtaacataggtttgtaaagcatttttcccctcgtattttgataggcaaaacaaggtggaaacagagctgtatgccttcaccaccgtgccagcggtaatttgcatggatgagaaatatgagacaggatagactagcccttctttatacctctgttttcagcttgcgatcttgcagttcatttttttttattttctaaacgaccttgcagttcaattgtcaagctgaatgctggtattttacagcagcatgccttccaaatactgatgctacctacctgtaactgtaaggctgtaaaccaatgtattggcggtacagagtcatatgtgaatgaacgctctgcaattttagctgctcttgaattgcaaattttgtttcgtccctggatgttaatttttctttctctgttgaaagcaccatggataatggttgtctatttgagtttctctgcttaaaattagttggcagaaatttcctttcgatgcaaatcctaagctactggagaaccaaggtagagggctagaggccaccattggcaattcggcattgagaatcactggaagcagtatttagttactggaactgtcagatttacttcatgtatatggatcgcgctcctctgacgtaaagtcagagagacgtgggtcactgacgtgggggcccaacctttgtgggtcccacatgtcagtgacagggggactttacgtccgaggagactcatcccatgtatactatggtactgaacagcaaggaaaaattgacaaatgtgaggttcatgtatacacgcggataaacctgagcgacaaagaatcagcggcgattatttccgagtggacaaaccgttgaagtgttgacgtgctagaccaccggacggttgagctacagcttacacccaccgacccgaaaagatttaacttctagagagcccgatataacgtcaaactgtaaaaattacccgagatacagggctacaaatgtaaaattgatagcgatccgaagggttaaaagaatgaccgctacataggcgatagcgaatgaaatcgagcaaccgaacaatgttgggcctccatttagccaactagaaaggaaaaagtctactttgactgccttaaaactatgccaaatctaattcgtcccctcaaccagaaaaccaggtaaaacgactcccctaactattaaagttggtttaattgaactccctcagcagttttataagatggttttgctgatgtgacgttttgacgcggtttgaccagctgactcagcatgtgggacccacacgtcaatgtcacgttttcctcaaatctctttcatttctcttgcccccccccccccccctcccctttttttttcttcaggacggtaggagtgggcggtggctagccagcggacgtcttcggctttcacgtcttctatgcgcccgtgtcgcggccattggcgaagtacgccgggctccgccacacggaacggcgtgtccgtgaacatcgcaccgccaacgccgcttgcacgaccgttgataccagccacaacgcgtccacgccgaccagctgcgccacgctcgacgcctgcccgagcgcaccccacaggccgaaggccgctcctcgccgggaagcagcgcatccgctctccgccgccgatccggcccccgctccccgcgtacgggccggagctccagcccccactccactccgagaccacgccaccgtcccgtcgctccgcctcatggccaggtcgccgccgctccgctgtaggccggtccgccgccgcgcgtcgcggggtcgcccagccgcggctccgcctgggcagtccccgcggctgcgcagaaccccgtgactgcgacgcttgggtggagggcgcacaccagcacgaacaaggactcatcctccatcatccactccaatccaactaatgcctgcaactacatcacatcatcttctccaatttcttcttcttgttgtttgttgcaatttactgactgatgaagaccgaagatgcttgcttggatactgctagtctgcgttcgttgcagagaaagcaagcaagcaaaataacaagtgaggaaaggaggaaagcagagtagcagacaaaagaagcagatcgatcaatgcgatgctatctctctctatttgaatttgaatagtagcagcaaccagtttatatatccgattcatatcgcaatttgaattcaaatattttttatatatagtatttctacacatctaaagtttatacacctaaagtttatatatccgattcaaatttgaatttgaattcaaatatttttcatatataggatttctatacatttaaagtttatacacctaaagtttatagacctaaagtgtatatacccgatttaaatttgaattttaattatatccgattcaaatttgaattcaaataattcaaaaattttctatatatagtatttctatacatctaaagattatagatccaaagtttataagtcaaaagtttatatacccgattcaaatttgaatttgaattcaaattttttatacataaatttttctaactttttggttttttaaatttttttgtggtgtactggtatagggaaaga

SEQ ID NO: 48732 - DNA, 4886 bp, Oryza sativa
atatttatttattttggtcattggctatccatgttgaccccccgctttccagacatgattaccttgtcttttggcctataagtttaggtggtcagggcatcacaaatgcatctggtcggatcacgttctcttccaataaaactagtgccgggtattcaagaaatcatcaggcttattacgcaagagaataaaaggacccttttaacttgtatgctacagcaataaaaagaatttcacctctaacacataaaaatggtagctatgccgtttcaaaaaaaaaaaaaaggtagctatactaatagttttaattttggcctttgttgcgcgatgcgcatgcccccaaacaagcaaatgcaagcattacaaattcatcagacgtctgaggctgtgtttagttcgtgtgctaattttttttaaagtatacggacacatatttgaagcattaaacgtagactaataacaaaacaaattacagattccgcctataaactgtgcgacgaatatattaagcctaattaatccatcattagcaaatgtttactgtagcaccacattataaaatcatggcataattaggctcaaaagattcgtctcacgatttacatacaaactgtgcaattggtttttttcgtccacatttaatgctctatgcatgtgtcgaaacatttgatttgacggaaaagttagaattttgaagagaaaagtttaaatctaaacacgacctgatttcttgtccctgacatggctgtataatttcaactttttttttcaaactttcaacttttccgtcacattgaactttcataggtacataaatgaacaacttttccattacatcgttctaattttttcaaactttcaattttgacgtgtaactaaacacagccgtagttttactactactttatcttgtgcagttcaataatactaatacttcctcttccgaaaggaattacttctatcattatcttgcatttagtacgcaggagcagtaccatgccgtacgcacaatcccttattggtttgcgtgccgttatcaccttgcacagttgcactatcccaacgattcttctgcaattgcgctggtccattggtcacccatgcatatgcctgaagcttctcttttctgatctttctgatccacaaacgcatgggcatggcaagaaaatggcagaaccatacgcggcgatctgtcactcataatctgatgcctgcatatacgcctcttcttctctgcttcctgaatttttatgtccatgccatgccaaggtagaacaattgcaatatattaaaagaaatggccaatggtctattggcagcatgattggttactctttggcaattggcaccaatgattcgacctttctatttttttgcacaacatattgtcctccattgcatcttccagtttagcttctctcctatgatggaacaactacacgattccagtatcagtagcacatcactgatcagtggccactagtgcatgtttgccaaggttgcacattgtcacatggagagcccagctgcttgtctcctcccacctatcaagccaaaacttgtcagcatccagcacggcatgctatataggcctgtttagattccaactttttttcttcaaatttctaacttttctatcacattgaatttttctacacacacaaactttcaacttttccgtcacatccgtttaatttttccaaacttccaattttgacgtggaactaaatacaaccatagtgttgtttgcaacaactctttagggtgtgtttagttcacaccaaattgaagtttggttgtaattggaacgatgtgacggaaaagttggaagtttgtgtgtgtagaaaagttttgatgtgatggaaaagttggaagttcgaagaaaacgtttggaactcaactcgaccttagcaagaagaacatctactccatccataaaaaaatatcaccatttctgttatttgaaatatatccataaatataagcatttctacagtagtattactttcccaacccaaccgtttatggtttaggcccttattaattcccaaaataaaaacttttcacccatcacatcgcatatttggatacatgcatggagtattaaatgtgaaaaaaaaccaattacacagtttgcgtgtaaattacgagacgaatcttttaagcctaattgcgtaatgatttgacaatgtgatactacagtaaacatttgctaatgacggattaattaggcttaataaattcatctcgcagtttcctgacagaatctgtaatttattttattgttagacaatgtttaatacttcaaatgtatgtacgtatatacgatgtgacaccccaaaacaaacttttttgccatctaaaccgggccttaattttcacctcatcctacccccaacaacctcttatttaataagattcatcacagtctttttttttctcttcatccttaatccctcttaaaaaagctcagaattttacttacatttgtgtatggagggagtactatctcttatcattggacattggacaaaaatacctacctgtcctttggttgtaacttttcaaacgtatttgagcaagaggagcgcactgacgaacaaatttgcctctgtactctgtggccctcatcttgctcaccctagtactgatagtactaaccttaacctggtaagtctactactagtagtagtccagtactagctagctcttgtacaaactctcatggatattcccttgcaatagcacagccaaatagcaacggtaccatcaccatcatttatcatgggcacaacttgctagatctcatccaatcttggtgatagagaagaagggaatgtcagctgccattttaaacatccctgtgcttgttgttcatagcaacttcaattcgatcacagagataaggtcaggtcatagataaatagagagattgtctctgtcactggttgtgtgtgtgtgtgggagaggcagtgtatgacgaggccaatgaggaggaggaggctacgcattggcaaggtgctggactgcttctccttctccatgtgttgcgcgagaagcagcggctgcctctgcttgcgcgcgtcggaggaagacggcgacgaggagcgggccatggagagaaagtccctggtgagcagtagtagccaggtcgaccaggtgatcaggcttcgcgatcttgttgatggcacgaggacactcgggttccatctagaaccaaaggtatgcaaaatcttcttcgtcttcgtcttccatcagatatccaagtgcaattgatcaacgtgcttgtgtcattgtgtgcctgtgccattggttgatgtgcattctctgtctttttggttgtgttttgatgcagactgtggagctcaaggtgtccatgcactgcaatgggtgtgctaagaaagttcagaagcacatctcaaggatggaaggtaacaaaacatcatcatcttttagctttttctatgacgaacttctcagttcagaaaaacagtttatttcttccggacagttttcagactgtttgataggtagagaatgttaactcttctgctatcgtcttgagagtctgctctccctaccttcatcggttcatcgaacatatacgttaaccggttttatccaaatgctcgatcatttcaactaacgttagagaatccaaaacataaatcccctccaaaatggttcaggccaggtaatacctttattttccagaccaagctgaactccacatttgcactcacctcatgaactttcctaagatacactgtactttgctaccctttttcagtcacggacaaagtgcccttctttgttctttcttctttttttgcttttgcccctctccaacactctgcaaagatcagttcagttttcagagcttgccatgtaagggcctgtttgggaaacagggccttgttcacatcggatgtttggacactaatttagagtattaaacatacactaattacaaaacccattccataaccttggactaattcgtgagacgaatcttttgagtctaattacgccatgatttgacaatgtgatgctacagtaaactttttataattatggattaattaggcttaaaaaattcgtctcgcagattagctctcatttataaaattagtttttttattagtctatgtttaatattccaaattagtgtccaaacatttgatgtgatatggactataaagttttagccccatctaaccaccccctaagagtagtttagactgtaattcatcttctccagtcgcttgctaggtaaatggcctgggcattttcttggctgtactgtagtctgtagtacaaccgatgaaccgaaaaacaccgtacagaccaaggccacagacgcatggtacggtgaacattaactcggctgcttttatgcatctgtgcttcactgtccttgtactactccagatcttgatactctctaccagcaaaatactccctctgtactaaaaaaaagacaaaccttggttaccgtgttcaacgtttgaccgtccgtcttatttaaaaaaattatgaaaaaaattaaaaagataaatcacgcataaagtattaatcatgttttattatctaacaacaataaaaatactaattataaaaaattttatataagacggacagtcaaacgttggcatgagaactcacagtttgtctttttttagacggagggagtagtcaggatggatcatggaacatggatggcagcataaaatgcgaacacaatcctttcacctttcctctgttccccaatctggatggatctactcgcaactgtcatttggatcttcctgtcatcaacccatgatcctgtgatcatggccacagcagtagtaacagttcacagtgatcctcaatcttggcaattc

SEQ ID NO: 48733 - DNA, 3900 bp, Oryza sativa
ggcggatgcaggcaatgagcgtggaggataaggccagcagtccgacgaccgcaacggactaggcggcgccggacacggttgatggcgacagcgatggtgacgatggtggacacgtatgagggtagcggcgacggacgcagtcgatggcgattgtagccatgatggacgagggcagcggcgacggtcacgataaacgtagtcgatggcaagggcagccatggcggacgaggactgcaacagcggcaatctggtggagcgcgacgcccgcggacgtggcaacgccggcttgcgcgggtgcacccatcgttcttggtgggccgacgtctcagacagagagtacacctggtgggccgacgtctcggacagagagtacagttgggtgactaattagtcgctcgctccttctctctcttcccctctctactttagctcataaaaaatcctatatggattatctaccatctattattgtatccagtctaaaacgtccattatttttttccaatcacagcgtactttcaccacgacaccacgtgcgcacaggattttgagttattatgtatttgaaagatgcatgactttcccaccgtatgttaaccaaagccaaatattttttttttgaaaaaaaccaaagccaaatattattaactgtagcctttgaattttggaactcaagtcacgctttagagtttattttggttctcttttttaagaaaacatagcaatagattaacgtgacatgttttacgagcttctaaactatgatttttgcgaaaattgtatatatgtaaacttctaatacagatataaagatttactctctccgtccagattcgtagtcctagggtgggttatggatctaatcccattctagattgctacatattaggacggagggagtaacttataaattaatttttgcttgtttctctctccttttaagacgcagctcaactgatcaaagcacggtgatagcaatggcccgtgcatgatatggctaacatttaattccattcactgcatcatggtatgctctgattgaatatgcgtgtgaaattgcgaatgtccatgcacgtgaatgtacctaacagaaacacccctgaaagcatgtcattttatattcttttcatcacaattatggtgtgcggtttgctatcaccaggtacatttgcgtaacaaaaacaacttaacattgatatcttttttttccaaaaagacgaaagggcaggagccatgactattacatgcatttatacttgctggaaacaagacatgcggccttgtttgccgctactaaagtgtgttactgatgacactattatcttagatactctaatgagtggcagacaccttcaagcatgacatgagcattccaaggagctgctttatctcactttctttgaatctagagaatttccatctttccgtttctttccatgttgacctctattttcttaaagcaccaaggtggaatcagcgtcatactttgcctgattaagagttgtgtttgaaaaatctgttattttgtacagaattattacacgcagtcacgcccccagtcattcgtccaaagatggtgaacaagcagggagcaacacgtcttgtctattatgttgactaggattaatggtcagttgggctgaatgtactatcaccactactggctactccctccgtctgaaaacataacctattattataacgtgacatatcttaatataataaatttagacatacagtatgtttttactttttggttttttttaacggagggagtatgctcttatctatgttcctaactttacctttctcctttttaacatgtacactttctaaaccgttaaacaatacatttttttaacttgtatatatagttgttttgaaaatcatattaatctattttttaaaagataccccatccgtcctaaaaaaacctaatcctagctacgaatttgaacacatggtttatcttttttcgagactaagtagtagctaatacttagttaatcatgcgctaatgtgtgtttccttttacgtgttaaaaagaaggggttcctaacctctcctcccgaacacacctttataaggtcccaatatcgttttcgtttttaactttatcattttcagttttttatcaaccaagataaacatatatggcaaaacatggtttttcactcgtttccactttccagccgttttcaggttttcgcccttacctaaagcaccaaagtgaaaaatgtgtcatgctttgcctgattaagcaacgtgtctggttaaaatcagtgttttttttttccaaaacacggtatggacgcaatcgctcatatagatgtgtgcaaactcacctatataaacgcacacatacataccctactcctaggactctataaacacctcttaaaaattaggtcattatatcttgaagttcataaattaactatagacgtcttattaagttattattggcatgaatgttgtctacccctaaaaaaaaataaataatcgtaaatatgagcacatgtgctaaggccctgtttggttcgtgggactaatccactagtcactctattttaatccttaagaatccaaacaggggtgagtaaaaagcactaaaagtgcatattgagacttataggactatagtggcaacccctctcttcttcggtacacatgactttagtcccttttagtccctggatccaaatagtaggggattaaaattttaatccagggactaaatgattcaaacgggatctaaatctagaacttaaatctggatgaacatattccacaaaaaaacacctaatcagttcagttacactcgctttacatgtcagtgcttcacaaaagcgcacctcatccgctaagttagtctaacgttttgatgttagatgagcaaattatacagtagttgcattacagtagttacaatgtaattatcctacaatttaaaagtattttaataaaaaaattgtagaatgttatatacctccaccttgtcacgaatagggcaatatggcctcgtgaaccagcacgccctgaggcatcgtcaggattcgtggcgcaccactgggctcttgtcaatgttgagtttcacggaaatctcgtcgttgacaaccgacaatgccatgcttcatgtgataaaaaatcgataccatcgtcgactttggagcgagatccctcaattgaaaaggtgcgaactgccaaagtgccaagtaaagtagtaccaaaaacaaaagcattgagcagcacgtgtgccctagcaaagcagcaacttagcatgacccaatttgccaaacatagctagaccaatttgtacttgctggtaatacaccaatactagttgttagtaacagttaattgtccagacagaatttgtttgactgaagccagtaacaatcagcattggtttcactatatgatacagagataatatgcccaatatatggcttcttgatcacagtggttgtacagggtaactccagaattttcagatctaaaacaaaacactcctacattcaatgatgtcaatcagatcagaaaaggacttaaatctcacctatgaattgagaatatcaaatgcgtgcttatccctgctattgagttacatatatgtacagccaaacaggccaggaaataaaattagctatctcctggaacaatggttacaccagatgcaccaaaaatcttcgtgtcaaaacgatttttccatttctgaagtacaacagcagtcaaatgggaacaatacagccctgacaacagaaccaggccaccatgatgcctagcaaagcgccggcaaaaacctgtgatggagtatgccctaacaactctttcagttttctttcactaattggatggccttgaaacaggtcctcagcgatcttattgagtacctgtgtc

SEQ ID NO: 48734 - DNA, 794 bp, Oryza sativa
acgacagatttacaactagttttttttatactagatttaaaactagttaagatgtcgagacccaaaactaacaacttggatccgactgagattaatgtatcaatccctggatcagtaaaaattgatacatacaatataactggttcttcattgcatacgttaaagtcttacaatatcaagggttttacaataataggtactcttctaactgattaatacacagcggaagtttctatacattctgactagtgaggtataacctttagggattttctaaattatcgaggtcttcgtagtaatagtcataagggtcctcttgacccaaatctgaaaaagggggttataagagcaaggatgagtattcacaatactcagcaagttatctcggaaatataatatgcattgacatataatggggttctttgcaaaaaaaaaagcaatattggacaatctggaagaattatagcaagatttataaacatataaactttaagtttctaaccagggtaccatatgagtcccggtactcaattcgaatagtttcaaagatattctactgcagtagatgtacgctttacccgcagtccacgacttgctgataattatcggctttagtcatggcccagtattaagtcattaacaattgtggcacctgttccatgaacttgtatcctcatatgctctgaacgtaatattaacagcagcaagaggagttctggggttcccgaggtatttaaggggaactgatcgtatgacaccacgtcatctcgatcagggtttagaaatataaccat

SEQ ID NO: 48735 - DNA, 2767 bp, Oryza sativa
tttaaataaaatttaaaaataagaaaatagggaaaataagataaaatgcaaaaaaaataacaaaaaggggtccaaaagatagagaatgattttagaagaatattggtccaagtttcactggaattggatctatattttaaaagatatgggcttctaaagtttgaaaattgaataaaagagaaatggcactgtgagcgggtcccacctgtcagtctctctctctcttctcttcttcaacctccggccgttccccaaatcgggccagcggcgctagggtttaggattgcggcggcgctagaggataaaagtagttgcggccgaggaggggagggagctagggatctccggcgacggcgagcggcggcggaggagttaatttggtgcgtggacggcttagcggctagggcggcggtggcacggttaggccgagatagcgatcaaaatgataagggttagacatggctaggggaggggttctagagcatctacgaggtatttagagggattccgacagcttgccgacctttggcaaggtgcggagaatagttgccgacgagcacctccataggcgacggtcgtgctcacgtcggcagctcagagggtggtgtgttagtgcaaagggattgctaaaatagaatctaggtagtatgtagatggttgaaacggaagaactcaccgagatcggttgaaacgacggattgcggccggaaaaacttcgcggcggtgaagaacagagcagcgcgggggcggcgatgctcggcttgatgcggtgaggtaaaactcgacgcagagctttggttagggcttagtatgctagaacatggctgatataaggtgttctatgaggtatttagggcggaggatggatggagaagggtgaagtcgatcgcgcacaaggtgttcgaccgacgggcgagggtggttggtgagacggattgatgaagcagagcttcggggttgaggggctatggtcatggatgatcgatgatggacagggaagggattggggtcctatttatagggctaggaggagcggatgagctcgggcaccgtcatcgccatggatgagctcgagctttggatatggttagggcggcagaggctgagagagggcgggcaagatcaatttgagtggcgggaggccacgttcgaatacttaccggcgaaggattgacttgaccgcggttggaatcggctggcgacgtgttggcgccaatccgagcacgacgcgcggcagcggcgagggtgaaaacagccggcatgggggtgaatggtttgaattgagggaggggataccaccgtctatcttcaatctaaccgtgcggcaagaattggcgcgattcatcccgggtagaaacgaaatcgcactcggcggcggcttggacgggagcgcacggcgtcgagcagtgatttcgtgcggcggtcgtcgtcccggctttgtcgtcgtcgagattggtgcggcaacggtgggttgaaggcgttggacgggcggcagcgcgccaaggcggttgggcacgcgcgatcgatcccgagaccgacgcgcggcggctcggcgcgcggcaaagtcggctgctggtcggcgcgcgtgaaagggaggaagaggtaaagagaaccacggttttgagtgggatgtggtcccctaggaccaattctaaactttgcataagattgggttggagttgggctgctctagctgggctgggcattctgtcgagcaccttgagtgcaatgaacagtagatttcaggaattttgaatatttccctagaaaagatttgaattcaaactaggagtttggaagggtttcactagggtttaaagtatggcaaatccttactaacattagggtgaactaagaaaataatctatggtttgaatttgagagaatttgctcaaattcactagggtttagaataaagggaataaattggaagggttctaataatacttgaaccaattttgttaaataaacaagaaatagatttttgaaccaaacaaatttaattaaaagccagcatgatgcagtcaaattttagtttaaaatttgaggatgttacataagattataccatgtaatttctcaaaaaaaagattataccatgtaatcaaattatatatgtcacatgtaaattttactcatcaaaatattatactttaaaagtgatttatgatcaaaattaaaatagcactaacactcacaagtcacaactattcaaaatgaagggagtatatgcatttcggtatgtagcaccagcctaaaggagtatatacaggctggctaaagtcgaatccaatcgatgatagatgtagcgctgcatgctatagcctaaatatagcattgcatcggaggaacagataagcatccaagattgctagcaatatactctctggtatgtatgcaagaaaacaaaaataaagaggaaacatcaaaatattaacagtaactacaaaataaaattgatttttttaatttatttatttttaatgataagggggcggggaggctcctcacctcaaggatggtaaaatacctctagagaaaaaggactccccactataaaaacaacaaagctagcagtcaaacgactatggaatagagttggcatctgtaagtggctagtaatgtgctgcagtgtcctggttgggttggcatcttctgatatcaaaagaaataaatcaaaaataagccagagtaaaacttaattagttatctgatagaaagtcatatagttttcctaacagtatgatttaaaactctgtataatgat

SEQ ID NO: 48736 - DNA, 2468 bp, Oryza sativa
acattccaaaatgcatataatcctttcattttaaatagttgtgacttgagtgttagtgctattttaattttgatccttaatcactttcaaagtataatattttgatgaatgaaatttatacgcggcatatataatttgattacatggtacaatttttttttataaattacatggtataatcttaactagatgtagttaaatctagtataaaaaactagttgcaaatctgtcgttaaaatagtagtcaaattaagtgtggatatgaataacatgtagtgacaattattttatactaatgtagtgactataagttatattttggactgggaatgaattgttaccaaaaaaattatgctactgaatatatcatgataattaattaagccctcttattgcaatagcataattaatgttttagacaaattatatggttttagagatgctgaacatttttatcataaaatttgatacctcactagcgagtaccacaaaaccgctctttaaaatactacatctgttccaaaatataataaattttaacaataaaactgcaaagttctttgtacctcaaacttatagccaaatgatatatttttgaatggaggtagtatgtattttctctgtacaatcatagatgcgtgcatacatatactacttatgtacatgacatgcctgaatttcttgctgctggtgccgtaggaattccgcacgaagcaccagaagaaggacatggccatcgagcgtcccctcatctcgtcggactccatgttcctcaaagccatccttccgacgctcaaaattttaccatgcaaccccctgaccctccatggcgggattggttcaagcagggttcccgcggaggcctttggtggcggccagcttttcagctgcccacttcaaattccagttttccagcagcaatcccccggcaatggcaacacggtgattagcttcagcaacaatgcttcaccgatggccatgcgtgcgccaaccgacaatactatgatatcgttcaacaatgtctctgctgcgccggtcgccaatgcggtgatctccttcagcaacatttctaggtctgctgccatgcaggcaccaagcggcaaggggggccaacatctgtccggtgatgtccagcagctggattttccccagcagaagctgtactttgggcccttctcctaccaagggcctccgccaccttccatgcacaaccacatcaacctactcccgccgacgtcctcccctgtgacctgctccatggacaaaggcaaggttcctattatcgagctcccatatgggatgcctgtggatgacttcctcgtcagtcaaaccacatatggcggtgccggaccatccatcggagccactgacgctgctgccgctgcgtacccttacacagatgcaccgagcaataacgttgcaactggctgtctcatggtgccaccaatggggccagcattcagtatcactgagccaactgtggtggcccaaggtgagggcaccggcaccggtgtcgacgccggcacatcagagaagaacgcgatagtagaagcaccaaacaaccccgcgccattaatggtactggatcaggttgctgctgatgctgcaatggatgttcaagaagacatcatgttctctttggaatctcttctggggccggactatgacctgctacctatggaagacgttagtgctccggacaccgctgcagccggtgatgcagctggtggctcactggacggagaggaaggcggcatggacattggttgggatctcgacctggatgacatcctggtggagaacgttaatgacttcgcgttcctggacaaccttgccgggagcgagtagtcagtagtcatctcatcgcaaatatattatctcaagttaattaagctagagattagagagaggggatgtgtgctcagtatgataaaacaacttttagtctttgttgcaagtactctaaacattgatgatttttcctccgttatcatgccaggaatgtgaacttttaaaactccaaattcctatattgcagatatgatattatgatgcaagatactggagtattattttgagacatagtaagtattttgttgcattcctgcgctccggcgtcgtcgcggactaggtgcctcgcgtggctgcatgccatgcacgccgctggccgatcgaagtggttgtttcggtcgcatcttcctctcgtaccccgcgcctcctcacctcacactctgcctattttccaacaaatgaaggctcacactagtgctctgagtgcaaggatttctggtcacaaataagtattttgcgatcttgaataagttcacaggggtaacagagtgagaaataagatatactcttcatctatgaatacaagggttcctagtcttttctattcatccacaaataaaatggattttagagtacttttccgctccaactaactactttattatttattgctcact

SEQ ID NO: 48737 - DNA, 9629 bp, Oryza sativa
tttcctttcttctactcgggaaaaggaaaaaaaaggagaagaaagaaaaaaaagaggaggagggaaagataagaaaagaagaaaaagataaatgggtttcatttgttagtcaaaatgatgccacgtcttgtccgtgtggcatgccacatcagtgccacgtaggatcctataggggctggggcgatttgggacctaaatgacacactatgacaagttcttggacttggatatgtattttgagagtttagagacctagatgacatacccctgcaagtttaaggaccgcccgtgcactttactcttaaattaactagagaatgacaacaggatgcagaaaagctaaagaaaacaaactagattacaaaaaatcaagaggcatagacaaactagattacaaaaaatcaagaggcatattaaatttctgctaagttttcaacacatgaagaaacacaaactgatcgaaatggtataaatcaacaaaaaattacatcgtctagatataataaacatgtcatttcacttgccctcttttagagctattaagccacatgacctctatcaagcatgagctgctataatccacatttagacccatggtaatagtaaacgatattaaaatggaaggctacagcatccattcataactcagaaaaactgattgaagcatcaactgtaaaatgtgcagatagcaagggactccttacaggattggaaggaggaaggtacttactctgttcaccatttctatgaacacctccaatccctccagttacgaaaattggtatgccaacctgaatttgagagcaactttagtttgatatagagatgaatgattggcaccaactacatgtaacaaagatgaacaagaaaaaggctatcaaatcaaggaaagataaattaacagtaacaagagcagtaagatgtttttggctctgaccttatgagcgaaaaacatagtggcagaaactgttgttgcaccattaccaccagaggccacctttcaatcagtaaaactcgttacaggaagcaataagacgagaaacatatatcaactgtaaagttttagtgcagatataactgaacacattggaaaacattctgaacgaccaatttctagtgtgcaaggtactcacaacatgtgcaatatcccttctagccgtcttctgaaactgtcttccacttacagccaagctcttcaattgctcgccgctaaggcctatcacattacgaaaattatccggtgttaattggagaataattcatagtagctagcaactacggatcacgcctccagcacttgaacagttgaacatgtatctgatctccgagtcacaggaaaaatcacaggactcaccaacatgtggcacgccgttcagaatggctatggtggcaggaaccgccccgttctccctcacgacggcctccacctccatggcggtctggagattcttcgggtagggcatacctgggatgggaagaaagccaaacgcgtcccccagccgcgggcgcacatcgccggagtgagccatgtaatccgggagggagacggggtggggaggaggcggcgaggcgcgagcttaccgtggcagatgatggtggactcgagggcgacgaccgcgccgccgcgcgccagcgccgcttccacctccggcgacaccgccacccccatcggccccgtgctcgacgacgacgacgacggcgacatcccacggcggcgacggctctcctccctttctgacttctctgatgagtacgcttccacttccagtctctttttgggctatactaggctgcggccgacaaggagtattcggcccatgaatagtggtcgcaaagcgctcggcccacccgagatgagggcccatgggcttggttggccccgcacgtcagtgacacgttctggggttctaacttctcgtgcaatcctgcccttttcagggtcaaaacagcggcgaaaaatgttcgagaaaaaaaaaacatgtttgtacggggacggagttttttggataatggatatgaaacccggtgtttgcttcaagtgaagctacaaatttttaactcagaacctaaccataacagaaataaacaatggcacaactttaagtttatcaattttgctatatatttatcgacaaattttcttctaaaaatttaacaaatataactacagtataatcgtagtgtaattatactgtaacttgtatgtaattacattataacttgtatgtaacttgcatataactttcacataattttgaaccgttatatttgtttcaacattcgtacaagtgaagaaggaaaaaaagtcgctgcatgcatatatatgagaggattcgttcccagacctccatttcaccgaaatagtatgttatggagagatttttaaaagttacatgtaagttatagtataattacatcatgattatactataattatatttgttaaatttttaaaaaaaaatttgtgaagaaatgtacaggtgatcccaacaaaatacagcgaaaggcagtggcggcaagtgccatactgccatgtcgtctcatcaccggataagccacgccgatctctcctatcctctcgccgacacaaaaaaccacacaagaaaacgcgcgccaaccaccgcatcttcccctccccccggcctctccgacgtcgaccatggccatgctcctcgcctccctcctctccccttcccctcttcccaccaccaccacctcttccacgtcgccgagggctgtcaggctcgcgccggcgaagccgctcgccgccactctcgcagcggtggccgcggcggggctcctggcgctgtccccggccacggcggcggcggcggcggccggggaggcggagttcaaggtgtactacggcacggcggcgagcgcggcgaactacggcgggtacggcgggaacgcgagcaagaaggacgcggcggagtacgtgtacgaggtgccggaggggtggaaggagaggctggtgtccaaggtggagaagggcaccaacggcacggacagcgagttcttcaacccgcggaagcggtcggagcgggagtacctcacgttcctcgccgggttccgggcgctggcgccggtgggcgccgtgctcgacaacctcgcgctctccgacgtcgggctccaggaccagatcgcgtcggcggacggcgtgctgtcgacggagcggagggacggcggcgggcagctctactacgagtacgagatcgccggcgccggcgcgcacagcctcatctccgtgacgtgcgcgcggaacaagctgtacgcgcacttcgtgacggcgcccaacccggagtggagccgcgacgaggccgtcctccgccggctgcaccagtcgttcaagaccgtcgaccccgccagaccgccgccggctagctcctagtcctagctagccattgttcgccgccgccggccggccggagtccacgacttgtctcgatcgagtggagagctagcagctgggcgaaacaatttctagtagctttgctgcccgagatgtaattaaagcagttttgtataaattatggatctactatacgcgtaatcaaacattgtcctgtaaattattttcatccatatagtatatactccctctattttcagtttataagatattttgacttttgttaaagtcaaactgttttaattttaataagtgatcaagtcaaactccctcactcctagagagtgtggtgcgtggaggggagggagaccggagccctggccgcggctagctccttcctcaccgccaccctagaggaaggcaccgtattcgtagaggtgagggaactcctggcccaacgccgcctaggcgttgaggtccagcgtgtcaacactggcgcggggaacggattcgtgggaagggctagacgccgacagccgcgagggccaaatgttgccggctacggactaaataggatcttgagagaagaaatcgaagccgttggggtccatcttccggcagatccggtgcgcggtgatgtgtggacggcggatccggtggctggcaatgcgggtggggtgaggcgccggcatggatggccagcggcggatttaaaggaaggaacggtgcgggttaaagggagggggcagcgttggttgggcccggcggccgccccagccaaggtcggcgacgatagatcgaggtggctttagggtttttgaaaaccaaccgagggcaaaagcaagggaccaccagtgtgggtggctgcaatgggatccagagcaagtgagagataatgggaatcggtaggccccataccaaatagccccaattagcaccccttgagggtgataatttttggggtgagctatttacaaatagccctcctgtttgactccccttgagctattttgtggctaaaaggggttaggggtgggctaaaaaatttcccatggatccaaacatagcctagatgtctttgtttttgccgcgagaaatcaacatgtcagttgacgcgtgtattatgttattaatatttactaatattgttatgttacttccctcccaagaaaatattttagggtttcttaacggtctgtgtagccaatatattgtatagtattattagccttttagcatgaaaatattttagatgaatgaatttgaataaaggttcctatcaacataatcaaataaaaatgtattactactactaaattacgtgtttcaaggaagactatgcgcagttgctcgattttgtgtcattttcgtttcttgccaactactccctccgttacctcgggacggttttcgagaactactttgaccaacaatatctataagactaatatattttaaataaagatagtttgcatattataatagttcatttttacatgattaatcttttaaattttttttgctattaatagtcaaaatttaaaagtttgacttcgcactattctaaaaatgcttatattttcgaacgaagggagtattattctacgttgctatatttgttttctttgattattcattgcattggttataagtctcaacggaattagcgtaccatttataggtgtcacctcaattagcacagtggtttcaaccttccaagtgccacctagaattaacatagattccaggtgttatctgaataagcagacaagttctaaccttttagatatcacccaaaataagcgtaccaatacaggtgtcattcgaacaagcgcatcagttcaggtgtcactcgaactagcgtacgaggctaggtgtcacccgaactagcatacaaattctagacttccagtctttacaggtgtcacattaatcagcgcatcagttccagtcgtcgcctaaattagcgtatcagttccagttgtcacctcgaatcaccgcatcggttacaagtgtggttcccaattccggatcaaaaaccgggggtaacggaagttgttgtttcctttttaggggtatccccggggtaaaataggggtccaataactcggctctaatcttaaaaatttctttaattaattaattaattaacatatatatccctttttactgggcttttgcagccaacccggctctcccaaatcacggtaaaaaggtcgtttagaattccaaacacggtgtaaaaaagcgcagttgaatcatcaattctgtgatggcaaaaccacctacctggcgcctataaacgcaaaaaacccaataaatctcgccctcgttgcctcccctccctgcctacccccatctccacctccgcctccacgcgtcgccgccgccgccgccgccgccgccgccgccgtccgggcagtcgaccgctgcggcgccgtcggagctccccgggccccgtggatgagagcggcgcggataaggtcgccgcgggcccgcttcgtctgcacccgtctcggccccgggaccccactgggctggatctaggtttggcgaggggggttctggaagcctccgccgcgatggaggcggaggatgccgccggcggcggcggcgacggaggccggtacttcaaggccgacctcaccggcgccggcgtcgtccagctcagcgagcgcgtgcgggagaagctgcgggagttcgtggacgactacaccaacaacaccctcgtggtacgacgccgccgccaccgttctcttcccttcccttcccttccctcctctcgcgcatcgttggcgctccgctcggtgtgcgggcagtgtagtgacgccgttcgtttgtggtttggattatatgcttgcaacttcgggattttagtctagttttgagcgccttttgtagtggtatgccgcggtttgtgtgagatatatgcctgtgcggaggagctaaaattttgctaaactttcatgtaacctagcccgaattatgccgctgcgcgctgtgtttaatgtttggtcctctgctgttagtgtaatcactcataattgccgtaagatcccgtcttctttaaatatgttgggtgtgttcgcttcctggaggtttggttgggttggaacgaaatgttgtttatttgctctaatgtagttgggttggaacggaatgttttttatttgctctaatgtagtgcccctgtatactgctgtgctttgtttaattgaatccagtcggtctaatggtgccagaagcactagaatattgtgtagttacctgaaacatgtcccaaaaaaaaaattctaaaatgggagcataatgtactgccgctccattgcttttcttaggagattcttttcgcgaggtgatcactgattagatgctaggagcctagaaattcttaaagttccttttttatttttgccatgtatggatggatattttggtctaatctagttaagtttatttatttaatactaggttaggagatcgatatctcctttcaagaacatgatcatgcagtgtagcaacaaagattacattatctcatacttgacttgtgattagtcaagttcccatgggtgctttccattttagttcttattaacacgccatttattttctatttccctttccccatccatcaccaaattttcttaaccagatttgctattttgacctcatcttcttgggcacaacactttactatccaaaggtgaccaaactgtgataagattgctgcatctcctcattgtggttatagcatttatgcaggaatctgctgctaggttttcctctacctttaattaatgacaccatttttaatcatcgtgggtagaattgacatattctgtctgaggaagcatcctgcaatggcatggaatacattgctttcagcacattgtattgccttgaattcattttattcattttcttacacactagaatgctaaataccatcctttaccttttctatgttacactgaaatgctcctagagaaagcaataagtgtacctctgttgttgttttaagtgcaggagtacgtcattttgttgctcgaaggtggaaagcgcaaagatgaggccatcaaggagcttgatgtatttctgggaaaggatagtcgcgcctttatttcctgggttagttcacatgtcatatagattgaatttttaattttttggcatcaactatgttgttaaaccaacctttaatatatttttgcatttgtgcacagcgttctctatatttttgaactaatgcattggggggcccccccttaaaggggccccccaaaaaaattttttaacctttcccccccctttttaaaagggggaaccttttaaaattgggggcccccaaaaatttttacctccctttgggtacttaaggtcaaattgatgttttgcatacatttaaccatcaaaagcatttataacatctggttagaggggcgtatgaaaatatgccacatcccatggagtataattttcctgctaaaagtaaccctgcagcatggctaggcgcatccatccacataagcaaagacatccatgccgatatggttgggctgctgcatgacccaactaaatcacattatgggtttaggccacgctcttttttagaggatgaatttagctgagtagctgcacgcaaaatgagaaatgtgattagtatatgattaattgtgtattgattataaaaaaattgaaaaataaatttatttcatttttgaaagcacgttctatatagaatttttgaaagcacactatttagcagtttgaaaagcgtgctaatgggaacgaggcgtagataagctcaaatagcactttagaaaaggcccttagataaacttgtttggaagtacatggatcaagatcaaccatctgcaagttcaagaacttgccatgtaactctttaatcaaatcgcaaatcatttgtgactgagcattggaaaagaattaaaaaaaatgtttttgatctttgcattggttttttaaataaattttgctactttaccattcgtgtgaagtggagaggttgactgtagtaaaaacgaaaaacactttttacctggattatttctgtatataatttgcaaggactacaatatattataattacttgttaaacctgaaactggtttgtatctactgattaatttagcctttgtcatttgcccatacaagcagttcaggttacagagactgtttcttgcctgaatccatcatttcttgtgcatacttctcataccacttcaacaaaatatccagtccagaacaataaacaatccttgcttatttacatgcatattactttatcaagtgtaactgaataccatgtctttcatgtaggttgtgggatcatttatctgtaaatttgcacctttatgtgcaaacacaagaacaactgcaggtggataataaggatgacgaagccccaaatgaactacctggagaacagaaatcgtcagagttgcagttgagaagcaaagatcaaactcatcctgagtgtgtaagtgaacccagtacaaccagaagtcggactaaaagggattggaaaggaattggtcgggagggtaatgaaaactttccacttagaagtgtactgaaggatattttgcatggtgaggagaaaaggtcgcaaaaggttaatgaaatacgacatcccccatcgtctaatcaacggaatggcagaaagcgtgacagggatgacgaaccgcaacaaataaaggtgtgtgatgtgataataggagatgcataatgcttgtgttaaccaaatggattgactgaaacactctgctgtcttgcatacttttttaatgattcactttttcattaacttgctttgtgttgcagctaaacatttaattgtttatacttctctaaattgtgcaatggaagattccttttaacacactaaatatgaacttttatagcatcagcacaggattataagaggatagtatcatgttagttgttaaaatgaaggtgcactgcgattttccacattccctatttgaactatacactacattgcaacaaacgttctttgcaactgatgaattaacaatttttcatctcatgaatatgcatatgtgggctctagctgtttgtgttttctgcaatacttcgcaattagaatgaacaactagctgatctagttattttttcatgtttctaagtgttggggaaatcaccaaatagccaatacagtctatgtatgtactatctacctgaaatattgttggttttctgctctaaaattttcataagggaatgttagact

SEQ ID NO: 48738 - DNA, 825 bp, Oryza sativa
agcaaaactgtggttgtcccagttaatgccaacaatctggaaccttccaattatgagacaccaaaagatgttcatgttgtagagaaaacggacattacacccatgaatgctactgttacctctctgactagtaatatcaaagtaagtagcttcatattttaaaccaatcaaattttattagtaactgcttagtaactgcactatgtttaccatttctgcatacccactctgattattttgcttaaagttttacttctatttttaaaaaagtatcatctaagtaagtatattggatatttgcatgtgataactatcgctgatttcccatttgactggaatagatgagaagcaaggctgacagatcgtcgagtgaaaacacattattaaatgatttgtcactactttcctctattggattgaactgggttggttagtggtttgcaggattagtttattgtgcttttatctcttcatggccagctgaaaaggccgatgcagattggttcacatcaataatgcttggaatgagaaacctatagctacttcacttgcatgttccattgattcagactacttactgtattagcttgcttctatattttgttaatacacaggaaatattttacattctttagctgttacttatgcctaattactgagtaattgtttgttccatttggtcacattccttgtatttagctccaatgctttaaaattatttaggaatcttcaggtagattttatctgactgttgagaaaaccactcaggaactagctcatggagaagtccaaaaggattcacagcgatctgcaattgcatcatct

SEQ ID NO: 48739 - DNA, 2099 bp, Oryza sativa
cacgggacctcaccaccttgaagtgcacttgcggctcctcaatgatgatgacatcgttgtcattgccgtctttgccaacaacaccggcatgggcagctatgtcgtccatggagtcacgaggaatcctttcttctaggcagcacctacgccatgcaaccactctccacaattgggccattgtggcctggtcgagtggcttcctgacgatataggtcgccttcagcaagaggtggttcaggaactccgtgtcctcaccggcaaccatctgctctggttccgtcgtcgacaatactgtatgacacgtatatgtggatgatgtggattgattgatagacgcgacgacgacgaggagtaacatctgagcacaagcttagctagctagcttacggtagatgacggggatgtggtgttcggtctcgacgacacggcgaaagtcgaagccggaggagaccacctttttgacatcgcagaggacagtttggacgtctgtcatgttgtcgctggagagggtgcacaggccagcgcttgcggtggtgtgcgttgccaccactagaaaagacaaggagtaaatgcagttaagagttttgttttgttttgtcttatgtgggagaagtcagttttacagttttaaattactatgttactacttattatatatgatataaatgactttaagtaaaatcatatattattatatataaccatatattatacacactgttaaatatttttagaaaattttatgactataagtttgtaacacaaaagttagggagacatgcatcccaaaagaggaattttttttaagaaggggagagggagagatctcaatagacaataggagtgtctatatataactgagtaaaatgagaaatgagtgaagtataagtgcaattgcactacagtataaaaaatccttcatagaaataacatgttttcttaaaagaatatttaatttggcacaaagcaagagcgcgcaaccgactaatttgaatttcagttgaaacaaggaagaacatgcatccatggagaaaggctataagatcagtgtttcaagtagttattttgaacaaaaccatatgcagaatcaacacagcaagaacatcaaacaggttggtcaattttatggaagtgaccaatgatgagtttactcactgcctttttaaacccacccaggatcaaaacatttgctagaagcaagatatatcaaagagatgccgagtgaacaaaaaagttcattttgtaaacaaatcctatagaaaacacatataacaaacaccaatattttctcaagaatccccacaagaatccacggattacacaacacaagaatccgataagaaaaaagaatcacacaagcgaaatatcggatctgtagtgcacagagaccaacagaaatcatccaaacaagctagaaaatcaaatgtacatgagtagtgcaaggtagaaagcgttttggttgcagttctcgtgttcttcgtgtcaccatccacgggcatgacacggaggccaccagggaagaaggagagctgatcctccatggacaaagagatcgatgtacaacaactacgtgcactcacttagcttgttcacagatgaattgaagtgaaactgaagggaagaacgtctgcatttgtaggccggcaaagatggggccttgggggggggggggggcgggttggagagataggcacaaggaatgacgtgtagtgtcatcatttgttttttccttcattatttttggggaagaaactgacgttgccctttgacgattaaaagttgggtgaaattaacctgttgtttcggtgtgtgagtaagggaatatgtcattagagctgtgcattttagcccttaatttcctgctcaaagttggaaaaaagaaacctttctgatcagttctgcgtgcacttatagttaattatgcatgcttgctccttttctgaagtgttaatataaggttaaaatcattccctgtgccaatggtaaattgtactacgctgtaccttaacaaaatggtactgcacactcattgtactatacttccatagagacgtttgccctcgatctcttgaacttttcttgtgttgcctctgagagac

SEQ ID NO: 48740 - DNA, 727 bp, Oryza sativa
tacacccgtaatattgccacaatgagtgacattagtaacaaatatttttattattattttgtgaataaaaatgagtatcagatctaccgtgggagaggtaaagcgagtcctactgtacattttagccggaaattatcagtatcacttcctgctcaaagttgaaagccccttcctcaattctgcacttatacgttaaaggttcttgtgcggccttctctaaagtgtttatgtgaatgatattcacatgaacagcccagataaatggcaccgtatgccaacggtaaattgtactacactctccttaaaaaaatatctcaaactcattgtactatacttcgagggaaacaaataaaatagacatccattttctcataaagatgttttcatctaaataatcataaaaataattttaaaaaataacaagaagattaatatagatatatcgctcaacaaacttgtaagttcgtatccaacttctacaagttatatattttttagaaaaagtacgaatcaacccttgaacccgaaactagacattgctcaccctaaacttttaataccggacgaattacaccatcgatattgttttgagtggttttgtcttgagcttgcacacgaggtgccaacgtggtaatccagtcgaaaaaactccctgggcccacctgtcatacctctccctccccagtctctctgtctctccacggtggcactctctctccgtgcacgc

SEQ ID NO: 48741 - DNA, 2378 bp, Oryza sativa
  unsure (1)..(2378): unsure at all n locations
aaaaatagatacccttttatttttataggtaggctaaaagggacccgcctatgacaaatgaacgagggttgttcggccaagaccttcctatgaaaatcgattttcaaaggtagtggttttcattatttggctagtggacgagacatggatggaggcagccaccataggaatattctcaaaagatgttggaggagtgaatccggtaaaattggttgttgtgttcatccatcttgtctaacatagatcgttggtaactaaacagtgataattaacatgttttattgttaattagtgattatcatttcaagactagtgctaattagagatagttagtatgttttgttgtaaattagtatttattattaaagtatagtgataactaatagtggtaactaacatattttgtattggggtttatatccatgtgtatgtaataccagtagacactaggattgagttcgtagtcatttaatttatagttgtttaactgtatagggattgtgtatgtgttgtgtgggtagggtagacggtctactagatgatatgtgaaggacacaacatcttcggtttcatgtaaaaaaatgaacattttatttttaatatgtaagatcatttgtgtttgctgaaacaattgtattatttttttacctttgccgccatatgtgtggccattgatccaatcgtggccggtagataacctggcaaaataaagaatcttgaaagacattcgatgttagaatgtgtctcatgcatactggctaagactatacattggtgttattcctatcccaaccatcatctttgaccattaattacactcgttacaatcgaaccaacatccaatcattaattaaggtcgatatccttcatcatgtttcctattactaaatatttatgaaatcaaccataatgccctaaacctatcagtctgacttcgattactcccttagtccacaaatataagggattctaggttgtttagcaaagtttaatgttaaggttaaattactatgatgcccctaaagggaccttgaggattttgatgttgcctaggggatgaatagacatttcctaaattataaaaactttgcatcttaattagaactagttggagagtcctgtcatggtctggacaatacgaccaacacagagagaatgaaaacgtccttgtgagataaaactgtgacatcttggcccaattaggatatgacctatgtggcccatgagagttgtatgtacatatttagtaccacattgctagtttagcaagagtgaaaccaacttataagggtttgtccctccaaccatatcactcccagattaactctcatacacgaagcgatgacaaaagtgtaagtagggtagtatgtcgattggccttcaggctgagtgggtgaggccagcctactgaccttgcttcttgcatcggtcaggctagggtgccgggcttggcctagccctcctagcttcctggtctccagcccaacagttcggggcgagctgtcctaatgtaacaccaattgcttggtcggcctaggcactctggactagtcagttgtggttcctcgagaactcgtgcatttctaacttattttgactgacacttgcaaaatactgaggagattgttagtatttcttacattcacaaatactgaggagactgttaatattttcttacatttacaagattaatttgcaagcacccggaataccgttaaaaccattttaaccattagtatttcccaaggtattggatttatatttttcccaaggaaggtgatggtataaagatatgattttttttatgttccttaatcaactaataattaattcaccatagtctaaacatgggttaggataataattgataaggtagtggacacacaggagattcacctctaaaagaatatttaataggaaattagcattagaaccctataattcatatgtacttctatactaatcatatctagtatacacttaaggtacacatgtttacaacataggacttagttccaggcacccaggtactaccgagagaccactccctgctggtctgccagcgtggttatggcatttacgcactcttacgtcatacccgaacgtggaggaatacaagggacgaacaaggctgttaacacttgccacctatctcactttccgtggtgcacaaccatatctaacgacatttatctagcctaagcaccatgcttataccagtaaataatatcactaactcgnnnnnactcaccctaaggatgaacaagttggagctagagcaacctataaaggttattggattgttaccatagcatggatcgactagcctaggatgaagcagatatacaaagtatatactactcatagaacatatactc

SEQ ID NO: 48742 - DNA, 4434 bp, Oryza sativa
ccatcgcctcttcagcgcccatccgccgccgtcaccgaagatctggcccttgctcttgccctcggccgcccgccctaccaccctcccgccgctggcccccgtcccacactgccgaacgtcgccgccgccgctcattctcgctgtccctgcgcgccaccggccgaaggggaagaagggagagaaagagagagaagggagagagggaggaggaagaaggactgacatatgggctccatatgttagtgggcccacaattttttttgtgtgaatgactaatgggtctcacgtatattttttaattctactgccacgtaggtgccacgtcaacgtcacgtggaacgaagattcggtcaatattgccacgtaggcaccacgtggcgccacgtcagcaaaaccgcctctcaaaaccatccagggagtcaaatcgcatcggttttaggagtttaggggtcgggatatgtgatggattagatttcggtcacacttgagggtcctaaagtgaacttattccttacgctgctgcagagacgatcactactacttcccgtcacacgcacggggagcagaaaatgagcgaaatacactaatcctgtaagatgcattttaattctagtttaatgtataacagcgtgttcaggcctccatttatcacgtatgatcgccgccacgctgctctctgtcgtcgccggatggggcaccgggaactgcctcaagaaatgcaagcagcatatagccgcacgccccaccactaagtcgtgacggtcggtggcagcagtaccagcaggatgaaaacattacgaaaatttctcgaccataccgataccttccacaaaactaatataataataatatttttatcgatggttactgtttttaaatttagttttaagttctgtcatcgtggcattgaagttgatactaaatagataaattcataaatatggaaatttcccgatcatttcggttcgttttcgagaaaataataaaataatgatattgtttctgaccatttccgtccgttttcatccccggcatgcacagtgagtggcctctagagttcaacatcggtgaggttgttctgaaaaaatatatagtggaaactatatatatggtgtcgctaaggagtctaaatgcaaaatgtgtgctagcgtatagcgttacgccggtggtcatacacgagcaaataagattttagacatgctgagatacattaaattaacaatatgaatctaaatatgtattttgccagattaggtacttaagtaaaccaccgtataaatttaagggctggtcgtgtatttcacaggaaaaaaaacaaccattccttttttcgttgttggcctggttgcccaaacttttttcctaagtagtacaaaatttttaccaattttttggccagccaatccgagcacccctacccagtcaaaagctccaccattgcatgatgccattatctcccctggagtacaaaatcaaatgcaccgaaggcactttaaaatccacaatcactaatggctaacctcaaaacaggacagaaaagtaaaagtagtagtagcttgattaggacggatggccaaaagaaggaaaaggagggatgtttagcaaaagcagagagttcagtgaacctgttgtctttctgagacgcttcatggcgtccccacaagtcccaatcattgtagtagtactgaacggcccctgttctggcaaatggatcttcccagcgtcggttatcctcgatgaaagcaggcgccacacacagcaaagagataaggaggaaaaaccggtaaagtatatagctctagttcgtgtttagtgcagtacaattttccatcctgcggtcagcagggtttacaaaaccatattgctactacgcgcacggtaatcacgtacgataacctacgacatacctcgcggtaatcaccaaaccgtaggcgatggtaaccttacccccaaacaatttggtaaacacttacggtcattctattactataggaacaatttgatctcatggtctctctaggatgatcgcgatcgccaatcaccggcgatcaatttttcagtccaaaatactttatggaattatagtagcagaaacttacataatagccagaatgttgttgccattcggaacgaggctactagatccaattgttacagcaaaattagtctacgtcacgtgatcgatctttttctcaaatctcattgacatgtagtactcggtacaagctgcgcaatgactagctgcgttcgaagctaaaggttaggaccatctcttcgctttgtaaaatagaacgagccattagggaataattaattaagcagatacctttagcttatttaaaaagttaatatattttttaagacaactattctatagaagttttttttcccataatacgtcatttagcaatttgagaaagatgcgaaaaaacaaaaaaagttgtagttgaaaaaaatatggttaagaacgcaaaataatttgtcaatcaactcccacgaacaaggaacgagtccaaagcaactcacgcgcttggatcactcgcgaaacgacctatcaacatctcaaaactctcaaaccaatcgagagaacgaacgcaaaatttgcccataaataaatttatttgctccagctaagaccggcggctgatcgatcgagctcatcaccacgggaaaagccgatcgcggaagagaagagagcccttccagcctgggccacgtggcgtccacgcaccatcaccagcacaaggaaggaaggagaaagaaaaaaaaaaagaagaagaaaatctcctcgtgctgctgccgacctgtgccggcgatgagagcagtgggccccagtgaagcacggcggcggtggggatcggcgaaagatcctccgcctccgcctttgagaggggaggaaaggtcgccggggattttctgtgaaggcgtatcctgacgaccaccttaagctgtcgacctgcttatgtttaatccaaaaatttttgggggatgtttcatccaaatcgactttaaatccctgattgaattattttttcacaggattattatatggattatctactaaattatgtattatatattttaaaataaatttaacaaatagtttagaaaaaaattgtctaagctgtatggtagaagaaaatattctgagagggcatattttaaaacgaatttcttgaagcttgatttttttgtattaattttaatggatagtagcatttgttttcgtgttaatcatgaaatgggagtcatgcaactaaagcacaactagttccaaaatcaaattctaaatttcaaaatcagcctacagtgaaaaaaaaactgaattgatttccatttcttgtttttattcaatagatggtgaattgcacgcatgtatataatcatttttctgtttgtaatgtgttttggaaaaggaaaagatgatgaattgtgagctgaaatttggtctgaaagaggaaaccaagtgtgtgaacaaatgtcgacacgtggtggtcaatttgcagccgtattaggtggtatcaatacgatttttaatcaattcgaatacaggacggttacctatcttaaaaaaatttaaaaaaagaacagggaaataattagtgtacgcaacttggacctaccaataatgccaggcgaactaatccaatccggttcaactactaatggatggctccaagtagcgtcaatgattgagctgtcagggcaattcacaaccaatggaggaaaaaaaaaagaggagataataaaaagaaagatgccactagctcaagctgataataatgctctccacagataataataaattttatacaaaagggaattaaaattaaatagagatttgtgggaggacaacacaacaaccccatcttcttccttcctccctctttccatccaacttccaacctcaaccaccactacaacaacaacatcatcatcatcatattgttcttcctttgcttgatgcatcttgagtcacccatctcatctccttttctttttctttcttttttttcccctttcacctttaagaagctctcaggaaaagaaaaaataataccctcaactttaatttttaaaaggaaagaagaagaaaaaagaaagaaaaaaggaggaaaattcaggttggtttccccttgtattatccttttagaacctaacgatcttggcggcgcggacgacggggttctccctggcgatggcgtccctcgccgccgacttgtagtcgaagctgcagtcgtggcggtcggagtaccggtgcgcgccgcagtagagctcgccgcagcggcaccggaacccggtcaggcccacccgcctccggcagctgtggcatcggttgaccgacgacgacctcgacgccttcgacgacgactccaccggccccgccgtcggccgctcaaccaccagcgccaccgccgccgccgccgacgactg

SEQ ID NO: 48743 - DNA, 1869 bp, Oryza sativa
  unsure (1)..(1869): unsure at all n locations
agccacagcacagataacggaggaaaaccgagttcacgacctggtacacggcaccaccaaactttgcacgcgccccccgggcaccagccaccacaccaggggcacaactgccaatccaccacaccaccaccagtcgaagacgccgccatgtcacgcacgcatgcaacccccctcgcgattggcgcccccaacctaagnccgcgccgatcgggccgcccaaagctgaccgacgccacgcccgtgaaaccaacccaagtgaaaaaatacccgcaggaaacgcagcggaaacccatcgcgcgattcgccgaggagccgcgtgcgtgagcgctgcagttttagcgtcgtccgtccctgcctgacctccccggttgtcgctgtccggcagctgagctgtgccgcgcctgtgcggattaggattagcacggccgcgtgcagctgctgcttctgctccctttccccggcaacccgtcgctgtcgccacggtaaaaatatggcgaccacgaattcacgtggtgaattaacatccgctgcaggatactagtatgatgctgcgtcaaggtcaatggatatcaccctttttttttctttttctcacacatagttttcttttatcataaaataaatcaaccacgactcgtaatgtattttggaacgaagagaatacatagttatacatactataggggtatcatcatacatggaggagaattatcgtgttcctggtaggtaccaatcgaaatcctctgcagtatgctcactgacatatagggcccatatatcaatgagcagtggaccctcacactcgttaggtactactactaatgctggggcgagctgcggtatgtgaaaagcgagggaaatgtgcgcgtatgtgcagggctacctaactggcttgggtaccagccagggtggtgcacggatggatgaatacggcagccgacctatcgtgcccaaacatccgtgttacacccgatcgatcgcgacgacggctctcatcaagccgcgtcgacggggagagctctcctagttggaaaaaacgataaagttgctgaaaaataatttaaaatgagactgatgtcaaatctatagataattgtataaaagttttagtgctatcacgttatttttctcgataaatggaacaatggatgataccatactcatgtttctgaagcttgtaagatagtagtattacctttctcttaaaatatattaattcttacctatgtatatggatatacttttatgtaaatgcataggtaactaaatgtggttatattttgggatgcgatttttttaaaaaggaaggtagtattatatattactccctctgtccctgaatatttgacgctattaacttttttaaacatatttgaccgttcgtcttattcaaaaacttttgtgaaatatgtaaaactatatgtatacataaaagtatatttaacaatgaatcaaatgataattacttaattttttttaataagaaaaatgctcaaatatgtttaaaaacgtcaatggcgtcaaatatttagggcccctttgatttgtaggaaaaatgtaggaattttggaggattttaatcctatagaaaaaaaatcctatgaaggcctttgaaacaaaggattgaatcctatccaatcctttaaaattcctatgaaatgggtaatcctatgcacattttgaagaaaagttagcaagaggtctaacctcttggaacatttcctctgagtctatctctctcatctgatttctgtgtttttcctgtggtccaatcaaacggccattcctgtgttttgcaatcctctgttttacaattgtattcatgtcagaatcctgtatttttcctattcctatgttttttttcattca

SEQ ID NO: 48744 - DNA, 3929 bp, Oryza sativa
ataagtgattcagctatttcgaacaaaatatagcactttttttgagggatttttttagggaaaaaatagagcacttttatgtgtgtaaccgagattcttttaccagattaagaaatctggtaaaagaaccgcgctgctatataaaggtgcttctcaatgctatatcccatccacactccccacgcatttatatgactactaaagtttcgcatttatatgactactaaagtttaattaggttgtgtttagttcacactgaagtttgaaagtttggttgaaattggtacgatgtgacagaaaagttgtgtgtatgaaaggtttgatgtgatggaaagttggaagtttggaaaaaaaaatttagaactaaacagggccttagtcagtttttatttaaattgcacaaagctaaattaggatccatataattgatatacatgtgttgtatacatctatagcaatcaatccgtactaatactttttggaccaccgcgatcaaacagtattttttttctctctataaacagcggataaatttaattcggttggttatttttttaaaagggcgacgtggtttgtctttgtcccgtaatctctttatcttttggaactatctggttacatgtattggatagaagatgtaaactattttaattatcttcaaaagacgtacgtactcctagtttatacatacggtagatttttacattatttacaacctgtgcttaacaacatagtaagatgtactcccttcgtcccataatataagggattttaattttttttcttacaatatttgaccactcgtcttattcgaaaaatttgtgcaaatataaaaacaaaaagttatgcttaaagtattttagataataaagtaaataaaaaaaataattcttaattttttaataagacgagtggtcaaacatcgaaagaaaaacacaaaatctgttatattacggggagggagtaattaaggactgtagtagtactatcgtgatcgtgacgtcggttggcgatacatgaatccagctttctctataaagagatgcttggatggccatattttacacctctcgccgactaaatcctctgtttattcgagtcatcaccggattggttagtttatagggaaagtggtttagtgggctgcccccacgaagcacagcaaacaacagggtgtgttcatcacctacagaaacacgatttgtttatcggtttgggggaaaagacgagacggcgacgtggccgctcaagtggacacattttaatagcataaatgtagtatagtactagtagcatgattttttggggggcatctctatcaacagaaaatccttaaattacacctaaagttgcttcacaaattggtgaggtccaggcaaaaccaaatcgaacgggatattgtttttttcttcaaaaatttctgtccatcatctctccagagccgtgacacatgcaccaccatgtttggcatgatagggagaatcgattttgcttatcaagaaacagagaaaagatcccactaggttagtaggtgtttagtgttttcctccccctactaatcaatggttatgaccttaattaattgctgggagccaggattgggtgaactgcccacgtatactataatgttatgccgtatgtaagtgtgtatgagaaagagagaaattatatactccctccgtactcataaagaaagttgtttaggatagcgatacggtctccaaatcatatctttaacttcttatttctataaaagtatttattaaaaagtgatatatgtatacttttataaaattatttttcaagacagatctattcatataatttttatattttcaaactcaactgcttgagagttattcatgatttatatccccaatgtttgacttaaatattgtcctaaacgattcctttataagtatgaagggagtatgtattgggaaaggaaattggtgcgatgtggtgtggagttgaggacgcgtagcttcattcactaagatttaattcctgatgtctataaattttacgcacttaatgtaagtgaacttttaacagaaatatagctgagattagaaatatgcctgttagttttcgtcttctttaaacgtgtattagctgttgtgtaggtgagtatggcgttacgctgttgcgtatgtaatggtgtgcgtctaccgtgtaatagtaaaataaatgacatcgtgtacatggattatcgctaatgacgccattggattagtttaggttgcccatggagcctaaggtcccctaacaccaaccctaaacccgtaatttaatatcctctcgtgaatgacagcacggtgacgctgtgctgcgtaggaaagccactagctggtgccgtggtgcagcagagcagcagcatcacgccaatgactcgaggcattacacaatcgattgatacgctgttgccttcttcacgtgcccgcgtcgcagcgagcttcgcctttccacacagagattttgtggagatcgcattctcctctcctgtgtaaataagtggctgatcacatgaacgacaatgggtggcaatttggcaactggcaaagcatcgcaaatttgcagtgctgcattctaggatagatatgctcgtatcaccaaaaagagagactttaggaagccgacgagttccaaagtagggactccctatgtttctaaatgtttgacgccgttgattttttttaaatatttttgaccgttcgtcttattaaaaaaatttaagtaattattaattctttttttatcatttgattcattattaaatatacttttatgtatgcatatagttttacatatttcacaaaagtttttaaataagacgagcggtcaaacatatttaaaaaagttaacggtgttaaatatttagggaacgagggagtaaatgactacatgtatgcgcagtagcattagatctcatgcaatcctccttccccgctgcattgatacaagaactgaaaaccaaagcattagaaatcacaatgcagtcacaacatagatcgaacctgacaaaaactttgtttcaaaatactccaatcgatagtatttcgtttcatattatataagactctctaatattgtctatatatatatatatatatatatatatatatatatatatatatatatatatatatatatatatatatatatatatatatatatatgtgtgtgtgtgtgtgtaatgtgttactgattgccactttactcctagactatagccaacccacatataaaaggggagcaaaacaccttgctgaaaatcagaaaatgtcctacacaaattttacatctcaaattagggatcaaaacatttagaagaaatataatatatatcaaagaagtcaagacaaccaaaaagttctttcttgtaaacaaatcatatagaaagcacacatataagaacagtacatttttcattctcaagaaatgcccatgaaaaccgacagatcacacaaacaaaaatattttattcaggacacaagtacctgaacgcatttctacacgttgtagacacaatttaccgatttatagtgcatggaggcccccaaatatcatccaaaattaatctaccagcgtagtggagttcggacaacatcgccgttgcccttctgacggcctttgcgtcgtcgtcgataatcatcacatgaaggccatcggggaagaacaagatcatctcatcctccattaattactaaagagattttctttcttttttgtataacatggtgaacacgcgtacacactagtaaatatgcaacatcacactcacacctaacacaagctcagagttttagacaacacaaacggtttactgctcagttttcactgacgagagtgattagatttgaggtgagtgaaccctctgtttgtaggccggctaagccagggggatgggttttactgcctaatggtgt

SEQ ID NO: 48745 - DNA, 1018 bp, Oryza sativa
atatcacaaaaactatgtggagtagcttgcaagtgggtgagttgagggctgaagcattcataaactagatcgaacatactactcgacataaccagggataaaactggacagctctaaatttaatatacttgtgctaccaggttgccaggggccatcttccataatgaatgcttgaataaaactagcttgatcaatttctttatgcataggacagattgttctaagtaatgcaaagttcaacacagaaactaaagtctaactaaaaaattatatcaatacattaaggaataaaagtataaaacagtactatgttcaataaaaaaacaaaaaagaaacaaagagagatgtttttccttttctttttttctgttttttttgttgggaaagggactggttctaagaagagtacaaatagatagactgctgtacagtcggagcttacaatgatgaagagcccagactaccgactaaatgccatgtccaaaaactagccctcaaatgctctatttgacaattgatcctcatccatggaagttatttcaaatctcagcaagtcctttcagatgactgaagaaaactgtttgctcaatgtgacgacagttcattgatctccaatacaaccacctccaagtatcagcatggtggtttatcaaattctggctccaaactccttcctcttttcttattttcttctctttttttgtattttcctgcttttagccttttttacaaagcagcatttttttccataaaccatcttccaagcttattatgctgattctaatatgctgtatgatgggctaggcaccaatttggttctcatcatataaactataattcatctcccctatgtggcaggaggaagcacctgttcagcagaaggcagtgccacggttgcacctgtatttgaatcagtaactgaaggctcccgtttccattgtaaacttctagcaccagctatcattggagcacgccctctgaaggtgctaccagggaggccaccccttgggtatgccat

SEQ ID NO: 48746 - DNA, 4257 bp, Oryza sativa
tgttctatgggctagaactcgagcccatatagttttgtgatctgactagtcagagaaccgaatatgtagcattttttgtgtcctctggatcttaatctaacggtaggaaaaaatctgggtgattttgacccaaggatttgtcgacaaagacatagctagtttttgaggcatcggccgtgtttaccagagaggacttgtcagttaaggccgagtttagttccaaacttttcttcaaatttttaactttttcattacatcaaaattttcctacacacaaactttcaattttttcgtcacatcgtttcagttctaaccaaacttttaattttcatgtgaactacacacagcctaaacaatcagcttatgggcagataggatagtatcttacactaataatcctcacgtgctgtgcgatccgatccaacccaagcgctttgcgtgtgtcgaaacctccggtgtcaataatgaattcgccgatgcaagcaagatcgatcccaggagcagcaaacggttagcgatctatgggtgatatgatatcgggagtagtagtacgactgtacgagtacttcacatgtgatctgggaaagaacactgatagatttcgtcaagcgtacggttgtttccagaagactaaacgatactgtatgacgataggttaaggagtacctctccattccgccgaggaaaaaaaatacgaattagtccccttaagtccaccgaattacatccctaaactataaaattaaatattcttcacccctaaatatgcaaaccgtataaataatccctctggttcaatccgcggtggttttattcctactggcagtctagtcagcatttgtttaaaaaaacagtggggcccactttctacctctctccctatcctctttctctacctcttgccgccaccggccattgcattagcagaaggggcaatgcacgtgcccccctactgccgcaccgccgccaactctgcctgtcacgtcagcgagcgctagtgacgaagccaggataaaattatagcggggctacgccaaaataaacaagagcaacaaagagagatatagggttgggttaggatttttttgggccttcttagccttttggcccttctaacaacctcaaacaaaatctataataacccctcatctataaatatatggattaaaattttagagggggtattataggggctctaatggtatattaggggctaggagggtctaaagaccccccctgccccacgctttctccgtccctagcgagcgcatctttgtcgctgcggagggcatcgtggcaggagaggtgcactgcgaagttggtgctcaatctgcttcgccttccacctcacgcgcggttctagaaccaaacggcgacctggcgagggtggagacccatacccaccgaccggtggcgaggatccagatcaacaacgtcgctccaatagagacccgtcctcacaggcaggctccaccacctcctccggcagtcagccgcgcctctcccagtcctcctattccctggccttctcctcaaggtgtcgtccccgtcagatagatagccggcaacatcagattggggagaggccgcagctgttgagtaccggggcgctgttgagctcattgttgcctctctagctccctcccggagttcgccactcccacctttgcgtcccgcgccacgcccgccgcctgcctctgtgtgctatcgtgcgcgtcgaccgcccgcgccgctgcttgaccaatgcccaatgacgcccgagagagaggatgaggggaaaaaaatttatgacgggactaccacgtagtatcaaaaccaccgcggattaaactggggttaagggcaaagaatgtctggttttgtagtttaaggtataattgaatctcgttacagtttagagagataatttatacttttttcatctgtaaaatactcaatacaaacacgtcatattcaatactaacacatgcgtatctagctttatgattggtttttttgaacgactagtagagagtactactcctatcctcaattagtttactgtagacgtactgtactactagtagtagtgtactgtacacaggtgatgcgtggctcaaagtgtaggcgtcctgctcaccgatgtggctctagctgccaccgcgacgtggcacccggggcggccgcttccggaaggcacgagatcgacggagacgcgcgccacggagactccctctttttgggtcgatcgctagctagctaacggcacgcgcgttgcgaaaccggcgcgagctccggcggcgcggccagcaagccaaccacgtaacgttggcgaaagggcgacgcaatataatttagctggtgtacggtgcgcccggttgacgggtcgaggcagcgtgtcgagctgaccgagggggcctgctttcagagcaggtagcaggctatcaattatgatagcaaagagcaacgggctacagatttataaccagctacagtataaactacaagacgcagtgtgtgtatgacaggtgagaccagttattaatagtttagtatgtaactattatatgaatgagctattagattggctatagataaattgaagctagtaattggctatactattaaacctcctctccgctctctccacctgatcgcatcccgaattttttaaatagcactattttaataaaaaattaattataaaatagtgattacataattgaaatcgcaattttaggtgcgatatgtgcgatacaattttgtgccctgttaaattatggttgttcgttagggtaaaataaaatatatgcaggcaagtgtaaaccggatgcatatatctgagatgaggttcatccatctttggtaggttgataggtgcgagggcatcagcgaggcccattgatgtcgacgagctcgactctacggcgcagatccgtggcagtgagctcatctcaaggacggcaacgaggtgctgatccaccggtagcactagcagtagcgataagattggggatgggaacaatgcgagtagatccatgatgacgagcttgaggaaggcaatgagttgcgggtctaccaatggtgctagcagtagcggtgagtttggcgatgcgaacaacacgagcaagctcggggaaggcaatgaggcgtgggttcgccgatggtactagcagagaccaggtcgaggatggtaatggcacgaacagatccattgcggcgagctccgggacggcaactaggcgcaacgcaggttcgccggtggcactaaatagccacgaataagggagatatagatacctgatgggcctacacgcccctgaactggagcttaaacttgaaggccccaacaagtgaggggcggacacccatagagatagccacgacactcttggctggcacacgaggcactgttgaaaattgcgcagatgggatatgatatgagagggtgaaaggaagaagaagattctaacatgattgggcccatgtgccgatgagtaaatgggtggaaaacgtcaccatagtggcgccgctaccactatgtaaaaattcattgtcatggctgctactagacgaattgtaatgatatttatttgaaatgatatatttgcaataccatggagcgaattacccttaaatataaatttattgtagtctaatcatttgagagttatgagtggtaaaatttgatacaatagtgaaaacggagggagcatgatgcaagacaagtaaaaaaaggaccatgtaaaatttttaaatcaaagttaaaatacaaaatactttccaaatttaccataatttacagctgacgaaagcacagcttggtcggtccacgctggatacgaataaacaagagaggttattcccgccggtaataagaagcagacactatcgcaatgcctgaaacggatatgagctaaaaaaaaaaacacccgctaaattcccgcgaagattctttcccggaacggggcagttccgacatttcacctcctctttcccagctgcggcctattgttagcgaggagtcacccagattcttctccaacctctcgcccccgaaatccacacctcacaacgccccttacgccccacgcgagcgaacccacaagaaacacgcgcaaaatctcccctcccgccgcgaattcgctcggtttgatcgcccgaaagatcgaagtgttttgcgcgggattcgtgctttgcagcttaagtttagtgcggccttctagctgctcggatttgaatgaatgattgattggcgggtggtcagtcgatttaagt

SEQ ID NO: 48747 - DNA, 916 bp, Oryza sativa
cctacccgcagccgtcgtcgccgttcaagtggcgggacatgctccaccacagccccgtgccgctgttccacagcccggcctcctcgccggcgtcacggagcccctcggcgtcctggctcgccggccgcgagcgcgagcggctcttctccagcttcgtgcgcaacgcgctcggctcctgcgtcgattacgcgccggtcgccgcgctgccgctcggcgtctcggctgctgtcggtgtcggtgccggcgagctcgcgttcgagctcgacgagcacctctccgaggcggagccgtcgtgcgagccgtacgctcgcgacctcctcgccggcgcccaggctcgccaccgcatcttccacgacgagctcgtcgtcaaggccttcttcgaggctgagagggcgcaccgaggccaggtggaatcccaattcccaagaacttggacgaaactccaatgttaacttcttgctttttcttttttgcaaggtgtaattatctatgtccttaaatctagtgccctttgtgcttgccctgtgtgatcagacgcgggcgagtggtgatccgtacttgcagcattgtgtggagaccgccgtgcttctagccaagataggcgcaaacgcgaccgtcgtctctgccggactcctgcatgacaccattgatgatagctttcatggattatgatcagattttccggatgtttggtgccggcgtggctgatctagttgaaggggtatgagttttgtttacttgatttttagatggatcataaattcataatagtttaggagctctcccagtttagtagatgaagggctggttccacggctatgattgaattatctatgttatcattgttgattattcaaagtcaacaggccatgtgctcatcttgcttaagctttcaaccatatggataacttcacta

SEQ ID NO: 48748 - DNA, 967 bp, Oryza sativa
ccggcacacacaccttacccctcaccgcatgcgcagatagaactgtacccctatacatggaaatggctataaatgactatgaactaatccctaatgcctgcgaatattgtgtacatgtgagtgtgctttcaatatgagttctgtgaggtaagaatatattttccacgggcctccatctcgttaagcttggattaggacttaggagttgcactcactcttgtgtgcgtgtagtatacgtgcgtagtggtatgtatgcatgtgcttctttgatgtaatagaaaatggctaggaatttaaaactagcctgaggaatgtgctgatgtcttgacaagcaatatcaatcaactgaaacatcccatgttcccactcatagtaaaccgatacggagaaaaaatgtctacatatatatatatatatatatatatatatataccatgatctgaagaaggaaacgtgaccgagtctgaaaaaccgaacaaaattaaccaagactgaaaccaattttttttcgttagaaatctggtcagcctttttcactaaccgaaattaatttggttgtcaccatcggttaactgaaatgaaaattaccaaattaaccagaattaagaaagaagcctaacattcattgcattgaatggatttggaaaatagtattccaacattcattttatttgtggataaatggagcatcctaaaatccctaatatctgtggatggattgtttctcaccttattatacctatgtaaacttattcaagcctgcaattacttatttatgacaaaaaaaatatgtgcattcggagtattaggatgtgctgatgtcttgacaagcaacatcaatcaactgaaacaccccatgttcccactcatagtaaaccgatacggtgaaaaaatgtctacatatatatatatatatatatatatatatatatatatatatatatatatatatatataccatgatctg

SEQ ID NO: 48749 - DNA, 1665 bp, Oryza sativa
cacattcggtggctttggcatgacaaaaaagttgtcaacaaatttcaggaagcgagagagagagagagagagagagagagagagagagagagagagagagtttataggttctcgggtgtgcaagccaccaaacaagtgaacaaccatcctcgaacatcgtggggcgtgccgccacgtgaggcacttagcaggccatggcggcggagcggatgaatgacataaaatagtttatagtattccagtaacatttggtaaaggaatcatgtctgcaacatagaaatttaattggcaaaggaaatactgtattaaggtaaacatttcttccacgagaatgaagggagaatcatccatgtaaagagtacttgcaacaagattaaaagctggtttgtcatggggagttcacatcccctctctctaattagcttaactagagctaatttatttgccatatgatgaccacggactactcgatccaggccatgtcatccaggaaggcaaattcattggtgttgttcataaggatgtagtccaggtccaggtcccagccgatctccatgccaccttcctttatgttcagtgagtcgtcagttgcctcaccgccagcgtcttccataggtatcatgtcctcgtccaaccccaagagcgattccagagagaacatgatgccttcttcaacatcaaccggagcatcaacaacaacctgttcaggcatcatgaatagttctgcattgttaggtgctgttgcttcaattgctggcaccgcattattctgatcctctgacacaacgacaacagggacagatccctcacccttggtcccaacgattggatcgatgatggtgaatgttgactcaattggtggcaccatgagagaaccaacagctgcattgttgttcagtgcgcttgtgtaggcgtacatggcggcgtcatcgtcgttgtcgtcaggggctcctatggatggtccggcactgccatatgcggtttgtccaacgaggaagtcatccacgggtagcccaaatggaagctcgatcataggagccttgtctttattcattgtcatcccgtcctgaggcgtgaaggccgccgggactatgttgatgtggttacgcatagtagctaggtggtggtggagggccttggtaggagaagggccccatgtacaacctctgctggggagcatccggctggacaccaccggacagccactgtcccatcactggagcctgcatggctgccgacgcagcaacgttgtcgaaggatataaccgcgttgccggtggccgccggcgaagcagcgttgctgaaggagataaccgcattgccggtgggtgcctgcacggtcgtgttgctgaaggagatcaccgcagtgccagcaggttgttgctgttgctgctggaaaaccgaaactggaaatggtgctgcagtactgccgccagcgatggtggtcgtggggatgcagctagcttggcccggcgccaccggtgaggatcagagggtgcacagcgagacattgagcgtcgaaaggatggctttgaggaacaaggagtccaatgagaggagacggcgctcatcaaggtccttctgttgcttcgtgcagtattcctgcggctgtggcagcaggaaattaaggcacgttaatttggctcaaatatatacatattcacgt

SEQ ID NO: 48750 - DNA, 4155 bp, Oryza sativa
agcaacccagctatattcccaaactgacttgtgttttattgtactgagatactactggatggctgcgaagatgtatgcaaaatgttctgatgactaaaaacatcgagaaccatgatttagtcttgagacaatatcacgtcacgcagaatgggttcaagtgcgacaatcagcaagtgtcttgcattgtctcacattctgtgtaggggagttgatcaggcctgatttatttctattagcatcggaggttagttgatctaatggtcaaagacacgttgatctaatggctgagatgattctgatgacgtggctagctgagagatcttctttatagcatcattgcacttagtgggttccaattatataggaagaatggatttgtaatcaagttgttgtaatcaagttgtaattttatagttagcagttatttgtcctctaaattttatgataattggtttaatcttatttagagtaaaggtgggaacggattctattattaccttaaaaatattgttacttactataaaaaatgcatgtgcgttagaacggaaaaaaactaatgttatggtaatgatctatctatctattaacctattaacttaataaagtaatagaaaaaattagcctccacgttagctctccaagaactagaaattctcatattaattagagtataataaaaaaataaggagaactcatttaagacaaggactctttttttcctttttttaaaaaaatcatgttatatatgtgtagtgtccgatcgaatacctgcatagaacaaatcttttgcaaggaaaaaattacctgagctggatagactaatctctctatgtaagtaatacaacataatacaaagtattcctattttttatttttttggtggaatacaatttaagaaaagaaattaaattcggaatttaaaaataagaaatattgatagatgagattagagttcatatagaaatacaattaggaataataaaatttcagaattaaaaaaataggaatactggaagaagaatctagagtccatacagaattaaaaaataattaatattattaatttttagtttaaatttaaattatatatcatgacaaataaataattacatttttttactccatttagctataaatagtttaatttggagaagaaaaaactatttcaaattttagcaatttttaatgcagaaacagtttaaatcgattgagaataaataaaacgtaattaggcccatatttagaaggacggctcaaatatctctttttcacatcatggcatgttaagtgaacagggcccaagtggccttggcccaagtcggcgtagaagcgctgagagccaccggattcgatcgaacggttaggatcacttgtgatttagataaagcattgcactgttgaatcctaaaccctaattcattcttcttcctctcagtggcacattcctccaccgtgagcggccgtgccggcgcccttccctaccaggtgttgccgcagtgccctcctccctgtgagtaggggcattgccttcccccccgcgaccgggtggggcagcgcctttccctaccgcgagcggcggtggtggcggtgccctcccgcggcttcccacgagtggatccggcggcgacggcggcttcccgcgggagaatcaggcgatgacgaagatttaagataaaatttgtgcgtttttttattattcttcatattccttttctcttttgatgaattgtccgattggattttgtatttatttttgaatttgtgctttatccacccttacacgatgtgttactcgcgtgtgtggaacggaggtcatcgttggatcggacttacggaccaaaaaatgagtgatgaacgaaaagttgtgttaacgtcaacttttggtaaaattatttagtggattcggttaaggaaagagcacaatcaactgatggaaagcttatccagaagagtatgagttcaagaaagaatcatgaagactatgccgtggcagtttaattctatctattaattacgtaggatttagtaaatttcctttatctttagaaagttttatctagtatccgattagtacttgtatattttcttttgtatttaggaaacatgcgtcgtgtccaatatggactagtatctacccatgagtataaatatgtatatacagggtcattgtgatctatcctcgatcaatataactactcccggcgtatcgccaccctcttttccaatgtatttatttattatcactgacggaacttagcacctgacgcgggctgcattgacttcgatctccggcgaaggggtaagccctatgttccgttggccctggtgaatatatcggctacattggtgttgttcaaggtacatcgcttcgatctcttagatcgttctagttcggtcgatatatttgcctacctgatgtttcgattctattttaaaatttaagggggcccccaaatttttttggggtttggggttttttaagagaccacatcggtttagttgggactgtctcgattaggtctgattttatgtcttagcctatatatctctacaatcacaatgttgttttaaatagatttgttagatccatcatattagacaaatttatcggctcattgagtattagattattatatgcaatctcgtgttgcatcgattaggttctacctactaaattgttgttaataatcaaagtcttgtcaagctgatatgttcatgctaatgtttcattggagggttagccgcttatataatatgttaaatttattgttgatggttttattgtcttagttaaatttaagacatgaccactctgaaaaacaatgaaaggcttggttgtttagatcttatactttcttttatacttagtactgcattagtcgtacttggaattgtaagaactaacttgctctttggttgacgataaaggtagcatcagggttttcagccgatgagttgtctcaatattgcactggcttataaggattatatacaagttgattttagccgattggatcattacttcattatatcatcatcgactcttggattatttgttcaagttctttcattgcttatctaagcatcggaatatacattgaacaaaaagcgaattatttaaagccttatcgacatcggctaagtaccattacatcggcttgtcaaccaatcggttttttgatcataaccttttttttattggtggttccttaatcaaattgactagcacatttgcatgtaatcaaagtttaggatatgcactagagttaagcatttctttcattcattcgttttttttcacatcaataagttgtaaatttgttaagtagttaagattttcattgctcgagagtgaacggtctttacttgggcctcgccggtgcgatgccacagagacggaaacttagccgcgtcatgacgacccgacacgaaccaccgaatccaacggatcgacacccgttccacgcgtctactcagccaggaaaactccccgatccccatcccaagcggaaccaaaccgttcatggcgatgcttataaatgagcgcctccacagctcctctgccacttcacaaagcaactcatcaacagccaacaattcgagcagagcagatattagggaaggagaagaggtgagacttgaaacccatatcgtctagcccacttcattgtggagctagcccgaaaacctctagttgtttctcccctgtccgccgatccaccatggcgttcatctggccggggccgccgggagcgcagccggtgggcgacctacgggtggcgcagctggcgctgctcgtcgccggcaacgggctgatcgtctcgccgtcctacctcagcagctgcccctgcgacgacggcggccggtgcttcttccaggacggcgtggcggagcagaggtgcttcgacctggccaacctcgtcaccgccgtgctcgggctggccctcctcgtcggagacatggcattctcgacggcagtgcccggccggtcgacgcagtcgcaggccctggccaccgttgctaggtggctcgtcgggctcgccaaggtcgccacggttgggaccttccagcattggatcaatgccttttacctttgcctcaaaacgtggtccatcacgtcttatattatccacccgtctttgcatgataaccctg

SEQ ID NO: 48751 - DNA, 1377 bp, Oryza sativa
tggtatgttcacttcctgggttgttctttacaactgaagcaaatttatgattggagctacatttggagtcacttttttttccttgtttcatagtagtataaaagttactccaatgtagtttattttctttgcaaattgtttgtccgaaacgtcatctaattatacatgtcatgcgaaaactacaagttacttaaataaaatctatttttcaggtttaaataattataactcaattaatcatacgttattttcttattttatctgcacgcagttacattttcagcagattcaaaagggacatctagtagcataaacactcacatactcagagaaaaccattgacctgagtaatgacccggttagtcactaaccgggtccccgtaggaccgtaacgaaccaaatggagcagcgtcccacgcggataaaccacgtcgtccccgtcgatctccacgcgcggctgccagagtcgatcgtcacctcggctagctcggtctcgccggtgacctcaccgtagacgacgacttgacctgacgaaactggaaccaacccaacccaaccaacataaacgagctcaccccgcgctgtgtgggccgccaattcacaaatcacaagcaagaacacaccaagaacccgaactgtcctacctcgatcgatcaccagcagccagccatggcggccgtcatcgacttcctccagttggagccgccgcgcgagccgcggccgcagccggccgtgcaggcggccctccccgtggcgaagtcggcgctgttcgtcgccatcaacggcctcgtcgcgccgtcctacctgtggtggtgcctggcctgcgacgacggcggcggcggcggcggcggcctccgccggcgctgcttccgcggcgaggccggcggcgacgtggagcagatgtggtaccagatggccagcttcgccaccgccgtcctcggcgtggcgctcctggcttttcacgtggcctcctcctcggcgccggcggcgatggcggcgtggctggtctggctcaccaaggtcttcacctgtgggactctccagtttggcctcaatattgtccacttttgtatcaaaataatttacttcaagttgatacgggggttggattctaatctttcgaggggataattataacacattttttttactgcttggatgcaatgccgatagctgtaaatggatttgaatcgatttgagtacataataatgtacgaaggtagattcaattttgtcagagctgcggcgtgctaatgtagactccatcgtggctaattgacggaataaacgaaacggtatatttgcaaacggaaaataatttgtaaataaaacttttatatacgtgttcttagcgattcaaaacaaaggctgtaaaat

SEQ ID NO: 48752 - DNA, 1509 bp, Oryza sativa
agaaaaagaagaagaagaagaacacgtcagtagagggtccttgacggaaaatgatcttatcaagtcaaccatcgattctgggccgccgaatagtgatcggacgggtacgaagatgttatccaagactcccaattatgggagggttgaaacgatgaatcatcctcatgaaggggtctctaacgtaaaatcattgcctggctggcataacatacttttcctagtcgatcaggattgcagaagcattatcggacggtgctggagaacccatgttttgatcgaacctgtgagttaggcccattaagaattaggcccatgcaaatcaccctcggttgaagcccaaagcagtggctgtggcggccgcaggtacaaagatctaattaagttaagagattatgctgtccaaggcaaggcacacctttttattcctttttattaccatgccagtaagaccaaacaaggttttcaaggcaaaatagcaggcaaccattggccaattctatcttcgctcttgattaaccacgatgaaaaatccacaatcaggattctcatcacattattggcacattacggccaataacagaacactatcaataaaatgaataaatcccacacaaaaaaccaatgtggtgttgtgtgtcttgtatcacaacacctctaagatctagcttagttatgtacagatccttttgtttcccctaattaatattactcctatatcttcccctcttaggtctgaccatgaaattctaggcacccctctcctgagatagctcggtgtccttctgtgccgcctgagcgaggtggtgtacgatccgatggagccgtcgcgttgcagcacgatgtcagcatggattgcagagtttgggttcttcagccggtatcgatcatggtgactctggtgcttctcttccactgtcccttcgatcctcatgtcaaccttgttctcacaatctacttgttgggttttggtcacatcgtccttcttgttatcttccacaacgacggtgaacacaaatgtaccaatttggaggtagtcattcatgtccaatatgggctctagggccttgaccacctccctcatgctgggcctggactttggtgatgggctcaagcacttgtaggctaccaaagcagcctcttgggcccctttgtaggagtattggccctccatggctgggtccatgacgacccggtgcaactggtcgggcttcttgaggtactttcttgtccaatccaccagactttgctccctatggcgacgagagcggtccaccgagtgccgacccgataatagctccagtagtaccacaccaaaactatacacatcgctcttgtcggtcaggtgccctgtcatgatgtactcgggcgctgcatacccgtttgtccccatgacacgcgtcgtgacatgggtcgcgtcgccctgcggcccatccttggcaagcccaaagtcggaaagcttggtgttgaagtcctgaaatcaaatgaatcagagatcgggttaggcaggga

SEQ ID NO: 48753 - DNA, 3063 bp, Oryza sativa
caatcatgtctaacgaacccacacacccagccaacgattttggaacgtgtggcacgcagactttgacagtcaaatctagacttgataacttgacaagtggtatcccatcaaaattttcagaaataagaagcgaaaaatggtctgaaagttagtaaaatttttcacggcagtttgaattttcgctctcaggacatggtagttttttttttcctttaacgactgaaatttctactgcactcgagtgaaatgactgcgaaaagtacacagtggaatcaagaacgggatggtgctcaccgagtcgaggaggatgttggatgccttgaagtcacggtagatgaccggcgtgtcggcgtcgtggaggaaggcgagccccttcgccgcgccgacggcggtctgcatcctcctcatccatggcatggcgccatcgagacctgcacggacaggaggacggttcagcgtcagctaaagtcttccccggaattttttcagagctgaaacttcagcgatggcgtaagcgcgctctaagcgcaaatgattcggttaaccactcgcgtataaacaccagtaatctcccggattctattgacgattgcgacgggggtaaaaaaaaagaagaaaagattcaacagttggtaattattctcgtgtgcttacttttgaagagatgcttctccaagctcccgttgctcatgtactcgtacaccagcatccggtgttcgtcctcgtagcagtagccgatcagcttgacgagattcttgtgcctcaactgaccaaggaagaacacctcagcctgcaagaaagaaaggttcgtagattaattagcacggtgagctaaagctcgagctagcccaacaatggcggaaggaacgcatgaggtggagagtgacgtaccagccactccctgtggccctgcgtgccgcagtcgaggtcgaggtacttgacggcgacggcctgcgcggcgaggccggggcggaggccgtcgtcggcgcggcccttgtacacggggccgaacccgccggagccgaggtagttggcgcgggagaagccgccggtgacggccctcatctcggcgtaggtgaaggcgtacaggttcgagcccgacagcgtcagcgacaggtcctccggcgtgagggtccccgtcgagctcaggctcgacagcgacaccctcgacgccgacgacgccgacgacgacgacgacagcagccgctggtggtgaccaccccctctgaccctcctcctctccggcggcacgtcgtgctcaacgccggccaccccgccgccgccgacgcagcagagcatcgacttccacgacgtccgcaactcagccatcgaatcgatcaaatccaagatgaacaagaagccaagataaaccaatcgcccacgaacacgaagcagcagagagccagagcccgaaatgcagagacggagacagcgagtaccagagcttgtaaagaagaagaagaagagaggacagagttgaggaagcgtctgcaccggcaatggcgagatatgtaggcgctgtggctgtggcttgtgccttgaccgtgtcgcgcggcacgaaaccacgcacggacggcgacgccgagggctgcggaaaacggcgtcaaaaccggccacgaaacgactcaaaaaaagcggagtgggtgagtcccccgcagcaacttggtaagttggcagagagtactattactgtttccgctgctgcattgatggttgaatttttttttctttgaactttttaatttttagttttaaaaataaacatttttcaaaacgtattttcaagatattaaccttttgggctacgctagccgaactggtgtaaaaaaacaacattgtcactccgcgttatttggtcacgccgatttgacgggcgtggccacgccatccttgctggcatgacagaataaaactatcatgtccactgcgtgtagcgtgtcagtattgttttgccatatcacgtcgattggttcggattatagaaagaagttttgaaaaggtctatttttaaaattgaaaaaaataaaagttcaaaagattaaaaaaaatcctcgctggttccatgtagaaacgatgaaaaatcattctctcttttttttctttttgaattttgaaaattcattctttcagacctgtagaacggtgaaaaatcattcttttattagaccgatctcgtacagtctcggctgcttttcaccgcatgtactggcactgtgggtttggtcatttcttccttgccacggaaggtagcaatttttctgttctatttttggggttggaatggaattctctgcgtgcgtcactgtttcttactctctgcttaaacgtgacgctgacatacttgtaaaacaagtgagttcttgggagggttgcttatagcggaattaatccagcgtgctccatgctgatactaaactgattataacagattaagcaattccaagtgcttggatcatgtgaaaaatttcgtgcaaagtatttcattctttatatgttgcttctagttgggtgtttctgcttttctttttttccttttaggctaactgggagtggtcagactggggatgctaaaaccagagttgttttgggaggcaaagcagcggatgcaaaggaggtgaagccatgagctgcatctggttgctacctgaagcaggtagatctgcagcaaaaggaatctgattccagccgcagttcctcccacaatgttctggctcaccattctcgttttaatttaatctccatgatccttccacgcacgagtgaaatgcaattatgcaattgcagtcgatcgagatgagatgatactgtgataggcagttctgaactgaaactgaaccgcacgctccgaacaaccgtacaggatgcagacaaaatctctgctggaatttacaggagatgggaaccatcgtgtcttgcgctgcagatcaaggcgcataaattatgatagttttgtaatttaaaccctgcttaggaaaatacgcaagctggaaggaagcatcaatctgagctgtttgctaacccggtgttcagcctagccgtcgtgtttaaattcagttgagcttc

SEQ ID NO: 48754 - DNA, 1869 bp, Oryza sativa
ttcagctctgttttctttttatcacagttatctctctcgttttcattttttcaaaaaagatgataatagtgaatattattccctcatttcttgacggcagcattaacgcattggatgcggtaagcggattgacctgccaccgtcctaatacttttcttctactactactatttctctgcaaaaatggatggattatactgtgactctgtgagccgtagcagctggcacaacgactttgaaccgaccttggatagtggatgcattgtaactgtacaatacaatttgtacaggaggagtgtatgcttgtaactgtacaatttgagctgcatgtctgaaaagatcgccgggcacgagagccatggccgccgcgtcgtcgatgggttcgagagatgggggggaaaagcagagcacgcctacgacgtggggtgcatggctcgatgcgtgggcgtcggcggcagcaaaagggaaaaaaggagagatccgtctctgctttcgcgaagaggaggaggtcacggccgtccgatgaggaacggatggctcagatatcaagcgcaaacggtgacgatgctgacaagaggggagagattccgtgcatctctccatttcgaattcggggcatgggggcggctcgctccatctcctacccacacctgagatctggcgagcgagtgacgacgtgccgaccaccggccaccacaataatattgctcggtttttcttttttttttgttatctaattatcagccgcaacaatttgaaatctaatatttgagttgattttgaatttttttatcgaagtttaatttttatattggcttttaatcgttaaaaatataagtacaagagttgtttacacataaattgttttttactttatttgtttatgtggtgtttggattcaggggactaattttagtccctatcacgtcgaaagttggaacactaattataagtactagacataggctaatgataaaatccattccataaccctatactaatttgcgagacgaatttattgagcctaattaatccatgattaacctatgtgatgctacagtaaatatgtgctacttatggatgacttttgctttaaaaaaatcgtctcgcgaattagctctcatttatgcaattagctttattattattaatctatgtttaatattcctaattagcgtccaaatattgtaacgctccgcttttcgtgagtcgttaaaaactaactcggcaaaatcctaattgcgaaaattttcgttctttgtgtgagagtctaagttgtgccaaggatcccaatttaatctcgttgttccctctcatcgaaatcaaaatcctccccctcatccaaattccttttccgattcgagtctctgaaatcaaattctgaaattcaaatccttcctttgaatcctcgccaaatacttctacgaatccagaattattcaaatcctgcctcgaatcctttccttgactccaccctatgttcccgagaacaaatacccaagtattccttttgaatcttttccatgacttctccttgagtttcccttgatacatccctaaaccctcgagttcgaatatcaaatttgaattcgaatccaaaccctaaatcactccaattctatccaaatcagttttctctgtaaaagtctactttacctccctgtatttttggatggaccgattttcctccatcggcccatctcccctcccagcccatcatctttccccctcgcacgtgcgttgcacgcatgcgagccgagagagagccgtcgctcgctctctctgtttctctcgctctctcgtcttcctcctctctctctatgtttctctctctctcgttcgatctccctctcctcggtgcagatttcc

SEQ ID NO: 48755 - DNA, 1556 bp, Oryza sativa
gtggccgcgctcggcccaatggccggccaagccttgtgaatccctcgggccgcgcctaagtcgcccgaggaagtctaaatccgatccctccttccttttcttttccaagggaattaataattccttttccttgtccagaaaatccatttagacctccaaaattcatatccctcgatccgtagctccgattgactccgttcagcttccagtaattccgtaaaattgagatctatttaatggcactactaataggtctaaataggatctttcttttggtcttttgtttaggttttcgattatttgcatatagttgcggttatcggattttcgtcgatcgcgggttttctcgaagattcatgaagctttgtgaaaaccttgaaccaaggcaagtcaccctttgatcaattgcccctattaattaaaaagtcattattattttgtttgcaacttgcattactagaatcacacacttaacttgtttggcctcggtttgcgtgccaaaccgacggacctacccagtagtcgcactaatttccgtaggtcgtactaccctgattccttgtcgctccacccttgtggtacctcggtattcgtgctctctgagcgcgtataccaaatatcccacatacaccgttgcttgtcgaaaacttgggaaatgggtttgtgaagccttcaaaacccgacatgtggtgtcggtgtgtttgaaaataaaatgaattgtgaaaactcgcgatgcgggggttgtgcctatgtggcactgtcccgtattcgcatataaggaccgattcctgtgggaaactcatcgaacataatcaaagtgcaaccacaaggtggaatgggacaccctggctaagtaactagtcgattcagggaaacctcgcatgccaatagttgggaacgccggggcggggtcggacaaaccgggttcctggtaaggcaaggacgagaagcttgctcacataccgatcaaggtggttggagttgatttgtgaatgcctaaaatggcctatacttacgtgaggatttgatccttctatgtggcatgaggtaaccttgggtcggcttgggaaatgctttgttgcgaacctctgacaccgatgggtgtttggagtaagttcgtgtcttgtgggtaaagtgtacccctctgcagaggttaactaactgttcgaacagccgtgcccacggtcatgggcggatgtgaggtggttcccgttgcgtagagttgtttgcctgtgctttgtgaaaagttgttgtggtgtgggaatcgtaaccagaatcagcctatgtggcagatggatgacctgagtggtcaagaaacgaatctgtgtgattcgggatgtctgcgggcatcatagactaggcttcccgagtggaagcggattgttgtgctgctaggcagctggactctgggagtccgagaaaatgaaaaaggctctgggagccgattaatccagtggaatggctttgggagccgagaagtaatgttttgaccccgagcgtcggtacattactaaatgagctgttgaaaaatatctcttaaagtcgaatcgagacgc

SEQ ID NO: 48756 - DNA, 907 bp, Oryza sativa
aaattgatagggctaaaattattccctcccatctaaacaccaccttatttttcatgtcttatccattgtggagcgcaaacaatacgagtgcatgactacttcgatctggtgtgttcttgtcaaatgttcagatatgctgacttcttgcgttgcttatgcgtcatgaatatacagatttttgcactatctgaagctcccaacatagtagtacatggctacctctgaaggtgtcaaactgtcaaggtgatcgaaaaggaatgctaggctgctaatttagcttcgacgcatgttcagttcgacagacatgctcaacgtgtgtacacatcgaacacactgttgtcaacgtgcatgaatccgaaaatcgcatgaatataatgcatccatcgttaagttggcagggcggcagggccctacgctcgtatgcatggctgcccttcctcagccgagacgaaggtgcatcacacacgcacgagaaccacgcgtctggtctgaccatggccgacctgacgaccatgcatgcgtgtgtacacgtactagcactctctgtattctctactctatctgaatctctgatatcatccaggtgatgggaatggttatatggattggattaacctggacgtcattttaatttggatctgtctgaccttttcccggccgtctcgtaatctcgttacagtgtcaacgtgcagacggctagcggcttgtttttgtccgagccgtttggaccatctgcagagcggcgttatgccttctgagtttgaccagcgtgtgtgtgtgagtgtgtccgtccacaccgattgtttcgagtcaaaattggctacagattcacatgctcttttcaactcctcggtatgtatatgtgtttttttgatacttgaattcgatttggtttttcgtattatct

SEQ ID NO: 48757 - DNA, 948 bp, Oryza sativa
tgaagatttgtcaagatttccttggtgcagtttttgttggacagaaattgtgtgcacagctggttgatgagcctaggattgttggctctggaggtgacagctctccaggcaaagcttgtggacaggaggcagtactgaatgaggagaaggctgaggaaaattctcaactatcctgcagaaatcatgaaagcaatcagacatgctatcaaaatggagatcgagaccttgaggcacatctcaatcaggatggatcgccgggctggagccttggagggatgcaacacggaggagcgagatcgaaggcatggctggccggtggagctcgatttttcgcgtcgtcttcggttcaggcgtggattaagctgcgtttgggattttctcgggatgcggtgctagggttttgatgttgggtggcatggcaaactcatcagcgacgccgtggcggcggcggcgcaccgccggagcggaagccgggagcccgaaggagtttaaggcccaccaaaggacacgaatgaacgccgactaaattcctgtcaatgaattcggcctgcatacattcagccctcgaattccactcagcgaattcgtcccacctaattcggaaaaagtacaccgaaggtccctcaatttgtcatcgggataaaaaacgtccttgaaccgtaaaaccagatatgtggggtccctcaactatacaaaaccggtcactcgagatccctcggtggttttcaccccggttttagcctacgtagcagctgtcagcgtgagacccatgtggccccacatgtcaggtgtctacgtcagcctcctctccctctttccctttttctctcccttccttgtctctctctctctctctcacttctgacttctctgcaatgggcggccaccggcgaggaggatggcgcgacgggcggccgcggccgcgtcgggatcctcgtcaacgtcgcg

SEQ ID NO: 48758 - DNA, 1637 bp, Oryza sativa
catatgccaatgcatctcacctggaccatcaatactgaagcttctatggcgtttactttggttaattcaatatttcaatcagagttcctccaccaatcttgtgtttttgcctgcttactttggttaagtggtagatgtgtatatatccatgtgctgctgcctaattgtttcaaaaatcaggatgtaatttccaaaatatataatcggcaaaaactgccatagagttcaggaagtcctgatcggaaaagcggtgagcggtgggcagcggtgagcggcgtccggcgtgcagtggccggcggtcggcgtcgtaagcgcttttcccgtttttcttcgtgtaacagtgccatgcaggttggacctgggcacctggctagcttgcacggtggtcagcggacagttgccggcgtcgaccggcggcttgggggccagcgacgtgcatcggctctcaggctcggcggcctgcagctagcgacgaacggcggagggtggccggcgacgagcggcggcgcggcaatcggagtgcggcgagcggcggtcagcggcggaagcgtccttcttgattttttgttcggtggcggtggccgcgtggggcgtagcctgccgccaccgccgcgcatccgctttcgctccgctccgctccgctcgcacgccgcctccgccggccgcatcctcccgtccgcgctctccgccgtggagagatcgagtgccgccgcatcctcccgtccgcccctctgccaactccctcctcgccgcatcctcttcgatggagagccagacgaggccaacgggcgcgaggcgggagaggagatccggccgacgacgcggtgacggccgcgccccgctgctcccccgccggccgccgctcgtgcagctgctgcccctccacctgcgcccacccgcacgccgctccgccgtccgccgcccatggagaagagagagggagaggtgaagaggagaggagaagaagaggctgacacgtggggcccacggggtcccacgctgactcagccaccaacgaccgtggtcaaagcgcaacgtaggataaaaccgggacgaaaaccgctgagggatctcgggtgactggttttatatagttaagggacctcgtatatctggttttatggttcgaggacgttttcgtatctcgctgacaagttgagggacctttagtgtactttttccacctaattcatgtcctcgaattcgtctcaagaataaatatggcccatcaaggaattcagcccaccatataacttgacacagtttactcattaatacttcatccgttttaggttataaaatgtttcgactttattcaaagtcaaattgttttaagttttattaagtttgtagaaaaaagtagtaacattttcaacccaagacaaatttattataaaaatgtattcgattattgatttgatgaaactaatttattattataaatattactatatttatcaataaacttagtcaaacttgaatcagattgactttgtctaaagccaaaatgtcttataacctaaaatggagggagtaatttggaccgccagcaaacttggcccacttattcccatcaacaatttcagcccacctatgaattaggcccgcttgctgcttccgtccctacagcgctcgtc

SEQ ID NO: 48759 - DNA, 3300 bp, Oryza sativa
agtttaggcaggggcatgatggcttgggagttcgaggagatcacggaggagctcgatgtaataggggttgggcacaaagatgcactgggggcaacgtgtcgtgcggtccacagtggctaagtagaacagcgacggtggtatagggatggaaactgaggggttttggtgtacttgggacatggattttattcttaccattaattttgaacaaggacggtttggtggggggtgaattttgaggtttggacactgacgagtcgagttaggattcggcttcctagctccaatgacggtgattggcgctgctgagagcagagcagcttcagggagcaaggagagcatgctgtggcgtttctgtttgttggtggtggcgaccgatgaggcagttgggagagggagaacaacggtgaggacaagagagcggcaaaggagagctcacgtatgcgggcacgtttgtgaaaaaaaaaagatgggagaacaagaatgagttgattggtaggtcgtatattttttttttcacttacatggggtcttgtgtaaacacgttagcgagtcaactatggttaacctatcatattagtaaaaaccgctttctaaaccaccaaaaaagttaaaatgcactggttttcaaagttggaggatatgatttacacggtttgttttgctgttaaaagatgcgattcgaacaggggcaagagggaggcattatagattttagtccatttccctttagtatatttgatccacaactgaaattggccttgttaattcccgtcaactatttgggtctctaatgaatttggcctacctactgtccaatcaacgaaattgggcaactacggccacgaaagaatttaggaaaaagtacaccaaagatccctcaacttgttagccagatataaaatcgtcccccaaccataaaaccggacatctaacgtcccctaacttacaaaaccggtcacaatagatctcttggcgttttttgacctcggttttgtcccacatggcggctgactcaacgttgatctatgtgggccccacatgtcagatagaccacgtcaccaccaaggttgttaggatcgggatactaggcagtatcgttttgctcaaagtaatatcgtatcgtagaatcgtatcttagtatcgggatactatgagattttctttttttaagtttaattaatatttatattaattatatatagccattatctactactacttaaaaaataagaggtgcttctatcgtccgtcaaaaaaaccgagcgaaaaaaccaggtttgtccgataaaaaaactgggcaaaaaaaagtgcgaaaaaaagaaaagaaaaaccaaaactgtccaatccagaaaaaaaaagggcgaaaaagaaccgggccaaaaaaccaaagttgtccgatccaaaaggaatcgggcgaacaaaaccaaaccggacgaaaaaatgtgcgaaaaaaagaaaaatcaaaaaaaattccgattcctatggcaaggcggaaaaaaaatgtccgattcttatgaaaaaaagtggcgaaaaaaacacagtagatccgattcccttaaaagttggaaaaaaatcatattcctatattatcctatttcccgtacggttgtttgtttttcttcttttttttccgtttcttttccctttttttctttctttttctttcttttttttatttcttaatactatgtatgtatataaaatttatatacacgtatacaaactttatatattgtatattttttcttttttatacgtatgtatatgagctatgtatacttctctatctctactattaaaaaatttaaaacatttccttcgtccgtccctacttaaaaaattcatattaaaaaaggtctgtccgatttataagaaagtgggaaaaaaaggttcgtaaaaaataaaaaaacaaaggagaaaaaaagtacaaagggcgaaaaaaagcacggcaaaaaaaaagtccgatttctattcgtttttagtccctatatatctcttctctatctctaatctaatctaatctaactatttaaaaagaaaagttttcatagaacaactaaaaagaaaaaatgcgcgagaaaataaaaacggttaaaaaaagcatgagaaaaaaaaagcaaaaaaacgcgtgagaataaaagtcagaacagaaaagctaaaaaaggtttctgccgtctgtaaaaaataaaaaaacatgcgaggaaaaaactgttagaaaaagcacgccatttttaaaaaaatggtttgaaaaaacctcacataaaaaacaccgtttacaaaaaaaacaagcagctttgaaaaaactattagagaaaaaacgttaaattgatagacgcatgagtcggatagtatcaatcatttttttcatctcttaaacggcttttgtttcgtcatctatagaaattatattaaaaaacaaacatatttttaattattatttagagaagagtgcacatgtagcaaagtgattctattttgtgtagacttgattatacgaggcaatgtaggatttgattgatcctattattggttgcaagaatgagatcgaaaaagtattttagattatatgtatgttgtcgcgtgaataatccaattattttaggtaaagcaagcatcggtaaggttgtgatcgtttatgttgggccattacattaaagatgttccaattttcacccgttgcaacgcacgggtattttgctagtatattaaaaaatgtagtaatgatatatgtcatacaaatagagacatttatcaaaagaaaccacgttggtttgatatatttaactgatttttatataaatttgagcatatttattcacattattttcaaaccatgttttcttaaataatattttgtagtatcgtagggatcgtcgaatcgggataccacctaagatttcgtaggatcgtgtaggatcatgtagtaatgaatagtagaatcgagatactatgaaaattaggatactaggtgggatcggtatcgtttcggcttggtagcatcgtagtattgtaagatactaggatacgaatcgggatactgataagcttggtcaccaccctttctatttttcccctcttctctcccttcctctctcctttttcctctgggcgtggatggcggcagcgtcttcaacgcggcgtggaggacggccggcgtggccggcggctgacggggaaggagcagcgcggacaggagggccgatgggacgggcggcgccgccaatggctgccgtcgcgcgaggaggagcgcggcggtcgtcgtcggggtgaggcggcagaggaaggggagattgaaga

SEQ ID NO: 48760 - DNA, 2100 bp, Oryza sativa
ttcttttagcagcgcatcgatcggagtgggccgccgccgtgaagctgacgccatccgccgtcgccaagccgatcccgaggtcgccgtcgtcgtccaagcttcaccaagtcacgagctatctcgactctcgagtaagcacctaagaacgccgaccctcttccccaccgcgtcagtgacgccgtcgccgccgcatcggccctcctctccgcatcggtgatgatggctgtagccgcgcgccgccaatgccgaccgcacgagggggacggggaggccggcgagctcgcgctgccctaagcccgcgcgccgccacccgggagctgccgtcgccagccacaccaccctctggccgcgcgcgccgccgcctgtgcgagagcagagagcgaaaggaaggagagaaacagagaaagagagagggtgctgacatggtctccatgacatgtggggcctacgtgggtcccacgctgagtcagccgccatgtgggataaaaccatggtcaaaatcgctgaaggaactattgtgatcggttttataagttgggggacgccggatatccggttttgtggttgggggacgattttgtatgtgggtaacaaattgagggaccttgcgtgtactttttccaagaatttttagcccagctctttcgtctacgaattcggcccatctatgtcctagtgtcccgtttcggtttcgggcctctacagatggacaatgggccatgcgaggtgtatggtccacaatggtccggaccacaggagccatgccaagcgaaatctctgcgtctaagacatacttcgtacttccttttgtcacgaaggaagaaattaattcatccgcatgtagcaaacactagggaactatacgaatgcatctaaccaatgagtattaacatgttggctcaggttttgatcaataatttaatttagcatcatacaacgataatccctttacataacatttaaaatatgcgtagtttattataaaatactaataaataaaatatgtatttttggattaagaagcatcaaaaccagataatagaaaatacaggcgcgaccacgatgccatgactcggaggttgcgaccgggtggggccaaaactcgccgagttcgcaccggacagatcgatgccctttatttgcaattaaggtccttcccctgctttttggttttaaccttacatttttttccttaatcacttacttttgtattaacctattaattttttttggctttggctttatcttctaaaaattctggtgcaacacacgagcctttagctagtcctttaataaaaagcaataaagaagtcacactaccaaaactttctaacgattttgttatatacatctcaacacatttctcttaaaaatttatcacatataaatataatattattatagtgtgctttaatataattttgaactgttaaatttgttttaaaattcatattagcaaggaagaaaaaatcaccacatgcttacatgtgaggagattctattccgagaggtccgcttcgagaggtccgcttcgtggaaatagcatgttactgcgagatttaggaacattacatataagttgtatcgtagttacatgcaagttataatataattacactataattgtattatatttgcttctgtcaaatttttgtaattaaatttttttcaataaaatatatagaaagactcattttctaactgaaaagcacaccaacacatgttataactaggtagatttttaataatgtagtcattttaaaaaataatatcaatagacccataaaacacatcttacatatggaccctacctcagcagtgatatgttggtgccgagatgggatatctcagggctaaatactccggcgctgagggtctgatggcgccagtgaattcagcgtcgatgaattcggtgccaacctctcccatctagacctgcaagtccaattaatttgctgtcaaatttttggaagaattgataataatatatcttaattcattatctctaatatatttttgtctataaaatcttgatatggaggagaatgtgcatcctttcctccttataactaaatcctattgatttgctgtgaaattttg

SEQ ID NO: 48761 - DNA, 2513 bp, Oryza sativa
cctatgatgatggacctatatattcgatggatttatatttcatttctgttgcatcctccacacgtggaaacctccgcttttccctcctcgagctccacacccaatgctccgatcccttttctgcttaattaatcaagaaattaacaatctgcataaataatactgtaacagtttttttttataacttcatccaagttacagcttacaggattagtggatcaacgacgttgtctgttctattttaatcatcaccagaaaaaggaaacaatcatctctcttttacacattcacgccaagggggatgcatgcattgtttagtttgttactcccttcggttggtgcggagtactgatgacatgccattgtgttcttagatatgaactttagaaatgatactgatacatgagtagcaaacaaacagtgaaggctccatcggttggcttttttttctaataagccaaaacggcttattaggaaataaaaataaatttgtaggtaaagcttttatatatatgtgttcttcgtaacttaaaagccaatgctgaaaaaaaattacgttgaaaatatctcaaaatcaatcttaaaattaagtttgaaaattcaaaatttggcttattctttggcttattaggtcatctgatgggagcttgattaattcttctatttattactggagagatggtttgagacataaaatctaggcaaatttattatatatatatattaaggacttttattagtagctccagagagtagaaatgaccgccgaaatatttaaggaaaaacagctagactgacatgtatccagataaaaacaaccctgtaatgcaaataaatccaagaaacaaatcgactattttagttataaacttaaaaaagattacattagtggcgttcttcttgagcctaaaattaacatgctaccactaaatgggaaggaaattgaaaggacaagctagtatgtaagctattgattgattatggatatgcacatacgattctataacgtgagctgctttctctgtcccaaaatattaacatgtacgtattggcattaactttgaaaatgtactaggaattcagttagtttacaaacaagataaaactaattaatttaaagcactgaagtacttcctccgtttcacaatgtaaatcattctagcattttccacattcataaatagagatatatgtctagattcattaacatcaatctgaatggggaaatgctagaatgacttacattgtaaaacggagtaagtaaatcattctagcatttcccatattcatattgatgtgtctagatttattaacatcaatataaatgacttacattgtgaaatagagggagtagcaaagttaagagagagagagagaaatagaaaaaaaaattaagcatgtccatgtcagcttgggggtcctcttataagtcgtctcctccaaaccctcctcgcctctccatcctggagccacagccttctcccctattcttagcccgcctcgccgcctacgtcccggcgcgcgcgcggccggccgtcgtacaaacccgcgccccctgccccccgccattgccgccggcggccacccatggacatcgacctcgaccgggcgcgcgccctgcgcgtcctcggccgaggcgccatgggcaccgtcttcctcgtcgaggcccggtacggcggcttccgctacgccctcaaggtgttcgacaagcggtccgccgcggcgaccaggcacgacgccgagcgccgcgcgcggtgggagctgtccgtgctctcccgcctcgcgcacccgcacctcccgtgcctcctcggctccgccgagacgcccggcctcctcgcgtgggccgtcccctactgccccggcggcgacctcaacgagctccgctacgcgctccccgaccgcgtcttctccccggcggcgatacgcttctacgtcgccgagatcgtgtccgcgctgtgcgagctccacgcgtcgggcgtggcgtaccgcgacctcaagcccgagaacgtgctcctccgcgccgacggccatgtcaccctcaccgacttcgacctctcccgcctcctccctcccaagacggcggcgccgtcgtccgcgtcgccgccgccgcgcatgttccagggcggcggccaccgcccgcgcgtctcggcgaggagcgagatccctctcttcagccatgccaccaagcccgacccctcgccgccggcggcgaacccgtcggcgaagcagcagctccagagcctggtccggttcatcatgaagggcgacaggagcgagctgtccaagaaggccaagtcggcgcgggtgtcgccggtgagccggaagccggcgagcttcgcgtcgtcgtgggggaagtcgttctcgttcgtgggcacggaggagtacgtggcgccggagatggtgaggggcgagggccacgggctcgccgtcgactggtgggccgtcggcgtgctcgcctacgagatggcgtacgggcggacgccgttcaagggcaagaaccggaaggagacgtt

SEQ ID NO: 48762 - DNA, 2666 bp, Oryza sativa
aagacttcagcataagagaatacttcgataagcttcaccagccgccgccgccggagtcggagagctcctcgtcggagttctcgtcggagttctaatctatctaacgtggctgctgcctctgtactcctcctactttttctttgggtcatttttcggtttggtcctcgttaggttactattttgtaacgaaggggctgagggtgcgtgtatatacgtggagaggggcggcaatgtaaattcggtgtagaggctgtggagatgtgcaaaacaacatttttggagggctgtcgcacgtgcacgtttctgtatgaggctgtccaagccattttttttctgtatttttctcgtgtccttttttcagtgcctggcagaagaatttaccaaaattgtcacactgacagaaaaaagcttaatagtaaagaattttttttttcaattacatggattacatggaggacggaaagtcattttgtttacgatcttgtttgtcctttcgaaattgagtggtgaaaaaccatttcccatatatatagaacactaaaggtaaatgataagcaaaatagtgaaacgggttgatatacaattgcatgagttttaaaatatggtcataagttacaaatcataattaattatttcaagttagtaatacttttttttgaagttaattagtacatgcatctttaatcatataaaagacacattcatcacataattaaacacgggtttagtatattgtctttgggcgtgcttaactcctttgtttcgattttgtatattgcagaggagaatatttataattacctcccgtacatctctacaatgattgatccacgagcgctggtggttatatacatttatcatgccaattgcggttcgtacacatgcaactctgattaattaggctatgttgtttctgagctgttggtggttgaaatccttaacatgctcatctctcctggtttccagaattttcgattgacacgcatgtggcatgctatgtttaatctctggaccttgatttatataccaatgagaataatatacatactgcatttaatttttgggctaatgtgtgcacggatgacatgattccttaattaactaggtgaaaccccgcgcattgctgtgggaatttagtatgataataataaaaaataacatgtaagatagctatataacatcagattaagtaaattaatgtggtttatgataatttaaatttaaatagtatgtagaatggtgatttaaacgtaaaaagtaaggtggtataactttatagaagaagaaaaatagagagatagtttggaccgtagattaatcatctaaaggctaaaaaaaattgatgtgatatgacttaattagaggaaaaaaaagagaaagataatttggaccatagattaatcatttaagcactaactaagtgaggatgaactatataagtatataggatatgataaaacataataaagatatacattgaaacattatgtgaattatgttgaatgataatttaacatgtttgtattttaaaagctcttaaattataaaaatataaagatatagcatgtttgtatgatgtttaaatatgatgattgttagtggatgatgatgtggtatcttgttagtggatgatgatgtggcatctttgcatgttaagcttaaggagttagtggaggataactttacagtaagataggatttctatccacatcatattcaagacagacagttatttacaagctcattcattagagaaaaaaaatatatcattgtttagaaagctggagattataaaaagcagcctaataaaaatatgaaaaggctagattttagctcttataatatctagtttattttctgggttctatagcttccgattcttataatctatataaaagaaattgtactactccctccgttctaaaatataacaacttttaaccttcaagatttatccccaaagataacaatttctccaccaacattctcttcctaaccaaccacaactctccaccattcacttttcccacctaccttcactaatcatccaatcacaaccctccaccattcacttttacctactttcttaataaccgtgttcaactctaaaacttcttatattctgggatggagggagtatatatttaggggagttagagattatgagagaaagttgtagctatcataaaatattatctatatgtttatacatattcctattccttttaaaataatggattaaaattcaacatgtatatccacacaaccaattcctatacatatgaaatgctataagagcaagtttaataggcggctataagctggactataaacttacgtgaagaagaaagaacttgaaagagttctgctatacgtacgactctagtcgtatggcccacatctgaccagcaatcagtacacttaagatctctttatgtgggtctaggcatgtagtagcgtacactagttggacacaggtcggacacgttgtgtatagacatttcaaatttgaaaaataaagagagttggctctcatgcaagagctagctattcacgtatttcaagatgaattcattaaatacatatatgagaggtagagaggggagaagaaaaatagcgataaccttatacctcatctactatatatgttaaatattaaatataat

SEQ ID NO: 48763 - DNA, 3484 bp, Oryza sativa
agaaggcaggcgtttaatttgaccaaattaaatttggtgtgtgggcgcctaaatcttttgaacctcatcaatcgattagcgtaattggagaatttcatggagattgctcatggattaggagacagtgggccggtttgttttacacgttatggtactactgagtaagccatgcatcttcttcctaaaagcattaataagttgatgaatccacattcggcgtgaggttgcatgcatttagcagaatatgcgtgtctgtaacacttagtttttctttcaaaccaacactttggttttttgtggcacaaaaaagttcagttgtgttggtagccacgttcaggtatggttgaaggccccagtccgctcattaatatcaacacgtttgaaattagacagaaaaacatatcacagagatgaactaataggtctggctcggttaatcatttttccaaaatttagaggagatttatttcactcctatttgaatgtaaaattaattaaccatactcagtctcttcctatccctttctctaattagggattaatcgacaagggctagaaggtaaatctgatgaccaatttctcttgtttaattttgacaagatttttttatgaattaagcaaaataattttcacaggagaatttcctgcattattacaaacgggtctggtctgacaaaggtgctagaaaattaataagctgtcacactactaggtcagttatctataatattacctggcaatcatatcagcttattaattaacttgatcttgcctactctgtctcagctttgtccattcctttgttgtgcaagcatatctagattgagttttcagtaaattggaaaaatcagctacattgagtttaattcctaagctcaccacttcaccgtgtgatgcattatgctgacaatatctttactactgctgatgacagatcaggtgaagtcgatctcggacgccgactgttcagcacacacaaccatatctacattacactgaacattcatctcttttgatctgagatcatatatatatatatatatatatatatatatatatatatatatatatataggggtcacttcctggggatctatatcagtatagtttctttgcaatacaactactttcagattggctactactttactttcgtaaggtactgagaatctttcagcaccaactgatcgaacagctggttcatacatgtgccacgtagtcttctgatgaaacatggagatgtgtatgtatgggagctcgacacttgttccatttttggtcagtaccctgcattcatatacccactgtgtcgatcgtgaattcgtgatgcagtcagtctcagataatgacggatcgatgtaagtcattgcctctaaataaatccgggccggggtacattgaatccatctatatggacttttggcttcagatgataatgtcaacgagattccaattttcatattgtctcttcggaaaaaaaaagagagagaaattgaagccatggaattggagaaaagaaataaaaattgctagcaaaaacagagcaagttcatgccgaaaagggtagtttaccttgaaagtgttggagtagctcacgcccagccaggcgtgcatagaacgctggcgtggtacttgccctgacctagaaccaactcgccgccggatgacggcggtcggcgggcgctcgacgtcggcgacagagttgggcgcgggggatgaggacctcgccggacgccacaccgaaccttgactcgaagacttcggcatgcaggggaataagttcactttaggtctctctatttgtcgtccagtctgatttttgtccctgaaccgtaaaattgggtacgacccgtcccccaacttacgaaaaccgggcaaacgaggtccctcgacggttttgatagcggttttggctgacgtggcgcctattcggctaatttgactcggtcctcatctcacatggcactgacgtatcgcttacgtggtaattcgatccggaaaaataataaaacccatgagacccacatgtcaattgcacacaaaataattaaaaatggtgggacccacgtgggccccacatgtcatcctcactcctttctttctcctctctccccatctccttctcttcgtctctatccccttttcctctctgttctctctccagcgccaccaccacggactcagccgccgctcccgccaccgccacatccctcgctggtgatcaagatgaggttccacggcgtgccggtggatctcgtgtacgccggcgtgtgccttccgagaggagaagcgagcgatggcagtcatcgagttgtagtttcataggatttgtgttccaataattaagggatagagaggcatgcgatattatatctgattgatcagccttacaaatgatcttcatcttgtatcttcacatatgcagtggtggtttgaacacttagttagtttgggcatcaaaccagtgtagcactcggtgccctcgtaatcgttgcccctcagcctcccaacctaacagattgagctctcatctagaaacgaagagtggagaaataggaccggtctaatacgcgaaaatgtttgtggtcatcggcatgcacgatcgagaaaacaacaaaatcggtggcacctgcaccttctagatcgcgatgccatgtgcattttgaaaacttagttggcaatgtactggcaaatagttatacatatgaactttgtcccgacacctgggctagatattgtgtaagctattaagcatgagaactagaaatattcagccagactaggtctcaaataaaaattatgaattcaaatctaaaattactgtatacttagtgtgtttcgtagtagatatgcgaatatttcttgggattttacctcgcaccatttatttttaggaaaaagttcgaattatccccctgaactatcgtggtcgatcgatttacccccctgaactcaaaaaccagacattgctcaccctgtactttttataccgatgaattacccccctcgacccaatccagagcggttttgtcctatgtggcgtacgcgtggaaatccagtcagctttttatttattaataaaaatatgggaccacctgtgagactcttatccccctcttccactctctcttctctcttttgcacgcatggcgggcggcggtggaggagaggcaagcgaggcggggccgtggcgggaaggcaaggcgggcgggcgcaggtcaagtggcggcgggcggtcagtgtgtggggactggcagtgggcggcggcgcgggacgcagaggcgggagcggaggcgggaggccgccacctgcacccccccccccccccccgccgcgcgttcgtgaacatccggctcagcacgctgaccttgtgcttccctccgccgccgccgcgccgatttccagccctcgtcctccgccgcctcgatgatccgcactcccctccgaatgactgcgtgtaccagacatcagcctcccccaaatc

SEQ ID NO: 48764 - DNA, 1566 bp, Oryza sativa
  unsure (1)..(1566): unsure at all n locations
catcgcggctcgatcccgaggtgcccaacagcgctgctcctccacagcgtcgtcgcgcgtgggcatcgagaggaaagccggaggcgcatgaacctatctcgcttggcgacgacaggagagaaagactagaggtggagcgaactgtttggtgcgggtcaagcagaggcgggagcggaggcgggactccaagggccagcggctgctcttgtccctcgccggagttcgccgccgccgcctctgcgtcccgcgttgcctccgcctccgcatggaaataatcgccgaattcgatacaaaaccgggtgttttgtgactgaattcaaccctatcatatacagtatatttgatcctttggatcttgttgaacttaactaggtaagcatggcagctcatggcggtggagacctcgaagctgcagctgcagcgcagtaccatgcatgccgtcgagggcgccgatccgcacgaacacgaagcgcctggtggtcgtcgttcggtcgtcgttgttcgcgagattgcctcctgtggacactggccttgctggggctaaccgtgctgctgctatccacgaggctggccacgacgacgacgctgcgcgggaggttccgtaaccacgacctcggcctcggcgccttctccgtgcacctcgccggctacgagggaacgcctaccgctgctcgagagagaggaagagtgagtgtgtgtgagagagaggaacatgggaaagaggaggtgagagagtatgacaggtgggccccaccattttaaaaaatgaaaatgttgattagattgccacgtgtacgtcacgtaggacaaaccgctctggattggatcgagggggggggtaatttatccgatattgaaaattcagggcgaacgatgtctggtttttgaatttagagggtaatttagtcaaccgcgatagttggaggggtaattcgtactttttcttattttttcgtatattggcatatgaggcctattaagaaatgcaaataaagataaaaacaagtacaaagtttcttatcatatgacttgacataaaaatgttacatacaaaagagcacaagagagtagtggcatcattagtgccagtttttcaaggactggtacatgtgaaagtacatatatgctggtttctattgagaactaacacatactaccttcatcctaaaataagtgtatccgtggatctccgtttccaacatttgaccgttcatcttatttgaaaaaaatttaaaaaatagtcacacacaaaatactattcatgttttatcatctactagcaaataaaatactaatcttaaaaaattttcaaataagacgaacggtcaaacgttagaccttgaaccgggcgcaaacttggacctatttttaggaccggggggggtnttttacattttgtatggggtcgcttttccctgaccgttgcgccctatgccaccttatttgaggtcgatcttcatatgaccgtggcaatgacgtggcggcttacgcggcaatttgatttgtaaaataataaaatttgtgggcccacatgtcatttccactaaaaaaataatttaaaaatgg

SEQ ID NO: 48765 - DNA, 5680 bp, Oryza sativa
  unsure (1)..(5680): unsure at all n locations
tcaggccctttgataaatctgtcacgctcgcacaaaacgaggaggtcgatgcgggcgatctcggcggcgccggcgggcatgctgcgggcgcggctccgcgggggcggaggcgacggcgcggggcggtggacgacgcccgggcacgaggagcggcccaaggggcacctcttcaaccggccgccgccgggggagtcgcggaagtgggaggactgggagcttccctggtacgtcacctccttcctcaccgtcgccatcctcggcgtcggcctcagcgccaagcccgacctcaccctcgagacgtgggcgcaccacaaggccctcgaccgcctccaggagaaggacctcgccgccgccggtcaggttccccgcgaactctagattttcttctttttttttctttcttttcaaacggtttgtactacgttatgtgtaattccgtaagtggattggatgaacctcaaactgataaaaaaaatgtacatctactgatgtttctcttgataactgtagtatgagtcatgattgtatctctctttctttctttctttttttggcatgatggtgaacatgttatacctttttagtggtttgcaaactgagatttttgcatacctgttgcagtacatttgtttgttggtatccattggcttataatttcctcctggttttggcaaaatgctacaatgaaatgcaccagtagatgaaaatgtcagatattatgcggggtaattcttgctgctggagtgccaacgattatcttcccctcttcgagaaatctctctctacgagaagttaagtactaggttatatgtaaattaaactgcgaaagcttatgttagtgacaggtgaggtttttaaggaaatgtagttgctcatgtagagtgagatagggtctgagtgaactacaagcccatggaatcgcgtgaggcttttgttgccacggatgttgtcctctagaggaaatggttgttacaatgcataatcaaatttagctggtcatataaagtttgaataattttcatgttgaatgtgacgattgttgttgaaagtcatagcctcatagggatcatgctaatgcatgtgtgacatactgatatgtgttcctggtgagcctgcattggccttatggcttttaaaacattgtcctggtttaacatcaaatattaaaagtgatactcccttctgctataagtaatatactcctcaaagattgacttgtgaaaatggttcctcaccaaaatgtgtgggatatatttctctcatgtctgaatgaagtggaggttcaaaatgtgctgttgaaatagagcatgaaggtatgtttaggtggctaaggtaatagcaattacaagaaagtgcaattttccatttggattaaggggtaaactacaaggattggttgtctgtgctcttgattagaatattaaagcaagaaacattttaaggtgggaaaatgaccttgccgtacagaaatccgataggcccagcggtgtgtccagacccacttcctaatattttgccatctctaatgcgacggtccctcagttgttacatggaattaaattgaatctctaagttgtttgcgctacccttcagctgtaaggactctcaatgcttctcttctttgaccatttattgaccttccctcttacaacttacaaggccccttgcagggttgggcctgtctatattcaatacaagaaggggtgcatactgaaatgctaaggctttctacaggcagcctatcttcctaaattgtgtaaactttgaactacaaggttgtgccatatgaacatttattagggcttctcctccagatacattctacagagacccagaaatccgagaggcccctgtaatcttgccccaatcagggtggctaagttcggatatcttgaaaagtttcactaaaatatttaatgtccactccaggacatcagtactatatgcctatngcttaatggaactgggttgttatcncattnttgaaataaatggctaannatatttgttaaatggatgcctccttttggaaagccttcacatgtgtacccttgaccaagcacttgaaaacaaaagtctgaaaaaaataacccactttacttaggcaggcatatgcttattgaccaacacttacctaacacattacacatattgtttacctgttcagttggtacatgatgcatttttgtgtctgtgctctgtatctgacaaataagctttacagtgaggattttttcaaattttgcatttgactgtcttgatcttttgcagcagtttagacaatgtgttgcactgttgcctcttgattaacggcgattcctatcgaagctatgaaattttctcctgcaatttatttatcactagttcactgcattattcttcatgctgtggtgattatattgtgcactgagtccctgacatctgagcatcctgtggatttattagatttgagcagtgtctgcatctttaccaacaaagcatttttgcactgtcactgcagcttttgttgtccagcatgcaatctcttgctcatgctatgattagtctttgtggacaccaatgctatcttgcagctttggcaatataaatttcttactctaatgatctaaatatgtataaatatagcctgccaaatttcatggatgcttttatatgatttgattttnaaattgggggaaaaaattttttttaancccaaatttntggttgttttcgttgaagatttagctcatgttgtcaaccgaactaccgaatgcattcaagaagtccttaaaccaattatccatattattagaattgttattttagtgctatttcttataagtctatgcgagctaaaaccataacggagtacattcttttatgccagtgaggcgtgaaccaaaccttttttccttagttgttgacatttcctaaataatttagtctacatgatgggatgattctgcttgttagggaccacaagcatggacatgaggcactggcattttgtttactgtctaaagtattcaagttaaaattgggtaactgtaagggctatacttcattatttcaattttttacattcttttatttaacaagcagctgctgaagtgctaataactaaaagtctatgaccaacacaacaaatcatcatatacttaagctgagtgcctgcatctaaacaccattgagtattatttgaaatttcttgtgcactattctaccagttaattgttgagagttgacatcatggaacttttggtctaccaaataaagatatgtcccttcacatttaacacattttgttttaccttaatgttacagccttcaaattcttagtcctttggacgacttatttaactcttcgatgtatatttgttctacttgctgttttggaagggatgtttgaaccatgtataaactttttggtgtcatgtatatgtctatcttgtactttcgcatgattacatttttccaactttgtgtatgcatgagctttcggaagagtttcagatctttagcagatgtgtagtaacttatcttacaagattgcaacttttttctaaagttatgaaccgatcttcctgttgtgacactaacttcttacctgatgatgcctttcaaagaaatgtagttgccatgtttatttgatgaataaagttttatacaatattttcctcatttaaaagctgagttactcttgctgatagctaatcttttgcatctttattatactagtgaaattgattaatttcactgatgctatccttagtgagaaccccaaagtgcaagttatagttgatgttatccttgaagaactccaaaaatgcaagttatagttcttgtcaaacagatattgagatataattatttcagttgcaatatcttgtgggaaaaaacttggttagagagtcaccacccacaaattatgcagtctcatcaaagttacatgtacttggatataatcattagtagggcgcctcatactgctccatctcaggtataacatataattctgctttattttctgtccctactgcatcactctcttgctgcctgttatgattgtgatccaacggatatgtatagctcaattctgttcatccctaatggaagtaaatgaaacattgctgtctcatcaccgttctacctgatgaattagctctgtgtgtatggtctcttggccctttcagctggttgcttggtttgcttcaccctccgaatcgtaactccaacgtgactccaggtcagtacattaacctactcctgtggctgtggttgtgatgtttttagtcagaaactggtagaatgggggatcagtgtaccacctaaggattgattgctgaggtactatgaagcaaccattgacattcaatctcacaatgcgagctgacaagctgtatatgcaaagcaatacggtggttgctgttggcatgtccttgtgagagcagtcgcggtcctaacatgctgctaagttaatttcttttttttcttttgtaggtccttcttactgaatactgatatggcctgccttgtagctccagaagtccagatctttctatatgccgaaattgctgacgagcagctagctagctctatggaacttctgatggatgggtttgctgacacctgtcggtcaatatatggagctctttttgcaggtatgacaatctttttttttagcaaactcccagtacaggtataattccatgctccattataaaaaagagaaaaaaaagggtataattccatgtgtctagacatccttttccaaagcctctttggtcaggatgaaagagacatattcaaactgcgtgaaaatgagaactgagaaaagggtctctcaccgaccgttagcagatccactgtgtgggggttgttggatccccacggaccaaaaccgaattgagtacacatagaggtttacatgataaatgtgttatacaactatacatgataaatgtgtcctcaaggaccacatgtcagtatgttacacagcattgcttaaactctgtacgactgtttggcatcattactggtgattggacatacttgatgagattagacgattttgctgttgagtgtagttatcatttgcttaatcttaatgcctgacttgtttagttccggagggcaaagtttgtcctcaaagtttcttttcccgtacatgacgaatttcaggtggtgtagcttcatgccttcaacttccatatagggatgcaagtggggcgggcaatcaggttttttttagcccgcttatctcatttctagtttatttttttttctaaattttgcactaccacgtaaaaattaaagtaatgagcgggtttttatacaggtagcgggactatccacttgcatccctacttccatatgagaagtacaacacattgcccatcttatgttcccccaacatgcgaaatataaagccccacttaccatgaagaaattccataatatcttacactattttttacatccattttctaaatatatggtgcagttgatttttctcacaaactgaacaatatttatcaagtacagtgagaaaagagtactactaaataacaatttagtactggattatacacaatctagtactatgaatttatacgctttggaacaggaaaaattggcatactttatgatagagggagtagaatgtataaataatcaaatgaattaaaaaataagtgtg

SEQ ID NO: 48766 - DNA, 3702 bp, Oryza sativa
tactccctccatctcataatttaaagattttaagtttttgttggcactgtttgaccactcatcttattttaaaaatttttagaaatattatttatttttttacttactttattatccaaagtattttaatcacaacttttcttttttttatatttacataaattttttaaataagacgagtggttaaacactataagcaaaaccttaaaatcccttatattatgggatggagggagtaaggtttagtaggctgtgaggcgcagcagaggccggccatcgttgacactgcgtgtgggcccatgcatcttgaatactccggcttgccggcggccgagggcaaaagcgtaaatatataaagactaaaaaaaatacctgattgatccgtcgttagcataagccaattctctgatacgcacggtgactggagccggccggtggacggtggtcaccgacagctcctcccggttaacctgaagctgcaccggagtccggtcacctccctttataaaaatcaaaaagagagaaaaaaaaacaacaagatctcctttcttttcatatctgtttctctcttttttttctttgcactaatgacttagccagaagaatatgttcttccactttttttttgaaaaataatattagtataattgagattgtgctctaattggtgccaagggagaacgcatattagacctcacctgactgcatctgcatgcaccagaagggcagtaggaaacaaggaacaaacatgaacatctgggcccacttgtctgtgaatcacatgcagatgtgcaatgttggtagtggtactgaccctcatcggttacccgtattccctaataatctgttttagcttattaaggaataaaaattaatttataagtaaaacttttatatatctgttcgtagcgatttaaagctaacactgtatagaaattatgttgcggatatcttaaaatttgacttcaaaattaaactcgaaaatataaaatttaacttttgctttaatttattaggccaaccgatgaactccgtggtacttgcataggagcagctagtgtgtgtatagaaaattggttggggctcttgtgtactggcaacacagtagatggatccagattgtcacagcttctttttttttttgtcaacggcgtgcagaatgcagacggatgtgtgtaaatatatgtgtcgtgttgcgtgaggtggggactaatcaaggacccatcgtctcgtaattaggtgatttggtgatgatgagaggagggatgtcttctggccggtgcacaaacaaattttactttattagaacttactactgttagagcacaatggtacaaagtagtgtacttcaccgttttaaaatataacaatttaaataatggatattagatataatctagtttcacgaatatggttatatctgatctagtactatgttgctactatattttagaatgacgggagtatatgctattctagggccaaattgaaatttaacgttgttatagattaacctcaatttttcgtgagcacatttccttaattgctaaatgatgattttttaaaaaaagcactacatattttttttctaaaaataaaaataaaaataaaaatatatttaagtttataataattaatatttgattaatcacacactaataatttatctcattttgcgtgctgtcaaatatcccctctaaatgccagaatggatgtagccttaatttggttggttattgctattgtatatgtaatatcatagctgataactagttgaatactccatccgtcccaaaatataagggattttgggtggatgggatgtatcctaatactacgaatctagacatactctgtccagattcactcgtagcactaggatacttacatccaataaaaatcccttatattcatggacgaatggagtatgtatttagagaagaattaacttcgtaaatgaagttatgggttcttttctcccctaaatatttgagcaaaagtactacccacatactccctcccttcagaaaaaataaattgctggctatgtataactagtagatgcccctcgcatcatagcaggacattagaactcctttgataaaaaaaaacattgatatgatagttgatatctcatagccacttcgatccaatggctgaacaatttatgacagggctaaatttgagagctcccatataacaaattaatgtatttagtgagtcgtgactatttcatagaaataggggataagctattcgattcataaaaataaaataccagtacaggagtgaggctaacttttaaaggggtgtattacagattagtatgttaagagggattaaggtaattaactagatgttttttcaccaaaaaaattgaaataaaaatggaataaagtagtgagacaaaaaggagaggcggaaagcatgcgcctatccaagacagaactggagtgcacccttttataatccccacagttcaacgtgcaacaaaggtaacagtatgcacctaagcaccgcacaagatcacatccaaagtgcacttaatttcatagcatatatagcataaaaattattgcctcacttgtacattgtttttcttgttgacgttttatatcgccttttgccatattagaacccatacagatcttcttttttgtaattttgaggtttttagccttacctctgtacaacattgctttacataattaatattcatacatatcggactttattcatacatttaggcacatcaaaatccatggttgagagtctggccggggaaaaaaataaagcttaaaatataaaaaagtacatactccttttgttcgaaagaaaattataattctacgttgtttagcggaggttaagctcgggtaaaaatgacttggatgctctttaataaatgaggtagtgttaagggtgcttttgggcagttcatttgggaatgaatttaactgtaaagtgattgatggagaataattagtattatgaacggtggtaggactgtttatatcatcctggaattaataacggaaatagaggtaaataaatataactatatgttaataaatttggccctcttcacgccagttttacaggttaccaagcccggtttagttcccaaatttttttcacaaaaataccacttcaaatctttggacacatgcattaaatattgataaaaataaaaactaattgcacagttaagaaggagatcgtgagacgaatcattcgagcctaattagttcatgattagccataagtgctacaataacacacacgtactaatgactgattaattatcctcaaaagattcgtctcgcggtttccagacgagttatgaaaatagttttttcattcgtgtctgaaaaccccttctaacatccggtcaaacattcgatgtaacatctaaaaaattttcttttcgcgaactaaacagggcccaagtactactataatgacccaaaaaaaaatctcacatacaccgccactgatgtcacttgtgagcaaaagaagctaagaggctcatcggttgcccacatttcctaataaatcaaaagcaacttaaaagctaacgctaaaaagaaatttatattgaaaatatcttaaaattaatttaaaaatttaaaatttaacttttactttaacttattataggtctaccgatgggggctttaaaaaaaattcctaagaactcac

SEQ ID NO: 48767 - DNA, 3641 bp, Oryza sativa
gacacgcacggttgccatcaccgttcgacctgctgattcattcctgcgactgcgagtgctgtttccttgtcgtttaaatgggcaattcggttgcggattaggattctccgggggtagatgtgtggtgccatctgcatttatgacggaatatcgtccaggcaactagtaatgatttcttcttttaagatgctctttgccatgctactactagtagttgcttttgctgatgattggtttcttggccaatggtttggttgttgttttttttaaaaaaaactttcagggggctctgatttcttgtttcagttaaccgcccatacgaaggagtctactggcaaaattttgctctctattttttttttctgcggaatgatttcattttgatgtatgatagcacttcatagtatgataagtctggattttgattcactgcataatcttctgaatcataaagttggtgttttcctcggtgtcgatagtgctcgatcttaattgggcatgctttggttttaattagttgatcgcctagcaaaagttgctacaaattataatgattaatcatttggactttattatttttccaggtaccacaattctagcagagattataaatattcagaaatgggtgccaaagataatggggaagtaagagacgagaagggggttggatcagattatgaaccggccagagtttcaggagtttccaagaaactcatgagaaaggatacaagagaaaatagccctcgcatggcaaaaagcagtggcagccgtcaagttcagaacaagctgcaacataaagcttcaaacaacattcagagtagatctccaaaacccaggaaagttgttaacgctgcgaaatctgctgaagttagaaggtcagatactgtaagagttccttctcgtgctccatcagagctttctgaggaaacagacgatatagttagcgaggctggaaccgttgatgatagtaaaggcaatgaagaggccaaggagattgatgtgctagatgaagctccacattgtgatcagagcactggtactgacgatgaaattcctgaaattgaagaaaagatagttgatgatgagaaaccagttgtgtatcaaaggaatgaggagttacaatcaaagattgacaagttggaacaagaacttcgtgaagttgctgcgctcgaagtttccctctactctgtattgcctgagcacggaagttcggcacataagctgcataccccagctgggtgtctttttaggatgtacattcatgcatcaaagttttggtcctcagataagatagcttcggtggcaaaaagcactgtgtgtggcatagtgcttgttgcgaaatcatgcagtaacgatgcatcaaggtaaaatatggccacgatatgcctctatttcaccttgaatataggtcataaccatcaatttccttgaattaaactctgctctcttgtagattgacattctggctgtccaaaacagttgtgctaagggagataattgcacaaactattggtatctcatgccaatcgtcttcaaccattacagccatcaacatgaatggtagtgcaaaaagtcttgatgggagaccgatgccaatgctatggacaaatagctccagtgggcaaacaaaccaaatttactggcatgcaggtaccggatgattggcatgaaacaagtacacttttgggtgcattggagaagattgaatcatggatattttctcggatagtagaaacagtgtggtggcaggtaaaagttagactatattcttgctgacacatgcatgaaactgagcatcccttgctccaaactggatgttctagttgagtgtttcacaaagaaatagctcgcaatgatattgttctgtgattatatctgatttctccatgttgtcaattttctgaagaacgtttgttgttcaggcactaactcctcacatgcaaactccggtggaaggatcgtcaaccccaaagactgggagagtgttaggtccttctttgggtgatcagcagcaaggcaccttttctgttaacctgtggaaggctgcatttcacgatgcattcaacagaatatgccccctccgtgctggtggacatgaatgtggctgtttaccagtattggcaaaattggtattctttgacatccttagcttgacaaaaagaaaagaaaaacatttcttactgaaaatattaatataaatgttatattcatgtgttttgtgaattatcaggtgatggagcaatgtgtaggccgtttagatgttgcaatgtttaatgcaatccttcgtgaatcggctagtgagatacccactgatcctatatctgacccaattgttgacccaaaagtcctgccgattccagctggtgatctaagctttgggtcaggcgctcagctgaagaattctgtatgtacttgattcagtaccttttaagtgctttctcagttttcctttatttactcacaatgatttatgcatgggaagctaaacttccgtgcataaactctagaatgcaaacgtgttgttttcttaccattgcacttaaaatagcaaatttatatgaaataaaatgcatatgcagatcggaaattggtcgagatggttaacagataactttggaatcgacgctgatgactcaaaggaggatggtaccgacacaggaagtgaaagaagtgcagctgaatcaaagtcttttcaactgcttaatgaattgagtgatctccttatgctcccaaaggacatgcttatagaaaaatctatcatgaaagaggttagtgctcatgcatatttcctgatgaataattgtactgttatctatctacctatctagcaatcagttgagctgtgtttaatactataacctctttgtcagatctgcccttcgattggcctcccgttagtaacaagaatcctatgcaacttcactcctgatgagttctgtcctgatcctgttcctagcatagtcctagaggagctgaattctgaggtgttgtttctgtcttgaggaaactttgtagtctagccttacaaaacttgttcccacaacgaagatgcatacagtgcaactttgtagttaacatgatacttgatgttatgcagagtttgctggagcgatgcaccgacaaaagtgcaaccagcgcatttccatgtatcgctgctcctgttgtgtaccgccctccatccctactggatgtggcagagaaagtggcggacactggtggcaatgcaaagctagacaggagagcgtcaatggtccagaggagaggatacaccagtgatgatgatctggatgacctggattctcccctcgcatcccttatcgacaaaagcgctccgcctttgctgtctaaaggtagcgcgcattttactgctcaaagaggagtttccatggagaatgccagatacacattcctgagagaggtatggttggagaggcagtgattggtgaacctgtacaaatccagaatctcttctttagctaccttaaaaagggttgggaaggaaaacctgctgaggtgaaacctttgagagaagttgctcacttgcagagctagttaactaaacaagaatggctactgtcaaaatgcaaacaatttcgtgtacattcatatacatatgttgttcgtttgtagtataatagaag

SEQ ID NO: 48768 - DNA, 1190 bp, Oryza sativa
acaatcaaaagtccctaacagtgcacaaccttccttgctcatattcatgcttttgctgaaatggacattgatggcaaggtaaaataagacaacaaagacgcatgaataggttttgtgtgattaacagctgcattctgatataaccataccgttaaattactggccagggattgttaccattaattattatttggtattcctatgtttcacattctttctttaacaatggacaaccttccttgctcatatccatgcttttgctgaaatggatattgatgcttcaaccagaagagcagaccttggatgaagatagctagggctatgatgggggaagcggacctctggcggatggctagatcccttcgcttgttctttggtcaccaaatcattcgggagattaggcttctacttttctcttcccctctcctgtaccctgtccctttttttttatttttcaggcccgttctgtaaatacatttattcctcttcataaaaaatgcgcatctcgtgtattcccaaaatggccaaggtaaaaaaagacaacaaagacacatgaataggttttatgtgattaacagctgcattaagatataaccataccgttaaattactggctagggattgttacaattaattattatttggtattcctatgtttcacattctttcttttagagaaaccatctctattttacgttacaagacattctgagttttaaatagttaatacgtgtatgcattatgtgctaagagacggagaaaaacccgaaaaatgaaaagattaaagcggcagatcgagtctcgccgcttctcgatttctcacgcatacgtatgagccacgtccttgtggctcaggcaccagcagcccagtagtcgatggcccaaggcccaagccagctgcaccagccaaagctctcagctcccaggcacatgcatgtaacttgtttgtccattacgttgcaccaatgtatttcttccacaataaaaaataatggttagttttgatccatatatttttaaaaaataacatatttttcatgtcgaaactatatcattgaatttgtgtttcttttcttttttttttacaatccctagacatgtatttggaaatacctattaatttgtagtaaaggaattagtaaaaaaagggcctttttttttttaataaaatagactaaaaataattttaa

SEQ ID NO: 48769 - DNA, 8125 bp, Oryza sativa
  unsure (1)..(8125): unsure at all n locations
attttaaagtgcctatatataacatagtctcaaattataggcactcttatgtttaaaaaaatcaaactcggtaacttttcactaataactatacgaataatatctacaccagtattatatacgttaagtcattacattcatattttaaaatacttttatgtaatgctaattttatagttgttgattatataatacaaaataaattaatgattaaattatgttattgaaaaccgtgtaaaaatacaggtcttataatttaggacagatggagtaattcataacacatacaaatgtaatttttaattactaaatagatatatgtctttaaaatatgctaaactagcgctctcacggggcagggtgcatctttagatatttcaaaaacgcaacaccaaaatggatacatactggaatatacatttcttttctagaaaaaagaagaacatgcattttcaaaaataaaaatcctcagttccattggctcaaatacaaaacgtgcaaattcataaaaaagaattacttattaacccggtaaaccctagctagcagcgtttgttactatgctttccgcacaatatagaagttaaacctcaatgtagagttttgtgaagtgtgtggaactgaattataaatgtaaaggtcatatctattacaagggaccataaataaaaatagtatgtttctgctacaaaccaatagatcgatcgatgcttttttttatcagtatttaaacctaaaatttaaatcccattaaataatactagtatgtgtccaaattcatatggatattaatgaacctaaacgataaatttatacgataaatttatacggatgccagtaaacctaaaggggagaagccaaaacgttgttttatgacgtgaaacaatgggggagaagccgtggaacggagagagagtaccatccaaattttgctggtggtatggacgggattctcttatctcaaaggtttactgtatagttgacacctcaaagcagagttatccatcaaagtaacataaacccatgatttataaaagtcatggcaaaacatcataccatcaaatttatcccatgggcctcatgtatgaatatgacgagcaaccacaggcgatttcccaaactggagcattgagtaccagagcttataccagaggcaataatgaacactacatgaacaaaaaggtaaatccatggaatatatacgaagatagacagcttgcgatgtgctatagtccaaaacttctgatttgccaaaataaagtttgatgttgcaatgcaaactaaactcattctaaagatgcagagaaggtaaagcttaatccgtttcgtcaacaaccttggttcccagccccttcaaaccctcaggagggacctcggccacagtgaccagagagtagagctcttccttggcatcctcctcgtcattcctcttgcgggcgatcctcacacgaaccctccgcggcacactcctgatcccactgctccagatgtgcttgttgagcttcacatcgaccctgacatctgtagtgcccatagccttctgcgcaaacttcctgatctctttgatggcattgggcgccttcttcttgaatgtactattcaacataagagaaaaccattagagttatccatcagaacaggttgtgatattcatgtttatgaacagtataatgtagtgatggcataatgttgtgttggatgagaaatcacagcacttgatttctagaggttcagttaaataactacataaaacaaggttaaggcagtaaaaataggtcaccatgccaagaaaataaatatgcaggacacgaagttaagatcatttcgtgttcagataaatacattgagtgctgattaaattcaaaagcgagcactacgaaatacacaaaattcagtatgaaaatttggtaaaaggaccaaagaagcatttccttggtcttcattatcaattattaagtttgtgccacatttcaaatattagggtaaacccagtcagtgcatccactagaattcaattaacaagtttacagggtactcaatagttgcatccaaaatgcaaatgcgactcgcattgtgcccatcaattagctatatacatcttcccaaggaaggccaaacgagttaacgactcattgaacagtccttaagcatagcttgataactagataacttgttgggatgttgttggtgagcaatgacaactagttgcaattccgacgagcactgggcgtggtagtacacaaatagaagccaatcttatcttaggaagaaaacacacgagaacaacaatgagcacatttaccaccgtaaattcaaatctaaaactactgttcagggcatgcaattcagatgtaataaaggaaaaaacaaaaaaaaaacaattgagtgatccatccatcgtatcagatctcacagttgacgtagcggggaacagaagaggggaggaaacggaaggacgtaccagctgtggaggcgcttgtggaggttgatggtgtactccctcgtcaccacctcctccttcctcgccgctcctcccttcttctccaccatcttcttctccttcttcccttcgccctaggctgggtttgccgctgttccggcggcgcgagaggaaaccctatctccgacgcggtggtgcctttcatacctgcacctcgctgagtaccctgtgggccgttggaaattccactcatgggctgggcagggccacgctttcgagccgagcagaggcggatgggccgcgtttcgcgtgtgttcatgggtcccgtctgaccgatatgagaccaaaggcaaaaggaaaaaaaaaagttaatgggatccatgccactgcaacttttgcgaaataaaaaaaataccactactatttgtcatatcggctacatgccactggaaatttctaaaattgaaaccatgcactcccatccctttttccatctccgttcccgtcctcatcccctccctccttcctcatctccgttcccgacttcatcaccctctccggcgagcggtagagcttgaggagggattgcgccttccctttccctctccgtcgtcaacacgatctcctccttcccgccactacatattcctcttgccggtgaacttccaccgcacgcgcacaagcacagtcatcgtagactgcggcgatctccatggctccatccggcggggtgatgatggggtgcgcgagcacgttacacttgaacgcctgcgcgtgggcaacgcacacggctgcgaggcacgcgaagcctgcggatgggtaagagggcggggaagacgacatgcaagggcggcgaggagggagaagatgaacggggtgggcggcgaggcctccggatgtgggagtagagggcgagggaggcggccgcgggggcgcagcggcgggctagcgtggcgtggagcgagtagccccggaagggcgctgacgagaagacggcggcagaggaggaagttggggtccggagctaggggaggaggcagcggaggcggcgtaggagctcgggagccgccgccgccgtcgttgtcctcgatccaatctgtggccgtcgctgccgtcctcgatgccatctggagctcgggagccgtcaccgctgtcctcgatccgcaacgggaggtctcgacagatgccgccgccgctgtcctcgacaccatctgtggcgggagtgcacaggagccgctgccaccgtcgtcgccattgtcctctttgccatcgcaaggatggaggaaaagatggggaagaaagaggagggagatggaaacggttaaaccggggggaacgaaacggcgtgagagaggagacggaaaaagtgacggaagtgatatggttttaattttagaaaattctagtggcatgtagccgatatgacgaatagtagtggcatttttttaatttcgcaaagttgaagtggcatggatccaattaaccaaaaaaaaacctacataggggatccgcatcttgtcaccgaatgccaagatcgtccttgaaatgtaaaaccggatacaacgtatcctctaacttacaaaaccagtacgaacgagatctctcgacaacggttttggttgacgtggcttctacgcctcctccaccgccgtgaggagcccatctgccgtcgttacacctcctccgccactctgcctccgccaccgcattgaggagctcatccgccgccgctatgcctccttcatcagcgatgccgctctgtctcctccaccgtcgtgaagatcccgtccgccgctgctatgctggcatcgccattccgtcgtccgccgccgctacgcctcatccatcgtcgcgacgagcccgtccgtcgcctctacgcgcctccttctctatcggcgtcgttgcttcgcctcctccaccgccgtgaggagcccatccgccgtcgctacacctcctccgccgctccacctctgccaccgcagcgaggagcttgtccgctgctactacgcctcctttgtcggcgatgccgctccatctcctccaccgtcttgaagatcccgtccgccgctactatgctggcgccgccgttccgtcgtccgccgccgctacgcctcctccgtcaacgtttctgctccgcctcctccaccgacgtgaggagcttgtccgccgctgctacgcctcctctgccggtgtcgttgctagcttcgcgtgctccaccgccacgaggagcccgtccgccgctgcttcgcctcttccacaaccaccgctcctttccccgatcgcataggttcttgccatcattgcatgccggaccagagaggagaggctgactagtgagtcccacaccagtttctacccagcgttcctatgttgccatgccatgtaggcaaaagtgacaaatagttaagaagatatctcttaagaggaaaaaaataagtgcaaacctatgaggagcatttggataattgtcgaatctaaaagtgacaaatcgtttcccggggtgggtgggggagagagactcccaccgtcttgtcattcttctctactcttttcatcctataatataagggattttggttggatgagatatatagctaaaattttaagttttataatattactatatatttcatcaaaccaaaatttcttatattatattataggatgaaaggagtagttctctgcatacattctgagttgtcccctgatcccgaatcatcatgaccacggggaagcaaggatggagcctcctgtggaactggaagcccaatcctccggcctatcctacattcctcagcatgaccacctgccggcaatgttagaaattaatctcgttcttttctccaataagagttggataaagattaagattttcatggcacgcttttccaattgctaaacggtatgtttcgtgcaaaaacttttatatgaaagttgctctaaaatatcatatgtatctacttttcaaatntgtaataattaaagctcaatcaatcatgcgttaataccaccccgttttacgtaaaaaacttaatcttcatcttcaagaaaaaagaataccatggcccttgttgggattctccaggctattaaatacccatctggaatattgctatttagaagtaataaacgtagattactgacaaaacccattccataacctctaggctattttgcgagacgaatctaacgaggtatattaatccatgatttgctacagtaatgttacagtaatcatccgctaatcatttaaaatgttacagatagacaaatacacaagggctttgttgctatatctctgtaactagctggtgttaatgagaagaaaacagagaaaagggcgcacgttgtttcagtgccacaaagctcttgtgtatttgtctgtgttcgtgtttcttcctcgctgcctcatctagaaagtgtagcctgtattcccgtgagttgctttgatccctacaggcaagatatcgagctgttgcgcgcatcgatgagaagcggcgtggggatggtgagtggcgacgggagcgggagcgagagcgaggcagccgccagatcgggcgaccatcgctggatccatcggctgccattaacccaccacgctaggcttcacccagtggcgctgctccttgggcgagagggctccgtccgtgttcttgctttccttgcggagaccaaggccgcacggacgcatgagttgagctcacctgacctgagcggctctgcttgaagctgatgctgggatccaatttccccctgcattgattttacccattcagcgggtgtttaaattcaggggtgtaaagttttggcgcgttatatcggatatacggacacacatttaaagtattgaacatagtctaataacaaaataaattacataatccgcctgtaaaccgcgagatgaatttattaatcataattaattcatcattagcaaatggttactgtagcaccatattgttaaatcatggagcaattagatttaaaagattcgtctcgcaaattagttgcaatatgtgcaattagttactttttagcctatatttaatacttcatgtaggtgttaaaatgtttgaagtgacaggtaaaaaaattttgaggtgggatttaaacataccctcatagtgtggagagctagctatgtacagaatattcagttagattaggtctcaaatacaaataataaattcaaaactaaaattactacgaacttagtgtgttttgtaatagatctgcaaatatttctcgagattttacctgacaccctttattttcataatttttattttactagaaaaaaatacccgtgcgttgcaacgggtaaatactatcttaaatcttattattgttatacggtttagctaaattaaaattcactgtaggaatttgcttggatattatttttacaagatcatgaactataattaggagttcaatcgttaaaaattagcatgtaaggttttgaaagagatttcttatatgactccttctatatttctaaaagcaaacgaatttaaaaacctacttaaatataaatctgtaatttcaaaaggcaatgaacttaggaagaaaaaacacgagaacaacaatgagcacatttaccaccgtaaattcaaatctaaaactactgttcagggcatgcaattcagatgtaataaagaaaaaacaaaaaaaacaattgagtgatccatccatcgtatcagatctcacagttgacgtagctgggagcagaagaggggatgaaacggaaggacgcacgtgtaccagccgtggaggcgcttgtggaggttgatggtgtactccctcgtcaccactagggctgggcaaaaagctcgaagctcgttagggctgggcaaaaagctcgaagctcgtggctcggatcggctcgtttcaggctcggctcggatcgactcgagtttggagtcttaacgagccgagccgagccagctgttttgctcgttaagcaaacaagccgagctcgagccagctcgcgagttactcggtaggctcgttaaactcgcatagctcaaaaatcagacatgcagcccaacccaataaggaagcccaagttcctagcccaacagcccaagtacccagtaaaaaggaaaaaccgtagctttgaccatcctcagtcagccgagggcccgaggcgcctctctcgcgcatgccgttgcaggctgctgccgtggccttctcttgcgccactgtagcgctgcctcgtgccctcgcccttctccttgcaccgccggcccgccacaggccgcaacattgccgttgccctgcccaccggctcctcctcccgcaggctgcagccgcaagggccgcaaggccacggcgacgactccggtcgctcctcccgcagccacagcgccacgccgacgatgccgatgaacgccgtcctcccaccgcagccgccaggccacgccgaccacgccccttctcccgcagccgccgcagggccttcatggatagggagcgccgattggcaagcatggagtccaagaaccacagcaaggggaagaaatcatcagaagcttgtccaggcagcagccacctcgcctctgttcagaagccaccaagacaaagacctaaatcaaatccaccaacctcacatccagtgctgcatcaatttttttcacaatctgtagcaattttgtttcctcattttatcactgattgaaccat

SEQ ID NO: 48770 - DNA, 1883 bp, Oryza sativa
attatgtggtagcaatagcatacaatctgactatttaattgaactatttaattgaacttgcagggatcagactcgaaaaatgaagaattttataagccgtctgtttcgtctgatagcacaccctcacatttgtcagttcattcctcaagtcaagataaggaagtggatggggaatctacagatgagggcaactctggatctccaggatcaaagaggaaagggaaacgaaagaagggtatttttgtatcccctacaaagagtgtggcaagggttaagcgttcagattgttggaagcttttcaaggttgtggatgttccatcaaaaacggagaaaggggtcactgagacgaaggccaaatgaaggttttgctataggctcattgcctataagaaaggtggtgctacttcaactctcaatcgccatataaagaagtgcacggcatatttgaacaaattaggcaggcagaaggctcaagctttgcttggctttaatcccgacatggcaggtgcctctctcattgctactctttttgattatgatcatgaggccactcgtaaaatcattgctaagatgataattgtccatgaatatccatttaggatggtagagcacctctggtttaatattttgatgaaatacatgaatgcagcataccaatttattggtaggaaaactattagaaaagagtgtgtggatgtttacaatacagaaaaagaggttcttaggaaagcttttaaaagtgttgatcatgtaaacttgacaactgatttatggacttcaaaccaaaatatttgctatatggcattggtagcttattacatagatgcaaattggaaaatgcagtgtcgtggactgaactttattgaattggatccaccacacactggagttgagatagctcaggccatctttgagggcaataatgaatgggatatagagattaggttatctcaattacccttgacaatgcttctaataatgatagggctgtggccaattaaaggaccagttcattggtaggggttcataagagttcatgcctcagtatttttatgtccgttgctgctcgcaaatagtgaatttgatagtgaatgatggcttggcaccattgggacctttgctagtaaccttcgagagacttgcaagtactttaagaagtctctttctcgtatgcatagatttagagaggtatgtaacaaaatggattgcctatggaaaaggtttgtgttttgatgtgccaacaaggtggagttcaacctataagatgctttgtgcttgtgagtttacaaaggatgcttttgttcaatatgcttatgtggatgctaaataccaatggcaacctttgcttgctgattggttagtcttttccaaaattcatccaatattgaaggcacttgctgaagtaactactgtattttctggatctacataccccacaacaaatgttttttatccaagcattgtgaatgtgaagagggcattgcttgctgcatctaagtctactaatagggacaaggttttgaagaatatggttgaagctatgttggaaaagtttgataaatattggaaagagaagaacaaacttatgatcattgccactacccttgatcctaggtttaagatgaggtatgtgagttggtgttttgttcaaatgtatggtgaggaagctggtcaagttgaggaaataagttgattaactctttgccacggctgaaacgacgcatcgccttgaaaaggctgcaagaaacaggggaagggatgaaacatccacttcaaccattgacacaagtaactcattagcttcagttaaatcttcaagtgagttctagatatttttgcaatctagctctgcaaatgtatctaagtcagaatggctaatctat

SEQ ID NO: 48771 - DNA, 10887 bp, Oryza sativa
ttttccatattgttggccatattcaccaattgttattaaaccaccagcatcttcatcatgcatgtaaaccgttattggcatcctatgaacagaatatgatgttagatctctattactctataagacaacagctgaaagcagtgttcatacttctatgctacctgatagctacattttcattccaccaatacaagggtgtacttggttttaaaaatccaactaccctaaatttaatcaattcgattaaaaaaatccaattcatcgtctcatggtgatattgttggaatttaggtctcaaaatgatttgacttgatcaaatcccttttctgttcacacagacatctcacactacagtaaaaacaaaggtttctttttcttttcattatatatatgtatgttgtgttatatggaactctataatacctgaacgatataaaattttagctggcaagcacaaatataacattttggtgtcattaccgacagtgatagctatgaactatgacatctttgaaatcaatgtaactagaacacataatagaccctactacttactcaagaacatgtgaagccatgaataattctggttcaccgccccacacatgtggatgcctaatatgggacacatatgtgtcgaaatctccctcaataaacctgcaaatcggtattacatcaaaacacagtaatcgaaatatattgatgataacaacttacagcagcattaaaaatgatgagaaagggtatcaaatcaactaaccattccgattcttcccgcctcttaacaaattcatcagcaacctagaaataattaaattatatctgagcttagaaaagaaacaacacaaataaccaaaagtatgactatacacaagaaacaagctataccattgccctcaattcgtcagctagctttctctgaagatcttcatttggtatgggtcttcctgccctaatgcatgccccatgaatcacagagcggaataagcatcttccatctccaggaatccctaggggttttgtaaataaatcacatgttatcacatactactattctcaagatccaaattaacccccaacaagcaaaattgctaaacctaaaaaaatgaatacccacctgttactgaataatccgtatagacttctttgccatgagttgaactggtagatgctgctgaattgctgatgcttatctccacaggaacctcagcatttgctattccagaaactgcaaaacctaagcaaagtccactggttgtacctcctattttttgatgcaaacctctccatttccagctcatactagagaaattgtcacgggaaggcatgtcgagcttcatatttaaactaccttctttgcctgacagtccacaacggaactgccgacccactaagctaacaaagtacctcagactaggccggtcagaagattttatattcctatgtagagaacaatcgacaagacccagcttcacattataactggatgtctgcgagcgtgaacacttccgtaatcccaaactctgtgttaatcctccatgaaactgactagattgggaatacatggtacgtttagaaggtcgccgcaaattgactgcagatgagtagagccgcatccggtccaaccaatatcagctgtacacgaatgaccaaattcaatgtcaaaactcatgcaaaatggtgacatttttatttccaacttgcttttgttttgtttttcaaaaaaaaaaatatgacacccgttttattgcattaatatgagaaacacaagattagggtcttccaactaaagtagatcaatcagttcagcaacagcactactccacacgatgttgttcagccaaaaaatccatacaaaagattttgcgatgacaaagcgtacactcgaaaataacgaagtcgggaactgatactacatggcttttgctaacgataaacaacgcgaaactattagtattactaacaaataaacatatccgacctaccaaaagcaacggaatatcaaaatgctgcacaaacaaaacattcaggtacgcagcaccaaattctccgcgcacaatctctcatctcaacgatggtatacacatacaccagcatagaaccacagccactatagacgagggatcagaggcacataccagcgaaccaacctaaccaaatccagcgaagaaaaaagaaagaattcccctcaattcctgctaacaagacaaggagaagcagaggggggatcacgctgacgcccccctgggtcctatgtaagctaagattcccccacctttgcccttcccttgggcggcgaggagaagtgaaggggaggtgaaaggaggagtgtgtgcttcgatttcgcttcgacgcgggaggaggaggaggaggaggatctcgcgaagtgtatttgctgcagcgagggaaggggatgccattggcgatgggggaggaggaggaagctgaaggctcaagtttcccgacggtcgagaggattccggaacgaacacgacagagtacggcgattgtggggctttgttatataccattccatgggcccatcacgcctgaattgggtggtttatgggcctattgtttacagccgttttagtccttaatgggccttgatttttgctagccaggaggacctaatgcgtcactggtaggggagtactccgtaaaaaaaaaaaaaatcaacttcggactgcgagcctatgtttaaatttataactagaaattaatttttatgagatgaaggaattaatattaaagagattgtctcaagcaatcaaacatatacatctctagatctggatttatgataaccttttgatggtacttatctgtccatatagcccatgcgaattttttgataaatatatgtgccccttcggcttggtgccaccgctctgaccgccccgccccgccgctccgtccaccgcactccactctgcccgtcgccgcctcgttcatctgcccgccctgcgctcctgctgctggccgccgccgccgtagcgccggcggctagacctccctggtgcctgaagagaggagaggagagagagatgaagtgaggggaggtggggaaagaggaggaaggaggagactaagaatgacatgtaggcccacgtgggccccaccatctttattttttagctgacatttaggcccacgtggccccaccatttctttattaatttatatgtgaaactgacatgtgggtcctacgaagtttattatttttctagatcgaattgccacgtaagtgtcacgtcaatgccatatcagataaagaccaagtcaaattagccacgtaagcgccacgtcagccaaaaccgccgagggacctcatctgcactggttttgacagttgaaggacctgttgtatctggttttctggttgaaggacgaaaatcggattcgttgacaagttaagggacctcagatgaacttattccaaagaaaacaccaactgactatgagcctatgggcctgtttgaggagcttaaaattttaataagcagctggttggtagctagcttttgagaatttcttgcttctcattttctgaattctacaactacagcttcttagaatataaaaaaaacaggactgtttgagaagcttctaattctgagaaaaactgcaacaactataagtttcctaaataggctctatgtctagattcacagccagaagttaatttctacgagaggaaggaaatagtactgaagagactgtctcaagcaatcaaacatatagtactccccctagatccggattcatgataacattttgatggtacttgtctgtccatatagcccactcgaattttttgataaatatctgtggccatgtttggaacgaatgaaaactatattgttcgttcctgcagaaactaaagtaatctagcacgtatccaacctttatttgaaaatcttgtatgggaatttattgatagcaccgtaaaaatcatgaaaaacgaagtaactatgtgattttccttcttaatctgatagtcgagctatggccgataggatatactagaaaagaagcagccaaagataaattacgagtaaaacttttaggctgcgttcggaaggggttcctggcacgtaaaacgaagcacatattcttacataaataattaagtattattatttttgcaaaatggattaatataattttttcaaaacaactgtcgtgtgtgtgggtatatatatatagttgcataaaaacacgccgtttagtagtttaaaaaacgtacgcgtggaaaacaagagaggtgagttgaaaaaagtggcataagaacacatccttaatctatattattattggattaagaatcaatgaacaataaaaatctaaaaccaacttcaaaatttagtttcaaaaccaagatttttagtcgtggttaataaacaacataccgacagagttatagacgccgagagatgtctagctgaagcatccaggcttggtatttgcttcgttgcttgtggcaacacatggatcatggatgcacctgagtccacaaaccgaaaaggaacttcgcaaagctccaagaggaaccatgttccatgaaatggcctactggccctatgcctcatgtggccacatgattaaagaaaatgtatttgtaaagccagttaccttctcctttgctatctgctttagcaaaggacactgtcacaaaaccatctctaacttggtagaaaaaaaattctaaggcttacgcctatgaatcccttttcgatgggattgaaggagattgaagtaataaaagttcatataactgttaaccctttttccgttgggattgaaggagatatgaagaaaaataattccatatctattgagacgtggaactaatcggtttagattctttagtattaaccgaacgagctctaacaagacattacaaaaatgctaaaattcgtgcgctgatcaggctgaaataacagtagacgagtcaaatgcatgcatgtcagcatgtgatctgatacatgaaccctatactgaactaaaactacttgtagagctatagggcattgatacggatgaatgcacatcacgagtcaggacagggacgtgcctatggttcacatcgtttggcttatttcctaataagtcaaaacagcttattagaaaataaaaatgaatttgtagatgaaacttttataaatatgttttttgatgacttaaaagccaatgttgtaaaagaaactacgttaaaaatatctcaaaatcaattttaaaattaagtttgaaaatttaaaatttggctttttctttggctgattaggccatccgatgggagcatatgatcagtggcattcagcactctgtctgcgtggatttggttattagattatccccaatcgatcaatgtaatgctccatcagtttaggctaattattaggtgccgacccttaactccgggcccgcgcaacgcgcagatcacaagagccatgagtgccaggtgggcccaccggtccagacagctgtgctgtggtgctgcagcccggttccccatcacccacccctgtctacgatctgacctggtccaccgccgcattcacgtcgttggctcgttgcatgtggcgtggtcaatcactggtcaattattatcaccattttatctactagtcccggtcaattatgagtactcccaccatactataatacaaggatattttattaaaaaaaccttttagaattattatttattttatttgtgacttactttattatctgaagtattttaaacataaattttcgttttttatatttgcacaaatattttaaataggacgagtggtcaaacagtataagaaaaagttaaaatcctttatattgaagagagtatttgggcagtcaatctccttctcactcctcgagaggaaaaaacaaattgtgctgaaataacatgtgcagagatgagaaacaacaacttgtagatgaatatttttctcacaccagtcaaatacggatgaagatcctctaacttaagttaaaagaacggatgtctctctgatatatgagtcataccttctagactggtagggattcatgtttctttaactttaaattagtggagcttcttccgttagatattgtgtttggttctttaggctcctattggatagcctaatcaatcaaagaaaaaactaaatttttaatttttaaatttagttttaagattgatttcgagatattttcaacgtagtttctttttcagcattgacttttaaatcactaagaacgcacatataaagttttacctacaaatttatctttatgggcctttagactgtactccttacaacgtgctccatgatatatgtatgcttgcgaattaaccatccaaacagcaacaagttcttgcatatgcgacagtatgcttgtttaatcatgggagtaattaattaatcaaagtttcgtcgtcgtcatgccgttgcttgcaccccgtacgtacgtgcaggatacacagtgatcgatctgcatcgatctagtcgatcgatcgccgagccggcagatcgatcgaccagccatgtgtccgagaacgaaccagcggccgcgcccacgttggattgctgcaaaccaatggatcgatccatccatgcgccaagtgatcgatcgatccatccatgaatcctcacctcaccggtcgacgctgcggcgcagtacggcacgtccatgcgcttacacagcggcgagaatatggctgcacgtgcccatgcgcccggctcgtccctgtctgcaatctctctagcttaattaagctatcgtcaatcacaatgaaatttaatttgtttgctaactggtttattgattactagtagataatgatgtgtcggatatggccgtagaggaaattctacagcgtccacttcgacttatccgttgtaaaaaggtttaaagagtttttcatttaatagtagtagagttgagaggggaggatccatttcgagtttagggctttaggctatattattttcttcaactctaaacttcaattttcttgttttccgttagtacctttttcaaaatgttaataatatattttttaaaaaaatttaaataaatctatttttaaatttataatagttaatatttagtttaatcgtgtattaacgagattttttgtgtcgcgtacgtgaaatgtttctctccaatttgaacaaacgaacgaggaaacaagattgttagctgcacgcttcttaaaaatacattcttcccaaaagaattcctatggcgactaattgtttcaaattatttgttaaattcatttccaaacatttaaattattcatcatataatgagtacatagtctgcgataataatctgatggataatatgtttcaaacagaactgactaatagtgcatatactgtatacttgaagaagcagattttttatgtcagcctattttaagccaccaagtatttctatttctttacaaattcgtcctatcaaatccctctcaaggcttttgtgctaaattactgtgtttcaacaagcagtagcttaagatcggcgagaagcttctctggtcccggccggccttcccctagatcttcagattggaacgctttaagatagaacaagaaagatgctgctgctgatgtataacttagatccatacacacgtggacgacgggtgatcgtgcaatcggagaatccaacggctcgcatggcaccgtgcattgaatggggttcggtccgaagcagatcgcgcccatcatttgcactgccaacaacaccagtgacgaaaccctgtctggcgcacgcaatatggtgcgcgacgagattaaaggcgccacaccggcacggcacgtgccctgcagacgctcgtgcccccacctcatcaaatgactcttctacccctccattgcccggtctagctctagccaatcaccccatcgtctgatttaactaaggtcctatttagttcctacaaaatggtaaaagtttaactattttagtgtaggttttgtcaaaatggatctaagtagtaaaagttaacaatttgttatttgtcatttagaagtttagagtagcaaattttgctaaaaagtacggtgagaaccatattgtctctctctctactagtaaaataacaaaactttaccatgtatctaaacaccaattaataaaacttcaatgccaaaccttttatcactaaattttttttaaaaaaattgccacagtaaatttatctaaatatgccctaaaagcctacttattatgctgttgttagcccaagggtaagatgggtattttggccactgtgaatgaatgctccatcagctatagattctctggttttgattgcttcgtaggctaaagctaaaaaaactgaagaatgcttaacgaacgcgcttggtggagggtaatacggtcatttcaacactctgccaccctctactaataaagcttagctctgcgagctcaccactctcactctgcagtgcagtgcccacgcgagccgagacgagacgatggcatcatctcccgctccaagccccgccgcgccgccgctcctcctcgccgcgctcgcggcgctcgccgtggtcgcgtccgcctccgccgccgcgtgctccgcgggcgaccgggacgcgctgctggcgatccgggcggtgctgtccaggcccacctcggggtgttctcgtcgtggacgggcaccgactgctgcaccagctggtacggcgtgagctgcgatcccaccaccggccgcgtcgccgacctcaccctccgcggcgaggccgacgaccccgtcatggcgcccgccggccgcccggcctccggcgtcatgtccggctacatctccgacgcggtgtgccgcctcggccgcctctcctccctcatcctcgccgactggaagcagatctccgggcccatcccgccgtgcgtcgccaccgccctcccttacctccgcatcctcgagctccccggcaaccgcctcaccggcgagatcccgcgctccatcggcagcctctcccgcctcaccgtgctcaacctcgccgacaacctcatcgccggcgaaatcccaagctccatcacctcgctcgcgtcgctgaagcacctcgacctcaccaacaaccagctcaccggcgggatcccggacgacgtgggcgacctcaccatgctcagccgcgcgctgctcggccggaacaagctcaccggcgccatcccaacgtcggtcggctccctgacccggctcgccgacctcgacctcgccgagaacggcctcaccggcgggatcccggacagcctgggcggcgcccacgtgctcacctccctgtacctcggcggcaaccgggtctccggccggatcccggcgagcctgctgcagaacaaggggctgggcatcctgaacctgagccggaacgccgtcgagggcgccatccccgacgtgttcaccgccgagtcctacttcatggtgctcgacctgtcccggaacaggctcaccggcgccgtgccgaggtcgctgtcggcggcagcgtacgtcggccacctcgacctcagccacaaccggctgtgcggctccatccccgccggcccgccgttcgaccacctcgacgccgcctccttcgccagcaacagctgcctctgcggcggcccgctcggcaagtgcacgtgacgtgccccaaccagagccgtccgatcgatcgggagagcctgatcgaacgtgtggtgtgcgatgtaccgtgtacgatgcaacgaacttacgtgttcgtatatatggttaattagttgctgcttaagtattaactcacttgggctatagttttgggcttgggtacatatagaacaagatgagaatttgtgcctagtgtgtgtgtgtgtgagagaaagaggaagtggttaaggaaaagaagaatgttttctctttcctgcctttctcttctttatacttttaaccttttttgctagtgatttacttgatagttctactttaaagtttgtattgtacaagtgacaaaagcataagaaatgctaaagatcttgtatgagaggttgtggtttcatatttgtgcgcttgggtacttggcccaatttgaaaggtcataatagataaatggatgataaatcgtatgatttggtgataatgtttgataatacaaacgaatgatgaattaattagtatattgcaaagttaaaaagttgtcacagaaaaagtattctatgcaacttatatataaaaagatttaattggcggcttgccaatttgttaaaaaaaatatatggttttaaaaaattacaacgatttggagtttagaaagcatgccatgataatctaaaatacggagaggaaaaacccggtcttagccttaagggatttaaagttgtgattgattttgggggtatttttctaaaaaggggttgctatcaatttacttagcccacctttaattcaaaggaaatgaatcttctatggaatgcttcatttcatataagttttgaaggaaatttaacgtgaaatagaaccttatgaaaagttttctatgagtctatcttatgatccaatcaaatggttatttatgtgtttttctatattttgtaatctctattttaatttacactacatttctgttataattttgtgtttttcctattccctttaatttaaaggggccttagttatattgggtggcttgattagttggtacatagagatgcttcatatcaaacgacatgaacatcagaacatatgaacaagatacttgttctgcataataatcgcatggtgtttttgtcccctctgccattacgttcaccggttatgtagccccgtttcctggccactctccgcgttcaatccatctgtccccgttgtctcgttcttaatcaaagctctataataaattagcccagccgctatcaactcgattgaaaatgttt

SEQ ID NO: 48772 - DNA, 2354 bp, Oryza sativa
tggtcctcttccaggctgatctgcgaaggccgggtttcttgttcttcattggtgtcttgggtacagtctatcgcataatgtccgaattgaccacaagaaaaacaacagccatctctccttggttgccatgggaaactccttctcggtccaactctcaaccttctttgggggcatttattggcataatgtcctttctcaccacaaccaaaacatgtgacatttgccttccgtcttgccgtagtcagatggcagcttccatttgcagggtattgctttaagtgatttagaccgatgctgtagtcttcaggctttagtgaggattggactcgttctttgtcactagaagcttggggaggttcttcaaagagcattatgggttgttttatccccatattttgcaggccttgtaagttggaaggattcttgtgtcttggtgttggttgatccatgtcttcttgtcttgtggtaggtttattctgttagaagttagtaggttgaaggttagtaaactaaaattctcggggcccaatagtagcatgacaatgctgaattgttgtctttcttcttcatctgttcactccatttcttaatattatgctataaatcgtgttggtgagagccgtggttgtatcttgtgcagtattactgtccaatggtaccgaatctgctcaatttccttgtccaagggtgaataaaccttgatatatagtattccttatccatattgttctcacaaattattgattctcttgaggtcttcccataataggctaccccccttaaaataagaatgtttgaaaataatttaaaaaggtaacaacataaaaaaaaggttttgtacaagtatcctttgaaattgatgtatgcaaaccatttaaagttttcaagagaggtattttctcacccaatataatttgataacagatttttcaaggaagattttgtataatcatacatttagcaaaatcaatacggcaactagaaacttctgcaaccaaagcaacctttgattttattttgcaaaagaaaactcttgccaacagggcaaaatgccatatagtttgcatgcacggttcatagttgaaacaacaatacttttgaatatcccaaaataaatctcctgaaagtaattttttttggacctttttcagaaattgcaatattttcaaatggaaacaatcgcttggaaaacagttttcacaaaggttttggaaatctttcacaataatttcctttgcaaggaaagctttaggcaatagttctagaagttcagctttgcaaaccttttggaaaggatgtttacgaacacatgcgttcaaaatttgattttgcacggaattttaatttttggaaaattttgcaataaactatttagaactgaaattcacatatattttacaaagagatatttattttgaaactaattttgaccattaccagaatttaaatataatctcaaagtggttttggagacaattttgcaattacattgttggaaacaaacactcttttctctttggagaaattatctttgcaaaactttatttaaaaatgcaaaaattaattctgttttgcaaatattttttaaagacaatccccaaaacaaagttctcgggggaattaagccatatcagtttgacttgtccttggaattttgaagcaacccggagctgaaatccaacaaatccatattccttttatccttcgtccatgtatccttatccaaaatggcgttccttttattaaatttccaaattcgcatactatcttaagtgtgatacagatccatacctttgaatccttctctgtttatggaaataactagcaatcttgcatggttttctcatagatatgcagtctgtttgtcttctttttattgctctttgtgatattcccatgccgaaggtagtacatttgtggttactaacggcttagtcgatgcttcactcctactgtacgagagtgtaactagaggaaaccagttctaaaaatggtaagttctcatgatcgataagttagtttctgatcttttctcttttctttactttgtttttgtacaatatgatgcaatcgtctagtttcgaggatgaggtttcgacagcaatcaataatattcctatggcgtcttaatttcttacggtcttatcctacaattttgaagtacatgtaagaatatagaaccaatatttttcaatcacaaatgaagtagtaagatagccttttcaaagaaagggttgagatgtatggtatcaaaataattttttttcggcgcatcggaattaaacatttttgaagaggtaagatgggaaaacaacatttgaatgttttcacatttttttttcttttcagcactt

SEQ ID NO: 48773 - DNA, 7514 bp, Oryza sativa
tctcgaactacaatcgatatactctgataccagctctgtcgaccacccgattttggaaatcggaaatctcttgtgtttatcagtaccaatccctggatcagtagttggtacacacatacatagccgaatcacaacatatcacgaatgaattcaggctaaaagagttaaatgcttacattagggccaggcaggccaacaactatcagagaaacaacagcggaagacaaaataatacaagggcccggttgacatgccacaagtagtcgactggggaacgagacctagagtggaactgcactccgatcatcttgttaggtacgcaagtgcactaacaagggcttctcttcaacactctgctagaagatatatatagagcaacaatgagtacaaaagtactcagcaagccaccacacaaattgcagcaatgtacatgataatacaaggagtggctatggttactttgcgtaaagctgagtttttaaatatcatttcacaaacctaagacctagcataaactgatcaagttttaatttcattgttcattaaacagcaacgtttctatccaccatccattgtgttcccaagaatagcttcccgccactgccgtcatggttttctgtggtctaccccttctcgcctcccgagaagttgatccaccagtacaaaatcatcaagcaatatcccatcccaatcagattaagaaattcgagtctagccaagtgtaatacatgtcccggtgctcattaaccgcgagcacgactattcaaaaagatttggtttactcacaatacagtggatgtacactttacccgtactccgcgattgcccaacacatgagcctcatcccaacacatgagacgcgtcacggcaaagcctttcaataacctcacattggcagtacccgctccatgaacttacatcctcatgcactctaggcgtcataagtttctagcaatgagaggagttctggcgctcccgggaagggaagactcacacatgcattaagttatagttaagtttaggtttacacatggcagtcctaccgatggcaacaccgctgtaggcacccactcctcgcggtcctaccaatggctgccccaccgtaggcccctgcctcacacacattaagaaaaccactatgcagggatactgcctccgctcagctatttactccgctaggtctatacacattcgagaagtacggttgtacgggggtcgtttcatgcttaacttcatggctcggtccttaattgaccaggggcgcactagcctttaccagactccacccaagtcatccagccgccccagttgaaaacatttgtttagttttaatttttctttcacaaatcatctcatcaatatcttggcaatgtggcgctcatgtctccacatgccgtatctcaactaccttccctaaggtagttgcccaagcataaagcatttgataaacatgagaatgcatgaatctaaattagcattactaagcatttgccataagtgactagggactcatacgtaattatgggtacaagggaataatgagataggcaataatcaaaggcatggcataataacaagtaggatattcatcactgcatgtaattttatttgtaaacaaaacaattttacaattgggatcaacatgctcaagggatggggtgatgacttgcctgctcaggatagttcttattcttgatataatcttgatcaaccttcacctcctggaagttgcatacgttgcctcacgactaaccgatatacaatttctataatacgcgagaagaaccaatattcaacaacaaacaaatatgcacaaacaaaatataattgttggggttgaacctagggttgttcatactactcgtgtttgctaacggatagtttcttaatcattcttattgtcatggcggcttatttaggagctataatcatcataatataaatgggatacacatttcgttaattcggagttgatctatctattgagttatggaaggggtatgaccacatatgcttctaattagtttacatgggttttacagtgataaagcatgttaaagagaattatcctcacacctactctactgtacaatatcaattttatttattagcacactatttaggttaaccattatctaatcatttgatattaattatttaataattatgaatatattttattgaatagtgaattatataccattggaaaccttatgaatttagatgaatttaggttcaagtttcactcaaatccgaggtaaaatgagcaagttatgctagtttaaatattcaagtttgaattaattcgagaaattgtgaaagggtactgttcgtaactgatttatttttaatccagcattatccacaagctactgtgactgacaggtgagaccagacaaggttgactagggtcaaaccggctgtttttattcactggtgggccccatacgtcatagagaggaaacttaattttaattttagttagatttctaatcatccggacccatgcgtcataggctgggctaatcatcattaggtagaggattagtgtgcgctaataacatgtgggtcccacatggtttctctctctccccatcttcttcttttgtctcacccgttaccgagcgaggcagaggcgcggctcggcgcagctggtgtggtcggcccgagccgggacggcggcgggctgctcggcaactgccgggcagagacgcggaggatctccggcgatctcccgccggcggccaaggcgcgtggcgaagcggaggcgagcggcgcggcatagccgccatggttgagctcgggaggtttggggcttgagcgataggtgaggcctccgaccaaattgatgagtgcagaagcacctagagcgaccgagtgttcgatttcgctaataatgtggctaggtggagttgtgggatggcatgtccacggtgagctcgctggcggcgaaacagcggccgggacagcacgccgaagggctctaatagccaaaattggtgggggatttagcttctacgtgactaggaggagctataggagcgaggttttaccgagagacggcaggatgacgaagttcggcggcgcgcggctcagtgcggacgaaacaggggcggctagcggtcggcgacgcttgcaggtgttcgatgcgtggttcccaacgtccagcggtcctcgactccctcaatggcgacggcggcagcaaagctcttcctccactccctccaacctccagctccggccggggagcctcgcaatggtgatctctagcggtggtgagagagtgatcgcatgatgttcgatgaaatgcattcgagggaaaaaggcagagagggttggggtttgtatgggggcttggcttggagataagccaggatggcgtggaggataagatcggtagctggtacactcgatggctgcctatacggcctaagttagggaggttgacgtgggtaagtttcctcctctctcactgactcggggatttggggatccatggagtaatggtgccactaggattgtaggcgtcgcagctagacggctagaggagaagccgtttatctgatgggcacgacgtgggacgatgtgacacgaggagatgggtgagaggacaatgatgacaaaggggcgacgtggtggccgttatccgtcgatggcgaggcgacgggtgatgggatcgtgacggcgcgacgagacgtgcggcgccgtgtttcccggaaggaaaccggagcgagagagcgtggttaggcgtcgcgtggcgcggcgcggcacagaggggatggcgcaccggcacagacacgatgcggtgcacgggggcgacacgagatgcgaaggtggtgtggtcgatcgcgtgcgcggcgtccgggcacgagcgcggatgcggagggatgcggcgcatggcctagaagcggcgcatgacctgggagcgaatggatgcggcgcgaggagagggaggcgcggcatgcggcacacgggcaggacgccggcgcggacatgggaccggatcgaataggtgatagcccataaacagtgaccgacagaaaaagaaaagaaaaaggaagaaaaggaaaagagaaagagggaggactaaactgcaaatagctgagatttgatttggagttgagatgtagctctatatattttgcatttgagaattcaattatttgatttgaatatttatttggttattcattaattcccaaatgaatttgctttccattagattatccaaaaattatccaatataacttctaggctttgatatttcttaaaaactaattaaatattctattgtgacaatttatagtttggcaagtaatagcaaccataacatccagcatgatgcaaaagttttaaaaagttcaaaattttagtgatttttattgtcgggaattttcaggatgttacacgctcgtggtgtctagttttaggtgatgctttgtatgagagcctgccttgagggattgatttctattcggatatcgatttgctagcctccttgtttcatgttttccattaacccgccttcgcaaaccatttaggtaggttgcaaaaccacattttttgtcaattgccctacatctctagccttcttgatagccgcatgacctatttgcaagctcacactaaaaatagatccatcttacaatctctaattctctaagttccatccccaccactgatattgcaggcaaactatctgctataaaaggcaccccaccaatcgtgtatgacaaacaaagacagcttgctacagataatctcgtgtgacctaatttgcatggagaaggtaagcatgaggctggtcatggtggccttggtgttagtgggcatcgtgctggcggcgagccaggaggtcgtcgatgcatccacgtgcgtggcaacagattcccctgaacttgctgaagaaaggaaaaaacttgagaagctcacggcaatcttctctcggcctcgcggtgtttgccacgcaagcgagggttgccgcgatgaaccactactaattgatgactgatgccaccaaatgtaccagtccacacaaaatcggtgtgtgtgaggcatttcccatcttccccgacctgtgcaggaggccaaaattaggaaccggcaaatatatcccttgcaccgatttattttgctgagaaccgacgcttacagatgtttgtctatgtgtcagttctcaacagaaaccagcatatatgtactttcatatgtaccggtccttgaaaaatggcactaatgatgccactactcaattgtgctcttttgtacgtaacatttttttttatctcaagtcgtatgttgacaaactttgtgtttgtttttatatctttattggcatttcttaatcggcctcatatgcatcaagatatctaatttctctactattataaaattgaagatgtttttgccggtactttggtacgtcatctttgtttgagtcggtttttaagttcatttgcttttggaattacagatttgtatttgagtaggtttttaaattcatttgcttttggaaatatagaaggagtcatataagaaatctctttaaaaaacttgcatgctagtttgagacgattggagtcctaattatagctcatgatcttgtaaaaataatatccaagcaaatttctacagcgaatttcactttaggtaaaccgtataataataataagatataagatagtatttaaccgttgcaacgcacgggtattttttctagtaagataaaaactatgaaaataaatggtgtcaggtaaaatctcgagaaatatttgcataactactacaaaacacactaagttcatagtaattttagttttgaatttattatttgtatttgagacctaatctaactgaatatttcgcgttatagtgcttaatagcctatacaatatctagccaggtgttaggacaaagttcgtatgtatactttttttttttgccaatacattgccaactaacatttaaaaaataaccggcctcaatatcgaatgggcaaaaagccatcatgtaaacgacatgcgtccatgggccacaatgtcttcgttggacctttggctggggcattgaaagtgaaaacatatattttttttccaactaggccacgtgtagaaaatgtaggctacccgcgtacgtgaaatcgtgaaataaagggaattttttttccaaatacacatagcatccagatctggaaggtgcatgtgctgctgattttgtcgttttcttgatcgtgcatgccgatggcgcgtgaacattcacgtattagaccggtactatttctccactctctgcttctcgacaaaaggtcaatctgttaggttgggaggcggagaagaaacgattatgagggcaccaagccgtacactaatttgatgcccaaaccaaataagttctcaaaccaccactacagatgtgaggatagaagatgaagatcatttctaaagctgatcaatcagatacaacatcgcgtgcctctcaatcccttaatcatcggaacaaatccaatgaaactgcagctcgatgaccaccattgctcgcttctcctcttgaccatgcgcgctcccggctatgatcctaacagcctatgtcctcttggaggatccatcgaatacttcgatgttgacgccttgcagccatggtcatcacttgtcaccttaaatctgaagtgaacctcacaattcatttctcctaggaaaacaaacctcgaacatgaagaggagcagagaaacagatgttttttcttcaaactcataggacttgttcaaggctgtcccacatcgttgaggtaggactcttgctaagatggagcagcgacgtcgtgaagttttctaagtggcacccatttggttcatcggtacacccatatagccaagttttgtttttcaacatgttcagttttcaagttcttatatctaatcgcacccacgcgtttagtgcttatatcaccagcgcaatctacaccaaaaaaatacttcatgttctccaagcatgtttgtgccatttgaaagtttaattgcagtttcgatttactctgcgtgtgtccaggatcaagattgctcgcttttcaagtgtggcgctcgtggtgtctagttttagctcatgctttgtatgagagcatgccttgaggcattgatttctactcagacatcgatttgctagcctccttgtttcatgcttccattaacccgccttcgtaaaccatttaggtaggttgcaaaaccacattttttgtcaattgccctacatctctagccttcttgacagccgcctaacctatttgcaagctcacactaaaaatagatccatcttacaacctctaattctctaagttccatccccaccactgatattgcaggcaaactatctgctataaaaggcaccacactaatcgtgtatgacaaacaaagactgcttgctacagataatctcgtgtgacctaatttgcatggagcaggtaagcatgaggctggtcatggtggccttagtgttagtgggcattatgctggcggcgagcc

SEQ ID NO: 48774 - DNA, 1622 bp, Oryza sativa
  unsure (1)..(1622): unsure at all n locations
tcaccgacgggaggaacggtgtcggcggcgagttggggataggaagggatggaaggcggagggtagcacgcgaccgagcggcggcgcacggcgaacgacgccgaggcggcgcggcgtcgaggcgtgtgcgccggggaaggagagatggagtgcggcgatggggcggcgcagagctcctcgtcgactcctcgtgcgcacgtcggcacgcgcgacggcggaggaagggcgacaatggcgcggcggcagagggaagtaaaacgggaagaaaagagggggagctcgggctgggttttataggtgaggaggagaggtcggtttagaggagggaaaccgaccttggcggttgagcgctcggctggcgctcggcgggcggtcacgagcgggagcggcgttttcgtgggctgcgcgaaacgtggcgacggcgaggatgcaaaggggcggtggaggcggtggatcgtgcggcgggaattgaatcacgggcgcgggagcatcggcgtggccggtcaaagttgggggcacaggcgtggcaggacgttgtcggcgtcctctgcttccgcgcgcaagaagacaagggcgagaggagagaggctgggtttagaagggaaaaagtgagggccgacggtggaaagggaagcctctcccttctgttttgggccgcgggcaggcgaggcgcgtgggagcggcgtctttgccagtcggccatgcgtgcgagaaacggcagcgcggttgggattttgggcggcgtcggcgggagtcaatgagagagaggagagagatagagggtgagagagagcgaggaagaaggagagagcgagtgcacacgcgcaacgcacgtgcgagggggaggaggaggagcggctgagaggagatgggctgaggagaaaacggcccacaaaaattcgagggggcaaaatagactttttcggaggagattaattcgaagagaatttgaacttggaatttgacttagatttcggaattgggatctggatgagaggaaggagtcgacggaggattcaagatggggttttggatattttggatctggggaagtattcggcgatgattcaaagagagggatagaatttcagagtttgatttggagacatgagtcggaagaggaatttcgaggaggcaatttttgatggtgacgagagggatcaaggacggatttgaattgagatcttggcacaacttagattcgcacacaaagaacggaaattttcgcatataaaattttgccgaattagtttttaacgtctcacgaaaagcggagcgttacaattatccggattatctacttatttacaaaaataaatcaaacatatttaaaaatagcattaaaatgttatatataagtagaagaaagtttttttaagaaaatatttttcaaagcgcaaaaacaaataatccaacgaatattttttttaaaaaacgaggcacgagtttttcttatattggggcaatttttgggttccttttgagttcttcaagactaaatggaacctccatgatacaccagtgattttcatgatacatcgatccccatatgataacaataaaaacatactcaannnnnnnnnnnnnnnnnnnnnnnnnnnnnnnnnnnnnnnnnnnnnnnn

SEQ ID NO: 48775 - DNA, 1544 bp, Oryza sativa
aaaagtacttgtacctcaagcttatagccaaatgatatatttttagatggaggtagtatgcatttttacttgcataatcatcttaattattagattcgtgcatacatatacttatctaccataacatgcctaatttttttgctgctgatgacgtaggaattctgcgcgaagcacaagaaggacatggccgacgagcaccccgtcatctcgtcagactccatgttcctcaaagccatccttccgacgctcaatgtctcaccgtcaaccccctaaccatcaccggcggcgccggttcaagcactgtcaccgcggcggccttcgctggcggaagctcttcacctgcaccacttcaagttctggttttccagcagcaatccactggcaacggcaacgtggaaattagcttcaacagcaatgcttcgcctatggccatgtaggcgccagccgataattctatgatatccttcaacaacatcactgctgcaccggtggccaatgcggtgatctccttcaacaactttgctcagtcgacagccgggcaagcgtcggcgacgatgggacatcatttgtcaggtggtgtccagcagctggatgctccctagcaaagggggccttctcctaccaaggccctttgccaccttccatgcgcacccacatcaacctgtttctaacggccttgccactgcagattgggatagccattgacaaaggcaaggctcctttgatcgagccttcatacggtatacccatggatgacttcctcgtcggacaaaagtgcatatgggggggccggaccatccatcgaagcccctgacgccccggccggtgggtacccctacatagatgcattgaccaataacgttgcagctggctctctcatggcgtcaccaatggagccaacgttcagcatcaccgagccaaccgtgttgacccagggtgagggatcagagacgaatgcggtagcaacaacacgtaacaacgccgcaccattaatggtacctgatcaagttactgctgatgctgcaatggatgctgaagaagacatcatgttttcactggagtctctccttgggctggactacgacatgctgcctatggaagacagcagcgccgccgaagccgctgccgctgatgattcagctggcatggacattggctgggacctcgacctgcatgatatcttggtggagaatgccaatgacttcgtgttcctggacagcattgccgggagcgagtagtcggtagtcatttcatagcaaataaattagctctagttaagttagagattagagagaggggatgtgaactctctatgataaaacaactttagtcttgttgcaagtactctgaacatcgatgatttttcctccaactgagcaatcactaattttgtgttatggtcacacatatatcgatggaggtaaaaaatactacaattgtttcaccagacacaaatgatctttttatattaaatgtgtccttcacatatcctaccctccctacacaacacacacaaccctaatacagggaaacaactaaatgtg

SEQ ID NO: 48776 - DNA, 7869 bp, Oryza sativa
aaataataaaaaaaaattgttactaacatcactcattgcactagtaatcgtcaccctggcttgccggtattcaaatagagcgcttactccccttaattctaatcacttcatgtcagtgaaaaattgagctgtaagcggtgtgtgtcatgcacatatgtgtggcaatggaggatgagacaatcttctccttcttccctgatggcctctgtctcatgattctagatgacgacatgaaggtcatcaaaaccgcaacatcggcaacgttgttcgaactccactatccatgtagattttggacgatttttggtgtcctgcgtgcaatatacatcagtagattgtgtgtacaacacgcagatatctggacgggtatgggtccttgatgaaatatttttgtttgtgtaatctttcaatttttgtgggatttcttgtgaatgaaagttttattgtttgtatataggtgtttttttgtaggatttgtttggaataaggaacttttgtggttctttcaacttctttgataccatcttgtttctaaatgttttggtcgcttgatttgagatgcaaaatgtgtgtagtacattttctgattttcagcaaggtgttttgttttacttttgtatgtgggtcggctatagtctacgggtaaaggggcagtcagtgactcattgcatgttataaaaactttcttttttaatgaaactgaagataatgtgtcccttgcatatcatctactcaaccacctccccctacgaacacacaatgcgatgtttttcagcagaatgaaatggttcaaaaagaaccaaaccgtgagttttcaacatagtggagtggattggttgcattcgtttcaaaaaatccctcagtgactcacgtggtgaacatctgtgcattaaatgtcaatattggttcatgtaggtgtgatattttttatcggaacaaaattttttaataaccacaaaaacatgtgttttggaaaagtctctccatgactcgcatggctaacatttgtgcattggatgccgatattagcccacgtgggtaatatttttttcattggaacaaaatatttcaaatagcaccaaaacatgatttttgaatatattggagtgattggggtttgttcgtttgaaaaatctttccatgactggcgtggagcaaagttcggaaattaatgctcgggcttagattgatgtgatatttttcaccgaaatgaaatatttcagaaaacaacacaatagattcttatcggtctgctcttcttctttcatgtaaatgctattgtgctttaactatatctgtagcgatggacccgttatgatcgtgtctcaccaagatatttgtatatatttcttattttcctgatattgtagaataaccccatatttagggtgttgtataaactaatgtataaaaggactaaaatactcccaagataatgttgtacatatatagcaaatcaagagaaagatgtgatttccgtttacatatgaatacaatgagccctcctaggacaagaggggaggggtctccccattccatccacctctctgagccttcatcctcttcctgtcatctcctcacaggaccaagcttgggctgcctcccattggagggatgcccttgccatgcatgttggattttgttccaacacctgattaatatgaaaatttctaaagtccataccaccattttattatttaaaattttaatgatttttcagttaatcattgggggatttattttatatttattcggatggtaattaatctcatgtggggttctatgataaaatggcatttaaatattttttattttaaataaattttctatgcatgcatgtcgccgttaaggacatcaccctgatctagtgatcttccacccccgtgcgtgctttgagtcatagctcggtctgccgctcgatcctattgcggagctcgatctggcaccatcgaagtttgattcgctgccgtcggcaccccttccttgccactggagctccatggtccgtcctcaccactacagctctcctgtcattgtcaagctcagtctacacatcggagctcatctaccatcagtcgggaggggatgggagggtacacgaggaggtggcaccggcgaagatgggagggggaagaggaccaaaagcagttgaatgcgcgatgggggagaaagagaatgggacgagggggttccgtcgataagcaagggtactctatatgtaattttttttatcttgataaagagtctaaatataaaagttgagttgatttgttaatatacaatatgaaaatgactaacatacaaggaatcgaggcctgagacgaaatagaggcacaagttccgctccgccgttcgccatcgttgatggtcgggttaatttctgtcgggctcggcacaccgtacgtgacgcgtggtcgcgcgcgcgcttcacccgcacctgcgggggcgcccggcgcaacgctcgaggaggatacacggttggatgaagacttggtgagttggcatgcgacagtaaccgtgacgctagctatctcttgctacctgatcacttcttgtccatttgcacttaggtgcagcgtgcaacgttggtttcctctgcatagtagcacgcacgatcgacgtggggagtggggactactttttattattttttaagttgcttttgttctttcctccctattgctgcaatggacgtcagtttcgaatgggtgcaaagtttttaaagtatacgggcgtatatttgaagtattaaatgtagactaataacgaaacaaattatagattctgtctgtaaaccgcgagacgaatttattaagtctaattaatccatcattaacaaatatttactgtagcatcatattatcaaatcatagtgtaactagactcgaaagattcgtctcgcaatttacatgcaaaccgtgtaattgatttttttccatatttaatgcaccacgcatgtgtccaaacatttgatatgatgtttttggctaaaatttttaagaatctaaacaaggcctaaggtaaaaaatatttttccgggaaccatagttatagtagctggtagttgcctacatgaaataggggtggagatatttcgatatatatggacctgcatgcaaaacatagaaacatagaaatgattaaactactcttgttcaacaagacttaggaatgattaataaaccactattgttttttatttagtactccctccatactggtaaaatataacgtttaggacaacatttagcatactaaggggtgattaattagggggtatttttctatatctgtccctattaaatacagttgtgcgtagcattccatttgagaagcaaacttaactcaagcggctagtgcggtgaggctggagtccttgggatgattttgcatgggaaacgaggtgagcaggcgtgctgcggattaattgtggaagcttggctattgaatagacaagagcaatcccgtccacaaggcctagctacggttcataacgtcgtttaaatcgcaaacgaggttaggggctagaacgaagtttttttctatattgagagagtacgtgctgtatttcctatcatcgttttagatgatatttttaaagttttatattagtatgaaagttaagtaaatgttgttgagtatgcatatgtggctaatggagctagcgtgccataattttgtacggttcatctcaatatttgtgttcataaagatggcttcatgtataatactaattgtaggaataagcacgcactcgagagtaatttgtgtggacatgaataagtaatttgcgggcccatacaaatttactttagatgacaagataaattaatggtagtaataattgatatcaggctgacgttgtagaaatgaccgcaacgaagagaaagggagatggtatggttgatgacataaaattttagtaatagaaaataaatggagtatgatgacaatagtgatagaaacgcctgtagcgatagtaacggtcaaaaggatgacgattggatatgagtgctgattggccgatctttgtcagcgaggaatattctggtaccgacatttcaagattcttttccaatgtgtattatctatatgtcatgatagagttaacgaccatatatatggcggcgggaaggttaaaagtaccattattactttaagagagctgaaaaacacatatattcccacgaaacaaactataatttccatattctaacacaaggaaaggaaatattttttaattaattggaagctgagagtctatcctctcatatctgctagtaccaattttcacacccctatccattaacacacttcaatacatgactacagtaagctttctccggtgcactgcaaacgtaagcgagaaatggagcttttacgcctgacccagctcttagcctcttaattattgtcctcacatggacacgtttggcagatgatgttcccatctccccaaattttcaccaggcctgttttcctccgttctcctagaccgatgattaatgtcctaagcaaaattccaatttggcagatatacgatgttgtgatgcaagatagtattaaaaagcacgaccattttgttggcgttcctccgctacgccgtgcgtgcgccatcgtcgatggcccgacgaatgcacgccgtgatgtgtgggcgcggcacccacgcagccggtactcgctcgccttgcgcgcgcgcggccgcccaaagttcgaggccttcgaggatatacactggcaggtgcgttggcgctcgacagtgtgactatagctttctatctctggctggcgacctcacttctcctttgtccatttgcacttagctgcagcgtgcgatgcgagaagaggcgtacgtcggtttcctctacatggtctcaggcaccggatggatgatcgacatgggggccactttctttcttttttttaaaaaatatatttttcagatgctatgttcttatccttcatgttgttgtatttgggatgttagcagtttcattggacactggcgacatggactaggtgggtgaaaaatttgaagcgaaacaagcgttaaactatttctatagttagtaggtgtgcaacgagagagggatggagatatttcgatatggaaatgcaaaacttgggaaaggactatactacttttgcgctcttgttgaacaaaggactaaacaaatcttgttttccattgcaagtgtatcgaaaatcaagtaggtgttcttgagtgagcgtgcacaatgtaattaacggaattagtactactaccgaattgatttttctgaatgagatccctttaggttgcaggcagaccataactactaccacatgcaaaagccacttccccgaatcggttcaagggctgcatgcgaaaatatattcactctgctacttctcccctcttctcccacttcctcttgatccaggccggccacctgctcgggctggtggcgatgacggcgggctcgggcaacgacaggagtggtagtgccagcgtcgacgcaggctgcgatgagctcgggtatggccgcggactctgcctcggaccacacggatcccgccgtatctcctcactatcttcctcggcttcttctctccttacggccaatgggcacgggatccgccgatgctagcgaaagagtgggagccgcaaaacacaaaaccccagccagatccattggtttttggcggggggcttgctcggggcggatgcagtagcagcgggaagcagtggatccggccgaggtggatccagcggcgacaggctcaggagccaagggtgtcgatgagggctgtgatgactgacgagctcggctgcggatcccgccttctgtcctatatctctctctctcccctggccttggcatatcctctcctgacggctggtgggcatggatccgctggcggcggaggcttagggcccggcgaggtggagtgcgacgacgaccgagtggtggcaaatttggcttgggttttgattttgacaattttttcgaccaaaattattttcgcatgcagtaggtataggtgaccgcatgaagaaattccgtcttcacatacggttgcgctggtcgcatgcgaaaatattgattttcacagatacctggatgcaggtggctactttgcccatatgcaaaaataggttttggccgtctacagaaacaattgtttactggtgtagtatgccattaatttgcattgttaattcatcccagtatttgtgtttataaagttgggcttgtggattcacatattcgaatgcaccacattgcatggacacgaattagtaatttgtgggctctaataaatttacttggattacaagataattaagtgaaaaggagaaagggtatgtcgttgtgactttaattttctttaaaggatctatgactttaaatttaattagtagtaaaacatgcacagaggatggcgacaagtgaagcgtccgtgctatcataacggtcacaggacaacggttagatggaagtaatacatatatggctgttcttcgtcggcttccaagaaacattctaatagcactatcacttgaagattctttcaatgtctatatatattatccatgcgctatgatgagtcaatgaccgtatacatatatggcggcgaaaggttaaaatacaattatatataaatagtggaactgaaaaacacaaatatttcaacagtaaactatatttttatatatctaataaaataaaaaataaatagcaagtctgagtatatatccatatctgctacctacttccacacccttatccattaataacactcttctatacatgactatgaagtactccaccccgttgttattaccccggggcatgacgaccatcgatggatcaatataacccttgtctccaccgactgatccgagccgattcgatcgacattgaagaaagtgtcgacataccccgcatcacttcatcgctgactgcgcttgcgacgacatcatcaagatgactagatgatcaacgctcgagagtttagctacatttgttcatgtatatatccatgcatctatggctgcacatatatacaagcatgcatatagaacagtccaagtcagtcaaagatcatatatatttatatacgaacaaaaagcaaccacttctcgtcacacaagaaagttcaaacgtcttcacggaagagatagagatcagagaaaatggatgcctatttgttttctcaaagtattaatgtacaatgagtaatgtgcggtatcattttgtttaaaagagtgtagtaccatttaccaatggggtagatttttaaccgggatgttcatgcgtatatgaagcacatatacacttttttgaaaaaaaaggccccaagaacgtataataacgtgtataagtgcaaaattgaggggctttcaactttgtgcaggaagtgacagtcgtaatttccggctaaaaatgcatatagaaggacacgtttcacctttcacaccggctcaaatgtggcagtgaaacttcagttttctccacaaaaataataaattaaggaaaaaaatcgtcactacacgtcactcatccccatctcccaggcttgtccggcctataaatgcagcctccctcccctctattctctaatcactcaaaacactcatcaatgaaatctgatcagcggtagctttttttttttctttctgaaggaacaaaagtgagcaatagctagcggtacatctctctctgtggcaatggatcaagcgaggatctcgttcttcccggatggtctccgtgtgatgatcatcgacgacgacgcaaaggccgtcagaagggcaacggcgacgttgtcccaactgcagtacgcaggtagattaatttggatgattttctgtatgagatttttttt

SEQ ID NO: 48777 - DNA, 752 bp, Oryza sativa
agtagctcatcatcctcaaggacattatgaatggcttgttatgccatgaggattaaaaaatgcaccagcaattttccaaaggaaaatgcagaatatatttaacgaaaaccaagaattcatattagtctacatagatgacctgttagtcttctcaaggacttacaaagaacatattgctcatcttgaaatattttttagaaaggtggaacaaaatgggttaatattatccaaaaagaaaatggaaatatgcaaagaaaaaattaacttccttggacatgaaataggagagggcaaaattcatttgcaagaacatattgctaagaaaattttagaatttcctgatgctatgaatgataaaaagaaattacaacaattcttagggcttgtaaattatgctagaaatcacatcaataatttagcaaagttagcaggaccgttatatgctaaattaagaaaaaatggtcagagatattttaattctgaagacatcaaattagtaagattaataaaagagagggtgaaagaattaaaacctctagaattaccattagaagagagttactttattattgaaactgatgcatcgcagcttggttggggtgctgtattaaaacaaaggcctactaaatattcatctaagtcagaagaaaaagttcgtaggtatgcttctggaagctataaattaaaaaccgtaggcaatacagatagagaaatacttgcaataatcaatgcgataaatgcctttaggttat

SEQ ID NO: 48778 - DNA, 1677 bp, Oryza sativa
atatatatatatatatatatatatatatatatatatatatatatatatatatatatatagtaaatttgtttggtgctccatggtgcccgggcaccattgttgaaattgagtatatacccaattcaaatgagtatgaaactttttcaattactcaggtattaacattaactatatatatatatatatatatatatatatatatatatatatatatatatataaatataaagcttccaagcgcgctctcaccctccattccaccattcttagtagtagtgactttagcctaccttgcatagtatattgaagcaaggagttgtgttataacgctgtgtaaggtaagaacagcttgcttgtacctaccttcgggtttcccgaaagggaaaaccgtatgtaagcttatctgtttaatatgaagtaattttccttaagtattcctgcacgtttgttctagacaagtgtttatgctaaggaccctataggagaaacctcttcggtttgttctcgtttttagcctgcatcttgcataggcgtctggagaatcggtatccgtagagaagtgttcccttcgggtggaactgcctggggagacgataaactcttagctagaacaagtgtgacttggaatatctttttaagttgcttctaaaaagatagataggtgaggcatacggtgagtaccgagtaggactttacatcatctgaaacaagcttctgaggctgtctaaataggattcgccaccctgcaaagatcctaaagttaaaatatctctcgaagtgaacagtattgaacagtaatttaaacagtaaactaaatagtgtttttgaacagtgttttttgtccgaagcatatatatatatatatatatatatatatatatatatatatagagagagagagagagagagagagagacacacacacacacatacttttttttgttaattgaccatttagttgaccgtaaaaaatttagttttaccctcggatatggaaggaacatagaaatttgtgagtctaccaaaaagtagttgtttgaggaagtattatacatacaaaatttaatatatattaaaaatagtaagtgtagtgtatctttagacagtaaacataataattagtttagtttaactttttttagataatacatacaacaggtggcaaatttgttatactaccatcaccgaaatacgctaatatactcttttaattaataaaaataaatattactaaattttatcattatctaaaaataaattggcatgaataatactcgtacctcacacaaactcatcaatataatagtttcatgtagtaagttttctacacttccaataatgttatacacaaattttatgtttcttctatgtctaagggtaaaatagacattttcataaatcataagcattaaatgatcaactgtcaagtaacggaattggcatgtaagggattaaaccgaaattcagtagtaatataaaggaagtgagaaaatagtagggccatatagaagtgatcggctaaaattttaggacatatatactgtacaagaaatctttttatgctttacacctttggccgtgtttagttgtagattttttcttcaaactttcaacttttccatcacattaaaacttttctacacacaaactttcaacttttccgtcatcgtttcaatt

SEQ ID NO: 48779 - DNA, 3483 bp, Oryza sativa
cataatagcgcggaatccaaaatttaacatgggttggcccacattgactcctaggccatctgctcacaggccacacggtctcatccacacagggaaatgcacgaatcatggcgcaaatcctacggatagaaaaacgacaaatattgggggtgaaaatctgttgacaaagatctagcaaaatcgtttgcgttttgattgacgaagatggattagttacgggcctgctgctgcggaggctgaaattttattcggccctggactaatacctatcagcccaagtaaattacctggaaattgggcctacataatactggaagtgggcccttggtgtttgtgctctaggagctgcaggcccatatataatttctcaatccttttaggcaattaatttcctccatttgtagcacataactacatgagaagatatgtcacgtgaactctatatttagcataaacctgaaaactaccctgaaaaaaagtaaacgtttaagttttatttatctaggatttaaaagttttactcatagtgacgtgaatacattttagacgttcatttctgtcttctaatataagggattttgacattctgcttgtactgcttgaccacacgttttatttaaaaaaattgtgcaaatataaaaaacaaaaaaaatatgcttaaagtactttggataataaagtaagtcacaaataaaataaataataatttcaaaattttttaataagacgagtggtcaaacgttgcaagcaaaaactcaaaatcccttatattatgggacggagggagtaggaatcagggttggggaagagggaagaggggactccctcgggtttagaggaagatcgaggcagctatggctcgacgataagctgatacagatagaagtgaggcatttccaaagccaaagtgatggaggaggatgatgagcgacgatagcgggggccgtggatccagtaataggaattacaggggacggagagatcggtattaagaggaacatcgttgaagatggggaagaaggcacagagtggttaggctgcaatgacggattcagcatagtgagttgtgggagaaggagaaattgctgggagtggtcaaccgcatgcaaagatcagttttggccgcttggaaaaaccattttttaagtagtgaccggcacataggaggagtcagacaatgagattggtgtgatgcgactgacgactgtaatagttatctctttttatatatgtctataggagttggtttgaaccattgaatcttgaccgaaggatgaaataaaaaaaagaccgaataggagatctctcaattggcaaccatcgccggtcatccggttgctacataacatccgtgaattttatggccgaacatttgtagtagctattgatggacaaaatccacaattccctgttctccatttctattgttctttattagaatttagaaggtactaagcaggtgatgatgggcctactttcgaaggcattccattttgcgctttatatgctgaagacacacgatacaatgaaaaatgatcttaaagtatgatggtccaaaatccatattgtggcaaaaacaatataaaaataagtaaattaatttgaaaagttaagaattaatatggccacggcttataattaagacataactcaaagatatattgtatacttcctctagtcattaatatttgatgtcgatcgggtaacacctattccctccgtccaaaaaaactcaacttctagagtttgaattttgttccaaaaaaaccaacttttacccttctacctactctcagcacgtaaaacgagaaattttattgcttcaatactctttacctacatatcactcttactatttttttaatgattaagggtattttagtcattttcactctccactagtttcacctagggatgctaggaatggactgtttctgggagggaggaagtaactagtaggaataaaatccggttgacatcaaattaaataatcaaatattagtgaccggagatagtacgacgctgaggtaacggtaactctcatgcaagattgtaaaaagaaccgtatatctatcttcttttggaacctcacctgactgaaaagctactccttccgcgctttgcaaatgcatgcagccgtcactatatatgactacacacatatatatatacaccacacacataacctttaatttattaacttctcaaaaaactctcgacgttcggtggatttttttttctgacaaaaacaaaagagcacttatcgtacccatcagcacactgtccatacccacccttttctttctatccaaacgtgagaaaaagtgcattatttgatacgtacatctcatggtatgtatggtgttccatccatcaaactttggctgcagtacacactttggtcggccatccctccgatctctcaagtgcgcccaaaaagtagatttcctcgtaaaaagagaaggggaaagatggctagcatcgatccatccttgttttgttttctttgtttctacctgcaggagctaggtcaatgctccagtgctgcacatatccaatcaacttagtttttttattaaaaaaaaacaaatcaacttagcttaaggccggctcctttccaattgaccacacgaaatttataggaatcaatttaatttctgtacaaattctctaaaagtcctttgttccaaagtaggcctacactagtacataaataatttctccagacggccaaaacaaattttcacaaacaggcctctggcccatctacacctaggtttctgtgaattaaaatcgctaaatttccatgcggttagtgcaaccgcatgcgtaaacgtgattttcgcatgcggtcacatttaccgaccgcacacgaaaatagtttcagttaaaagaaatccagaaaatcaaaatcacccgaaaccctagccgctaccgccgtcgtcgtcagagcagctgccactgccatcgtcgtcagagcagccgtcaacactagtcgtcatcgttgcgctgccactacccaccgcaatcgctcccgagagctaggggcggaggcatagtatattagaggagtgtctaggaaaccggccaagaaaaaaatttagctatacctcacctatttttatcatgtgtgcacccccctcaatacaaacatagacacccgaatcagcttaaactcgatctaaaatagagtaaattaagcgttaaaaccgaatcagctatacctccgtttcgttctagctccgcccctggctagagcggggacggcggatccacgcgccaccatcgcttcctagggtggggacagtggatccatccattcccatcgcttgtcgcccgtcgctcctgaggatggggacgacggatccgtgcgccaccgccactcacgcgggcggggacggtggatccgctcgctcccaccactgacgccggccgttcactccttctatcgccgccactcccgagggggtgggggggggggtg

SEQ ID NO: 48780 - DNA, 3008 bp, Oryza sativa
ggggtgtatatgtatgctagtagctagctagcgcggcggcggctgcagggaggaggcagccatggaggacgaaggtctgacgacggcgtcggcgtcggagacggcgccgtcgtcgtcgtcggcgtcgagggcggtgtgggcgtggccgaaggcgcgggcgtggtccttgagggagcgcttgtgcttgaactcggagccgcagaggcagtaccagagcttgccgcagttcttctcgtgggtgcgccagtcgcccttgacggcgaaggccttgccgcacttgcggcagaggaagggcttgaggccgtgcttgcgcttgtagtgcgtctgcagcgtgcggaagtccttgagcggccgcgcccgcgggtggtcgatgttgttccggcaccccgccgcgcagcagtagcacggcagccgcagcatcgccgtcggctgcaccccgcgcagcgactccggccccttcctgtactgcgacccatgcccccacatatgcatctgcatccatgcattttttttcaacaagtttcattaatttccatctcgtttttttttctgatcgacatcaaaatgtatatattcaccaaatcaatactccctatgtcccataatataagggatttttgggtggatttgacatattgatctagtaaaataaatctaggcggtccgtctatccagattcattataatgtgtcacatctatccaaaatcccttatattatgggacagagggagtagtatatacaatgtaataaaaacaaattcagaagtttttttttataaagcttcatgtatatatatgggatgtcgatcgtcctctccaggtatgagaacacacttaattagatccctaacgatcgtatcattgcatgctcaatgtttcttactttatctaaaatcatatgctgatgagcattcatttcaaatgcatcaccttttggttatggttggtttgtttcaggaaatttagcaccattatttcacatttactcctactagtataaccaaaaagaacaaaaagaaggtgatgtatttcaaatgaatgttcatcagcatatgattcgagtaagtatattgcaggtatttaatgcaccactgcagctatagttgcattgctagcaatattcagctgcggcaaacctgagagaactactcgaactgaagctgctgcatgcatatgtcaattagtgcagctgctgctagctagtgtgtgatcttttgaaagtgagggctctactactccaggcagctatgccccctttgctagcttggcttgtgtgtttgttgtgttcaatgtgttggtgttgttcctttaaagagtgcagccagagtggcactgtgttggctgcatgcctacaggaagcacactgcagatctctcttgctgttcttgggagatgtgttcagcagcagcagcagctccataatcttatgctttccaaaccatgaaagcctgtcctgaaacaacccccatgcatatatctacccaaatcttatttgagccctgagtcctgagtgatcaggattcaggactactaggtgcatgatagcaagtgtagtactagtactagtacaagtagtaactacacctccagaaaggagtatatgtaatctgatgagatcagtggaagtgtactaagacagtgagagaagcaaagataaaatcttcactgggatctccactgcagcttggccactcatatgattctcccaaaagccagacaactcaaggagagaaaagcataaagattgcatgcatggtaagctctagctctacctctagctatagctgctcctggcatgccagtctagttcaatcacacaaaaggcagacaccactactgttgcatgctcctgtgagctcaagtctatttcatggcatgcatctgctctccaaagctagcagcttgctacccacctcctctgtactttaattgcaatcaacaaaatcatgaccaaccaatccttgcaaagttatcacaatcatattgtgtgtccaagaacaagaattaagatcaattattcagatgagatgtttctagctagtagtactagctataataagaatgtgattaagatgattattagctctgacctgcaaagttatcacaatcatattgtgtgtccaagaacaagaattaaacagcaatataagatcaatcatatattcaaatgagtagctaataagaatgtaattaagatgattattagctctgacctgcatgttattgtatctgttgaaggttttgaagcagacagggcaggagaactgggttgggccgatgaggatctgcgatggcgtcggaatccagtactgccctttgttcagcttcccgatcggcgtcgacgagaaccctagcggcaccacctcgtcgtcgccgccgctgccgccgccgtccaccttgcagtcctcctcctcctcctcgtgttcgacgccggcgccggtgagcccggagaggagatcggcctccgtgccgccggcaggcaggccgatgcgcagggcgaccgcggcgtcgatgtccgccgttgtcccggcgacctccacgtccatcgggtcgccgccgtcgttgtcgtcgccgcagcaggtggggatgcagttgaggtcggcgaagagcggcgcgcgcgcggcggcggcggcgggggtggccgtcgacccggccgccgccccctcctgatcctgcaggtggtggtagcagcagtcgccgtcgtcgtcgtcgtcggagtccgagtcagccgctgcgtcgacgacgccgccgcggcgcgccggcgtgggcgacagggacagcagcggcagcgcttcccgcagcggcggcgacggcggcgcctgatgctgctggtgcaccggcggcgggtggaagaatgcggccggcgggtactgatgatgatgatgcgcgccgacgccgacgccgacgccaccggcggtaggatacagggcagcgtaaggcggcggcagcggcggagggaggtgagcggcggcggcggcggcggcgggcgcggtggggaaggagctag

SEQ ID NO: 48781 - DNA, 1376 bp, Oryza sativa
acccgggaggttggtacattattaattgagttggtgaaatttgataccccagtcttttttccaccccaacttaaaaagaaataaaacacttaaggaattccaaaagatttcaaacaaaagatttaccaaaacaaccttgcctcttctttccaagcttgcatcaaacacctaaattcccgtgacttgctgagtacgaaagtactcacccttgctctatataaatatatatagttcctccgccctgaagagaagataaagtgaagtgaagattagggtttcgtcctggttcccagccgtcgcctgtggtgttgggtgttagtccgttggttccgctgctgctgctgttgttggtgttttcctcgtccgcgtcgtcggttgcattctcgggctgttctgagctgcaacctaagttaaggtaaataagtcctttatttattttaaggattgcaatgattcatatttttcatcgtgggtaccagcactatgtcctgggactggtactgtaatcgcggattcgtaagaagcggttcacgccgttttttctacgacacgctcctgtcaggtgccgttgtatggcagtgccgaattggggtgtgacaataatctactgaacagtctatcaaatggacatgatctttgcaccaccaaacctactatgtggcatccacaattcgacatgccacctcccctccaagcggccgtactcgattcatttttgcttaatatcatatcacacattaaatattctctctatcaaaaaaaagtcgaactctagggatgaatttaaacatggtaatgcatccctagagttggactcatttcgagatatagggagtagtttggaagtaagttggaataatatacttaatttaaagtgcgatgtgcaggcttagtccatggcgtgcactaattgaggcccaatcatttatcctcttcagattgcatcatgtactgtgacgagttctttaacttcatccgcgttacgttgagagtcaactgtcgaggtcaacgctcgattcaccatttagcaaatcgcattcaagtcaatttgctgtttcagtcgtatatagtgtgacaaatcagatgcaacgcaacattaattaattagcaattactgataattaatcacagtaactttttcagcagcaaaaaaagtttcaaagcatagtctacactgtacaccatattatatgacaccaaccaaaccggcgagcttgctgcgaggctgcatgccacagatgaaagctccatcgcggggaggacaacgacgaccgtgtccaagtccactcatgcctggcaatctcttttaccctacgcgattgcatcttgcatcaagaactcgatcgatctgatatatattactatgagctaagctg

SEQ ID NO: 48782 - DNA, 2771 bp, Oryza sativa
aatccacatattttaaaggttaaatcatcctatagttatcctagtaaaacttctaaaatatacgttgtttggcaaataaaattagtgctaaatttgccgctttgttatattatggctaaatatgtagttctatgctaactccgttataaattatgggagtgtctagattttaagcacatggaaaattttcaaaaactttaatcacaattctcacctcttagatataatccactggttgttatcaatacctacttatgcaaacaaaatctgtttctactaaaagattgacaaaattacataaaccaccccataacctattttgtcgcaaaagcccacccatcaaatattgtgaggccaaaattacccaaatgcttaagtcggactcaccacaaaccacactacctagcttggcttagttgatatggtccgccgggattcaagtaaaaaatggaccgaatcagttactcatgtgtcagggagagggcgagggtagagtggtttttccaacacaatgggttatgcgatggaatctcaaaacagggtgacaattataatgatttatgcaatttctcctaaaagattaaacaataaactattctaacctataaaaagaattacaaaactgcatgagataaacttataactaataaaaacttactaaattacatgaaaaaaaatgtttgaacttagataaaaataaaactctaccaaataccttacatgacagtttcatagtattgtagcctaaggctgctttcatttgaagcaccgtgagaaaaaatagtgcatcgtttttcgcgtgcgcagatattgaacggttaaaaggtatttttttaaaaaaatatataggaaagtggatttaaatatggtattatccatttttcacttttgaaataattaatactcaattaattatactctaatgactcatattgttttacgtattttcttaatcttctacttttcccttcctttagtgtttttagaaggagtaattctacggttcttgagaaggtaccaagatgtaccaaaaatttagtgcaaaatttaccaaatttacaattgaaaaagtggtacctcatggtacattctcaaggaccgtaaaattgctctttagaagtagctaggcttattccttttcatggttttgaacggttgattttgtgcttaaaatttcctctctcttaaaaagaagagtaaaattcacaaaactacatgttttattgtccaacttgtataacaatgtacatattttaacacttatcacttaactacatatattttagtattgaagtttcacaaaactatactatcaacgaacgaatccacctgcaagacgacgtgattgtttatctacatatatttacaatgcggacgtggcatcgtgaatgttcgacctcggatgaagcactcaagttcgcatcctaggtgaaacaaccgcacatcatctcgcgggtggatccattctctaatagtgtagttttatgaaactttaatatcaaaatatatgtagttaagtgttaagtgttaaaatatatgtaattttctacaacttgaacaactgaaaatgtagtcatgtgaaatttacttagaaaaggttctgcatgaaaaaaaaagaggttctacacgatttttgtgtggttaacgtgcgattaccgcggtaatcgtcctacggcaggggtgcagtaaccccggtcaaaacgaatgggaaaccctgcccttaagaacccggggtcttcagtacaacccagcaccggcgattgaacaggtccagaatccagaatggtgcgattgattgctcccggtgcgtgggacgcgccaacacacaaactggaaaaaaacccaaacagtggctacgagcgagcgtctccaaaacgaaccaagtactagcgactaaacgaaactttttgctcccgcgactcccgactcggctctcccgggcaccgcgggacggaaacttagccgcgttccgacgaccccagtgaaccagaacgaccggttccagctgctacacgcgagcaacaagttgaagcagagagtacggttcagagtgcccgaatgtccgattacactgtggacctggtcacctggacttcatcttggccggggccgctgaccaagatgggcgacccacccaccggtggcgcggctggagcaactggcgaggatcacaagattcagggcccgtctagttccccaaaaatttttcccaaaaatatcacatcaaatctttagatatatgcatgaagtattaaatatagataaaaagaaaaactaattgcacagttatgggggaaatcgcgagacgaaccttttaagcctaattagtctatgattagctataagtgtaacccacatgtgctaatgacggcttaattagtatcaaaagattcgtcaaacggtttccaggcgagttctgaaattagttttttcatccgtatccgaaaaccccttccgacatccggtcaaacgttcgatgtgacacccaaaaatttctttttccccaactaaacacacgcacaatggatctcctgagaaattaacacactgacagataacatggcaaaatctgcaagacaatttcccagccatgctcagttgttctaatatttccccatgtatatcaaaagtttggctgtcctgttaaaaaaggacttgttattattcccgagggagatgtaatcatagctcatcatgcattgtgtttcttgactttttattctataaataaattttcatgagtctaatggtgtgtttggttaggtaaatgg

SEQ ID NO: 48783 - DNA, 2818 bp, Oryza sativa
taaagaggatctttagtcccggttcaaaagggtaacgggcatatttgatctttagtcccggttcgaatgctgtcagggcatgtcaggccccccgggatctttagtcccggatggtaccaaccgggactaaagatcgtaactttagtcccggttagtattaccaaccggggctaaagatcctggtgatctttagccccggttggtgctaccaaccgagactaaagtcccacccctatatatatatatatatgtcttcttcctcctccagctgcccgagcaagcttcaaaatttcttcaaaaaagaggggaggtcatgccaaaatttttattgaatttattttggtgattacatacaaatcggaggtgcctaaaaggtttgcaacttcatcctccaatgttttttttttgtcatactacatttgcacctatgtttttgcacacttttttgtctccaaaatttagttgtaagttgatgagagagaaaatgtgtgtggggaagaaagaatatatagaaatttagttcatttgctaaataaggttttataaaatagttgagaaggaaaactctagtgaaagttaatctttaataatagaaaaaaaaacttaaatgaaaattaaaagaagtaaaacacattaaaattagtttaaaactttacaaatagtttttaagaattatttggtgtaatattttatgatttttgtatgaataaagatatcttataattattgtatgactgtcattattgtaagaataattatttatgtacggtttttttttgactcatatagatggatcggcaatggatgtacgctgaccggcggtctaaggagtttattgacggtgtgcactattttttgagagtggccgaagctaacaggtaaaggggttttatttgttgtccatgcaataagtgtaagaatcagaaggagtattctgcatccaggactattcatttccacttgtttgagtcggggttcatgccaagctataattgttggacatccccacggaagcaagggggttgaaatggagaaatattaagtgaaagacaacaatattccggactttgctcatattttggatttgaaaaaatcaaacggccaggaggaatagcttgtgatggtaacacgttgcggatgatcttggtcaaatgttgcaggatgccagggaggactgcgaaagtgaaaaggaggcccataaattggacaagatgttggagaaccacaaaacttcgttgtacccaggttgtgagcaggggcacaaaaagttagataccactctggagttcttgcaatggaaggcaaaaaatggggttagtgacaaggcatttggcgatttattgaaacccgtcaagaacattcttccggggggaaacaaattgcccgagacaacgtacgaggctaagaagatagtctgccgttaggactggaagttcataagattcacgcatgtccgaacgattgtatcctatatcacggtgaggagtatgagaacctaaaagcatgccctttttgcaaagcactacgatacaagattagacgagacgatccagaagaagttgacgggcagctaacaaagaagagaatacctgctaaggtaatgtggtatttccctataataccacggctaaggcgtttgttcaggaacaaggggaatgctagaatgttgcgatggcacgctgaagagcgtcaacaggacaggatgctgagacaccccgccgatggttcgcagtggcgaaacatcgacagaaaatttaaagaatttggaaaggacacacgaaacgtacggtttggtttgagtacggatggcatgaatccttttggagagatgagcagcggccatagcacttggcccgttacgatgtgtatctacaacctccccccctggctatgcatgaagaggaagtacataatgatgccgattattattcaaggccccaagcaccctggtaacgacatcgatgtgtacctaagaccactggtcgaagatcttaaacagttgtggaagaaggaaggtgtccccgtgtgggacgaggacaaccaggaggagtttaacctacgagcgctgctgttcgtaaccatcaacgattggcctgcacttagcaacctattcggacagtccaacaaggggtacaaggcttgcactcactgtatggatgaaacagaaagtacgtatcttaagcactgtaggaaggttgtatagatgggtcatcgtcgattccttgcagcaaaccacccggtacggaagaaaggcaagcacttcgaacataaggcccaccaccgtacgaagcctaaatatcgcagcgggaaaacagtgtttgctatggttaaagatcttaaagtagtgttcggaaaggggcctggaagccagcctatagagagcgaagatggtcacgcgacgatgtggaaaaagaactctatattttgggagttaccatattgggaattcttggacatacgccacgcaatcgacgtgatgcacctcactaagaacctttgcgtaaaccttcttggcttcctaggtgtatacggaaagtcgaaagatacactagaagcacgtaatgatctgaagcatatggaacaacgcggcgaccttcacccggaaccaaaggagaaaggaagccattacttgagtccagccagctacactcttagcaaggcagagaagggaagtatgtttgaatgcttggagagcataaaggtaccgtctggatactccacgaatatcaagcgaataataagcacgaaggagaagaagttcacaagcctaaagtctcatgactgtcacgtgttgatgacacaactggtaccagttgta

SEQ ID NO: 48784 - DNA, 4315 bp, Oryza sativa
  unsure (1)..(4315): unsure at all n locations
actatttttggatgtatggattatccatataaatcaattgatgtatggcataatttactatcattcatatggtacatttaattgaatatcattcatatgctaattataattgactagaaatttttaaaaagtattaaattattcatgtggcatttacagatgttaattagagtttttcacaatttaatttactatctttcatatgctacttatatatgactattcgaatttttaaaaggtttaaatcatgcatgtggcatttacatatgttaattagagtttttaacatttaatttaatataattcctacgctaagtacatatgatgattacaatttttattaattttaaatcatgcagtatgtacatacatatcttaattagagtttttaccaatttaataatatcattcatatgctaagtatatatgattattggaatttttattcattttaagtcatatatttgcttattacgatttatccacttaatttattatagacaaaaataatttttcgaagtaattgtcattaatatttgtactttaaataatgttaatgcattaacttctattttagaaacacatatgtaagcaaaaataatatgcagtgctataatctttagtcccggttcttaaccctaaccgggtttaaaaagaatttggaaatagcgggaaaagatctttactcccggttgatgagaacaaccggcactaaagatcgagggctatatatattcccgatgcgcgccctcgtcttctccaccaacaattaacgttttcggccgatcgatctctctcggcctctctccttcgccgtcactgcctagggcaaatccccgcgccgacgccgccatatctcgccgtcgtctcgagcttatagacaggtaccgtcataagttcctctgttaattaagaaaatcttgttatgttaattgctactacgaatcatagctttaaactccatgtagggcttggtatcggttccgtcatttggtccgcggcaaatggagagaaagacttaggcggaagttcaaatttcctatgagtacacatgctctacatttatatttctccgattcaaatacatacaagtgtatattaattagatctctcgttgtttgtcatttatttgtagtgcgcaaagcaaaagcagggaactaacttgtgcggctattacgtgtgcgagtattgccactgccttgcagaccaaatcatcaccacaagagagctcgatgtacgtccaaataaattcaaaatttcattacgtaaccatttcttgtttaattactaatcaatttcatacattcatatagtttattcgcacgagggataacctgaccacacacaaggaatttatcgcggcggttcaagaacaactcatgggattcatcaacgaagaaatccttgatcccaagggtgaattctactacgacggaaacacaattcactggtccttagcttctgagcntagcagcggagttaactttaagcttttaacccttccgtcgaaatcgtagctagctaggaaatataatggattgtaattaatacatgactacatatgtttctatatgcatgtgtacacattttctataatgtaaatatattttggtcatatatatatatatatatatatatatatatgcatgggttatatatatatatatataaaccatgcacaacagggccattcaaaaaaaaaaaaggcccgctgaagcatttttaatccccggtggtggtacccaaccggaattaaaaaccatatttaatcccggttttttccacccggaataaaaaatagcgatctttagtcccggatttgtactcccggtttgaaaaccgggactaaagggggttacaaaccggcactacaaagggtttctccaccagtgattagtagggatggaaattgtgcccgtttgcccgtttacccgcgggtaaaaaccctattaagggtgggtttgttctccatttttataacccattgggtttttttttgggtcaaaagctttccccaatgggtaaatgggcttgggtttaggtaatccctacccttgccccttttgcccgtttaccccgaaaatctaacttacatgtaggctaggagcaaaatccacttaaatacataagccacgttctttgttttctatggtttcccttttattccccttattatttctctcctcttactctatcgctgccagaggagagacacgacaccgaggcggagaatatttgatgttttaagttcgattcgaacttagtagcttgtagactttttgttccactgcttttgttgtggcgggtaaacgggcacgcctccgggaataagacacccgtgggcaatgggcatgggcaaccatccttacccgtcatgtagtaatgggtatacccacgggcacaaataatctcacgggcatgggtatgggtaggcactacccgtgcccgtcgcgcccgattgccatccctagtgattagtcacattgtgcatgcctccctcaggaacagttacttgattttcgtgttaatactaataaaattaaaatttcctctacaagaggataggaaatgcaccactagtagttcagtccttcccaagttttgctgaacacgagtaaaaaaatagtttagtcattttcaagttttacagttccatatccaaatatctccatccatatctctcatggcactgcacacctaccagccataccaaaaaaaaaaaggttgaaaaaaatagatttggcttatttcgcttcaaatttttcacctccctctccctttgcacccacatgaacctccaagtcgccaaactccaaagaaactgacgtccctaattgcaacagcagggaggataagaacatatagcatctgaaaaatatcaaaaaaagaagtggtctccacttcgatcgagcatccatccggtgcgtgcgaccatgcagaggaaaccgacgacgtactacgcctctcgcattgcacgctgcagctaagtgcaaatggacaaaagcagaagtgaggtagccagccagagatagaaagctagtcacggtttgtcgcgagccaactctcaccccagccaatgtatccttgaacgttgggctcacgcgcgcatcgcacggatggcgagcaaggctcgctgcgggtgcagcagcgcccacacgtcacggcgtgtgcagtgcactgtcgatgatggcgcacggcgtagcggaggaatgccaacaaaatggtcgtgtttttttcataccatcacaacatcgtactatctgcgacattggaatttgttgcttagagaacatttttccgtctagggagaatgaaggaaaacaggacgatggtcaaaagttggggagaggagaataacatcgtgccaaacgtgtgtgctgcatgtgaggacaatattaagcgctggctcaaaacgtaagagcttcattttttggcttacgttgcagagcaacggagaaaaaccgctttataataaaaaagcaacaggcaaagagttggtaggcttgtggaaacagtagcacacaaggcaacagcttttactcaggtgcatccgcgaattacgatgcgttacaggaacagaatactggcctctaccacgcaaaacatctccagaaaacggcttcatgctgcacctgacactcggtgattcgttttgctaacgggctgatcggtcatcaacctcttgcaagagcatgtagaatttgaaaagcaatgtgaccaaaatgatacagttcactttctttcaatagtttggtactttggtaatgtaacgttggatttttcataacatgaacgaatgttaaacactcgaatgctaatcctctataggatcatctaattgatatcagcagagagcagggtaggcttgcaaaaatattccctgccagaagctacagccaccttcaggggcttcgacatcatgactaagctgaatggctagtttaatgtaggttatcatgggaactaaagactccccgtttgcttcagtatattcccttctatcccaacaattgtaaccagcgaatttgagtggcctttcaggaaaacatctgtgatctggaaagcaacatgaacagatcaagttagataaaaataaatgtgaaattgatggctcatgacactacctagtcaactatgaaccatacgagctcctaagtgaggtttgtttctttctgcataactgctggcagtagaagatcgagcatagaacatgaaccaaaaaaaaactgagcctttatactaacatcctagtagtggcccaggaaagaaaaatcctggtaggtatgcacaagactaaaggatagcagaaaaacat

SEQ ID NO: 48785 - DNA, 5550 bp, Oryza sativa
  unsure (1)..(5550): unsure at all n locations
gcaaaggagtgcaataggacttctccaaacgaaccacaaaagtggaccccaagtaggttatttcatccagcaaggtttgaatctaagagaggtagcgtatttggctatccactagatgggctcaatgagcagccactatagcgtgtggtactagtacaagtacagcagtagtttctgcttgctcttgttcttctaaaaaaactactgtttttctgctctctacttcattgaataggcagagcgcctgacattttgtttcaagaatatactaacgccctagtacttaatatgtgaataagttatcatacctgggtacacccaaatagcttgagaattctcaatgatgagcagctgtcgacaatcagccccaacgcttcattggtcagttcacgcaaaaggaaagatccagaacctccaagtgcgttgaacagttgcgagcaattgcataagcagtaagatttccagcctaaagtaaaagcagtagatattattataagcataagatatatatgtgcaagacttataaggcatcatacaacagtccaagaaagcaggaaaaactacccaatggtacaggtttacatgaagcaaacaaatgcataggaaatggaggcaagggcaacgccgcaacagtatttaaaatgaataaataagaaattagaagtcaacaattatgtgctaacagccagggaataaatgattatacatcagcagttaaacatcagtgactcagcaattagttttgcagtacagcaattcaatgagtcaattcaagtataccatcatatcccaagaaatgcatgaaaagaacccatacaatgtcctaattccaatcaacacaacgcagagacaggcacacacacatccaagcagagaaatggaacaatgggcagagtaccttctcaacattgttcaggcataactcagttaggtatcctccagactgttccaagaaccgatacacagcttcatcactgcaattacaatcaacatgattacagctcagaaacaactttgcacgacctcattacacaaaaatcatgtgtcatcttcatcaatacaaaagagtaccaagtattaatgaagagtcacgctaaaatgaaataaaggtccaaaatatccatcagtgttgacctgtgttgatatgttaggctgacacggcaaatactatggaattgtaaaaacatgtggatattaccatatgattttgaccatctcttgtatagaactataaatggctaaggagggatccattcctgctggcctaaaaaccaaggaaattttttggaactgaactttgtattctatactccctccaatcagaaaagaatgttgttttagcatgtgtgcagtcaacaagtgttnaaaaaancctctttttncgcccactaattattgtttacaatgcaggttatgggcatatggaaatgaagtggctaagtttgtgttaacaaaagttttcataatattatacctgtaaaactttttttatttatgcaaaagaaataggtggtcaaaccgtcaaagttatctattgttgactttgaaaagtacaaaacaactttttgtgacaagatagtaatttcaatgtttccttaatctacaaaagaaaaaaaagtagcagctcaattttaacaaacaaaacacaatgacccccctaccctgattacaaatatcacatcctaccagaatttccaataaataatgagtttacagtaggacatagaatcctgtcagcattataagtaagaatgaagtaatccgcatcacatcaactatgttattaattgtctctaactgtaagtaaaatcaggcagaaaagcgtataaggctataggactttacagtacagaggagaaattcatttgaaaattggtaacagaaagaaaaggaattacaaggtaaaaacaaacagatacatgaacatcataattggggagtatggtcagaagcaacccaacaagcaggttgtcctagacagttagactcccagtcccagccaacaaaggaaagtgtgggttcctttcacaagcagtataatcaggatatgtaattgtgtgcaaaataagggagataaattcagcttcttttcacaaggttaaaaacctttttttacatagagaaactgaaaagacaccctataccaagaaataaattcttattgaaaagatgataagtagaacactagtcgaaaagataaaactcattcaatgatcattatgtaaaaaaaataaagccatggatgtacatactaacaaaattatcctgctaaagaataaaaacactccaaacagcatcagaagagaaatacctgaatgtattcctttggagctttattttttttataagccggcaaccattgcgaagatgtctcattgctgaatcccgcaatctattcaggttgcgaaggtccaatgaagataattgtgggcagttccccgcaatagtcttaatggaagatgatgtcagttgcctacatatagatgacacaaacgtaggtagtcagaattacaccctaaatcatgtatctatacctgcataatatgtcatattatgagtataaacatttatggtatcagatgattgtgacanaacagggggccttattagtttactatacgagaataacttattaacaatatgctctcaaatgtgacacttaaataacaacaataaggccagtgccccagtgaatacaattattaaataaatatttaagggattgatgtcaaaaggctttcaagaaggtaccaaagctattggcagcctgcaatatcatgttatagtttcattttggtcaggactctcatcagataaaaagttacagatccacatttaaaatgctggccctatattgatggataagcatttccctagcccctttactgatggaaattggtgctgtattaacacataggacagctgtcatgtactgatattgaggtaaataattgtcttattactgttgtttctctattgtagaccttctagttacattagaatcagcttttggacttatgctttatatggaaaatttgttttgtatgcacctgattcatggtgtagtttgggagatgaaagttgtaacctaaaactagtgctgataaagtaataatacaataaagaagatattcctcataattaagtagaatgccatgaagacttacaagcaaccagcaaatgccaactccttcagatttgaaccgtgtacaggaataagctcattgacaaacttattgctgacagattgtatgccagacattgataaaacctctaaatgcttaatcttttgtaaggaaggaagaatcatcatggcatccacgtttaagcagtcatcaatatatagttccgtaaggactaaactcaacttgttagcaagattctcgattccagttgaagtgagaagagaacactcgcacaaatttagcgaactcagagaaggggctgcagagattattgtgtctaacccactatcagaaagacggtaatttcccttcagagatatttttttcaataatggcatgctgttaggaacctttgctaaggtagcaggcaacatgtagtcaggcatgcatcgcccagataagtcaagctgcaaaacctcagtaagagcaaaagggagggaaaatgagtcctcaataggtgacttaaataagaaggccgcaaagttaacaaaatatcagtgatcaaccctaagacccaaacactgttatggtcataatctaaaaccgacaaatttaacaacttgtttttcaacgacaaatcgagacatggcacatggacgaaatggtgcttctacatgttttaatatcttattcaacctctaaaattctagttaatcacggaataatctatggtaacaaaattttcacatatatatgtaggataaatgataactttactattagaatgtaaaattgtcatgtgctccctgtaacaaaaatattaagggtgtgttcaatgaaatagctcacaatttttttacaaaaattacaacatgtaattcgtttttaattcatatcagcgcacggcatttagctataaagagtaaaaaaaatattacctgcaagatttctgtcctgcatttcccaaaaatggtctcaaagtcatcctcactcaaccatgaacactcactgagttgcactgtcacaggattatcacacatgagttcaccaagaagatggacattcatctttctagaatggcatagactagataagagtctattttttagctcatctggaatgccagcaagtgattcgatagcttcagcattatttgaaagagtttgcaagcacaagctagtaagcgatggagcagatcgcagtggagatttcctatctttggaaggtatccacgaaatgaccttattagcagacttgttcaagttggaagaattcaactcccgagctctcagtttagcttctctgtcagtaatgatcctcattgcagttgaaaatggacctggccagtcctgaggatcaggaaccggttccaactcttctgcattgtcatcatcatcatcaccatcatcactatgtccatcttcatctgctttgaagaatgcaaacctaggagccatttcaatagctctctgtcttgccctttctctccgacgtggttcccaatgatctgctgggaaactctgcacctcttcagaaatcactgagttcaaatccatttgatccgcacctgagctaacagacaatgaactctcttccacaaccatcttagcctttcctttactatcgggactaaacttaccaatcccggtaccagcaccagaatcatcgttccccaaatacagcttccctttgcctttaacatcatacctagccttctgccttctctcctcttctgtggaatacatacctgcatggttttcgcctaatgcacttcgcataggagatgctaatagctcaatactctcaccaattgccgaactctgtccgtgcacatgctcgtcaatggggatgtcattttctcgaatagtaactccactagctttctttttacctgtcttcacagaatcacccattctcccttcatctgtcctgcccatgctcatggtgaacagattcagttcaatcaaatcagaagcagcgcataactgtaccggcatcctactgccatcctcccctggaagtatgcagtcatcatcattgtcactctctgaatcagagacgtatgggatctccatccctatcttacgacgcttccccgaactatccacattccggtgtggcatttcatcatgcacctggcctccagccccgccacctccattcgatccgagacccatctccccacccatttgaacaccaagctccatcgaccgtttcgcaaccctagaccccgattgcaagcttatgaatgccgcttcaccactacggattttaccgccgccccaaaccctaacttcgccgccgcccccaaactcaccagcgctggtcggagaagcaacgggggcaggaatcgcttgtgccctccccttcctcctcccggacgacgcggaaccagagccggaggaagcgccatcggcccccgcag

SEQ ID NO: 48786 - DNA, 2519 bp, Oryza sativa
aggcttgcgggggaaggaggaggaggcggtttgggcggcggcgcagttttttatggttttcccgcgcgggcgagggggagagcgcggaggcaggcgatggtggtgggttgggtttgggtcgtggatggctgcgggctgaggcgggttcgaggcccgaggcggcggacgtgggggcgggcccaaggtgaggtgagcccggtgcaccgtgcgcccgcgccgtcgtttcgctttgagattcgtgcggtgtcttggttccggtgtatagggtgggtctagagtaactgggactttgttcgtgtccgttatcggggatcggaatggttgtgcctaggctgggttcgtgcttcgtttgttggcgtgttgctacagtgcttttgctgtgacagggagagaccgggagggttgtgcatcgtgcatttgtgcattcagggggtgtttaggctgtatttagatctagcgttgaaaagtttatgcgtgtctcaggatgtacggacacacatttcaagtattaaacatatattaataataaaacaaattacagatttcacatgtaaattgcgagacgaatttattaagcctgattaattcatcattagcaaatgtttactgtagcactacattgttaaatcatgaagcaattaggcttaaaagatccgtctcgcaatttacacacaatatgtgtaattattttttattttgtctatatctaatactccatgtatatgtccaaacattcgatgtgacaggatgaaaagtttttgcgtaggaactaaacaggtagattcaggggtgtaaagttttggcttgtcgcatcggatattatatagggtgtcgtatggggtgtttggacactgataaaaaactaattacaaaatccgtcagtaaaccacgagacgaatttattaagcctaattaatctgtcattagcaaatgtttaatgtagcaccacattgtcaaattatggagcaattaggcttaaaatattcatggagcaaatgtttactttaccattcccatattttccctatgaaatgtccaagggatctcattcggaataacattctcagttaattctctttcaatcaatggcaagttctgtaccgatacaacaggcactccatttcccattttgatttatttttatctttaccttttttttaacaaacttataaatgtgtgtcttatgataaaaaccggagatgtaattcatttctattataaaaaaaaagatacaacagggcacttgctgcagaaagcgcatccgatgggaatagacgagtgatcaaaaggatcttacaatcacaattattttccaaagagtacatttgaatagataaatactataaatacaacagatgaacagcctgcacaggtaattcatcatctataagtgcagaaaacaatgctctttaatcctgacagagttcagctgctaagaaaggaaaagaacagtgcggcagcaacaagagtgttctactggttttcagaagcaaaattccaaaccaggtccaagacgagcaaaagaatggtgcaacaacacatttctactcaaactcacaaagcgaaaacacaagccgcggagaaaagtagtgcagccaccagtctccatgtacctgcaccgatcgaaactgcagcattggcacccatgcaatcgtcgttgttgccactgaagcatcctggacggacagacttgggcactccaccatctaccttgaagctggtggttggcttcccgctgctgaacaagacacaccagaagtacggcccgccgccagaagtgccactgacagctgctcccacctccgtgtggttcttgctgtgcagtacctgaatgctcttcgcatcattaaccaggaagttgaacgcctggtctggggtcgcatagttagactggcaagccagaagcctcccggtgatcttggtgagtgttgcagcttggacgccacaatttggggcaaatgtttcagcgaagctggtctccggaggcttcttgctttcaccgacttggttgcactgaccctcgtatgctttaatgtactgcagagcaatgcatcctaggccttggttatcatcaagagtagatgccttgctggcagtgcggttgctgttgatcaatgccacaagctggtcggcagggttatctggaaaggagatcagttaagaggtggaattggtacacaaatgcattaggctgtgattgggtggccatttgattacaagcaaaaaatcacaacactggaaccaacaaatgcatgctaacttaaaattttaaactcttattaataagcctacagtaaatgtggagggaagtacagcaaatttccatcagcaatgatcagtagtccagacatttttcaatggagaaagcagcaaccaatgtgaaagttgagcatgctagtatcaaacttaatgtggttacttttgggaattttgtttattaaagatgttattataccagcattcattattagcaaccggggtgtgaattgagtaatagtgttttacaattaactggtgtt

SEQ ID NO: 48787 - DNA, 2327 bp, Oryza sativa
ttttgatgggttatcataaatatacggtgtcttttaatgggttgtctgtgatatattgttttgtatcgtgtttatccagaattttccaagaagttaaaaaaatagcatttccattccattttcaaataattcagaatctaaataaagcagtcgatacaaaactgcaatgtagcagataccattagaaaacttcaagccatttcaccgctaccagaaagtcaataaaactaagtgtatcattagtcttttaagatatttcattgaattgaataacttaaattaccttgccctggttccctcaatcgtcggtgcgatctcacttgtaatgatctgcggtttgtatttaatttgattaattaagtgcactttatgatgtgacgtaccgacgtgtcttcaccgaacgttcaatgacgctactagctttatatatgtacgttcttattaaaaaaaaaagagagatgatggtatcacacagctagtcgcataatatggtaagtgagattttcatgaggcatttttactcttcgtttacacattcaagaggggttatgaatttacagactttattacccatgttatctgcatggagccgtaacccgtaagtacttgtgcagattaaaattaaataagcgaaaggaagtattcttttctggggtaagtttgcatcaactagtcaaatctgttattctccacctgtagtagcaatttgatgccttttgtaatctatttgccgttacctatgaggctgtgaaattaagcacactgaaatttaaaaaaggaccaaatggtaggtgcatgccatgtgcaggttcttaaattaagaacgcaaacactgcaaaatcaaacgacgcctatatctgccgtgattttgcaataacaagcttagcacatctgcacatcacatggcagcaataatgtgttctttttgtcatgtctacggttttacggactgctatatccgaacatacgcgggcctccgacgaggatttaatttgtccgtgatgattgacaaattgataacctaaccaatgtcaccgacgacagtggtaataaactaggagtactacctgacccgtgcatgctaatggagtattatcagtttgtcagtacagtatgagggggcagcgctagtgagacaattaaatgaccaacgaacggacgctgtcatgtcacctctcttaatcttcttcaaaatggaagaatttatagagattttgtcagaatttaattaaattatgtgaaatttctgtaaagttcttacattaaaaaagaaccatggaaaaacaatctattttgccacttattaggcgtttaactatttacgacccatatttaccacccaaggatgacacacacaaaaaatatattgtcataacacatgtgtgcttatttacctacgacatatgagtccaatatcaaatagttaatagccacatttaaaaatggtaaatagttaaatatctccacaccagcactaaaaattaaatcgttaaatgtcacatctaaaagtgataaatagttaaatatctcccggatctgaactgttgatgattaatctgaaccgcctgcccaaaaggcacagaggttcggtagaggtccaaggtgtattcggaatagcatgttcccaacatgcactgtaaacacgaaaaacgaagcggtccattagtgtgtgattaataaagtattagctaatttttttaaaaaaaatggatcaatatgatttttttaaacaactttcgtataaaattttttttgcaaaataacgtaccgtttaacagtctaaaaagtgtgcgtatggaatacgatggagaggtgttccaatcacagccaatatattttgaagagtgacaattataaagggcacatcaggaaatttacctaccgcactgttcgtgccagatgtgatcttagccgcttatacctaatcgaacggtgagcctatcctcctctcccacctccccaaaacctcgacaaatcgtggctccggccgccggcggccgtacccgcctcctcgagaggaaacacccccgacccacatccttcgctgcacagagcatgcagcatctgacgcgccatcccaaccatggccgcaggcgaccagggccatgtccatctccggcggttcaattcttcgagtactaaccatctccttcgggcacggcgactaagggcctgtttggttgctaccctgagcaaataagcctggcctaaggtcatgcctgtaactcgcctggcctctggttgggtgcttaccctgaggattctagcctgataaatcttgcctgagtgtactcgcctgaatcaggcgtacaaaatgggtggcctga

SEQ ID NO: 48788 - DNA, 1136 bp, Oryza sativa
tatgtcataagatccagtgagacagtgagcccggtacttcaatgaggtgttgaaagctttatgttgtcttgctaaagatatgatacaaattaggtcaatagagacccttcaaagatagttagtaatcctggtagattctacccatattttgaggtatctcacgtgaaatatacttattcaacattctaattaatgtaaccactttatgtttgtatagtaataatttcttctaacttaggattgcatcggggcattggatggcacacacatccctgcatttgtcccagagaatatagttaacaggtttagaggtcgcaagtcctatccaactcagaatgttcttgctgcggttgactttgatttgaggtttacctatgttcttgttggatgggagggttccgcacatgactcagtggttctcaaggctgctcttagaagatcaagtggaattcaaatacctgaaggtgtgcatgaagctttagtattttcaggtgcacaatattttgtgacaaggcaataaaaccattcatcttctgttgtaggcaaatactatttagctgatgcagggtatgcagcaagacctggtatactaccaccatttaggggtgttcgataccacctgaaagagtacgaaggcgggaaatcaccagaaacacctcaagaattattcaatcttcgacattcctcccttcgcacatctgttgagagagcatttggaaccttaaaaaaccgtttcaaagttcttgctagcaagcctttctttccatataaagtccaagtgaagatagtaatagcgtgttgtgtactgcataattggatccttgataatggtcctgataacatcatatatgatgaagctcgttggtatagtaagctacctagatcagctagagtagcgacagattatggcgaggagcaccaacagtggatagaatttcgagaaaatctagctaatattatgtgggaggaacattaacagtggtgttgtatggcatggatattgttctatgactgttagctatttctaatgaattcttctttcagctcttcatattatagcattttctactttatgtttttttgttggatgccattattacctactgtgcattgctttgtagttcataacatggata

SEQ ID NO: 48789 - DNA, 1526 bp, Oryza sativa
attatatttctatcatatgcttatggttctaaagcatctgggggtctggggttggaaattaataaatctaaggctggtatttcctttactattttgataacttatataattttcaggctgactcaaagttttgctttcaattaaatcactaatttccattcttctcctgccctttcttcagaacttatttttaaagggctcatgacagttattcccttagagtgcatattttcaatcacgtcatttacatttattttgtatttggaggcacttctattagttaatcttcctataaattctatgcttactagcaaatttgttcctttaaattcctcgtatccctttgtttgaaaaccaaaactcattttatctataaattcttttataggcatcattagatctggggctatatatgttatcaacatattctcattcatgtcaccttctaaaaatcctaatgctgctttatctattgtgtcccaccttttatctaacagagttattagaactttagctcctaatttctttcttgtcatacctttgattcctattatatacataccttggtgaatatatttataccctgaatactttaatccattttcaaattccttggctacaatttttagctcaactgcgctttgttaaaacgcttaactctacttctctagatattctgtataacccatttttattctcaaaaaatcccatgcaatatatttgttgaggtcttattgccctcagagtatctctttgatatctttcgagctgtttgtctacttctgcaatatcttcaagctcatctatgtcttcatttttacctttttgtttatcaatacaacttaaagatttatcgtctctgcttgctattcttctaaacaaactcctagataggtccatttttctgaattaatagcttgagatgaggtaattatgcctgttgaagccaaaactatctcttttcctttactagaatttattatttctaataattctttgatatagtcactgttttgtaatatcttattctgccttgtcttatattcctctagctcttttagcactgaatttaatttattactgacaagcaaatattgttcttcagattgctttcgttctttaaacaaatcttcaatccttcgctctaaatcttcctgctttttatcccaatttatataaaaattatatatcagatcaacaattaaatttaattgactattgttagagtgccaactatggtcttcaatgtgatttaacctacaccttatattcagattatctttggtagtaattacctttccaatattagcttctgaatttgatttctctatgatgactggctctgataccacacttatgcttcggacaaaaaacactgttcaaaaacactatttattcggctgaatactattcagtttactgtttattcggctgattactattcaaaaacactattcagtttactgtttaaattactgttcaatactgttcacttcgagagatattttaactttaggatctttgca

SEQ ID NO: 48790 - DNA, 5000 bp, Oryza sativa
atgggaaacttttcgtgggtctatctctcctataaatcctatacgacttttcccatgaagcattgaataaacaagaagtcccatataatttctgcattttgaaaatcctaaggatcaattaaatatgccaccttaagtttggattcatgtgttccgaaagagccctaaagagagagagtatacgagggcataatttaatttgcatgtatgcgttgaaatgtaatggattgagagacggctgtgttcggcagtaggagattgtgagagagtttgtttcgttttccgtatgtactcttcccgaactactaaacgatgtgttttttgcaaaaattttctatacaaaagttgtttttaaaaaatcatattaatctatttttaagtttaaaatagtttatactcaattaatctcaggtagccgagtggaggggcatctcatttcccaatgcgtagatagagaaatggcacgctcgtacgacaacattacctagaaatctgaataagattgtgctatactcatctcctggactggaatgacccgggtacaccattcaatttttcatcaattgctaatcgctatattcactagtactccctccgtccctaggatatgatataatgtttccattatcgagatatatatattatactgaaaaatatcatatattatcctagattagtttattagctctagtgtattggtaaaatttctatgcctagttcactgtacaagtcgatgtaaaattatataatttcttccgtcccaaaatataataacataatactacaaatctaaacaatgtccaaatttgtactattagcatgtgtctcatttagttctagactattatattattagacggagggagtagtcaagataattaattttgtactagaccataattaatcaaaaccttcagactattattatttgtaaaccagaggaaaaaataaacccatataggagtatatgaaaaagggatgtatatatacgtagaagtagttaattgaccatatatgcagctcgggtgtcattaacccttttctctgcatgcactgcatgcacacataaacaagttgatctcccatgtttcccttgacagctacgcggttcttcttagatccttgggtatatgaacgagaaatattattgacactaccaatgatcatgttgaaatgtgcgtttgcatctacacatgcataccaaattgccaaccaagtgaccaacattacactacatgcccctttcttatactctcttctagtaggggcagagcagggcatgcgtgcgtgttgtagactcgagcattgaaaaatggagtgatcacacagctggtagtggttgtagttgtagtagtagtgctactactagtactatagcgacacatgcaggtagatggggagaccaggagaagcacaagagggaatatacaagtgacgtgctgtctcgtgcacgccctaacagggtaggaacagcactgtctccccaaatcgggtttacgaggcactttttactctggtgatttgctctccctctcgtccgtatcaggcacctagggagagaatccctcccagatagtaacacggcccaacagtactagtagacgttgttttcttaatttaacatacattttttttctttgaaattaattagtaatccatgtgtttgtatacctctacggccagtttggttggaggaagtttttaggagggattgagagtttaaagggatgagactattaagtgttttgtttggtagggtgacataggaattttggtgggctggggatggggaattgaggaagaacttccctcattttcaatacttgggaagcgccaggtaattgtaagggaattcttcttttatttggtttaagcaaatttaacccacccattttaataaatgccttattttccaattaaattcccaaccaatttcaatcccttttaccaaccaaaaaattggaattaaaaatcaaattcccttttaaatcccatcaccaattccctggggtaaattcccaatccctttccatcgagataccaaacaagccactagcttattccatcgacatagatataagagcattaattcatgatatattaactccgttacagctatctagattcattgtactaatatctaatatgattatagatggctatattattatgtgatgaagggaatttacattacaaactagagttgtccataccatctaaaacaccactcaagaaaactgttcacttagtgcatatacatatatatatatatatggggtttatctcagactcaactaatcaatatcgttaccttaatccccatttcaatcgattcatgtctagacacaatatgtatgcatcaaatgctttttttatatattcttaaggttggattttatgtaggacataggttgtctctccccgtattaattgcagtgacaccttggattttatccaatcagacatgctatttataatatcatgaactctagtgatggtggagtacatagtacggtaggatcttacaatgttattcaaacatactgtataagttgatcgatctatatgaatactttctttattccaaaatataacaacttttaacttttagaatttattctaaaatataacaacttctccaccaatatgttttctcaaccaatcacaattctctaccattcaacatatcttcacttcttatccaatcataatcttgcccatttaattctacctattttcttaaaagttatgtctagtcctaaaagtccttatattttggaacgaagatagtacaatttacccagttgtgatatattttttctttgacgattaacattggaaagtgtaggaccttatgacaaacatgacgactctctttcagcgctctgtttgtgctctcatcaaaggcagagacaggggggcggcagggtccgcaagccccctccaggcctccaacaaattttctacatagaatcatctgacgaattatgtaattaagctacgtaatggagtattagaccccttcgtgactcttatacctctctcccaagtttaaattctggctccgccgagggctctctaaaacacatctgaatgggataaaagaaatttgggcaaaatgtatgcatgggatggatatatgcatgcatgtaatttggacaaaatgtcagcagaatggaagagctatagctaggcagatgagatgagagtaaatgcgcctttgggcaagagggtggtacagttactgccatactggtgacacgtacgtacgtactccacggaacacagcaaaatggatggatgggtgcatggcataaatgcaccccacattacttcctgtccccccctccaaaaccgagtagaggctggaggccggcagctcttgcattctaccctacccttgcattgccattgccattgccattgccattgcattgcattggcagtagtagtggttgcacagggtctcaactgtagtgacaagccaactgtaaactggagtaaaagcagcagctatacaatgcacacaatgcatggatggatgcatgcagatgcaggcaggaaggaagggggtgaaagctagtatgtagctatcctacactaggcctggctaggaaagctgacatgactactggagtaactgtgccagctcggaatgacccaaacagagaccatgcacaagctgcagctaccgcacgttaccgctagctccccggccggctacatgcagatcgatcagcatgctgaatgatgaatgaatgcacatgcatgaatttgttgagcactgttcgagctcgaaatcgcagtataggggaatggaaggagacagcactacagcagaggcattctaccatcagctgagaaaaattatgagagctcccattttgctacggactactctctcaatcccttgttccaaaatatatgcatttctagctagcggccttctttggaacaaagaaattttgctagtttttttctctaataaattgaactaattcgtacgaaaattaatcctgtaggtcattagcatccaccatccggttaccagagcacatatgttaattttggggtattgttcgattgatattgcttggagttagatgttggagaaagttttaaattgtactaccttcaacagcccggctaccacccggtagtttgacttaaccgtaccccggtcttgactactactaggatctgattgaactgaactagtatagtgcagcaagcaccacgtactccaaatgaacgtaacattgtgagcaagttctagtgttgaacccaataaaattaaagatgaaaaacaataacactgctagaaattagaaaatcatcagagcctaataatgtcataccagatggcccaaatgtattgtggcccatagaagttcttacctggacagaagcaggccagcctaatgggccacttgcagaaatgacctggatatcaggcattcgtgccaacccaagctgggagcggatggcgtcgtcagtcctcgcattattcatttatgatcaacgcaatagagcaaacactggccctgttgacaagtcacaaattccacattagtttgacaacagttcatgcactccaaataggaggactgaatgcccagttcaaattaatttcaagttttcaaggtgaaagcagaagatcagattaacaaaaaagtgaagaacacgcccgaaaaagtgaagaacacgttatgctggagtggaatgtactaatttaagtctacagtagcaaatctcgctacaaatcatgcactcgcacctcaggtttcatttatatagtgccagaaaaggatgaagctacaagtttccaactagttgtacaagcatacattgtgaggatgaataggatgccccatgtttcagacctcgcttgcctttgtacatgcactctataaggcagacctccgaaatcctgttacagcaagttcaaaattgttaggtctcaattgaacatgtaggcagaggagatgctagtgtgatat

SEQ ID NO: 48791 - DNA, 3374 bp, Oryza sativa
agtatgttataatttcatccgtcaatgtatgtagagatcgatcgatgtagctatgcatgcatatgtaggttcgataacatacccgaggagggtgcccctgggcatgcgcttgttcttgtagtagcgcgaatgctggggcggctggtagagggaagggtggtggccggcgtccaccccgtcccactccagcgcgtcccacacatccttctccacctcgatggccggcttctgcttgccctgactgcggggcagacggcggaggctccagcatcctctgatcctgatggtctccagcgcgggcgccaccatctcgacggcctcgcatatctgccgcagtgacggcaagtcgtgtaggtggatggtggtcagttttgggaactcgatacttgtcgactggaactccgtgtccggtacaaagatgtgcctgaggtcgccgcagtggatgatgtggagggtttccaagctggggaaggaggggagcgccattggaagcgcaaaccggaggcttgggcaggagcgcaggtgcaagtgctgtagactttgcaagtaaccatctgaggacttgatgcctctgctccatatgcagtgggccttgaggaggtccgatgcccagatgatctccaggcgaccgtcctcatctgcaccctgaggaaagacgacgtctaggttggaggacctctccacgcggcaccacctgaggtaacaccaattttccgcagccaaggcgtggcggcaggccgagtcatcatgcacatgcagggactcgtgcacgataccattagctgaattaacttgttgctttcatcataggcttgcttcacttcactctccacgctgtggcttccatcaccaatctccatgtggcgatccagctgttgggtcggaggctgcgggaaggcctccattgtggttacggcatcgccgaccttgctaaatacatcaccatagatgcctgctacaccgcagtgtttctgaccactgggttcagtcatcttcttgcttgtttcttctggttgcacaactccgctactggatgccattgaagaggtgatactgatgttgaaataataatagtaattgatcgtagccagtaaggaccgagcgagcctagcatccacaatacaagcatgcacctgtaaccggaagtatttatggtcgacggcaagggatggccgagcacatccaagtaccttccgggcaggacgtgtgtctatacagagcaactccagcaaccttgaccgtccccatcttattgcacgaaggtgctcacagcctagcagaaatagccgcttgagacatgggacatccgtcaccatagttccaaagtcgagcaccttgattgcacagcctgaaaggtcccgctccaccaagttgggcaggccacgcaagaacagattgtccagctgcgtgcagccttctagggatatcacggatgttttcacatccttcatacgaatcataccacgccgaacaggacggcagctctgtagaggtagctcaatagttgatgcccgactgggcgctgcagatccatagccatcaaagctgaatgaccttagcgatgatggaagcctattaggcacaacaacatcctccagcgcgtcacaaccgtcaagaataagaaccttaagttggcctgcattggatatgcttgttggcagatttttcatctctttgttgccagacaaatcaagcaattgcagatccgttttgtctacgaatatgtcgttgatgtcagttgatgatgatgatgtctcagcctcattctgagggttgattatccggagcctctcaaggcatggtaatcttttctttaactgacttgttagctgcgagcacctaactccctctatgtttacctccatcagctggttagtcatgagctccatcttttcctcgtggaaaatctcaacccagtccgtgtagcgtaggtcaatcaccctcaagttttgcagacatgcccactttccttgaagttcaactgtactgttgctcttacagcgatctaatccaatgaattttaacgtttggcaatggaggaaaggaggcgatacaaagttgaaggcacaacaggagagaaccagcacgcagaggctactgcactgttcaaaaaaaccatctggtattccaaggaggccaccactgtacatttgagttgctaagaagattgatgatgcacttgccattttagtttgcatagcctcctctatggtatcatttgagatggcaaaaacccaacggtaaggcctgtttgaatttgaatagacaaacttattgtcgtcttccagtaataggaaaggggccttcggatccatcttcaacatttcaaccacccttttcaactcataagaacgacactcgaaacttacttctggatgcaatgcattactgacctccaatgctctagccccttggatgatcccatcgcacgtccaatagttggacgcatgagctggccaaacaaattcattggtgttttgtttattgtgataatacatgagaaacccatagagacaacaatctgcaactatttccaggtcgatgttctgcagacatgggcagcgacctatggtagcagcctcttcacgaaacagtgcaccgaactctgaacttgagaatttatcagcatcctggtagccatatatgaaaagatctgtgtatctgccttcctttattttcctgtaaatactatgtaaataggaaacatccatcacggtaaggaacattctactccaagtccatattactacgcagtcaaaatagtctgcaataccaaatgtgcttagggggatctcatcatcactcccgttaagaaaaaccatcagaaatctgctctggctcagtatcctgctaatcgctgctgaaacatttagtatggcatccctagagcaaatgtccactccactgaagtcatcctcctcatcctgcttatcaaacgatgccatggtctcattgtcaagttttagctcctctgctatttttctttgcatcacccttttgcttttccaccttgagcaatctatgtatatagtcctgtcgaagcgtaattctgggggataaggtttcatggatggaagaacttctgctatggatctaaggaccccggtcctcccaaaaccataccaaccctgaaaataaatcatcgtcatctttctattgatgttgatgttgctctagataagatttagtatttcttctctggcggcaccaacatctctcgccctgatttcctgaaatgcagtagcatatacattaagtccactagtcgctaacacgtggtgatcttcatctctactattataaaagttgaagatgtttttttgccatgaaccttggtacgtcaaccttttctggttctatttatatttttcatc

SEQ ID NO: 48792 - DNA, 2201 bp, Oryza sativa
ctaaatatgttatttataggttttgttgccttaaaaattaatgccaatgggcccgtgaagaataccactatatatcattgtgagactttatacattaattaagggaaattcaaatggtaaattgcttattggacaatgcaaatattaaaatagcatctcataatttgattggaatttatctaaataaagtaaaaaaaggtatgttgcataactaataagggactttgtgttaaataattaagaaaaaaaaagtgtgagcagtcgatattatggggctaaaaccacacacctcaaccaccttactagtaggcgcattgaaaaaagaaatgcagttactgaatgccatatctctacgtccgtaaataatcaaaacatcaaataaaagtagtgccttaaccatggttaattgtgtacaattctcttattcgtaaaattacgacggattgatacaggattagctatacatttattgtcaaattttaactaaaaattttaacagatgtaaatcgtgatgtaattgttgtgtaacttacatgtaactataatgtaacttgtatataactttcaaaaatccctaggtgacatgctaattccgtgaaaacggatgtaatggtaccaaatccccttgcatgttcgtggattgtgattttttttcctacctctcttgcacgaatttaacaaatcgaacggttcaaaattacattatagctatatgcaagttgtaatgtaaatacactacgattatactatatttagatctgtcaaatttttagaaaaaaatttgtcaaatatatagtaaaattgtttctgtatatatgtagcctttgatggtctactggtgttatggccaccttgggtttttgggtaccggtgttattaacacatagttagatgttttgacgatgtagctggatatattacgattgtagtatatttatatctatcaaacttttagaaagaaaatgtcgacaaatatgtatgtatatgtatgtatgcagtatttgatgttctgctggtgttgtggccaccttgggtttccggtaccgatgttattaacgtatagttagatgttttgacgatgtaacactagatatattatataaggaatagcgaccgttacgtgtgttttacgataataactataaaaccttcacgatacgcactttttttttgcgaggacacgatacgtacttttaatatgggatttcaaatgatcttagtcataataatacggtctatctaatcaacagctagatctttcttatttacgtagaagctctctggaagcgcctaatgcagaacatagtaaaatgaaagcagactaactagtgtgcataaatggaagaaaacagttgtaccggttctttcatgatggaattccaatgccgtacaagatggaacaagaacgggcagagaaggcgcggatgcacaatcgtcggttgatgatcagcctaacccatgacggatcgatcgatccgccaactggtgaaatgccgatcgcctctttgccaactcctgcatgggtacagaattaacactctaactgtcagctctaattaatataatccctctgcgcttcacaaatcacaactgttggtgagagtagttctggagctctggatcagcattgttgcagaagcagaaggggaacaatcacctacctgcagggaagctcgtcgctcggaattagacgagaattcgtcgatccgtcgtccaaagaagagccctagttagctgctaattcgtctccaaatcaaagacacgacatgacacgcgattccttgcttgttgcattgcctggtggtattagaagagttggctggtgggtcatcggatcctttgcttctcaccgagctcgcgtctcttttacaaattaaagcatggaatcgaattctgttgcgtttttattctttctctaaagatgtatcatcgtttcccatgcagttgctgtgatcatgcatgtctgcacggcccattgatttatttaggctgtgtttagttaacgtaaaaattaaaagtttggttgaaattagaacgatgtgatggaaaaattagaagtttgtgtgtgtagaaaagttttgatgtgatgaaaaagttgaaagtttgaagaaaaactttgaaactaaacacggcctaaggctagagaactagtctttgctcctttgtctaaaaagtaaagagattgaattgggtccaattaa

SEQ ID NO: 48793 - DNA, 1303 bp, Oryza sativa
tcacaactgcattacaaaagggaagcggaagccaagacttgaaccaaacatcacaggcgcgacttgggaactaggccgaaaccctaaaactcatcgaagccggcttgctcctggaagaactcctcatcagcgggatccgcttcatcttcttcagcaacttgggggggttatttatatagagcaagggtgagtacgggagtactcagcaagccatgggaaataagtgtttaatgcatgcttcaaggaaaggctgttatttttgcaattgatttaattttgaactcctttattgaaacaactaagtgagtgcttctcaaacgacacggatgagacagtgcgtctcgtccggtcggagtatgtgcaatgtatcagtcttttgaattgttcaagattggcacccggccaacaacttttaaacggccacctgggcctagctgatcccatcagctacagattttccaaacatcgatccccttcccacaacagcaatttcacaaggcagtagtcaaacaaaactacgctaggaatcacctcacatccgcccatgaccgtgggcacggctgttcgaacagtttgttaacctctgcagagggggtacactttacccacacgacattactaacccggatcaccctgcccacggggatcagccacgtcgggagacctccaagctttcatgacaaggcatttccaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctaattactcagccaggggtgtcccattccacccatgtggtcgtacttgtcttatgttcggatgaaattccaaggaaacggtccttaagtgcaagaacgggaaactgtacacccggtacgttccccggtccgcggttttggaaattcatttagttcgcgagcaccgacccaggtgtcgagttttccaagtcttttgtaaaacccaagttttacccaagaagttactcagattttaagtttgaaggcgaccgtcgatactcgcacagagtgcacgaatatcgaggcgcaactagatggttacaagggaacatggtataacaattaacaaaggaaggatcaaatgcgacaaattaggtaggtccgccaatctgccttcagacgggacaagcagactaagtgcgatcctatcaatgcataatatttttcaagcaacataattaagttcaaatataggc

SEQ ID NO: 48794 - DNA, 1157 bp, Oryza sativa
cgggcggctagggcgcggcccgagagaagaagcgcggctcggccgagctaatgggccggccggcccaagaggactcggcccagcagggcgcgcgggaggggaggagagagggagccggtggaccgggctcacctcgcgtggtcccgagtgggacccgcttgtcggtgacacggttcaccgtgtggagcgagcacgcggcgcgcgctagggttcggggagagagacgcggtgcacgcgcgcggttcgcggaggacgcggtgcggcgggcccacgtgcagcctcacggctcgcggtggaccgcgcgcgcgagggaggggaaacggagggagcggttggccgggtcagctgatccgggcgcggccgaggtggtgccgactggcgcctacgtggcagccacgcgggccggcgggaggttgaagaagacgccggccggaacggacggcggacggcggctacgaaaggcggggcgaaccacggcgatacaggcgaaagcgagcacaccgggtggttgttcgagacgaggggagacgagccaacggctcggattcaccggagggagctcgacggcagcgaattgcggcagcggcaaccggcggagagaaaaggggaaaacggcgacgaggtcacgaggggccgattcccggcggtgagagcatctacgcggctacgggaatccgttgctagcgccggattaggaggaaacgcatcgagggaggccggcgacgagaggcgcttccgagctcgggcggcgacagcggcgagcacacggcgagcgacggcagcagtcggggcggcgccggctagctacggggagggtactcgtgctactacccgagtctaaggggaggagatggatcgaggaggaagaacggagggaggcactaccgagcggacggggcgcagtgacgatgggccgacggcacgggagtgatctctccggccctcggctggggaagaggaagaagagggcgcgcccggagtccccttccgtgcccttgctcgtgccggctcctccgacacgcgcaacgacgaacggcgacggcgaacagagcacgggaggcggcgacaatggagtggaggcgatgggacaacgagaggagaagagagggagggcgcctgggctttataggatggcaatgtcggtttgggagagggga

SEQ ID NO: 48795 - DNA, 1640 bp, Oryza sativa
attcaataaaattaacatcgacttatgctggttcataaaaaaaatggcattgatacgtgaattatgtcatcaatgacctgaacataaccgtccaaaaactactgaaaagtagtattaagggaggtcacctatgcatcatttctgacgtaagatttgacagcattttttattcttcttgttcaagtaattttgcaacaaaaatgcatgtcagccttttgtaatgctacgtaaactggcaacgcaacacgttcgagatactctctccgtctctatgatataaagatatataaaagattttgtaatgctcgattgtttgacaattcgtcttattaaaaaaaattaaaattattatttattttatttgtgacttactttattatctaaaagtattttaagcacaacgttttgttttttatatttgcactatttttttaatatgatgagtagtcaaacattacaataatactagtgaatattctttatattaagagaaataatactagtgaatattctttatattaagggacggagggagtagatgaactactggatgggagtggtcaatggagtccatgattttacttatctttttatctctcattctgacggtcatacttacctcatgctttcttttttgaaactatacctcatgctttcgccagggccatgcgatagagaactgtactggacgaccatacgaatctgaaaccagtttgaaattaagaatggcaatgcattatgtatgtgaaacttatggctaaagttcttccatcctcaagttattctgtgtgggacacgcatgtacggcttctcccctttcagattaagcagaattttatatgaatcagtatggctcattcttattctcggctggttttagcgttgttccatagcatggataacccattaagaattgtttgcttttgtttcagagttttgtgcaacttggtcaccaacaactacagaccctaaaaaatgatgtatacgaagcagtacactgaagtacacatctctttgttttttcagaactgaagaagtaacatatctccaagttatactgccaactgccaaaaagaaatattcagaccaaattgccaaatttaaatacgaacacattttacacatatcagctgatcagcatatgcatcgtagtgtcttgtacacgctgctcgttttgcatgtgtgctgcggtttgtttggagcataagtggccgtggttttcatgtcaaatcgtacgcagctgagagctcggcgagttagttggctgccaccacttacacgctagaattatcatactctcacgtacagcttcataccgatattcgaagttcacaattggcttggttaattacaggttataatgagcacgtacgcatctgttgcttacttgtatatactattctgtatgttaatctggtttggaaatgagtagcacgcaagcaaagcagcgagtaattaatctatatctagctagctgtgcctttgacatttcagcaggaggcaggttagttaatcttctgaatggaaaatacaagtacttaaaaaaaaagtcatggtcacacgctcgaagagttaattgcagacacgtacatgcttatttatcttcagacttcagaattccgagctctgaccatgatggc

SEQ ID NO: 48796 - DNA, 716 bp, Oryza sativa
gggtggattgtcatggaaaaaatatatagattttgatgaagctttaactcacgccagaaaaatattaggaataaactactacttggaaccagcagcaaaagaatatatacaaaaatgcaaaaaagccaaaaataagaaagctccagagaacccatattgttcaaatattaagaatgaaggatcatcccaaaaacctacgtataaggaatgcttgactaagggagtagatcctttggatggcgaatatatcgattggaaaataattgaaaaatttgaagaagcatccccccaaattaaaaaagaattgaaagaagaaatacttaaagaattaaagaaagaaatgaatgataaatttgaagaaatgaaaaaagcatatgatgaaaaatttgaagtctccttttctgatgtagatactatggatttaggtggtcatgggcagcctgaccaataaagcaatataatataaattgataataaatatccattctttgggcgaatgaccaaagtatgaattgaatttgaatcaatccaaaatgcaaggacagtgaatgacattgactgttaaaaatactgtggagaatattgctttcggcggaaaagaaaggcgcaggtacagaggtgtctccaccttggccaattcaaggacaaagtaagccaaaaagaagataagcatctccatggtgcgagccagctcgtgaaaatacagtatctagaag

SEQ ID NO: 48797 - DNA, 1953 bp, Oryza sativa
tattttgtgaagagaataatataccaattattatttttgaagtaagataatatatcaattttatagtctcttactctcttttgcctcatttatcatctaaatgtataagaacgcaaaatttctgttaaacatgcatgtaccaaccgtagactaaatatgatatacatagcagatgaagcaattcgattcggcagcatgcaaccttgtaaaattataatatgaaatataatcatgtttagtggatatatattaagatttgagatgaaagactgtagtatcccttgtgagtgggagggtggttgatgcgataagtagtactattttagtaatgcttataatgtgtataaattctgaatcctaaaaatgcttatatttgagctagctgtgcgattgtgcagcatgcaaacatgtactgttgtttaatttttgttccgtgcgcatgcactacatcggtcctagctacctcaaagtatgaaaactgaataggacataaattcaagcgtctgatctcagacataccaaatgaagcatccaaccgtatgttgcttacatactcctcgtttcaaaataactgacatagattaaagggtggttgggaagaaatttaaatgaggtgattgaagggaaaaatagtattctaggattgcttttttgagacaagatttaaatgttacaataattgttttgggacagagaggtagtccatgaatagatggccaagattttttttttctttttcctgatttaatctgagtatttctttctttttcgatcaatatgggaatttctagatttttttttccttcactagattaatgtgaggatttttaggagagccttagtatatataatgctattgaagagtccaatagttcctacattttcaaattagagttagtttggtcccataaaaacaaacgttgcatctattttcttattactaagcactgaaaagtgcaaattcttccttcaattcatatcaatgagttcattgaaaaccattcaagactcaagcatcaattgagatattaagttagtctagtataaatcaatgtgatcatctgcactgtaagtttgttaaccccaaaaatcaatgtaccttatccaaattactcatgttgtgtagattctacaggctgcactgaacttactggtttcgtagcggcccagagggtccatgttcctaaccaaaagagcaacaccataaagatacagtcagcgggtccagaagaatgtataatataaggtactagaggatttagttaatttacaaatgttaatttgcatgatacagacatacaccttagggcttaggccatcgatatcagtatgtagtatgctaatttacatacaacacagtagccccaatcatcttgcaggcacagacaacaccatcaaactccccccttatttattcacaatacagaaagacactagcagccccagtaaaacatcaagaatactacgctactctgtcgttttctgatctttgagacgacatgaggatcttggcctatgcagacggcgcaaatccatcattgaaaatgacctcacaggcacagatgatgttttaggatcacaggatcctaattgtagtgctggagcattataaaccgcagaattttcatcattagcaagcgacggaggagaatgaagctgctcagtgagctcggtttcttcgatgctgatactactgctgctcctggaactgctactagccaaggtcaccaaagagtttctgctcagactggcaagcctcttagggggtccagtttcataaacttctgctgctgtctcctgtgaagtttcatacatgatgctgtatgcaaggagattcttccgttttctcgaatatgcgctctctgccttcgcgatgtcctttgcagagccacaagatgaaacagcttccttgagacacgcgaaagattttgattttccattgtagaatttgga

SEQ ID NO: 48798 - DNA, 1523 bp, Oryza sativa
  unsure (1)..(1523): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatctagaagagttcgagttcaagaaggatgcgatatgacagttatctgttaattaggcatagtttgttagtttccttttatctttaggaaagtgtgtttagtgtccgataagaactttatcttttcctttttagtttctttcttgtccgacaaggactagtatctccttatgggtataaatatgtacacccggggtcattgtaatctatcaatcttcacgatcaatacaattcagcgcatcgccaccctttttaccttttctactttattttatcgtccggcgtaacttggcacccgacggagggctgcatcggtgttcgatctccggcgaaggggtaagtccaatgttccgtcggtctaggcagttgtatcgtctacgtcggcgtcgttcaaggctgcatcagtatattcgacctcttggattgctctggtttggatgatatatttgcctacctatttatcatatgtctctgttaatctagacttagcatatcaatttagctctatcggctgcttctggttttagggtttctgccggtatcggctaaatcgtgttgctagattagattagcttagacatctaccaccttaaaaatcagtcaacggcttgattgtctagatattatgtttcttttcatacttagtgctgcatcacttaagtttgatctactaagtcgtgcttaaaaccataatctctatcctgcttattgattgccaacaagggtttcatcgcggtttcagccggtgagttatctgaacgttgcattggctcataaggattgcacatacatgtaagttggatttagccgatgacaacaaaggtttcactgtttaatctaatcttgtggatttcatgacatcggacctccagccgatgtgtgctttaaccttcggatcgatgcttatttatcatatcattgctagccgattggtttatactggattatattggtattttattgcatcatcatcagccgattgcctttatatcattatctacattggacatatagccgattgcatagaccctatcgctatcggctggtatcggcatcggctattattggctaccagctgaactactccatcggctgtctagccgattggctgttttgatctactacttgcatatcttgtcagttgcaggatcaaactgactggcacgcccgcatctcatcatatttggacctgcactggagctaagcagatctcccaggccggtgtgttcgattttttcgtcaacagcgggcaggcagcctgcggcggcggggggcacgcg

SEQ ID NO: 48799 - DNA, 26307 bp, Oryza sativa
  unsure (1)..(26307): unsure at all n locations
gatttaggatgttacttgatttggggatatgaatctcacctgatttgggagaaaataaagagattaatagtaaattaacaatgaaaaaaaaaacaaaagcggatcaaccgggacgtggctctatcatctttagtcccggttggtaacatgaatcttactcccgggaatctgaaccggtctttagtcccggattccttctcccggttcgctacctgggagtaaaggtagttgtgaaccgggagagatgtggggttctccagtagtgatatataagattggcatacgtgaggtgataccttgaagagaatgacactgctagtgttggcaccagtaaaaaaaatggttgcttaattttctggacatagacatacagtagaaatggaaggtattgggacaaccactacaatctaatagaatcgataaagagttaaggcattccttcatgctatgggccctaatatgagctcgacatattcaagttatgagcatggccgacaagtttatagctaggctcgatcgagcttggctcgatcaaaggtgggctgtacttgagctcagcttcgatcctccagccatagctagaggtggattctggcaaagatcctaccaaattgtttttctctagtttcttcaatttctcatagttcttaccatgtatttttcagctaatcatccatcttgtttttctatgtactggtcagtgacttttggatgtggctgtgttgtgctaccttacctcttcctaatgaatgatgggattaatttaacaaagggtaataataataatgtgtttagtgtgcatgtatgatggtgatctttcatgtagactgtatattccagttggtacaagccatctgtttatctatatttgatccacagatggggttttgttctgtttccagagcactggtaggtgtgtaaatcaagtttcatatagatgaaacacatttattttctgtcttaataattatcatcatgagatgtcatcagtttagcctatgtggcatctcatttaataaggttgaaactcttatgaaacttccactcggaatagccatacaggagtgcactaagacaaagaaaatattaataactctcccataccatatttacctcggtaacaaactcgaagcatgtatcatcccactacttccgagtcactaacaaccaagatattacctgttagttgtaaagtgttgtgtaaatgaatacatgcattagggtgtgttcgctggttctggttcccatccagcacagtgagcacggaaaacggagtgatctattagctattttttttaaaaatagattaatttgattttttttaagcaaccttcatataaaacttttttaaaaaaacgcaccatttagtagttcgaaaagcatgcacgtggaaacgagggagagaggttgggaaaaggggcatccgaacactctcttttttttttagataatggaatataatatcccggcctttcctcaaaaagaactacagccaattattacaaagatccactccagaagagagtgtagtttaagacaagttgaacacaccaaacaagagaagagaggacccaaactgagaaaaacaaaacaaaatgtggagctagaaggcctcgtcaaggcctaggactgaagttcgaagccaatgcatagaccaatgacaatatccttgcacgaagaggtttctccaaagtggtgcccccaaggaggatgcgacgtggatcgccgccaccgctcgttcggaaccgaagcaaggtttttacccagagaatatggtagggaaaggaaaggggtatgctaaaacaacgcctccaaggaggggaacgacgccacacggcgtcgccgttgtcagctagccaaatggctcgacaaggctttcgcccgcgattccctgtccaaacccacaccacaatccgcacaagaaggatcgtcgtcggtcaacaacattgtcccttcagcgattcggccaaagccaccacccacagttgttgccgccgtcgacggcgcgcccgcacccggactcctccttccccgccgccagaccccttccccgcctccacataccgatgccgacgacgacgcaccatcagccggatgatggccttcaaccatcgccgccataggtaccatcgtagacagccgccaccgccactaccacagccaccactgtcgccagccgccaccgtcagccaccatcgccaccaccaccgccaccgccacggacacccccgtccagccaccaccgtcagccaccaccgtcgctagccagcgccgccagacgccagccgtccagatccggccggggtagcgcggatcggaggtgcagcgcgaaacgcaggtcgccagcatcatggaggaaggcgtcacgggcacggcgttcacagccggagcattgacagctgccaccgtcagccaccatcgccaccgccaccgccaccgccacgaacacccctgtccagccaccaccgtccagccgccaccgtcgctatccagtgccgccagacgccagccatccagatccggccggggtggcacggatcggaggtgcagcgcgaagcgcgggtcgccggcatcatggaggaaggcgtcacgggcacggcattcacagccggagcattgacgagggcgccgcgcctccctcgtggcggcgaggttcttgacaagggccggcgtcgcggcacgcaccgcagtccgccgccattgtcgccaacttcgtcgccaccacattcgccaccatcgccgccgctagccacccccctaccaggtccgcggagcggcgccggcgacgaccgagcgcgtcaccggtcaccccggccaagcggggagaccagatctggcgacgccgtcgcccgtcgctggagccgtggagagccgacaccgtggagcgccccaccgccgcgcccaactccgcgccgtcgccgcgccgtccctgtcgccacgacctcgccgtcccgccaccatcgtcgccacgcccacgccggggcgaggtggagccgaggaggatggccccgccgccgccatcccaacgcgtcgcccggctttgccggcgacgagctccggcggcggcgaagcacggaggagggaggaggaggggcggcggcggcggctagggttttgccccctagggtttctatccctcttcataagaggctcacttgctcattttctccgaacactctcttaatgttcatttactcccatacacaggtgataaaacaaacttaaatttaaggcatgaatactaatatgatgattatttaaaaataccatagaaaattacatgatgatcaattgggaatcagagggagcagaaatatatatatggtccctcatggttttcatttgctcatgggttatccgagtggctcggctgctgatgctcccgtcctgcaggtaaacgctgacctgcagagagagttaattaaggagaactcctacctcatttagcaagttgcttgtcgtcactgctgatccatgctgatgctgacttgtactgcttcgaagccataacaaaaaaaaaagttttatactgacttcacttacaattgatcttcacactaccaaaacaaattcatgtttaatgggaggcattttaaatttttttgtcactattacatttagcacttaattatttgccacccatatattgattatatgtggatccttatttatctaggacacgtgagtttggtagaaaatagttaattgtgtactctgccatcccatatttgaaaaaattatggaaaaattttaaatataagtcatgtataaagtgtagtatttatgttctatcatgtaatataaataaaaatactaatcataaaaaatttaaaataaaacaaatagttaagttgaatatgaaaactcacaactgtatttaaaatgagacgaatcgagttaagggtaagatttataatggaggtgatagtcacctccatttttatccatatcatctatccaaaaaaattaaaagtaacttatataaatatattgcatttaatatactagtcctaaatcctaatacatttgccaccaatcaaccctctcattttctattatcacgtgaagtttgtgtagaggttaccatgaggggtggctactcctctctctcctcttctgacacttttcttctcacactaataattgcccttaaaaattaaatatttctacatgcatgcatagagccatggatttaagggcctgtttggtacagctccaatccctaaatttagctccaggagttaagtctagagtggagttttggagctgcctaaacccagctccacaactctagtatattttgtgagagagctccacccaactccactcccagttttggtggagctgaaactgtttggctgagctctagctccaggaggggtggagctggagttggacctgtaacgctccgcttgtcgtgagacgttaaaaactaattcggcaaaaatcctatatgcgaaaatttcgttctttgtgtgcgagtctaagtcgtgccgcggaatctcaattcaaatcctgttgttccctctcgtcgtcatcaaaaatcctccacctcaactttcctcttccaattcaagtctccgaaatcaaattccgaaagtcaatcccttcctttgaatcctctccaaataattgttcccactcccgaaagtatcaactcccctcaaatcttttccttgactccacccaatactcccgagaacaaatatccaagtttccgttttgaatctcttccttgatttctccttgagtcttccttgattccaccctgaaccctcgagttcgaatatcgaatttgaatccaaatccaaacttcaattctcaacaaaccagccttctctgtgaaagtctaaatcgccttcctcaagttttgtgggccgattttgtccccctcggcccatctctctctctcagccatcccctcccttctccgcacgtgcgccgcacacgcgtgtgctgagctgacgccgagccgagttctctctctctctctctcgttctctcgatctctctccccgtttcactccctcccagcgccgattcccgcctctgcctttgaaatcgcgccgccttcgcccttcccgcgcgctcgcgcgcgcgcgccatgccgcccggttgccgccgcgtcagccctgccgcgcctgcgccgcgcagccgcccgaccccgctcgcctttttgcagtcgtcgccgctgtcatcgcccggtcccgatgcccccatgctgcatgcttccaaaacacagagctagagctcgcgctctctccctcctcctttctcccaaaatggcatgggcagagctccctttctctccccatttcttctttttccatgaccggcgccattgtcacctccaccgccgttgcagcagctcgccgcccccaccttgaccgctccacgctgccagcccgcgctcgtggttcgatttccaccgctcgatccaccgccttcgtcgccccttgcatcctcgccgtccgccgctcttcggtcgcctgtgaccaccagccgagctcccttgaccgccaatgtcggttccctctcccaaaccgacttcacgtgcctataaaactgcagccgagcccctcctctcaaccctacccacttcactctccacattgccgcgccactatcgcccctgccctgcagtcgccctctccgtccatcgccgaagcaccagggagaccggtgcgtgcgaaggacacgagaaggggactccgggcacccttctccttccccttccccggcccgaggccggagagctcaccccgcgccgtcggccgcccatcactgcgcccggctcggtagtgcctcctccgttctccctccccgctctctctcgtgcccttagcttttgagctagcacccgtagcactaccgaacgcgcgtggacaccgcccgagccccactgccgccccgcatggcctcgctgccattgccgtccgctcccggaggccgccgctcgtcgccggccctcctcggtgctcctccgtcccatccggcgccggaaacgcattccttgaacgctggaggtgctccccccgccgagaatcgatccctctcccctcccggcgagtttccctcttcctctcaccggcggtgacctccgccgcgattcatcgtcgtcggcccttcctcttctaatctgtcccgttggctcgctcctcctcgctccgctcgtcgctccggtggtcccccttcctttcgccgcgcctcgccgccgttctgccgatgcgcgtcgccgtccgctgtccatctcggcatcccctcttcttcctcctcccgccggcccgcgtggctgccaggaaggcgccacgtcggcgccagctcggccggaccgggtcaagctgaccccggtcagccgctccctccgtctcccgctcgcgcgcgtggtccaccgcgagccgtgaggctgcgcgtgggcccgacgcgtctcggtccatccggcgcaccgctcgtgcaccatccccaccgaaccctagcgccgccctcgcgtgcgcccatcccaccgtgggccgtgtcaccgacaagcgggccccacccgggacccgtgaggtgctcccggtccaccggaccgctccctctctcttccgcgcaccgtaatgggccgccttccccgcgcccgcgccggcccaaatggctcggtcgagcctccttcaaacctcgggccacgcccttgccgcccgagaaagtctaatatacatccctcgtccatttccttttccataaatcaattccttattattccaaaattgcataaatcaattcctttggtcccgcacgtaagtgactgtcaataatattctggagaatattatttctataaattccataaaccatttctcctattccagaaattccatttaagcttccgaaattcatatcttctcaaccgttcgtccgatcgcccccgttcaacctccagtgatttcgtaaaattgagatctatctaatggcactattaattagtctaattaggatctttcttttagtcttttgtttaggtttttgattgtttgcgtatagttgcggttaccggatttttcgtcgatcgtggttttctcgaagattcgtgaagctccctgaagaccttgagcaaggcaagtcaccctttgatcaattgctcctataattggaaaatcattattattttgtttgtaacttgcattattagaatcacacacttaatttgcttggcctcggtttgcgtgccaaaccgacggacctacccagtagtcgaactaattcctgtaggctgtactaccctgactccttgtcgctccacctttgtggtacttcggtatccgtgctctctaagcgcgtataccaaatatcccacatacaccgttgattgtcgaaaaattgagaaatgggtttgagaagacttgaaaacccgacctgaggtgtcggtgtgtttaaaaataaaatgaattgtgaaaactcgcgatgcggcggttgtgcctgtgtggcactgtcccgtattcgcatataaggaccgattcctgtgggaaactcatcgagcataatcaaagtgcaaccacaaggtggaatgggacacactggctaagtaagtagtcggttcagggaaacctcgcatgccaatagttgggaacgccggggcggggtcggttggagccaaaccgggttcctggtaagaaggaagagtagcttgctgaattatcgatcgagtggttggagtttgatttgtgaaaactaaaatggcctatatttatgtgaggatttgatccttctatgtggcatgaggtaaccctgggtcggcttgggaaaggctttgtcgcgaatctctgacactggccagtgtctggagtaagttcgtgtcttgtgggtgaagtgtacccctttgcagaggttaactaactattcgaacagccgtgtccacggttatgggcggatgtgaggtggttcccgttgtgtagatttgttggcctgtgctttgtgaaaatttgttgtggtgtgggaatcgtaaccagaatcagcctatgtggcagatggaggacctgagtggtcagaaacgaatctgtgtgattcgggatgtctgcgggcatcatagactagacttcccgagtggaagcggattgttgtgctggtgggcagctggactctgggagtccgagaaaatgaaaaaggctctgagagccggttaatcaagtgaagtggctctgggagccgagaagtaatgatctgaccccaggaggtcggtacattaccatttgagttgttgaaaagcatctcttaaagttgaatcgagacgcaagtctcttttcgacccaaagttaaaaagaaataaatcacttagtgattccaaaatgctttcaaacaaaagatttgcaacacaatcttgcctctcttccaagcttgcattaaacaactaagttctcttgacttgctgagtacgaaagtactcatccttgctctatataaatatatataattcctgtgcctggaagtgaagatgaagtgaagattagggtttcgtcctgattctcagccgtcgcctgtggtgttaggtgttagtttgttggttccgctgctgctgctgttgttggtgtttcctcgtccgtgtcatcggttgcattcttgggctgttctgagctgcaacctaagttaagataaataagtcatctatttattttaaggattgcaatgattcatatttgtcaccgtgggtaccagcgctatgtcttaggactggtactgagatcacgtttcgtaggaagcggtccgcgccgtgtggaccgcttcctacgacacgctcctgtcagctgccgttgtacggcggtaccggattggggtgtgacaggagctgtgccaaacagaccctaagtgtgagagattttctggagattagttaaatcacttggtccttttttaccgcatgcatgcgcgcgtgtttctggagattagttaaatcatttggattcaatgccatgactaattagcacaagaagagttataaatcccctcacactttttattggtcatgtgtgcggcatgcccggcaaccgaaccggcactgctatcaacgaatcagcaattgcttgatttatctctctcgtggtaaagagtatagtagaaatatagatcacctctcatacctatcaattatatcatccttgcacctaataataactagaacctctttataagagtgaaaacttgacaaccaaaaacctctatagaatttagaatgaagctctcaaattcataataggttatatctttataatttgctgatgagaatttgtttaattccgtaacaaaataaggccctgtttagttacatgggtgaaacgttttgacgtgttacattggatatacggacacacatttgaagtattaaacatagactaataacaaaacaaattacagattacgcctataaactacaagacgaatttattaagcttaattaattcatcataagcaattagttactgtagaaccataatgtcagctcatggaacaattaggcttaaaagatttatctcacattttacacgcaatctgtataattagtttttttctatatttaatacttccatgcatgtgtccaaacattcgatgtgatagtgtgaaaagtttttacgtgagaactaaacaaggcctatatgcattttgctagaaaataaataaaaaaaataataaaaatgttggatttccacgtcagccacgaaaaaatcactcgccccttaaacttcttccttggatgccgttactaatccatcctcatttctctcgcaaatctccatcgtcggcggcggcgcggcggtcgaggtcgacgtcacgagagatggcggcggcggcggctggggtcacgtgccacctctgccgcgaacaccagatggagatggaatgctgccgcgggggcctgctgccgcgcggctccaccaccgcgctccccgacgccgccggcggtgaggcggaggaggaggaggaagaccgcctcagcgccctccccgacgacatcctcctcccgatcctcgcggccctccgctgcgcccgcgccgccgcgcacacctccgtcctcgcgcgccggtggcgcggcctctgggcccgcctccccgtcctcacgttccaccgcgtcgcccccgccccgctccacgccgcgctcgccacggtcgccgccgccggcggcgccgcccccgcgctcctcgacatcgacctcttcagccaccacgacctcgacccggcctcgctgctcgcggccgccgcggcggtggcgccgggagagctcgtcgtgaacgccagctggtccgcgcgaagcaccgagctgccatgcttcgaccgcaccgcctcgatcaagatcgacgtccacttcgccggcttcacgctgccgcccgccggagtcttcccggcgctcgaaaccctccacctcgagaactgcttcgtcgacctcggcgacatgatcccgcgctgcccgcgcctccgcaagctctccatcccgttctggaacgccaccgcggtcaccgtccgctcgccgtcgctcgaggagatggaggtgtatgccaatttcaagatcaccatcgacatcgtcgcgcccgcgctgaagaggctgtatctggatgcacgtcgcgggatcaacacggatgccggcggatttacgctctcggcgccatcggtggaggatctgacatggaactgcgagtgccaggccgtgagcgatagttttggtgtgagatggcgcatgtggagcttgagctttagctcatcatgtcttgacccccatgggattatgcagatgcagcagatggacaacaacggcgaagccgaaaccgcgcattcgctgtcattgtcgtcgtcgtcgcagcgacgccctcgtggtggcgtcctgtctctgaacttagagaccaatgtactatgtctcctctcgtgtagtactcctcaacatcttgaactcgtattgtcatattgattttcaaatcgtgctcaatctgttgtgtaggtcatgacaggtgattcaaccaggagctttgagcaagagatattccggtttcaagttacggacaacttttctgttttggagctggatctgaaggcacaagggcatgtctatggggcaatcgtcctgcacctacttggcatttgtacctctacacaaaggcttagggtgttgctagatgaatttctggtaattatttcttctgttaaatattgtattattgtctagtagatctcaaatttctatgtcaaaatactaggttgattcagtaggaagcatcactgactggccactgtatttcaattttcttttagtcgcaggactcatgctttgtaagttgccgttgcgaccagcccaataactggagaaatcaaagtatctccttgactgatcttaaagaagtagaaatcagaggcttcagaggacaaaaccatgaagttgatttgttgaaggtgctcctgagatgcgcaaccgtgctcgaaagagtgaccgtcagattttccaggaaggttacaccgagtgattgtcgatgcagggaactcagtggcattttagaggcctatccttctgtgaaatgcagtgtttattatctccaatctggcaagcaggttttcatatgcaggcagcaataggatgctagctcttggatgtaacagtggtattcgctttagcacaatattgtccaaactagaagttccaatttatcaggtaaactttgtcatgtttggtttatttttgaatggatattgctagtttgtcaatgagtgatggtgggagttatgtgcctattaccttaaatgatctgtgagtgcatatgctacacctatgttattggtgttagagtaatcaaataggtggtggtgtttccaattctccttccctaattgtgctacgaagcacatgctttagccgtcagatgcacttcgatgtgaaatagttattccacggataaactaaatggttaattcatccgaacttaggcaaggcatgatgcattgtgtgcatgtgtaccttgcagtgatacctgtacatgttttttttccatgtaataattttaaaaaaaccagcattagggatatttgtttcctaaaaaaaatttccaacatgagcaatcacttttcctataacctagttgttgttatgggcatatgaattgagaccagaattccaaaaggccggtgataaaaggccaaaaggctaaccattcaaacgtaaaactttattaatttttcactggaaactagtttttctagagaaagcggtattaatttgaagcctaaacttttactagaaaccagtttgtccagataaatataatttgttgggcaccatatattggttcaaacttttgtcatatatatatataatgaaagaaaattgaataaggaatggctcgtttagttcagctgtatcatttttctgcaactagtatacattcaattccacatgctcagactagatagcctcttattcatgaacttataattacatatatttttttattatatgtgctactagttcctcagtagataaaacgggatcaatgagaagagttcagattacggcaaccgataacttatctgtgagatgcatatataccaatgaaagacttataaggcacgtagcatatatagctacatatatatacaccacacatcggaatgggagtcatcgtgatcggaaggtgaactctgtcatttcgccgaccagtggcgaatctagaataaaaatagaggggtgctatgtataaaacttagataaaattaattaagacagctaaatatacatccatgacgtattttgctaatcaaatcgtaaaattaataaataaatagaaagagggtggcatcatataaaataaaataactctagctcgtcgtttattatttggaaaagtacttgttaaccttgcttctccactttaatgtgcagttatatccactaaattctggcaaacaaaattaatttgataggaatgatgcgcccatacactgaaagatttccaaacctaaattaccaataaagagtctcacgtttacatactagtacaacagatggattaatgtccagtccagctagctagaatatgtcgtagaggccctgacaataaagatataatgaggcagtagacagcaacgtttttattcctgaacctgactgtgaaatgcacaaccgtggagctggggctcgagccccaaaaagccccaacggtggatacgccaatgtcgccaactatctatgattcctgattggttatgtatctacaatcaacatccaggtttttatatataccaatgcgataaaaacctatctggattcactgtaacacacaaccacctcatcctatatgttttgaacaatgcaagcgttggaggcaattggagggctataggaaccagtggaaggacatcagggctagccggcctgtctctcggatatatcggaaggcaaaatgaattattgtcggagtgataatatatgacactaaaacagtactggaaatagatgctgccgcgactgcatgttgatgaagggaagaatgccgatgttgtgtgagcaccacatcaagacttcgaaaaccgtaggattgaattgttcttcaacactgtaacaagcgtcttttcaaggccattttatgacataatgcttaccatgcatggacgccaatttcagttcttttttgctagacataatactaatccctccagtattttaacgtataacttattgatttttcatataacgtttgactattaaccttattttaaaattttagtacaaatatgtaaaagtataacttaagattatacttttttataactagaaaaaatggccatgcgttgcaacaggtgaaggttatttcaatcttattattattatacggtttaattaatgtggaattcactgtgggaattcgattggatatattttttttcataaaatcatgagttgcaattaggagtccgatcatctcaagttagcatacaaggtttgttaaagatatttcttatacagcttattctgtatttccaaaaacgaacgaatttaaagtccgactcaaatacgtatatgtttccaaaagcgaacgatcttaaaaactatgacgtaccgaagtactggcaaaaacactttaaatttttataatagtagagataaaacaagtcacagcaaaataaataatatttatattttttaataagacgaaggttaaacatcacgtcaaaagttacggcgctataataaatttttttacaagagtaaagggcatggacggtccttaaacctatagggttgtgtcatataggtctctaatcactcagaatacagatttaggtcccagaacttgcaaagtgtgtgtcatctacgtcacatatcaccacaagcccctctaggatccggcggacgttgggttgggcgggtgccggatgtctactgtgcggcggtaagggagtggggccggcgacgtggggacatttcagcgtggccggaacagggattgagcggaaatggcgtcgtcggcgaggcgtgcggcgctgaacatgtcgcacggcgacgcacacaggggagcaggggagagacgcggagccatggctggcacgacaaggctcggcagctagagggtttgggcgcggctcggcgagaaacagcggcgtcgcggcgggtgccctacagtcttacaggccagggaggactttggcagaatccggcgatggaggccggcgatgatgccctctccggccattagagacggccatatgctagagctataagtttgttcagaatatttggcccagtgagagacatcatgaacacgcactactacagaaaagggattaagtgctggttggaaaacccccttcggtgctggttttcttaaccgacacaagggatgtgtcactgattgaaaataaaaaaagtgccggttagaaccagcactttttaggttcgatgaataaaaaaaagatgcctcgatgcgtcatttcgatcgagccgacgcatcgagccgtgcagttcgtcctcccgcatccacaagaatttttttggcaacattcatcacacaaagaaatttggcagtattcatctctctctccgcccggtgagccacgtcactcttgccgccgtcgggctgtcgctgcctctcctctcgctagatctagcgaggggagggcgtcacggccacctcccctctgggcgccgggccgccgcgggctcccctccagccaccgggcaggcatagtcgcgggctccacttcagctccccaccgccgcctcccctcccgccggatctagcagtggggagggagcggtcactgctgccgcctccgccggcaacgcgttgggaaagaagggagggagggatagataagagagcacgcccacagagaaggaagggagagcaacagagaagagagcgagatgggagcgacccgatgagagcgagacaacgagcgacctttatccgatgccgcgtctgtcatggtggggccccggtcggctctttcgatgccggctcggctcgatttatataggcacttataagatattataggtgtcagttttttaattaaccggcacctataatatattaaaagtgtcggttttttaaaaaactgacacaaaagtataataggtgttggtttttatttagaaccgacgcctataattacttaaaggttccggttttttgtgatttcaacctgtgaaggtgggaaaaggtttataggtgccggttttagtggtgccactggtcgtgatgatacgtcgacacctatttgatattttgtagtagtgacggccttacatcatttcagctaatccaacgctgatcgtgcaatgattaagaaataacattgatcgtgcagggcaaaccaaacaaattaaggaacccataccatatattaaaaacatactttgtactttaactagacgcctagacatagagcatcgactgcattttctcccaacaactagcaggcacatgatttgtgagtgcccatattaaatataataactagtttccattgcattcttcttgtaaccacttgcaactatatactgttccagcatacccaaattaaaaagacatgtaagttacgaatttataagggtgtgtacattcgtacaaccatttttatgggttgcttcctctgcagataaaaggagagcagaaagagaaacaaaagatgagaacatggcagccgagaacttctccacgagatctacacatacatgacgggaccagtgcttcagtggtgtatgtgtattgcagcctaaatacatggaattgggaggcattaggaagccgagaagtgcatctcttatttttcaaccttccaaattcaaatgactagcaggctagcagcattttcgatgttctgatgctgcaatggaacgtccccggtttaattgcaaggctgcctcttgctatgtagtctaaacaacggagcaaacacagcacaagggctcggagaatttaactatttgccacttttaggtttggcacatatctaaatgcccctcttatgttcacatttaataatttgccactggagagaggtgattttttaactatttatctctctctagtggcaaattattaagtgcgaatctaagagagacatttggataattgcctaacctaaaagtggcaaatagttaaattcccataggctcctcctagcagatggaagaaaattggttctatcagcacaagccaaaaaaagaagtcacggcgtgtgcatctgcactggttgaagttgcagtaattgcgtgctcgctaaatgctgagacgaagaccctgtttaggataacttgagagtgagattttactggcgataatctagaatctcatgttgcttctcattttattacaattattttcttgaccaattctgtaattatagcaaaagaaaatggaatgaacaaatggttcaatatatttcaggggtgctactcaggccactacaactaatagactacatgccctttcacgggaagtcttccatatagttgtaccatataattagtagataaaataagaccagaacatgtaaacagaactgacaacttgtacgcggaaaatatacatatctatgataggtttagtgcttcacaagctagtttgtaatgtagctgtacgcctacacatataggattgggaggcatcctgaatcaaatatctcaattctagtcggccaaccatcgaaacttcaagaagcatagacattgaatttgcaaagtaatgatgtaatcgaacagctttggtttcatggtaattaacacaacggcctcatccgttgtgttccaaacaagcaagctagcagacatggttaaaaatagatgggagctctacaggtagcctattttccgagctagattgtggtttcttgttctcaatgtcaatggaaacgagcattcagaggttcaagccctttaattggttcaaaaaaagttaacgtgttctaaaatcaatggtagattgacatcctcattagagcaggtaacataagcaaacaaacacacgtattagatctatcataccaatgcttcaagatgccaaccaatgcttcagtaggatttctcgatccgtcataccagggttgtcataccaatgtgtgtgagggaagtattcggatgtgggtgcaaattgtgtgcatgtgtacgcgtttgttttccgtgtaataaaaacaagaaacaagcattagggatacttttttctaaacaatttttctagattagcaatcacttttcctacaacatagcatatgaattggaacctgaattcccaaaagcaggtggtgacaggccaaaaggctaagcattcaattcaaacctaatactttattaaaatctcactggaaattaaactagtttttctatactagataaaatggtatttggagtataattttttctaatagaaaccaggttttctagataaaacggtatttggagccctggttgagatgacgtttctatcttggtggtagccacgagtttgcttcaatttatttcaaaggaacttggcactacgaaattcagaatatcaagactagcagataagtgaaaacattgttgctttggtgggaaaagcacaagtgaaatatatttagttaggcaccatattgtcatgcattaagaaataagagccatttgcgctcaaactttatagccatagtgaaaacaaaattgaataaggaattgttttcatttgtttaaaacacaaaaaaattgtcgtggatggaaatttcgcccctcttggaacatacaaaatactacgaaggctccctctacgcagcctaggacgtgcctacacgtcacgtgtaagacttaaggcagggtggctagggtttctatttttttaacgcagtcatgaaaatccgctcctatggggagtcaaactaaggccacggggatgctgctatactaggcactataatcactaggctacatgtcaatgcgctctcctctactttagcatactatatcagttttttctaactacatactagcacatgctatgtcatatcattgcattaacagaacaacaagaaagtacacaaactcgcaccccaccaccaggacggttgcacggcatatcatttaagaactttttttccattatgtgttctacttcctcaactgataaaacaagagcaataagaagcgagttcaaattatgctgatcgagaacttttgagatgtatacacctatgaaagacgcaatagttagcaggcatgtagcgtagctacatctacatataagaatgagaggcatcatggtctaaaggaaggtattgtgatttagccagccgtcatagcttggacatgtagcgacatccaggtttccaatggggtagaaacctaggattcaatataacacaacttcctgatcactctggatgtattgaacatggaagcactatgttggagaacttgagattgagattctgctggtgagaccctatgttggagaacttgagattgagattctgctggtgagaataatctagaatcttaagttgcttctcattttattataattagtttttttagaccaattttgtaattatagctaaagaaaatggaatgacaactggttcaatatacttcagctggtcgatcttaagcattttcgtctcccacatgctttcccatcatgtccgaatcgaatatcatcaaaattatgaattttctacttttaggcagataaaagaagagcacagcgagggatgcaaagaacaaaacatgggatcccggctacaacttctccatgtaatccacgtaccaaagtggtttatgctgtggaaaaaatgcatcatacggacgtcggattgcgaggcatcaagaagcaatggagcactcagtgagatgtctaatcatcatgaattgaaaaagtatccacattgagtttatagtatcctggtgctgttagacatccatatgcatggtttctgtataacacagctgcccccctttgtgatgttttcaacaagacatggcacgcatcatggagggcagtgacgagcagtggaacaacaacaatactagctagactactccttgactaacttggtaaccgagtgactgggattgatgttgaacactgaacagtggttttgatatcagagagttatgagttttgagagctgtgtgctttgtgctatgtgtttgtgttgactcccctcaccatcgttgttgttaggctagctatctattacactccttttttcataataaaatatattccgtagtaggcatttcttcatgcaatatgaatgcaagctgactttgattatctgtatatgtgaactcagaaattaatgcgaactaaatagtacttaattgtaaccctcttgtatcttttatttttctcggtccttgtatacacatgatgttatttattactccttctctcccagaatataaagagttttagagttgggcacggttattaagaaaatagatagaattaaatacaatggagtcgtaattgtttaagaagtggaggtaggtggaaaaagtgaatggtggagggttgggattggttgagaagtgaatattggtagagaagctgttatattttgggacggagggagtacgtgtctatggacatttgctgcatctcttattcttaactttatttaaacctgaaagcttgtatttctttcccttgtctttcatccacacctcagcaaaaactctatccaatagttctttgaaacccatttaatttactgcccttggtatatatatgcacatggaaaccaagtatatatgtttcatcctagattctactaaaatacacgacacatatatcttggacacaaacaagcaagaatttaaatgctaactgaataacatcatatatatgcatggtgagcatctaccaacacatgtccatgccatccatgaacactcctttaggattggaagacatcaggaataccataggcacaatcgtatagcttagggcaagttatcctcagaagttttgcagctcacaaacaggggcagatccatggttgaggccttggtgggccgcaagacgaaagcgcagctgttggaggttggaacccaaggatccccacgtcattaccgtagcagcactttagttacatgctacacacccaccagatcaaggctatagacgaattgagcacgctagtattccgaggattttccacaccttgtaaaatccatgaatttacctcaatcgggactacaggaatggaagttgtcgggaataagaggactggactcaagcattccagttgctggtctcccatcgtctatcccgcttccatctcacattcaggttcatgttctcctcagaatcaaacctttaatctctcctctctctgcaactcggcaacatggtggagttggcggtgggcagtggcgaccagtgaagagtactttggctagtaccctccaggatcgatctagtcaggaactcaggatagatccagatccatatcagctaactattcatctgaattttttttcaaggctgcaagtttgtcaaagtatcaagaacatgaattttggtaagaagctacttcgaattggtgtcataaatgaataattagcagtacaaatcgagaactatatgcactcaaggaagaaagccattctgaattttggcaagaactatatgtattcaagaaagaaaaccattctgaattttgacaagaagaatgtggttaatgctgccaatttgttgtatttatgatgttggatgtattgaagattccttggtgtattatctctactacttaaaaaatctggattggtgatggtgaagctaaaacagacacgcgatccaaagtagaaacgtacgtcgacacgtttggagcgaaaaaaaaaagtacacgctcctccgcagcggaaaaaaaccccaagccccgcgacccgcgccccgccccgcgcgtcccgcgtcctaggcgcccctggaccgggccgcttcctcaccgccttggaccacagtcgccccgggggccctggaccgccgccgcctcctcgccgccccgcgccgcctcctttctgccctcaaccgccgacgccccgcgccgcctcctcgccgcacccaactccggttgcgccgtagtgtccaccgccgccgcccgccgcattgtcgtcctccccatcacccgccaccaacgcttactccgtccacccgccaccgacaccgaatcctccgcccacccgcaaccgccgccaacgcccccgccgctgagtcagctccagatccgctgtcgggctgactcctcctcctcctccctgtcgcggacgccgccgccgccgatgcctactactccgctccgagccccatctagcgaacagagcagggatgggaggggcgccgtcgtcctactgcatccttggtgagcatccacatcctttttctcattcatctctctatgtcccacccatttttgcctggaattttattgcgttaaccatagcttctcttcgagatctggatgatgctcttctcttagttagtttaattgtttgctccccccccagtccaagttggatctgcccctgctatggataaataagattaatctgaatcacaggcccttcaatcccttctcatttgtaatcctaagcaaattaataagctacatagatgttgttcttgtaatttatttggagtaatcagtttaattgaatcacagtagcattgtgtttccccaatttggttttgtcactttcaaaaaagaaaaagacatttatgtttcacatttggtactctagcaaatttattcagttatctacccaatttattcaattgttctgctgtgtactgtagtctagccaatttattcaactattctgctttggttccgctcgttgtccatctgctcatagtcgtccactcactggtgtttccctggtatgtctctgaaagactgaagtggcatattttcttttgacgtaggacatacgaaccgagctcttgcaggccgcacaggttatcacaatgatatgtgcatgggatatgtttaattactcaataccttgtattttttttcttctggatatcgaatcaaacaaaatccgcatgaaaagctgatggagtaatggctgcaatgtgctgcataggaaattatgtttgcatgatcgtagtcttcaatattcaggatacataagagaggatgttatctcaaattagtttcaacaatatactcattattccatccctgtaacagtaatgcatgactccaaaagcttctgaaacttttaaccccatacaactattttcagtttttaataaatgaacaatgattttctgtaagaaacaggaagtaatacttacaccgggtgagctgaaatcatggttgtgtcgtcatgatataacaatccgtggacttgctcgtacagggaatacccgatcgatctagaataggggaatcaatcgatttctgcatcagatgcgctttctttttctcggttagatccgactgccggcgaacaagcctgatagttcctaagattcaagccatgaattttgttactagctaggtgttgcaacagatctcctgacatccttacccatattgcagaagtttttttcatttcagccttggaaatattcaaagtaagaccctgtactactaccacatcaaagatttagttgttcctttgtaatgacattattttttgacagcacgcatactccattcctgattcacttgatattcctaatgattttgattactcaacattatataaagaacttctgattttgattcttaagtttttttttcttatcttaggattcaaatggtatttaattcagaatttggtaaatcacctccaaattcacaatctgatctttgatttatttctttcgacattttccaaatgtacagcaacattgctatctatgacatattccaaatgcacagccatttaggagattcttttagctaattcagcaataaaataaaccatgctgtaaatttgaactggtctgcctctgttcatggggctaaaagttatggatgcttagcccagatgaaatagcatcattgcgctctactgtatcaggattctcccttgagtcgtgtatttgctattttgttttgcttctctcaaacaattggtcctgatgttatgatctgatatatcatagttttaacgtgatacacaggtatagatagtataagctgtcgtatttcatgataaatcaattttcaatgatgaaccttaaccagatttggacatcttcaggtgttggacttgataaagcttggagatcatctcagtgaacgggagggatgctgatctctataggattgggattactggtgaatcacttggaggtattgtatatataatgaattcatgattgcatccttatattagagtaacatatgcccccctgtagagcatataaaataggtgtgatagcattagaagataaggtaattttttcagtaagaaaaaaattaaatcattttttatgtgtctgaaatctaaatttacaactgaatacaagctcttaatgattctctgcacttgagcgtgtccctgaaactgactgaaatctatctattatatactaaaagtccatgaaacttcctataaacgctctcaggccgccacgtggggctcctacaaacgctcctaggccgccacgtggctctgtcaaatctaaccgtcgattttcacttaaattggtggacccgatactttacaccattagattaaatttttcattgaacctccccttccatcgatccccggtttccctcctttttctgatcctattattaagctactctttcaccaaaaaaaaagacatgcgagtacatacgtgagtatagcacgatcagataaacccgaaagaacatactcctatacgtacttaatacatgatcagagaaaccccgaaagaacacatatatatatacttacacgtacatatagaaaaagataaaacatcatactctataactttacataaataccactgtcgattttcatttaaattgggacccaattgatgttttagaacattagattagatgtctaaaagtccattaaacttccaaaaatgctcctaattcgtcctacgacatcctacaaacgcttctaagttgccatgtgatgctctaataaattagtgaaatattcttaaaattctaaaataatcatattttcattaaatttggtggacccattatttacaactattagattaattttcaagaaaaaaattcctttcctaaacccgggccaaccaaagcttgtatgtataagttactttttttaaaaaaagcgaatatacgtatgtacgccttatcttcattcaattcatttctccactttttcacctattccttctcctattttcatgccttattagttagataagcaataatatcatgttaaacaattaagcttcttaatcatacaactaatttctgatccgcaaaatctttaaattatttataactaaatttacagttgaagaccatatttcactacaatttagctttgaaaaaaaaagtcattttggtttatatttctggcttttgcgtgccattcaagcaattataaaaaacatataaaataatgacataattaaattaggtctacaatcatgaaaataaaatgaatatactatgagtaatgtttacagaatatgttagttagaaagcaaaacttatgcaacaaaataagcaactataacatctaactcacactactaatatttgatgaacttatgtctttagattattttacatttaaagacccatatccactgtaatattgattttgagaagaaatatgtcactttggggctatattttctgatttttgtgtgccattcgaataattataaaattatagaaagataatgatatatatcttatcaccatatatgacttcggaataattaaactagatctatatggataacagtaaaataaacgaatgctttaaaaaagtactccccattataacattagaataagtcaaaataacattattagattattagattgtagtgttcgtatttttaatatctactacgaatatactggaaaagacaagtaaaaactatagattttaatcgaacaataaatcattttttaatttttagttaaaaaactaatagcaactaaaacactacaacccgggaattattacaattatatgcccacataatctcctcccttcaactctctcttcctctgctcactcatttaattcctttgtctcctaatttttaactaagtaaaaaaaagatcaataattagaaagccaaataattataattctaaagttaaatcataattttaacttattcgaatttttttatttataattaaatagataatttaagatccatgttacccatatttcaatctataaagatgaaaattcgtcatttaagcatagacaccgttcctttgcatagtaaccaaatagaaaaaacacaaaccataacacaaaatgaaaacaagtactatattattgtaaatcattgtacatcctttgagcacacttaaggtgtcacgtgttatgtcttaaaaataaaactttacaaattggaagaaaaatcatctgaccatcagtttccacttaaataggtagatccattattttaacccaatagatatacatttaagaaaatcttaagccgcaatgtgttatgtcttaaaaattagaaaaaataacaaaaatgtgagaaaaaaaatatatcaacggttgtcancttaaatcatttagataaaatagaaaaatccacccctccacttcgccctccccccaaacatacgcacaacacggcactacttgtcccatcccttttgacctttccgcactctatc

SEQ ID NO: 48800 - DNA, 3733 bp, Oryza sativa
aacaatctatcatgacatgtttcaagaatcaacaaaaacccggcaattttttgaggaactccctactccggcagcaagggacttcggctcaaggcaaaagaggacatctgtgcctcactgaggacaactgttaaccagcaaatctcaacggtatagttagctccatgccctagtttttttcctgaaacctctcaatcccatattaagcatctttctcactgataaaaatcttatggaagagtatttccttgtcctcttaactttggtgatttacatgtagagctgtaaatactttcctttggcctgtgggagaggccagcctttttatctctctgttccaacctctgcctcaatctgggtctcgttttatatgagcaaactatcatatatcctgttaatcttgccttatttactgccagaaaaagctgtactattgagcttgaatgcatgtagttctttttgttttttgagacagaatgcattttgttgagagaataatgatacaacactcttactgagagcaccaaaatttcaaaaaacaaaaatattaaaaatagaaaaaaaaaatgtatccagctaacattgcagctggaacatcagtatcataattgtcaagtaatttgaggattttaacaattgatccaacccgtgacccctctcctgcgtaggtggctcggggtgaaaaccctagccgttgccgccccctccaccctatcctccatctccttgtgctagtgcaagttgctggccaaccgtgcggtgtgagcactataaaaaaaacgattttcagacaaccccctttcatttcacaggtgggcatttgtgataacatgaaaattaccttataaatttgaagatacatttgttcaatgaccagacttctctgtcaactttaagcaatgctttcagtcataaactttaagcaatgcctgcatgtttgaagagcgctataggacatattacatatattgttctccaacttgacttattggttgtaattatttaatcttacatgcaaacactaagcgggacagatatatgttactttcgaaacaactgcctgcactccataattcttctgtaaggaaatttaattacttgcatttcattgaggtgaataccaacaatcaatgatgttttgtctatttctagatggagattgggtctgttactcccaatttactgttctattttgctcatcttgtttaccactttttttttcttcgtttttcctccatgggttggtcgatcatcttgctcatcttgttctattttgcagtgatatgattagactatagagcagcttcaccaaaggagagttcgtcatcgccatcgccaagtcttgattagaagttagaacacatgatgatgttaaactataaagtacgctgggagctaatgaatcatcagtatatatgataatgaactcttctgtttgaattcaaaagttacaaatttcttcaccgcactcgttttattctcaatgcctcctaatccgatgtttgtccctaccaattactcatgtcactcatgagcatgcgctgaatccatctcaaactggtttgtgctcatgaaatgtgattttctgctctctgtgagctctctacttaaagctctactttcacatacggagacacgtgaaaactagcacatatattttggttgcacactttctcttgtgtgagagagctttactttccttcttatctctcttcccgagcaaagcaacatgtctactagagcatggatatatgcaagcgttgttgaagctattaagtccattacggacgaatatataattgcattttatacataaaaaagaaaatcacacttgcgattagtctgaagaaaacaactgcaactataatttcctgaaagattttattgttgggtaccatgggtaggagacaggagtggacctaagctttgggccaccaggaccatggcgtgaggcctaggactaccatgggatagacattttaccaccacgtaatcatcatacaaggccgtattctccatgggcttgcttgggccttagcccaattttgggtccctccctgattagagaccctagattatggagaacatcgagagcattcaggatcaccctgtgaaatcaaagtttgttttgattattaatttgtgatgaacaattggtattatagataattaattttgatatttggatattattggcgaagtagtgctatctgtgtggagccatacaaaccaggcagggtaggttggtcaggctagtgtgttgtgtgttgtcagattggctagctcgacggtttgaccggctagctccagattagagtaggttttgggttatttatttgaatacccgtgattatcttgtaattataacttttagatgatttctacacatatgtaatattgctgtgtgctaatgttgagttaaatttggaaagaatttgtgctcagatattgtttcttgtttgattcatgtgtaggtgtgtcttgatgtctcgagaaagtatggccggtgatggattaggagtcaatctaggagaagatgatgtcccaatgatcatgatatcatgtggtatgattaggctaaagagcaatgcacgtggttggtgaagattccatctcacacacgatagggaaattgtgtgtgtatgagataaggagtcaaatttgaaaggagtttaaatttgggaagattggagtttgaatcgtgttaggataagtttgtatcttgtatgaaaaggtttcctagtgaattaagatttcttggacaagttggatttgtgactttaggctgcctaccttggatgtaaatagaagggggagggggggttgagaactctcggtatcgattttgtgagagttgagtttagagtaaagttagggtttcgagtttagtcgagatttatgtgacggatgctgttgttgcacttgtaaacatgagtagaaagaaataaacaatctactttgagagatctttgaattgtgtttgctcgagtttcaacggtcacaccggcgagtgaacaactgtcaggccgaggactactacccggtcatattggtaggctcatggcggttagatcggaggcggcgacaaacaacagcaggtggtcagattggagcaccaccaccagctagcctctatttcagtcagactgatctcgatctataacaagggtaacttttaattccgctaaaaaaatttgatttttggtactccaaccattcacctctcctcagctagttggcttagttcttgctattcgatcctacacaccccaacatttgggaggtgaaaagttgactttgtctaaacttttcacagaagcccctaatatttacgtgattaatgaaatgataatctcattagaatttgataaccgaattgaaatatactactcaatttaagatgaatagagaaatatatctggaacagaaggaaataaaggggagagactgtatcaaatgctgaaaacattactgtctcaattttctgttacacgggagcacaatcaaaatacagtttgttccctttgatcagcggcaatttgtcagtatgttgtaatggcaattatgggaaaacacaatattaattctacctgacatgttccaaaacaataatatctgttgaacccaaaacacatgcattttccctgcttaagcaacagcataatctaatgatgtgatgtcttcgcttcgatgaaatactacgcacaggatatatcatagctatgccacatta

SEQ ID NO: 48801 - DNA, 21417 bp, Oryza sativa
ttaattttacaagccatgtcaagtatcttgttggattccggcttaattaattctgaatttctgagagttgttgtgctgaatggtgatgtgatcttcaatgtatatctgtttatataccgaccccctgatcttgatcttctaagcatacgacacacttgtttgagtggaaatcgatacaaggtcaaccacttgtgtttcgacttggtgccaactcaagcagaaagggtaggtcagtggtgttagaaaccaaccaagaacatagtaatccaacacaatctagatagttcagggctgcctcttgttgcagtgaagtagctggaaaagaacacaagactaatctgattaccgatatacagatatacatatacatacatatatatacatatatatcaatgcatcatgtgcatgctagctatcgattgctgtgtctctcatgtctcagctttcaacgcgactgttgttctgaatggctctctctacacactctctcaactctccttttatgttgcattcttatatatagcacatgtatgtataccaaattaatttgcaaacaacatttagcacctgaagtagtccttatataacaccctgaatcttttccattttatcgacgcagaatgtaccgtatgcaaggcgtacactttgtttgttcacgttgtttcataaagtgcggtacatacacattcattaattccaaccactcagattctccgactgctgaaaataaataattaacacgctatccatattagcctagctctacacacatttttaatggattcacatacgtatagttcccgcttacaatttttgtactcgcttaatataaaaggattagttcaggtgtagaatgattggagctagcatataaaggtttataagcggtccctcactcttaaattttcaaccaacacaacacctctggaccacacgggctaacaacataacaaacaaatacttcaaacgtgctaggtattagaacaaatttgtttgggttaattggatccatgccactacaactttacgaaataaaaaaaaagtgactactattcatcaaatcggctacatgccactgaaaatttctaaaattggaaccatgccactcccgtccgtttttccgtctcctctctctcacatcgtatcatccccccacaccttaatcactcgagcgcgaggcagacgaggccggaggacatctccctgacgagcgcgccggaggagtaggcggccatctccactagcagcaccggcggcgagcgggtgtccatctgcagcgcgacgtgcccgtggccgcggcgccgcccgaagatggtgcccgtcaggctcgaccccagccgccgccgcccgcagcctctccaggtgtccgcacgcttcttcgacaacaactactacaaatgcacctcagcaggctccccggacgacgtcgcggaaaatcgcccggttctcgtaatcgtcgtctccatgcacggaggcgccttatctccatctccctccctctactatccacctcgccaatgcggtgacggaggcttagccagccacgcataaatagaatgactcatcaagattagaagtagcatttttcctccaatcatcaagaaaccggtatggctcctactgaacctgctcgaactcactgtgcgccgaccttattgtgctcgccgctgctccccttgggtgttttggccagcgctgccgcgatgagggatatcaaggagagcagctcctgcggcccgcgggagatcgcggagagcaaagcgtacggctcggcgttggtgcttgtcgccttttgtccgccgccgacttgattgcgcgagccacagaaagttcccacctccgctcgccggtgccaccgcttggcgcggccaccctggagctggaggaaggcagtggaagcggtgaggccgcgtggaacgctcaacggagacggcgtgagtgaggagacgaaaaaaagggacgggagagacatggtttcaattttagaaatttccagtggcatgtagccgatatgacgaatagtagtgatattttatttaatttcataaagttggagtggcatggatccaattaacctaatttgtttaattgaaatggtatgtatttatttaaaagctttatgtgaagtttgagtggatctaacgatccccatgacatttgatgtcttcactggaaaaagcatttttcagacgcccaaaccatccgcatgtacctaaacgcctacaaaaatcatcaatttttctaggcggaccaagcacctgcctacgaaaatcattcacgggcaaaaacacaattttcccaggcgatagcggccccacctatagaaatagttttggtgcaaaaaaagaaaattcgccaccaaaccagcccgccctcgcgtttcacccacaaataaaaaattcttcatccattcaacaaaatacaatcacaaacatccattcatcaacacaatctatacatgaacacagatacagcggattcaaatccccacaacaccgatttgcattgcaacatcaatcaaaataaaaacaaataaaaaaacacagctctgtggcctcctccctgccgccctctactgctgcagaggggagggccatgccgctgccgccggtggcctctccccaccgggcggatctgagaggaaagagggaagggaggccgccggcctccacccgtccccctccgggcagatctgagaggaagagggagtgagggaggggacgaccacaccggggagggagggtttatctgccgccggccctcatcatcggcgccgtccctcgtcgccgagcagccgcctctggccttccttgcctcgccgagctgccgccgggcggcctcctcgccgagccgctctgaccccacggccatcactccgccttgccgagcccccgccgctagacccctccttgccgagcccgccgccggaccatctctcgtcaccccgtcgttgctggccctccccgccgaaccgccgccactgccggaccacctcctcctcgcccggatcgccagctctcctctttgcaggctcggagagggagggggagggtgagaggagagggagagggagagaggagaggataagatttgagtggctgttgggggagtgggataagtctgaatttttttatagttggatgcgggtttttgcaggcggagctcttagcagtgcgcttctgaaaatgagatttttgcaggtgcctcttaataggtccgcctgcaaaaatgaaaatattatcgtaggcggcgtcttatgtggtccgcctataaaaatatattttcgcaggcagatgaaggtcttgaccctgattgccattttcgtaggcagccatttggctccgagagatctacccgcctgcaaaaaaagatactcaacatcagcgaaaatgctttttctagtagtgctttctcgtagctggcacaaggtaaataaccgagaggtccactttcaaaatagatataatcttttcggagaggaatcctctaacgtaacttttcacctgatatggtcaaatgacatgttgacccatgggtggtgaggcttacatattagtgaccacgtcactctgaatttactttggaggatcccaatcaagctttgcctattagataagcagagttttacgtctggcgctacataacaaaacaaaaaaaaaacactctatcaaaagaaacaaaaggaaaaaggcacagggtgtcagcccgggctatatatatctcgcagactgtggcacggccaaagtacatagaattgaaggtcagtagaactggcgtccaccaaagtgccgacatttttgcatctaaaatattaatgcagccccaaaattcaagatgtgaacaatgttcgaatttctagttctaagcggcatgcacgttggaacatgtcaaatccgggtgagctaatgcccaacgaaataacgtacactactcagcagcctcagtagcattaagtctctttttttcgtcagccaatcgaagttctttagtttttttaattataaacatatatattacactaagaagcaaatatggtacaattatttgcaaaagcaaaataacaccatttaaaccatgcgtgtttaaataggcaagctctgaacagagaccaccacaagtatgtcacattattattacatagtaacaaaactagaaactagaaagaccaattcatttttcattactaagggtctgttcaccgtgatgctattttcaaccataccaattttttaaagttgctaaaaaatatatacgtttagtttgttgccaaatttggtaaatacataagaaatcctgctaaaattttagccatcttgcctaaaaaagctataatctgatcaggcccctaaaaaagctaggaccattattaatttgcagccattatatataggagccttcataacataggtcttagaaatgacacaaggcacagtacattaatagtgctctcgaatagtcttgttgcccgctttctattttattctagggactatcttacatccaacagccggatcgttctatcaatgaggttggcctgaccgccaatctgcaagtttaaacaaatattaacatattctaataccaaataaaatgaaaaaaaaaacctatcataagataaaactgcagctacaaaccggcttgactccgatcttacgatgactgatgatgtgtatgatgtcccaatcgtcaatcttgcatttcattattgcatccatatgcatcgggattctattgtgtctctgtggtggcaagagaagtatgccattggtgccaccgccgacggtgacagcaattgttgtggcccaggtgggattaatcgaatcgatattctacagctcaattttaaaccaattgtaaagctgatttttttaagataatgggaatttataaaatccggtttttacaccaacggggatgtatgcacccattgtgaagatgcgccactgctatatgcaaaacaaatcaagattgccaacatatattctgattttcagatttggaaactcaccggtcactgcctatgcagatcaaatttccaacataaaaaacaatatctgaattcaaggaaatttgtttgctggattagtaaatagaggaacgatggatgtcgaagaaaatttgagggtaacggcagcacagcgatcggcagatttgccctattttgcttgcttattacggttcatccatctatcatagtttgactgacagtgggctgttgggctgtacatcaattcacgggcccattagcttgttggactagaagttggatggaaacgccagtgtacacgtgagcatcatgtctatatatttaaattctgaatttgcgagctcacatgaattatggggctgcatttgaaaaaaaatcggaccaaagtgcatcgtccatcggaggacctaatctgatctctatatccataagaaaatagccaaaagaatacaagagcacttaaactcatatcttaccaaagagaagaacataccaccaataaacgaaaaaactacgacctcgagacatccctgctttccgacatcctctcctgaaacgaccgaattcgacgagtggaattcgtctagtcgccaccacccataggcgttatcgctacgatactccgcgattggtttcagaactcagtggaaggcattttcatccacttcaagtgagctgacgccgtgcgccaccaattaacccaccatcatccatcgtcatccagtctgaaatagctaactagacgcgagccggaaggatccgcttccacttcgtcggatttctagaccttcgcctctcataggactgccgccaacgtctcgccagccacggccaggcgccccgcagcccatggccccgccgactactacaccactagccctatcggcctcctccgctgccgcgcatggccaggcgcgggcccggccaccaccgccatggccctgtgcaccgtctcccgcgccacaagacccgaagctcccctccgtcgcaccgaaatccccaccggtcgccgtcctcgcagccgctcggcataccggcggcttgctcgggcggcggcaaggcaacggagagaggagatggggagtcgagtgaggagacgagcagtgttctgaaaccatgatgatcgtctaatagatgctgccttccactgagttctgaaaccaaccaaatatatgtatgcaccgctttaatctctaatacctcccaatcctaaatatgtatctaattataatctgcatggttcctgagatctgcaccattttcatttccagtagctcatcctatgtatgggtgctggtgtctgtactatggtcatacagagcactacaaatatgtcggtgtgagaatgtttatgattttggtctcgctcatttcagctgcctcagtatctatatatgtcttgagagtaatgtttatgcgcgcacatgcaaacaagggtttaaattcatcaattcaaacttggttcacatccataaaatacgagcatttatgcgatggccgatcagacccacaatgaaacgaatcaggcgcgcgatggagaaaataagaggaaaacaaaagtgagggagatcgaactgcggtgcggtgcggattaacctattatggttgaaatttactattaacgtaatcttgtgtgcaaacagcaagggaaacagatatcctttaatttgtgcgaggtgtatactttagtaagctgaataccaaatcacggatctctgtctactgctagacagggctaggaggagatcgatcttggttttgtacttttgttactgttgatttttaccattctatttcactcatcttgtttaccacttctttttatctcagcatctctctttggacaaaattgaacaacagcggagttcgtctagattgcaatttctcgatcacagcgtagcggccataaaaaaggcacatagcagcttcacaaaggcaaccatgtcgtgagacgtcctctgaagtgtgccgtttctttcaggaaaactgatgaggcagatgtgtaacaaaacaagacgagaaccggcaaaccgtaaattccaagataatgcatcctcctatttgaattcagaaaattaatcagcaggaaactctggcactccttttgttctcggtgcctcctaatcccatgtttaagattgatttgtctttgctatgtgcatggactggagctaatgctcttcttctctctttgaattatctaaattaagatgtactcacatctggagacgtgaaaactagcgcacacacctttggcttgcatactgcatctctcttcctgtgtcagatcttgtttgccggatccagcaaagcagtagagacgacggcatatatctgacgaaaaagcggtggtgtggcacgtacggccaaagtatagtcaggtttgaaatttcggcatgccggtaggggggcgaaattccggaaagttcgaaccgaaatttcaaaccctgttcgtacagtagcattgaaggtcagtaggcctggtgtccgccaaagtgctccatcgatcggttgtccatgataattaattgattgataaatagatggtgccttccactgagttctgaaaccaacgtatgcatcgctttaatctcaaacagtcggcggttgtgtacgtactccctccgagtccaaaaaaaaaaaaaaaaccctgattttcgtacctaacgtttgaccgtccgtcttctttaaaaaaattatgaaaaaaattaaaaagacaagtcacgtataaaatattaatcgtgttttatcatctaacaacaatgaaaatacgaattataaaaaaattttatataagatggacaatcaaagttggacacggaaacctagggtttgcctttttttgggacggagggagtacatattatctatagtttacattgcagattgtttatataaaagattggctttaaggaagcatgaacgggtttaattattgcacgcacgtgtgatcgaaactaaactctatctctatggtctatcctgcttgagcgcaaaaataagctgtgtatgcagccacacagtatacatatacataaaagatcaagtaaactgaaccagaaacccatgaagcaaataaaatatttcattttgtataatttgctgctatcgtccggtgctagcagaagcgctggttctgctctctctctctctcatgttttctccctcctccttgtatgacaatgttgatgtggtggttattgacttgttatctccggctgaatcaacactattatacctactcaaagaacaagttcaatagtgtagctgattgttggctccaaaacaatctacgttagcaatagagttatacagtatctggcagttggtattattgctttgcacaactatcaaaattatattttacctgaatgagcaactttcacactagcgggaggaaggttagctggtcacccacataagctgagcactagtggaccccacagcatgcatgggagccggtgttagctctggcgacaaaataagtgcccacactagcttctctcttcacgcacacactcttttttctcaacataaatataacttgtttgttgttatagcctgcttacataggattattgtacctgctctaataccttccaatcctatatacgtatctcaatataatttgcaccattttcatttccagatcagctcccaatcctatacatgtgtgctggtgaactgtaaaaccgtcatacagaaccccgaaaatatatcggtgtgaggatgtttatgattttggtctcactcatttcacctgcctcagtgtctgtatatatatctcttgagagtaaagttccaaagcatttatgcacgtaaatgcaaacaaggtttaaattcatcaattcaaacttgattcacatcaataaaataagagcatacatgcgatggccgatcagagcaaatgaggcgcgcgatggagaaaacaaaaataaaacataagtggggagatggaactgcgcggtgcggatgagggggcctcagccactgggccatccccagccatgcacctgggccttatccacagatcccctggcccattaggattggcctctgcatgtgaaatttaccattatagtgtaaaaatggcactaaatggctcttctgctgaagtttagcccttcttttctgaacctgtttattacgtgggtgatacgaaaactatggtaaagcataattcaccaaactttagtttgttgatgattcaacagttcagataaccgtagtcccagtgaacttcccaagaaggcacatctaaaagtcttttatccctatgccattaaaaaatttactggttacttgtgtgccacaaaaaattttggagttacttgtatgccatgagcctaacttacgttgaccgccccaatctgcgccctggcgccgcaccacccggtgaccggcgacgacgccgccctcccgaaccaaccaccacctgccgcgcgtgccgcccacgcgccgtgcgacgagggaggacgcgggaacgcgcgggccctagaggagagaggaggaggcgcgacggcctagcgcaggggcgcgctgccctgggcgcacggcggcggcgacggctccggcgaggcgaggcggcggcggcagtgtgcggctagggttagggtgcggcggcgtgcagcgcaacggggagagagcaggcactcacgggagatagcaggagaggagaagagagctgaaaatccttaagggcaaattagtaattttcatacatgggtcccacatgtcagagctatggaaccgttaagttctaacagaaggtggacggaatggcacactggtcaacgaaagtttttctcatagcatacatgtgactctaaacttttttatggtacacaggtaagcatcaacttttttagtggcatagggggaaaagactccacattagaagggcattatttgtgacgttgcctttaggaaaaactgatgaggaagatttgaattcagaaagttattagaaaaccatggcactccttttgttctcggtgcctcctaatcccatgttttattgatttgtctttgctatatgtgcttggacttggacttctctctttgaattctctaaattaagctcgagttcacatctgaaaattaaatgtgaaaactagctagcacacacaccaatttggcttgcatactccatctctcttcctgtgtcagatcttgtttgatctgagcagagagtagcatgtatactgttgagcttggatatatgaatgcattgaaagaagcatacacttggaagtagttgagactttgagagaagtacaaattaattttctctcttacttacgaaggtttaactccctttctatttattaactagccctcgaataattaatctctggtccaaatttattacctatcttatttcttttctttcataaaaccatgtcagctcaattgttctcagcttccagatgatcaacctatggttggaattatctctatgcttttaaatagcacatcatctcaattttcttaagatctttttgggtgattgatcgatcaaatttataatttgtacatatcatagtctaattaaaaaaacaactttgcacattattcataccgttgctatataatatattcccgtatcgattggtttctatctgtgaaccaggctgaagaggcccatattgttgggccaaatattaacctatatttcgacgatttaggcagaactttatacgagccgtttaaattctaacggtccttatgggcctcaacgtctatccaagacgagcatgatcaacaaaatatatattttcctctggtttcatcttcctcatcaatggtgacttctgttcatagcacacctaattggatcaaattaaacaccacatccgaattccaaaaatcaactaggatgagccacatgatcaacaaaataatagcctttgggttcacacgaagacaaaatagctagaaaaaatgtgagccattggatagagggagtagtaatactttgtgaagtttcctcggcctactaagaaaaaaaatagttaagttgtgaatactccctctatactcataaagggagtcgtttaggacagcggcacggtctccaaaacacaactttgatttcttgtttctataaaaatatttattgaaaagtgatatatgtatacttttataaaagtatttttcaagacaaatctattcatataatttttatattttcaaactcaacaatttgagagttatttatgatttatattcccaatatttgacttaaacattgtcctaaacgacttcctttatgagtatggagggagtataattctactatgtataccttcaatattaaagaacaaaatatttacaaatagaccctcttactctatctacgtgactttcctttgggaaaaaatatttacaaatagatcattgacatctatttgataagatccaacaacaaataaaagaacaaaataaggaaaatgtaataatgtcgtgcatataattttacaaatcacattataatgaaggacggtttacaaatgaacctcattttaatttagattcatatgatctgactaagtttcagaacattcaaagttatatatatcagtgatgagcaaatatatgtatgtgtgagatatactaatgtgactatcagctacacacccgtctaaagagatgttatgattaacatcattacaaatttaagcccattattactacaataatctatagacatatttaataagatagggagtttatagttgtcggaacgcccaacataatacagtagcatatattaattctagagagtaggagacatagaccacatgctcgagctagcatgtttggctggaccattagaaaaataaattttaccgttacagaaaaattcctgtggtgaaccgacagaaactgccgtcagaaaaaggtccatcgaagaattcattttcctgtgggtttctgcaaagaaaaataagtactgacggcacaacagaaataagtacaacgggtttgtaaaaattcaatttctgacgtggacacattagggaaaaccatcacagtgttggaaccgtcagaaaaattggtctttgaagccaaaataataataataaaaacagaataaatgcaatgctaatggcattttcgaccagtacatcaaaatttaagattccaaagcttacatgaatatccatcaaatatcactatcaacgaattctttcaaactcaaattagtaaatacgcagaggattaattcgtaagaaaaaaattcagtgttaattagttttcacttccaaaaattcatcaattaagtagggagagaacggagggagaggtaaaaatattataagtaaataagttgaaaaaaatcgatcagctagaagttcttcttggcctggtaggtgttgtcgtaggtccagtcgcggggggcgacgcgccaggaggtggccttgcggtggtcgccggtcatgacccggaaggtgagcgactcgccggtgaggttggcctccgtcttccagagctggccccagctgcgctgcagcggcgtccacttcacccgcttggtccccttcaccgtcagcttcaccacgtcccccgcgccgcccacgttcttaccatcaccatgttgtacgacgggttccccgttatcgtgtactttatcccgccctgcctcacgcacgccaccctgcatgcacgcacaccgatgtgcaaattaatcatcgagtaatacaaagggattattacgcaaggacgagtgctagcgcatgggatgacgttgagaaaatggtactccctccggttccatattagttgacgttttagacaagattgaggtcaaactttttataactttggccaccaataactttaaaaatatttagtttaaaggaattagaagaacatatatagatttgtcttttaaaatgctataataaaagtaaacatgcatttatttattatatatattataatagaaaaataaggtcaaaaatgtatcttgtagaccatatcattgtccaaaacgttaattaaaatgaaaccggagagagtatgcgagcatgaaatataggtagcagacctattcaatactccctcccactgtattttaatgtatgatgccgttgactttttgaccaacgtttgaccattcattttattcaaattatttgtgcaaatatgaaaatatgtatgtcatgattaaagaacattttatgatgaatcaagtcataataaaataaataatatttacataaattttttgaataagacgaatggttaaacgttggacaaaaaatcaacggtgtcatacattaaaatatggaggtagtatataatactaggtactaagcgctagtttccgatggaacatttccccgcactttgctgcgaaaattaataaagagcttttaaagttttttttaataatcgagctaaaagtaaaatttatattagttattaacaacaaataaaattggtttgtcaaactatatggtaagagattaatacatagtagactctgtatgagatttgtagatgaaatatgatattccgcacattgattatatggataaatatatgttaagtattataaaaataatggatatatatatatatatatatatgttaaaaatattgtgaagaataatgtgagtgaagatgattggatgttgatttgtagagttcaatgaattatagataatgttgcatgcttgcgtaagttttatttttaattaatgctagcggatgatgaggtgtcatgattacatgttgagtattagaattagtggattataactttataataagactggatttgaaatgtcctatcgagaactagggtagcaatattttgggacgatgttagtacgatgtgagcatgacatcgatcagcacgtaaatcatccatgatatcacgttacatatatatagacacgtgagtacttactttcggtaggagacgggcacgacgccgagcttctcctcggcgatggagaggaacgccggcatggtgaggtcgaagtgctcgcccttcatcccgttcactggcggcggcgcctggttggtggccgtcaccacgacggtcttcccggaatcccccttgagctcgtagcacgcgccgcacccggcgccgttgtcgaacagggcggggctcaccgccgccgtcatcgcgccgtacccgtcggcgtccttgtacccgcacgcgccgccctccgtcgtgcccgacgcgtcgcgcccgccgtagaacgtcgcgtgcccgtccacccacggcccgcacttgtacctgccgtggttcacgtgcggcatcttggctccgccgccgccgccgccgccttcgccgtcgccgccgccgccgccttcgccgtcgccgccgccgtcgtagccgccgccgccgccgccgccgcccgcgacgacgacgtcggcggcgaacgacgacgcgaggaagaagaagagcagcagagacgtcgtggtgaggagagggagaggcgccatggtcgtcgttgtgtccatgaaattaaccggagatgatcgaatggatgggtaattgggtattattaagtttatgaagcagctaaatcttgctttgatagattcatggcggaccggcaagtggtgggctttggccatttttagatggacgcttgcatgcatttgtgcatagtgattatgagcgagtggagcatcccattcccatgtttctaggccagctgaagcatagggctgtctctagtaatttagggtccccagggaaatgcagattggggcctaaaagttgaaaaaagatcgagaagttctacggtgtttgcattctaaaaaggtaaaaatccaacgctcttgagtgatgggcacgatgtaaaaaaatattgaagtattggtacaggtacttaactactaagggtaaaatcataggtgtcggttaattaaaaaccggcacctataatttataataaatcatctatccaaaccgagccgagcctccgagctgatctaggccaacgcattggccttataccctacggagtatatgagtcaaccatgcactcaaccttatctaatactccacctctctcgtctctctcgtctgtctctctcttgcctctctctctcggcttctcacttctctctcacgcacggcggtggctggaggggagactggcagccgggcaacgggtggtggcggcaccctctcatccgccgaatccggcgggaggggtagcgacaggcggtggcgcaagtgggaggtgccggtcgatggacggcggcggccccctcccctctgctgaatctggcgagaggggaggcggtaggcggtgggcaacgggttgcggcggcaccctcccgtccgccgattccagcaggaggggaggcggcaggtggcggtgcaagaggggaggtggcgggcgacgggcggcggcagcaccctcccctccaccggatctggcgggagggaaggcggcaggcggcgggcgacgggttgtggcggcgccctcccctctgccgattccgctaggtggagaggcggcaggcggcggctcaagaggggaggcggctagcggttgctagtatatgtttattctgtgatgtcatttgtagaacatgtttttgtgaatttgttgttgaatatgttcattctgtgatgtcaatttattttggtgacgatttgtggatgattttggggtttgggaatttgattttgggatgggcgcatgcacactgatagcacttagtgagttcggcttggattcgagccagctctttttttttttggctcgagcaatgctaaaggtgccgattctatttttcttataggtgccggttgctagtatcaatgctgaccaataggtgccagttggaaaaccgacacctatggccttttaggaaccggcacctttggccattttttagtagtgaacatgtctacaagtgggcaatgtttttgaaaactcaggataattctgtccaaaaatttcaatagagaatgttcatgctgaatttgtttatgctgatgcgtcattctattaatttcattcagattaattaattttcatgcggaattcatccgactcaacttatccctccgatttgcgctcgctttgtcgtagtcacccaaaaacttcacggagattaagtttacacatcagttacacatccacatatgacataacgagcattatagatgcttaattaatttattcatcgattgacatcatccttggtgaggaggaacacctaattcactcgaagaaccccatgtcgcaaagctaattaatctactgctgtccttgccaaagcgacgttggtttgcagcttcacctgatgctcgcaggcgccgtacagttcagcttggtggactgaggcttctctttgacagagtacaagaggcaactctgtcactaacaaatctgaaaactagtaaattcttggagacaaagtcggcttcacagttcatcccttaactaaaaactgttcgatcccacagacgagcgcttcttttattacccatgcctcccaatcttacttgtaagttcactatatgcacggtaataaataaaggcaccaattctctgtactcatgccctttctattctcctttttcctctccttcgtttcagctctcattttataagaccaaataagtagcaacaaataattaaaatgtactcgcagtaccagtgtgcatcatattcaccaaacgagaattttcattttactagcgagtatatatttgtggtgacctgcattggtatagtattctagaccactcgctagaagtgatccgagactccgatttatgaaatctattagcaatagagaaaaaaaaatatagtactaccattatttttggtgaccacgtacgtctgcgaaggtacattttcgatatccccccctacccgcccgcctcccttctgttttcgtaggcggacgtttggttctgagagttctacctgccttgaaaaatattttgccattgtctaggaaaatggttttccttgcagtgcacattaggaaaatataaatattaatgacccatcggatgtgaaagggcagaaaatctaatttgaagtctatatatctaatactacctccattttttaatgtatgacgccgttgattttttttatcaacgtttgactattggtcttatttaaaatatttttgtcgatgtttgaggtcatgactatggtatttgcatggtatgaggatcgttggtatcagggtatatgcgagactgaggtaaaagagatggaacaaggatctttatataggttcggacccttatctgacaggtaatagccctactcctgttgaccgaagccggtgttggtctttattcatctgaatcacacaaatacaataattgggataacctatctaaatgtcatcgacttgtcggtatggataaccaacacatagtcaacgatatggtagtcttcctcctgaagtatgagctcatcgagatcagagatggcgctagatctctcttgtcggcctccgcaggcaccatacgaggtctgtctaggcttatgcctgatgttgatgtctggcggcgtgtgttagcttgagtagggagagaggacacaacaacagatagatacacaatagatgtccccttgtccaagtagaaccaggaagaccaatatggatacaatcagagtagtccctgttgtttccatatagaactctactcgtctttccttatccagaatttcttctatatacgaggtatgtctgtataagacttggtatatggtgggccccgctaagcttagtcgattactattgggtatgtgatatccataaccctgacagttttttaacaaatataaaaatatttaaatcattcttaaagaatatttgatgacaaatcaaatcataataaaataaataataattacatgatgtttttgaatgaaacgaatgatcaaacgtatctcaagttaacagcgtcatgtgttaaaaaacggatggagcagttttgatgccacactgcatagtacatatgatccccgtctagtcgaataaactcttggacatctcttttattaaccccctgatctcttctgaccacatgacattatgtttcagcggaaatcagtacaagatctatttagcagaaatcggtacaaaatgccatccaataatgtagctagtactaagatctttctttagtgagggttctgttaggaaggcgaaagcactagtttgattaccgataccttccaatcccatactaagcactgctgcatgcgtctctctttgtctgaactctgaacgcaatttgtagttctgaaatattggctctcagtcgtctctcaggtctccttttatgcaacaaattttactgcaatccatgccatggtgtatatacacttcatataattagtttctccttttatgacatgcagaagactcatacacattcttcccaaccacccagaagctgtcttgctgctagtcatcttcactgaaatatatatctgaacatggaaaccgagagaagatacaaatcaaataatataatcaataattgaatgaccataccaacgtgcagaacggccagcatatactttttaaaaatctttacatcaaaatcgaagtggcaaaacgtgtacatataattaatcgactcatcagtcacatcaaacgatcaagatgacattgatactgcaatcatgctagatcaaattaaagctggtgaataaataaccaacgggagatccactatacgagtatatgacttgctgatgccttccgtccagttctgaaacttacgccgaccctgcacaattttcatttctgataccacccgatccaagttatgtatatgtatcactggtgcagaaagcttttttactcccggttggtaacccccatatagtcacggttttccaaccgggagtacgaatccagaactaaatatcgctatttttagtcccggttgataacaccaaccaggactaaagagagtagcgcttttttttttcttttgccagatttaatttctatattttctcccgaatttagtgccatgtatatccctaaatcaatccctaaatccccaattcaaagtaacatccaaaatattaagttacttataaacataaatcaaatacatcacaaatcctaaaaaaaacactcaaatcaaatacatcacaaatcctaaaaaatacatacaaatcaaatacatcacagattatacatctcatatccatgcaatgaatcacaaaatttcacatctcaatcaaacacaaattgtaaaaaaaaagaaaagaaaagagaccggccggcagttgagagggcacggccgccgccgcgtgcggcacctccggccgcccgccggaagcgccgccgccgcggccccgccggccgccgggccaccgccgccggccaccggatcggatgggaagtgaggaggggaggagaaggggcggatgggaagtgaggaggggaggaggaatgggagaaggggaggaggagttagatctgtgaagaggaaggggacggatctgtgaagtgtaggagaggataagggatagggattatatactacgtattaaattttagtctcggttggtaatactaaccgggactaaagatcaaaatagactaaagatcaaaataatttttagtcccggttagtattatcaaccgggactataaagatgatctttagtccggttggtgtcaccaaccgggactaaaaatccttggccctttgacagggtactaacacgggatgaaccaggagtaaagatgatttttagtcccggttggtgttaccaaccgggactaaagatcataaactagctgtggtgtttttaactgggactaaagattatttttagtcccagtttttattgcaaccgggactattatggattttggccgaccgaccaaagatggttttccccagtgtatgcaaatataatcagcacatcctgaggtatgcactccctcaattttcagtaactcacaaatctatacaagtgtgctagagtactgtactccctcagtttttttttttcaaaacgcaccgaatttcatggcatgagaatgtttaattatgcttttggtctcactcatttcacccaagaaaataaatttgttggggtgtccctatgcatgcatatatatatatatacctgtgtcgagactaaattttcaaagcatttatatattcacaaaaataaaatcaaggattaaattgaagaataaaatttaaatatatacttttatttttaatgttttgtttttatatacatgcatgggaaagaattgtaaaaatatatatctaccgcagaatagagatgcgggaccgaggcagtgccgctcgctcgtgcagcgtccgcgcggcaccgtcactcccgcacgcaatgcctcgctcccgcgtgacacataagcgcgaccagcgcggtcccacgcgctaacgacgcgtgaccggcgcggcaaagcaagcagcacatgcagcggatgcattgacgttgcatgcattcactggaagcagcgcacggcgcggcggttccgcgtttccaggctgcgggatcgatcggtcccgcaatgctgttctgcgcgaccgccggttccacgaaatggtggtgcaggaccaaggcggttcccgtctacggtaaaggtatatttgttcacaatttcatcgcattggtatataaacgcaaaataacgaagaaaaagatatattttcaattttttttcttaaattgaatatcaactctgcttgatctgcaactataaatcacatgagtgccgctatggtactctactggtagtattcttctaccagtaaaaatgatttgggctgttgatttgttagggcacactagtattttgctaatttatagttaggggtaattttaacatttatttatttttaaaatcatatgattggccgtgtcactgctactgtcattccttcatgttgaaccttcccatgtctatacggcggccccctccggcatgcgctggctcctccgtcgacgccatggctgccgcaatttgttttcgaaaaaagtccattttgactcccttaaatatatgtcaaatctcattcgcatccctcaaccgtaaaactaggtaaatcgaccccttcaataattaaaaccattcaaaaatgactcctttagtagttttgagggtggtttgtactgacgtgatgtttatgtggaactgttgacctggttttcaacttacgtggcagtagaaggaaaatagaaaagtaaaaacaccaacgggacccacctgtcagttgaatttatattagaaaaaaattgaaaaaaatacagtgggtcatgtggtattgacatgtcagtgtctcctgtactcttccttcttttcttctatctcctttactccctcttctttcttcttctctccttctttctcccctctgccagtgtggctacgtcaagatgctggaggaaacttggggggggggggggggg

SEQ ID NO: 48802 - DNA, 19328 bp, Oryza sativa
agactaccgtgaaggccggcggcgccgccgcccaccgctgccatcaagcaagctcgaggtggcgctcgtgcaagcctctcggcgccaccgccccgcacatctcttggatgatttgatgatgactaggtgcattgggaaggcacactggtggagaaaggggctttactcccggttcgtaacccccctgtagtcccggtttttcaaccgggactacgaatccgggactaaagatcgctatctttattcccgggtgaaaaaaccgggagtaaaatccatttttagtcctggttggtgttaccaaccgggactaaagatagagctcaggttgctactttattctattcttttcttcattatttttaatatattgattcaccctatcccatcccaaaatcccaaatcaatcatccccgaatagtctccaaattctcaaatcaatctctaaatacataacaaaatcttaaaaaaaattacatcacaacttctacaaaattcatcacaaatacatcacatattcacatcacacacaaatcaaatacatcacatattcacatcacacacaaatcgtctcatatccgaatcacagatttataaaaaaagaaagaaaaaaaagaaagaagatgaacggccgctgcctcgccggccgccggcgcgccgcttgccgcgccgcccgccgcgtcgccgcccgccgccgcgccgcccgccgccacgaggccgccaactgccagcgcgctgcctcgcccgaccctccacacgccgcgccgccgcgaggccgccagccgcccgcgcgctgctcgcccgacccttcgcacccgcgccgccgcgctggctggcagccgccgcgcaccggccggtcggccctccgcgcgccgggccaccgcgcgggccggccgggcctctgcgtcccgccgttgcagagggaggtggggaggagggagaggagaggaaaggaggagggagaggaggagataagggtgaatatatgaggagatgagttaaaaaaggagaggaggagattgtattgatccgatcgcgtgcaaccaccccgcttatgttgacttttttttcccggttggtaacatcaaccgggagtaaagcttatattgatcttttccccggttggtaacaccaaccgggactattgtgaaatctggtggaccgaccaaagatggtttctccactagtggcagctgctgtggatatggatagatctagatgacgagtccgcacttcctcatgttcccggctcctgctccacgcttcccgaatcgatgatggcgccgacgaagcagacagcctgcctgtgggaggttgggccatcgggaggaagacggagggccgccatcgaggtcgccgccaccttgcctccgcctagatctcatcttcggtagaatgatggcggaacggcctcaaggctgtctggccgacaaatcccattgagcatgaggtcgtcatcgtcgtggcatctcccgcggctcgttgactagtgggggcggcagtggcatggagtcacagtcggtgcccgaggacgacgagctcgatgaggcgaccgagggtatctatatctggaggttgccgtctgttgctgatcgtcgccctaatagtgaataaattctatgagtttggcgcagtttgaaaaaagataatttaacttaagaaatttgaatgtattcaaaatttttggcctgttcaataaaatctcccagccatccaagataacaaaatctcacgaaatatgagaatatgaactacatgaaattgcccgttttttgttctgtttgaagagcaaggcccccttcgtggtaagagaagtgatcacacctttttttaagataattgataatatctactacctccatattttaatgtataacgctgttgactttttaccaatgtttcaccattcgtatattcaaaatttttgtgcaaatataaaaatatttatgataaatcaagtcacaataaaataaataataataacataagttttttctgaataagacgaatagtcaaacatttataaaaagagtcaacggcgttatatattaaaatacggagatagcatttacttcaacataagctacaactcttggctgaaaaccaaatataacaacttctaacaaagtataaagaacgacacatcatattcctgcgtatgttttcgaatattatatttatgcatatttcatggcgtctgaagatgcaggaatatcatatttgaaaacatactaccatatgcttgcttctggctgattcatatgaactccaagtgaattaactggagcgtctcccagggtgaaaaaaaagtcccttaaggtatgacaaaaataatagttgtaataacacaataaattgatagatcatgaatttagaaaaatttagaaaaaggaataatcaaatttgaagttagtatagggagaaaaactacctacaagttttagccagagattaaaaagataaaccacactttatgatgaaccccacgagcaggtgatgcaggtcctaggtcgtccgcataaaacattcaatcattcatgcgttcaagaattgtgaaaaaaaaaactagaattgagacaccaatagcatgaaagatcttcgcagtgtagtggttaagcttgacttatgccattccacaggtcgttggttcgacccctaggtgtgcagcatattttttagaaaaaatagttcacatgggctataactaaaacgaatgtagcgacctactttatctttaattatatgtgggtccagtgacaacctgatttgctattacagcataaattgtactaataaaggagcatgaatcgtgcacaccattgtgacgaaattatctattgtttttttgacgccattttaaatttcgtcatggagtttcaatgtctacccccaccatgagtgatccctgacaaaacatgaaatttcgtcatagatatgctctgttcaatacgaaattatacagcgtcacgagcaaaacgtcatagatggacgatttcatactagtgcttcttcatgtcctcttcctttcggaatccggcggctctccggtcgccagtaagaggggagggtgtccggcttctcctttaataggtatagctttagcttagttgggtctctcccatagtcgggttaatcacgttcgttgtgcggctcaagaaggccaccggcattttcgctcttcttgtcccggcttccggccatggaggacttcaccggcattctcatcgatcggggtctcttgtacttgctgggttccccttcaacgcctacaactaggagttccgctgatttgctcgggtttggagacttgtcctctagcccaagaagaagaaggttgcgccggccgcccagttcttctctggcgagcttcttgcattggtgttggccatcttcttcgtctccggcgaaaggattcataaagtgcgagtgatattatctttgcttgtcaaggcttcttcaacctcctactcttggaggccccatttgggttcgagcctaggcgtcatcttctgcagccgggccacggctccaattgctttttcattatcttttcaggtccttctttgcatcccttgtgttttaagtgtaatcttccctactttcgggggcttctttgcaaaatcagttgtactctcggttgctatcgaataaatgtactgctgaggctgttgcctgatcggtttatgcttcaaaaaaaaggctatgtttagatgtggaaaagttagaaagttggaagaaagttggtagtttggagaaaaagttagaagtttatgtgtgtagaaaagtttttgatgtgatacgatgtgataggaagttgggaataggggaactaaacacggccaaaaagtgaattaaccactggcctgtagctttcacaactgtgcctgctgtatttccggtatcctccaagtcatagtcgtcgtttttgtgtgtgaatgggtatgtgctatagggctctctatatgagattctttcaccgtgtttagttgcaaacttttttttcaaacctctaactttttcatcacattaaaactttcctacacatataaatttccaatttttccatcacatcgtttcaatttcaaccaaacttccaattttagcgtgaattaaacacacccttaatctggatcagatattctcgcttttgttcatgtgtatgagctgcctcgtgttctatgatctccttggtgacattgagagaaattgtcaaatcaactagtactggccagatctccaatgtgtatatttcatcttatattggatacaactctatgattttgcattgggataaactactgcctctgaattgaaaatctattaatgtgtgcatcttagttacctagtatgttcaattagaaaactgaatttattttgacggcatgcgtaagaattaattctgtagagattggcttcggaattacgatactgctgttactgtgtttcatacttagctgcctttgtaactcatgtttcccaaattctaccccatcgtttcacgttagcacgcttctcaaacagataaatggtacaattttttttccaaaaaatgaatatagaaaaacttctaaaaaattatattaatccattttgaagcttttaagctaatacttaaataatgatatgctaatgagctacctcgttttgtgtgtggatgaaaaaagttcccaatgagcacctctgaagcacaaccatgctatttctatgagacattttgactcttgggtgtctagaaaatatggagacggcagagactgaaaaactaaaagcaataaaatgctttgctcggttgaccggaaggccacaagctattggcagaggtagttgtgttacagctaaacaagagcatcaaaacttggataagaactattggatagttggctaactgctaatgcactcgtttgattcccgatgcatcctagttctacgtttgtaacgtaactgcattgtaagcatgtgaagcactggtctttgccgagatgctagctgtgagttgccctgttctcaccctatttctcctcatttttatcttctaggaaattaaggagagatacagttgaaaacacactgtgtgattgcacatccttataaagtccaaacttattaaatgcgatgaaatcaagcaaagggaactggcgatagtgtgttgcgcacatactgaatgtcagctagctaactggtataatcgaacaatgtctttaaattcagataactagccgtctatccgtgcgttgcacgggatattattattaatattgaaattttatcatatgtccaatacggtagttattaaatttacatgtagactttatattaatgttctaaacacagcagaatgattgattgttgaaaaatgaaaaatacacaaatattgagtcatccatcttaatattttctctgctagttattttttattttctatatttaataatattaaaaataagaattaataactgttgatttgcacgcatctatggagtcatggtttatcattttcattatttaatttgaaattttaaaattagttagtacgactatacccagtatggacattaagtgttgattatagaatattgttatttaatagctccaaaatttaactattaaagagttgtactcggtttgggaccttgattataggtttttcatgatttaatagttgtgaagttaatactatttaataagtattgaaatgttctttgtttcaagtgttagttactgtttttccatgatttaatgatcctagatttagtattcagtaacgatcgagaattttacttgatagaataatttcgaaattaagaattaatcatgcatgtttgttcgtgttgtacttttaatttggtttggactttggaatcttgcttttagacaatgttgaaaagctaaagagattacatattgcaattggaatgtttactttaaaaacaaattctcaacttgaagttgatcagctggtaataagattcacctaaccacatggagtataatataaaatatatatctatatatgtaattcgaaataggattaatcttatgtctcatgtgtgtgttgttttcttcagttcttcatatttgtaggatatgatgccaagtaacataaaaaatattaaattagtcatatttgaaagttatgtaaggattcacttaccatccatatgaaggctatggtttttggttttacagctaatctccgtttatttgagtatgcatttgttaggtgcgtattaaggggtgtgtgtgcatatgcttcttccttataatgctgtgcagatgtactggccactcccgatcttattgggtgcaagtgaacttgtttaattctagatcgacatgcaaataacacctgaatttataagatcaaatgatggcatagctgagttatgaattaaacaaaagaaattgaaccaaatctttgttaagaaaatatcaaccggaggcagagagatcaattcgaacgatgtctcttggtgagaaaatcatcagagctggagagtttgcaggacgtacgccatagccatctgcatatgaagaaggactaccgtcgacgcgttaatccttgccatctaccgaataatgcaattatgccgttctaccaattttggacgtacagctgtggaaaagaatacttacgacaacagattactgaaagaaaatagtagatcgcgtattgaaaaaaacagaaaaagaattaaaattcttatgtgggagacagccagacagatgtttccctggtgactggtccatcatcccgttaaaaaggattaaaagaatattagaaaaaaaagaaaaggtatacgtaggtgggtgacagtaggacagattgaatgggctttgccaggcccatcacgttaaaacgattaaaaggagattgataatctacggttaagattacactgtctactcgattaacggatggatttttctaattaacgtgagagttcgtagaaagtgcccaattagtataggtatagattttttggtcgaatgtttcaacagaaaatattcagtacattgttgttgaattgcatcaatgttcactactttatagaaaatccccaactttcactcaacttatggtacaagtataaattagttataaacaatgactggtgatcactaactttgttaagaaaattaatgtggagattatggataccccatacccacatggcatgtatatccgactaggtataggggtactgtatgtagatagaatatctttaagggactcgggttaaattccaaacttgtgtatcaaggaaataccctgagtcttagtcagttacgattatattttatctttactcacctcttagtcagtttcgtatccgactgggttgtaccttgtaatatggactcctccccctatataaggaggggtccgggtgtctcttggagcataactttttttccagatcatacgatcaataatacactcggtggatcaatctccgcacaggagtagggtattacttctcattgagagggcctaaacctgtataaaactctgtgtctcaaaacccatccacttttctagcttgatagccacccccttttcgtattgccaaaatcttgtttcgacaattaaacataagttatgcacataagtaaaagtacagattaattttccatcgagtcattattatatattgtttcccttgtatacacattatctagaattttcacgtattgaaaggtgtttcgtatcgtcttcgatctttcgttggaccgttaagacgaagtatggtactagtactttttgttagatttttacccatattgctttgagtgcattgccaaattacatcgtgccttcttacaatggaagatccgcatgattttgtttctgttgatgcctcgttatatacttctttcagattaattccttctcatgatgttcggactcgactcctcccctgattggctttctttgtcatagctttattggaagaggaagtaggagatatatatgctatgccgcattatactactatatgtagaaagcaaattaagatcgagattttatgcagattacgcttacgacggttacttatctacatgacgaatattttttttaccggaaatactgcatgactttgcctcgcagtgtgattttatagaaaaaaagatatttacaaattacaagagactagaaaaaagattacactgttggtaaccaataaaaaactatctcttttagaggtttcttcattctgcacatatgcagaagaacatcagctttaaataaagccctctaaaaactaaacgagggaagctcatttcgaaagatttttccattaaggagtaagagcattatgggtgcatgctctattcatttagcgattatccttgtttagaacacctacgctgtgtttagttgtaaaatttttcttcaaatttccaactttttcatcacatcaaaaatttcctacatacacaaacttcaaacttttccgtcacatcattccaatttcaaccaaacttctaattttgatgtggaactaaacagagccctaatcgatcactcgaataaccccatcctggaaagtcgtacagctgctagatctctccttccaatcgtcgaagctacatgcacaacacagctagcttcacctgaggcagtcgtactgtgcacagttctgaacagcaactgacacttgccccagagcgcgagaggcaacttagcttccaaaacatctgaaaactggcaaatcgatggagagagagtttgcttcacactttctgctacagctaaaaagtcttggatgctggatccatcgctctcggagttctttcattaccaatgcctcccaatcctatttggaaattcactatatgcatgacaagcgctttttaacgtctcccaccaatacgttctgaattttgatcttcagctagagtttatatgtggaagagtataaagaaaactttaaattaacaatataaatctgtgcatcagagatggaccatcaaagattgactgatctggcgtagtgactgcagctatgtggagggacgacacaatgccctctcgctctctttttatctgaccaaagtaacaataaatctgtcaaaaatgtactcccctagtaaactcattcgtacgttgagcttagatgcctttatttatcaagcatgcacttgctactagttgacggagctaaaatagtattagattactccaataaacaaaatcaaatttcgctctattttttgtcaacggtttaaaatatttcactagactaatattggggcaattggagtatcaatgtccttcatattcagcacccaacgaattctcattttgcaagcgagtatttttagggttatctctaatggtaatgttttacgataaatagtacaagtattatgactaccagaagttatatgaacaattgctttatgatatctattagctactgaagaaaatgttccaactaccaacaattttttcaatggattctactagtagtttcggtggtaaaatttatcaaatatataatgtctattggatgagaaaagatggaaggtctaaattgattatatcatcagtggagaacactgaaaaaattgtttctacaagcatacttggtattatggccatgtcaactatcaagttaattatatcctggctaaattctaaatttctaatggttgtatcctgcacgatctcatttgtcttgaataaacttttcagatatctcttttgtaccccctgatcttcttcgcacatgaaagtttcttgatcagcggatctgtacaagacagatcaatttatcggaaatcggtgctaccgttgatgatagattcttgtaatggagcttactcaagcagatgccagggtaatatagttgcaaggcgcctgacagcatcatgcacgcaccctccatagtgcattcgcttgaacataaaacacactagccagttgagatagaaaccagcctaaaatgtagtaaaccagcaagatttagctacctaaatactgcctctttttgtagtggggaagctgttagaaattgcaaagcaactagcttgattgccgataccttccaatgatccaatccttaatttgtatgccttatgcatgtgtatactaaaagtgttgtttgtgtctctcatgtctgagctccaaacccgtttgtagttctgaatgttttctgtcctctgtcaagtccccttttatctgccagtacgtattacacatcattatctaaaaaatgtattcatgcacataattgtagtgtatgcttggcttcctgcagagcaataattcacctcagatgtgcaccatatgctgggagcagctttcaattgaagggtataaagttttaaaatacctgtggatgaatatacttgattgccttcaaaactactcagatgtaatatacttacggaaatttcattgggtgtgcctatatatgcatatatgtatatatatagatgtgtcaaaagttcatatatgcggaacaaaatttccaaggcatttatatacacaaaatacaaaatataggagggaaaacaaaaaattaacgtgaacaaaaaataaggaacgaaaaaagggacgacaggcacctttccatatgagtgcagatctaaccgatcaactcgtccgcccgctagctggcatacaggaggctacagtcgatcgaaatcttttaacttccattggctttcctcggaactttgtgctcacttgctaagagcccatggaaagagctggttgcgttagggtatgtacgatggtctttactagtgggctctcgctattatcgtgcaaataaatttgatgacatggaacaaagagagggatggaaagagaaacatgatcattacgcataacactagttcagagtcgactcttaacatttattagaaaatattttgttggatgtggtttgaaagaaaggaaagaagagaaagataagattattttggtacattaatggttgtctcaactgcggtaagataatagcctttgatgatatagagctcacacctgactctcccttagtacatgccctaaacagtgaaatcagatagattttactctatcacgacttctctaaatctacatggatactagtttaggcttagatgagattctcaaactcacggtgtgttcctttgattcccaattcttcccattcctatgtttgtagctgaggtacatgcaggccaaattggcaagtagtaatccatgaatctcacggtatagtaactttatcttattgtgaagttctcagccagccaattctcgcctcttggttctctctttaatctttccaggaactaggacataccatgtataaataatggatgattacacacccttgtcaagtccataacttgaatgtcatttaatatgcgcatgctggcaaaacttgtggttgtaagtagtagttgcaaaaattagatgctacgggtacagctgaagtaaaaggaaccagtggttaactttccatactccattgtcttttgttactgggggaaagagatcgttaactttgattacaccattattttgccttaaacccagtggtttaagcagtccactccaatcctagggatccaattatcattctttacatcaatagttgtaccatcctcaaggattgttttacccggaaacatgagtggcgatctagtctcagaattgatggtccttaatactactgttgatgtctttcttttagtgtgttttagctgtgtgcatcttagctatgcagaggctgagagtgttcttaggataattgggtcactttgatgtaattgactgagaccaatagaacttccattatctaaaaatagttgtaccatccacagttctccaaataagtcccctttacaggagatcccttccatgcaaaaatatactctatgcatatgatgcatgcctgggacaaccaacatctaggaacccacaatttcgaaagttcaggttcagggtttgtagcagtctccatccctgtcttgctgcatcaatatgcaccacggtactgtctggctcttgcgtcaggcgtcaagccagtgccagtgtaataccatgttcaggtcataagaaaactgaatctaattatttggatgcatgtagtaagaagggtgttgtagattgatggacatcaaatagtcctatttactgtacctctcaaatactgtttctatggcaacgttttgttctcccactactaacaattcagtgagtgctataacagccatgcagcttccaacgtgcagagatctgagagcatcctttttttcaggtcgtcctctaacactgtttacattgttgatctccagggattcgttgaggcatttctgttacagttaacacttcgcaacgaaagcactggtacacgggagatcttggatgatggacacgctgccagtgcactcttgtggttcacgatgcatcccatttccatgtatgtaatgtaactacatggcctcgtcgagaagttgtcggcttcccacttcccacccttttttcagctatcctttttatttggtagaaccttttatatagtccttaagttatatgttattctttttatgaatcctgacaaagcagagtaaagtgcatggcaaaccccaaaatttgctcgtctatgttatctagacatatgtttggttcagtaacaaaatgagatttgttggactcacccctatttttggatgagatggtacgtttcatctatatccatttgctatgaggaataggatgatcctattttttaagggatagcccacatgctcatggatataagtcctacaacttgttacaatgtgtcattctagtcccaaattaattacttgtggctcgttaaaaaaaattccttccacaaatagtcaacatccaaccaattttgtcaatcaatgttaaacattataacattagaataaacccaatatgagtcataaataaattgtgtatgggttataaaattgcaagcatgttctttgcaaacgtttggaggaaatttttttcataaacgcgaaacgagaaagctcgttaagagatgattaatttaatattaactattataaacattaaaaatggattttttttgttttttaaataactttgctatagaaatttttttaaaagcgcactatttaaccaaaaaacgtgctaacggaaaactaaaatgttggagttgaagaaaagaaggcctaagtctttcctccgcactttgtgctcgcttgataagagcctgtgggaagagctgatgttaacgccaaaatttgactggagctaagcagatctcacagatcaatgtgtgtttttcgcatcaacagctagttgtgttacagtgaaaacagatagattttactctatcaggacttctctacctcgcagtggacactagtttgggattagatggttgtccaactcatagcgcactctgttgattcccaatacttccgaatcctatgtatgtagccacggtacatgcatgccaaataggcaagtagcaagccatgaatctcagagtagtattgttatttatcttactgtgaagttcccagctagcctattctcgcctattgcttctctatctctttttaatatttccgagaactagaagccactatgcataaataataggtgattacacatccttgtcaagaccggtttcacgcaccggaggagatactatgcataaataataggtgattacacacccttgtcaagtccgttttcacgcaccggattattcggaatatttccaaaacaaaacacatccgaatttcccacagcaaaacataactgcaaaagcaggctgcatctgcgtaagggtgaggaaccaattttaagtctgttttcacgcaccggatttttcggaatatttccaaaacaaaacaaatccgaattttctcggatttttcagaatatttccaaaataaaacaaatccgaatttcacacagcaaaacataactgcaaaagcaggctgcatctattcgatgcgtacgtcgcgcgccgcctgcccggcccggcaagcgagcaagcgcgtgtgttccccctcttctctccatctcacatacttcaagtggctaggagggcatcctccctaaggagatccctctctcctagaataagtaaggtggtactaaactcgctatgcatgccatcgcatgtggtggacttttctgatttttcaaagaattaaacttcgagtgggctaaggcccatctattaattccaacaatatgttccttacaacctacataatgtttgagcttgggactggtattgaaaactttggcttgagccaatatggatattgatttgtatttatataaaaaatgacatttatctcattagattttgttctcactttttgccaatattaataaaattttcattcataccctggtggttctcaccccgaagaaaagtctccactgggtcaagggatagtgagttcgatatatctcaagcaaaatttcgttgagagaaatgctaattgtgaataaattctatgactttggtgcaattcgaaaaaaaataatgaatgatccaatggaagccatttagatctgagttaaaggaataaattcgaatggtatcaaaatgtccagtcaattcaacagaatccctggagaccacccgagatcgaaaactctcatgaagtgtatcattgagaatctgaacacatgatatatagtgtcgatttgttttgtctgaggaccaaatctgcttgtggttggaaaagttattattcgatgcaaaaactattatgcatgcttgaagaaaaacacctattatgtgcttgcttctggttgattcgtatgaactccaagtgtaataaccactgaccagcagctgcgcaattgtggctgttgtactgtcgttcctgatctctttcaagcctagtcgtttttgtgagtgaatgggtaactgctaatgatctccttttgaaaacctttatcagcttctgaaaatctcgcttttgttgacgtctatcatctactttgtgtcattgaatgattcttgaaatcgactaatggttagctctccaatgtgcatactatatatctctcgtgtttgacgcaatcactacgattgtgcagttgggatgaactgctgccactgaatttcagtacttgaggaaattgaatttatttgtatgcctgcagtaagcgtgttgtagatcaatggacatcaaaatactcctatatattactgtgtttctgaaatactccctccatactcgtaaaggaagtcgtttaggacagcgacacggtcaccaaaacacaactttgatttcttatttctataaaaatatttattgaaaagtgatatatgtatacttttctgaaagtattttcaagacaaatctatacatataatttttatattttcaaactcaacaacttgagagttattcgatcatgatttatatttccaatgtttgacttaaacattgtcctaaacgacttcctttacgagtatggagggagtgctgtttctatggaaactttttgttcgacaatattgggagcccgctaccaagaattcaatgagttctataacagccatacaacttccacctggtctgaaagcagccaatcagctttttatctaccccttccatttcatcgtttccggtcgtcctcaacactgtttacatggttgaccgagatcgatttgttcgggcatttctgttacagttaaaccaaagagggttatctgcatcaacactttgcaaccaaagcactggtagtcaggagatcttggatggacgacaagctgccgacgcactcttttggctcccaatgcatcccatttctatgtatgtaatgtaactacatggttcgcttgtgaagcactggtctagtcgagaagttgtcagctgcccacttcccactttttttccgctgtcctttttatttggtagaaccttttataaagtcctttaacataaatgttattctttttatggatcttgacaaagcatgtggtcacgaagtccctaaaattctctcgtctatgtcatctaggcatgtgtttggttcagaaacaagatatgggttggactcacccctgttttaagatgagatggttccacttccatctgtccatttgccatgaggattgtgatggtcctatgttttaaatgatggtccacatgctcgcagatatatataggtcctacaacttgttgcagttgtcattcgggtcccaaattgcttgtggctcgtaaaaaaattccttccacaaatagtcaatatccaactaattttgttctaaaatcatctgacccatccgccaattttaagtattataacattaggataaaccgaatgactcattaaacattgtgtatgggttataaaattgcaagtgtgttctttgcaaacgtttggaggaaaattttctcatacacgcgaaatgggaaagctcattaacacatactccctccgtttcaggttataagatgttttgactttggtcaaattcaaaatatttcaagtttgaccaagtttatagataaatataataatatttataatactaaattagtttcatcaaatcaataattgaatatattttcataataaatttatcttgggttaaaaatattactacttttttctacaaacttggtcaaacttaaagcagtttaactttggtcaaacttaaagcagtttaactttgaccaaagtcaaaacatcttataacctgaaacagaggaagtaattaattaatattaactattataaacataaataattgatttgtttgtttttaaacaacttttatatagatttttttaaaaagcgcactatttaacattttgaaaaacgtgctaacagaaaacgaaaaagttgaagtaaagaagaaggcctaagacatcaatgcagtcctgatctgatttggttgattggtcaagtcaacatatgctatttttcttcctttcgtctcccaatccaatgtgtgtaggctacactagacttacaccaatgaagtattgaacctatcgttggtatgtaaatcccacataggatgtctaaatttacaatgtttgggtattgcttcactttatactctagcttttatccactgaggaagcaacacatacaatgcagatataatgtatgatcatacacctcataaagtccataataacttggatgttattgaacttgggcacactgaagaaacattctgttgcaagtagctagcgaaaaagggcataggaacatctgaattacaaggaaccattccttgttttatcttgttggctatgtacaccctcatgtacctcaaatatttcaccccaaaagagagtttagctagctgtcaccattgtcaggtgggatggaatgcacttgtggctgatatgtggcccataatatttggtcctgaacgggattgcggatgacatgcggctcagttaggttgggccagatgggctagacatcatgacttgttacttgctagatcctctaccttagcatccatgccaccaatctccctgcctcctcgtgcccgctgctcactgctgcagaacccctcttagatgcctgttgcaaacccaacataggtgtcgatttgcagccggcactaatacccttgagtcattggagctggtggtagaaccggcacctttattctccccacgattagaaaaagaggagaagttggctcgtagcattggctctatgagccaatgcttcgaccagcccaaaccaatttcccaaaatcagaccaagaatgaacatccattgccctaatcccaacatcagattaagaacatgcagaatcaacaatcacccaaatcaacaaatcaagatcaaccccacacgaataatcccctaaatccttaacttcaacatgaaaaaaaaaatcctcactgcagaacacgcacatcatgtattcgccatccgcgatgcaccacgttccaatttgccaactacacccaatcccatctcaatgaaatcagtcccttgaggaaaccatgcaagaaaccaatcacaggcacaaaaaggggaaaaatcccataccttgcacagcaaggggtcttgagtaggagatctccagagaccccgacggccgccttgcatcttgcggcgccggcggtggaggaagagcccggactgcagtgggtgggacagtgcaaactgccctgacttgggattcggatcgtctaacttcacccgtgaaggcacgagtgtgatgtcgcacttatccaccatccatgcaatccaacggctcgtgtgacgcatgcacttaattaactgctgataaagtctatttgaagccgatggtaacccaacaagacgcactcaagtgtcagtccgacgatgtctcagcgctgtcattgccgccaccagtggccactagcacggccggagctcgtctgccagtacggggctgtcaccagccgcctctgaagtattttttgttgttgccgggcccaagtaccaaatttgctaagttaattttgtctgtttttccaactgctgatggcactgaatacatactttagctatggagattgtattctagggcgctgcttttgttcttgtcaacctatactctattcacaatctctttgatttgcggtgtcgctcgactctccagtgtaaatttgtgcttagtaatgagtggtgttgtttgaaacttatgaattgcctgatggaatgcgtgctttgtatgctcaatatagaatccaatgcaataatgcatactttgctccgctcattttagttgtgttccatattccacgcagcaagcatggtgcatgactgccgattgatgcatccagtcctagcaggaagatggaatggcaaagcttcaacaatcaatacgagggtgaaggcagtagcggatggtggattgcatggatggtggataagtgtgactgcacacgtacgttcgtaccttcacagggcgaagttagacgatccgaatcccccgacttggcctccacgccaccatgaccgcggctgcagttgctcggtgagatgatgggaaggaggcgccataggagaggagggagaggaggcgtcataggagagggacggcggagaagagtgtgagagagatgagtttggtgtcggtggagagacattatgagtggttaagattgttaggtgcgttggtggagtcaaataaaagttcccaccaggtctttggctcgtctcagtttaattcattgggtgtattttgtttaagaaccgatacctataatatattataggtatcaatttttaatttaaatggcacatataatattaataagtgccggttgctctctgaactaccacatatagtttactcatatgtgccagtttctatattttttttcatcccacatga

SEQ ID NO: 48803 - DNA, 23330 bp, Oryza sativa
acggatggttctagcttcaaaatgttctaatatgtctgcatgttaccctgctgcatatatatctacgcagaaaaaacaaatgttcaaatgctatgccatcaacaagctagctactttcaatatttagttaagtaagagaaagcacaagttggttgcctcccagctcagtgtctcgacgtctcgttcatccctccaccaaagaagttatcatctgggagacttgtttgccttcccgtctacgagcagagtagaattcgatgcagttgcactgcttctctccatccctccacgctgtttgcttggctgtttagttcaggacacaagtgtagaggcagctgtgttgcagtcaaactggagatgttttactgaatcaagagctagagacctcatcgctccaacaggtttacgactagatacttgtctgggtcacaatgcactcatgtgcttcacgatatctcctaatcctatgttattccatagctaaggtacacgcatgcgaattgtggaaatctctcattggaataacgtggacggttgatgccatggagaagtttcaaatttcctgcctctctccactctcattttatctagtacagaagtagcaagtagcatatgttgcaagtttttgggggtaaaactcctatatatatgatacatggtaacataagcctttggatggcatccaatgtgtacatgtgcatgtgctagtgaagaatgctcaataatatttttttttgtggggaagaatgctcaataattaagcgtgtgtactatacaagggacagtcaagcaattgccatggcctagctagtgctgggcatcgaaagaacaatttgtcacttagcatgtgtctggtttgctaccatgccaaaaatattggtactaccaaaacgtaggcaagttttggtgtgctaaaattttagtaactttttgtatgttattggtatattttggtatcaaaccaaacactaataaaatactattcaaagtgcgaaacaatttgcattggtaaggcacattttggcttcaaaccaaaatagcccttaaaagctcagaaatttcagcccaagtgagccgtgatcatttcagttgggcccaagcaggatagagggaggctcacatatccagttaattgggcttcaatgggattgcaggtatatttggccaattttatttagggttcattggatccaaaccattataaatttgctaatttcaaagaatgctaatataattcatcatgctaattcaactctttcaaaattggtttcatgccatcctgtacgaggcacgagctagacctgaagagcatatctggcggtggcgagctatgtcggggccggtgatcgagtttgacggcagtgcgagcttggggacggcaggtcacggcatggaggggatggccggctcggggtcgactggctctttttcttcccttttttccttcgtaaattcttcttatcctagattctccctttttttttctctctttgtgtgatagatatatcatcgcaatgattcgttgcagtttgggttttgatctaaaatgaagcatgttcatatggatctaaagtgtatgcaggggtattttggtccataaaaaatacaataaccaaaaaaggattccaaatagatatcaagcatgagtccaattttgaaagggatgcaatggcatccttacaataaggtgaattataatcgtgtttctcaaaactattaaatttattatggcatagttgtaacacaagtgcagcccagtttggttaagctggaaagaattgtgctgtacatcaggtggttgggccggacctcaggtctttagcttcatcgcctagccacctccgaaccattatttacatttcttgacaaaatttctcgaaaaaatatcaaatgtaactacagtatcataattgtagtgtaattatattgtaacatacatactatacagtgtaacttgtatgtaacttttcacgtaattttagatcattagactcaatccaagattcacgcaagcgaggaaggaaaaaaagtcacagtgcatgcataggtgagggtattatatcccgtgaccttatcctagtgtttctctaaaaagttacaggcaagttatattgcaatctcactctgttgtgatgctgcacgcaatctcactcccgtgaatttgttccagcgttcttgctttgccacccacaacctttgtcgtactaaccctagccctccagaatactgtttgcgtggttgttcatgcactacctgctgctgctggggcaattgtgttgcattttaactagggaagttttatgtgtgaggatgtttacctcagtgctgcatctagctagagcttgaatcgattcgtgcggctgcgcgccaccttgccgccttgccctcgaaaggcccccagagaactagcgatggcggttttgttgtctagtggcgggaggtggccgccggcagggttgttgtctaggggttggcggagaaaaggcagcggggaacgacggaggcaagaagaatgaggagggatgagggtctggcggctagatctagggttcgggtggtgagccgaaaaaatatatgttgcagcgagagtaattttgtgttgcttgatcgagatccaatggatcaatcttcggcgacaaatggtgcgtaggtaagctttgcagacacaccgctgactcagaattttaagaaataactgattggtagctagattctaaaaatttagaaaacccagtttttggtttctagttcatttcccggattctataactacaacattttagcatttgaatgaatatctaaattgtttggggtgcttctgattttaggaaaagttgcacatgccaaaagcacttgcaaacaggccctcgcaattgttaagagatagtttaaccatcaaaatctgtaaaactcccaacatatgatctgcatcatgccaaagtactgcgcgccgatagatcctatgtcatatataaattttttccccattgatggttattggttgattctctatttttgcaaacaaacatctgtgggcaaatctgtgccatggtgcagtgtgctggcttaaaattactgtggttcacaataagtgtttctatcagaccccagtactgtacgtagaacgtgttgcatacacgcagtgcagccaaccccagccatcacttcatatcacagtaggtgtcgaagcttcaaccaactcctgctaaagtccatctctcagccgtgttattcatttgcctgctggtgtatgagcatgcagaactgatgttatcgctttgcttccatccaacgctctaaactgcttactcggtcgtcgaagctacaaggacgtactaacagagagagaggcacttgtgttacagctaaactagataggttctactgcatctagagtgtttgcgacctcgctgctcctacacccttagctatggatggttggtgaagtcgtcatgtgcacctttaattcaccatgcctcccaatcatatgtgtgtgaagctgtgtgcgacattattcgtgcgaaagcagtagtagcgatcgactctctcagatctcgcgaagtttttcccggttgcttttgtcacttgcgctacccttgttttatctacggttgaagtagcacgtagtacgtgctacacccttgtaaactccactccatataacttccgttgttatttagtatgagaatttgggttaaaaatatgattttggggtttgaatgtccggttttaagatttaggttgctagacagactttcaatcaaaatttggaggtatatatacatatggactttctcctataacgtaaaagaatagaatagacaagtcatctaagcaatatgctggcacgtaaagtttttggagaaaaaacacaagtacatactacctccatcccaaaatgtttgatgccgttgacttttttaaaaatgtttgaccgttcgtcttattcaaaaaatttaagtaattgttaattctttttctatcatttgatttattgttaaatatacttttatgtatacatatagttttacacatatcacaaaagtttttgaataaaacgaacggtcaaacatatttaaaaagttaacggtgtcaaatatttagggaaggagggagtaacaatttagagagtttatatggacttccatatgaagtgagaaaatataataggcaagtcatctgagcaatgatgtactccctccgtttcacaatgtaagtcattctagtatttcccacatttatattgatgttaatgaatctagatattaatacatatatatttatctagattcattaacattgttataaatgtgcaaaatgctagaataacttacattgtgaaatggagaaagtacctatttagttttcgtttgttggtcgtgttagttttgctaattagtaacgtggagctaccgcgttgcctgaatttaaaaggctagtattattactagtaaaatgagttgtaacttgtaagtgcaaaggacgttgaaaagactgctcttattatatattccttgcatacatgtaaaatatcgcaatgattgtcacaattgcttcttactatgaccagcgttctcctcctgctctcatctcaatcagcttgcagccgccgtaattacattttatcaatttcacttattcaaacgctgcgacatgctttacttgctttcatgtgtagcattatatgtgtcgtcaatcttgctttgctagccaaaggcctctacggtgtactatgtttgcttggtaattcggactacattaataagctactgagtttgctaccccaatgaatagcgtcctcaagacatatatggatggatggccaatttgcaatacactacttttcttcctgtggcctccccatcctatggtaggctacactacacgtacgatactcgtgatccactaaatttagtgtagatctcatgggagttctcgattgacaatacggttcgcaacttagtattgcttctctatctcctctccttttatatgccagagagtcggaatgtaaaataaaagctgaaactttaatattattcaatttgtgaaagctgaaaaattacaagacataatacaattagaattagacataatagaattagactcaaccctctccccccccctctcccacgcgcaggtgacacctgggcgaaaccctaccgccggtgctgaccccatgtcaccccctccccctacctcgccgccactggagctcactactggcaaagccgaatggtgagtaggatggcagcggcggggcttctccacgctgttgccccctctcaggcatgggggaggtggctttttttcgcccgtggcgggggtggcagcggcgaggtttccggcttgtcggggacagatccggcaccgccgtcgctggatctggatggagcgtctgtggcggtgttgttggacggtgcggctggcggcggccgctgtggcatcaggcgacggggtcacggcagcgcaaggcgctcgagtggcgacaggcatgcgcggcggtgcgaatattggcacgtgggcggcggagttcaccgtcgcgctcgcgtggcggcgttgcggcgcctgccggtttcggtggtcggcggggtgagtcggccttctagggcgtcggcatctctggtctcctgcctcttcttcatctttggcggttgctgaggccaccccctcaacaacccacttcttattctcttcctcccttcctccttctctttggtctctgtgtcgtctcctagcaaaaggggcgtctgccgtctctctgcgccggtgcccttccccccatcccttcctcactagcatttcttcttagttgctcttctcctcgccccagcgcgcctctctctgcgttggtggtttagtttgaggtggttgctcagttgtttggtgtgtctcgcaaagcccggagatcctcgccggattcatagaagacactgatgtctttgttgcccctgactcagctcttagttccttttcaagccggccaagcctccttcactccttggtgatcctcccttctttttggccgtctgcttccagacctggccgtggagcctttcggtggttgaggtgttctgtttgtctgtgttggaggttcagtttgtctgtagtcagggctctttggccacgccgttgcttcaagtgccctgtgtcggtgcgaacctgttgtagtgccgagtgttgagcgggatgcttgtcctctacgatactagagtctttgtgtttaggctgagtcggagctgctgcatcgggtttagccgatgggccggggcaacgataatactcaacactccggctctggtttcctagaggctctacaccttttgagggagtcttaggcaaaagcctagtctggtctcctaggatcgtcgacatcgacgcctacgggtgccgtttcctcgttgaaggtgttgccttgtggactctctccccttttgcgtgaaaacccagcccagttgggtgggcgttgataacggcttctgtcgttgttcacctccttggaggcttcgccttgaaggttttgctcttctctcgatgtctactgtggtttgtagttttgtcataggctttttgtgtcttctgtgcaaggttttagcggtttccctttagtaaactgtgcagttatatggtttttgggcccggttttcattataaatagggtcaattctcttcttctaatatatccggtagaactcctaccatctactgtttaaaaaaaaaagaatgctgaaaaaacatggttgcagacaatggcggaactagaaattttaagcagcctgagcaaatcaataaaaactctataaaaccactaccgacttatcaaatgtttatatgccgattttactaccaaattgaacacacagcagcttttctaataaaagcatagtttaacatgcatgtaaattttcactagttgaacaacaagatgatttgtaataaaaaaggatgattcatatggctagtactcaactcaatcacttcagccacagtgaagcatgcttgttccacggcttctaattaagagtttagcctgctaactttgtcagaaatcagcaaatctgtagacttgtacacaacgaaatcagtagacttcaatggatcgtgcagacgaaacccgggcaattcccccgcgtgctggtccggcggtgaatccgcgcgccgctggttgtagattccaattatgttgttgagcgaaaatgctataggaacatctgaattacaaagagccattcctcgttcgattttgtgcattacacaccaacatgtcccggtcagctacttaccttgccaactgggctgggctaggcatgtggcttaaatgtggcctggatagtctgggctagacattaggcctcacaaagtctggttcgcgtgctaccgtatctcagctaggacggctacgagtgacatgtttctgtacgtgacgacctcaagccaggggaataagtatttaatctgcaaaacccacttataggtcagacctataagtgagtttcgcggtttattcatttacacccttacctccagccatgctcgctctcccgcatcaggtgtgtgcccggcaatagtcatctctgcctctacaagcagagcctatgtttcttctgccttgttaatgcaccgtgcaaatgtaccaggttctttctgagtaggaaaatcatctgaaatatttctctaacatcgcacagtaatgctaattgatttgtaaattgggatacatatataattggtaatatatgcatcttagcttgcttcatcttggtatgactatttcccatttttgtggcgaagtcttggttgcacatccaactcagatcatcccattcacgatagctggtgaagattcagtggtacctcgtcaagcgacacattttccttctggactaggagcaagctaccactgatgttcttggattgctttccaaagccatctagacactatacattgtttgctccattggttaggcaataggaaaattgaagcggcggctccgttatagatagacccgagaagttatactgcatctagagtatctgaactgcgtgttgataaaaattttactcttgatggatggtagacaaacaatgcacttctttgcttcaccatgcctcccactcctatatgtaggtgctatgaaatagtcttgtaaagcagtagcaactgaatctctagttggtatgtatatctcaagctgaagttctcatgttgctcatctatgtctctgcttttctttcatatgtccattgagtagcatttatgttgtccacaaattatactcaaattgttagttgagtttttgtttgccaaaaaaaaaacgtcaacatagagagattcagtatgtgcatcctgggaaagcttgtggtagcaagttttcgggttaaaaatgctaaaggatttgtgggatgtatttttagtgtttagatggcattcaatatggacgtgctggtgaagcatgcaatttgatgaaagaaaaatgaaaagtatttcaacatggcatgagcactggacaagatatatgggaagcaaattcctaggctagtgctgggcctctaaatgtcatgaattttttaactcttttccctattatgaaatttggagcagcagttcttaaattatattttgcaaaataaaagattatttattcattagaattagttttgttgggaagaaccatggacgaacactttgggcgcactctgtagctgttccgacaaaattcagagcaaaggaagaaacaaaggacttgggggggatttggggcagttttctgtctcttttactttgaagacaaacaatgtaactcaactttacatgttgtagcttctgatacaaatagaacaattagaaactcaatgttcgtgccatctaacaacccatgaagttccattaaaaaccctaagacacatgcctaaacaccgttatactgagccagtagtagtttcatcaaattcccaagctctagctgctctactcttgtctccgcccttggatacaagtgtccctactgtattcttgatgtcttccaagcctaaaggtatttgtgggtgacgaggagatcattgatcaatgctccccatatgtgttttcctaattacctgatagttcacgtacacctacttcttgcttgccttttcaaagatttgttctgcgttctctgttagaatttgatcaggatgatatatatatatatatatatataagaatttatcgaagcaataacattaaatgggtttaaagcattatctttttgatgaggtggatggaagagatgagaaatagaaaaaagctttaaagttaaacactaacacagtctgaacccaaaatgggtacctggaagaagatctcaacaatttaagcccaaaaaattccagttgggtgagcctaggagtggctcagttatgacccatacaagatggggcgtatagaaatatgcaatgcatctacgcacatgtaggatttccatgcggcccatcttggttgggcccaaattagatttcaaaggacatgtcattgtatcacccatataactgggctgggcctttttgcaagccaccggatgttgggtttggtggagtcgttttcattactaaacaacaagtgtaaccgctggccggcttcctcttgtctctcctcatactacgtgctgacctcacaatcgaccaatcgctagatccaatgtttatatttcatcttatgtggaaactaatacacaattgctacgattttgaagctgggaatggtcaaatagatttaccatcacctctaatttcaaagtctactcacatttggtttgaaattggcgcacttcacaccacgcaaggtagtgctgaacttctgcttggtagtgaccatgatatgctaagggcatctacaatcaaaaccatactagagtgccctcactaactgagggcactcccaggggcacacatctctcaatggaggctacgcctaggtggggttttcaaaatttgaagcaactcggtgaagatacacaaacccacaatgggtgtcccaacccaaaaagcccacagtgggtatttttctgtactacccctctcttctccctctctacgacaccctcctcttttttttcccagcgacggtctcctccctcactctcatcgccactctctccctctctctctctctccctccacacggcgcctctctctcccgccgccaatctctccctgtcttccccgccgcttgtcgccatccacctcgtcggcaccggatccgctctgccacgccctttctttgcctccgcatggcgggacgcagtggccatggcgagcagtggtcggggcgtggtggtggacggcaagcggcgcgcgaaggccgcgcagcattgaggaggagatggtggcgacgacgagcgcggcaccagcggaggatgcgttgtacttgggcaatgttggctgtagccaagatgccgccgctctctccctccctctcattggtaaaacattagatctataaaaagtaaaacattataatgaaacatcttttttaaaaaaaggggagggagaagtgttgggcccaacaggtacgcacgtgaggggagaggcgcgcgggggagcgcccgatccggctccccctgcgccgatcgcccgagcgtgagtattttcgttttttccgcttcagtcattgctggtagtccgattcatgcgaaccatcctattgacaaaggcagagtatgtctcctcgcatcgcgtacgtgcgctttgcttgtgccatttcgctgtttccaagttccaatcaggttttcatcccatgacaattttcatataatttcctttcatggtgaaacaactgcttttcatcgtgaaacaattttcatgatgagggagcacaacacagtaaagtagcattccaagcgaacaatgtgactctccacacggttagtttattttaccgaactgaccaatttaaaaaaaacaaattaatttattggtcgtagactttcaattctttttcttccaaccataggagctatgatattgttatataatttttttcttccaaccgtagccgcttatgatgttaatgcttcgtccaatagaatacatcgaagcgttcttggacacccagatacgtaaagcttaatttcgttttatttcctatatatacctctcaatcccatgtatgcaacaacatgtatattaagtgttatagatttcaaataaatgagtcatctttcgattttttttattttttagactttttttaattttattaataaatctttccaaataaatattttcaaaaactgaatcttttagccatgctagccgagaggcaagaggctggtgtggcagaacaacactgccacgacatctgcacgtggcgtaacaaagttatttggccacgctaggcgggctagcgcggccaaaagctttagatttggaaatacgttttggaaagttctattaataaaattagaaaataaaaaagtctaaaagataaaaaaaattctcatctttgctgctagggtgtaaacatgaaggatagtaggataccagaagtctaagtaacttatatatttcacattagtgcatatatagtgtagtatggcaagtacttagtgatgtcagttttaagatggctttcaatatatgcatgtgttggagtctggcgaagcatgcaactatattagattattagaaaatgaaaatcaacaagactagctatatcccagcattatgctccataagtatgcaatatagcccagacttaatagaatatacctcatcacttgaaaacttagaagtttcagcccaaaagagctgtcgccaactacccaatgtttcagttgggtccacacggcgccattgtggggtatgtccgtcccattttggtcggaccacgatatcatttttgtttgtgtttctaacctccggatcgacaaatactagctagctatagacaagtaaatgtgttcatgttcagtagaaaaactgagctaacagggcttggtacgtaaggattttagacgacgcttcaaaaggatgatgctaccatatattgatcctgaaggtgtacttgatagtttcagaatttcttggccaacaacggcaggcctttgctgcttcatcctgatctgaccagcttcagtgccgccatttctcgtctggacaactagagcatctccactacattgcttcatcggtttgttaaactacaccaacagttacagtgtgtggaagatcaaccagccgagagctagactctaatgtctattatgatttctatacctcaatgctgccggagaaaattggtaatgtggctggctgaccaattcacgatatgcttcgtttcttccttttgactcccaatcctatttttgcgtaggctacgtacactgcacaaatacacttgtgatgcattgaacctttcatgggtatgtaagatatgacaaaggatttctccattgacgatggttactcttctctttgttctccttttatcggttaggaagcaacatgaacaattaatgtactctcttcgtaccaaaataagttaatctaatattgaatatgctagtactgcaaatctgaacaataggttaactcattttgaaatggaggatgtagaaataatgaaggatcgtacatcctgataaattccataatatgttgttcaatttgggtcaactgaagaagctcacgcttgcaagtagttgaaagaaaaatactactatatatactaggttatgtagtcgtcgcttgttctctatgctgctccaatcctaaccctggccgagaacaggcgatggcgacgacggtggcgggtgcgagctcgtgagtggatatgtcggcggcgaggctaggaacggcgagtcgcagcggcaaaacaagcaacagctcatgagcgagcgagcgagcgacggcgatggcggggcacaaggtggcggagctgtgagcaatgacaatggcagggcatgagacggtctttttcaataaaaaattagaggtatatatggaatttttcttataaagtactccctccgttcctaaatatttgacgccgttgattttttttaacatgtttgaccgttcatcttattcgaaaaatttaagtaattattaattattttcctatcatttgatttattgttaaatatatttttatgttttacatattttacaaaagtttttgaataaaacgaatggacaatatgactctccacacgcttatttcactgaaccgaccaattttggaaaaacaaattattttatcggtccaacactttcaatttctttttcttccaaccgtaggtaatctgatcttgttatataattgttttccaaccatagccactgttagagtttgtgtcgaatatgtgtacgtagtcggttacagtttaggacttggagttgtaataggtattaggactagagtatgagtcggactctatcctaggttctctcataaatagaggggcgtgcctgttgtaaccgcatagcgacttagcatagcgagagggagcggctgccggcatcgaccggccatgagtcgttgtaactctgatacgctgtatatgctggatcggggaggagagcccgtaatcagtgcctcggagatgtaggctacggctgaactccgttaccaaatattgtgtctcggtgtcgtcattgttttggatctccaatggcgttttcttccgcgttttagctaccgatgttgatttcagggctggttttataacaagtggtatcagagcctgcagaaggtccatggtagaggcgcaatggaggtgctccacaccgcatagcctgctgtaatgcccagggaggggcattggtgcaaggtggagcacggcggcgatcaatggagtcttgatcggtggatcgaacacttctggcggcggccggaaccgtcgatggctgctttcaacagggagatgactagacgtggtgctcgggttgatggcggcggaagcgattggcgatccaatcggtgggtcggacacttcgggcgggtggctcggactttccggtgagctactctcgacagggagacgtgcggccgcatgctcgggttgattgaagctggaggcgatcggcgttctcgatcggtggattcgaacactctgggcggggtggcccgggcctttcgataagctacgttcgacagggagacggctagacgtagcgctcggatcgttcggtggctgggaagacggcatgcgacttatcggcttcggctcgcgattagattgatggcgttcaatcaaaagtcggagcgtgtggatcctataggctgttttggaggtgttgacgaggtatttgcgtgacagactgctacggagaaagcgcacatatgaaaagcgacggaatcaagcagaagggcagtcaatttcagaccgtcaatgcgctgatcaattgtgttagcacagcaataagcattggttgcaactgaccggcggtattcgtcactggcgaggttcagcgggaggctaggtggctacgctagaggtcgtacgggtgcgtggaggctgaggaggtcacggagatggcggtgtgcacgtgttggtgttgaagccgggaccatggaacgtggccagagcctgagtagcaggaagtcggattgcacaggactcgatctggagaggttgtgacatggaaggagtcggatatgtttccaactcggatgcatagcacaatagagaaacagattgagggagagacctagtcaagcacggaaggggaatcggacgaggattacgatctgtccatgaatgggactcgatttttcccaaataaaagcagcggaggaccacgggattgcaacaacgcaatcgaaacaaaccacaaggcaagggcgagatcttacctctgatttcgtgggcagcgtggtttggggcggcgagttcacgggcggctggaggcgtcattgcaggcggcgtgcagcggcgtggtgctcggcgcggcgttcgtcgtagctcgggcaggagcttgcggcggcggcggcggttcccggcgaggaaccggcgccggacttcgacggcgggtgctcccaggtggcaggcggcggcttcccaaggcaggcgacgcggcggctcctcgcgaagtcggcgcaggtgacggcggcaggaggtggcggcgcccaggcggtttccgaggcggggcggcgcggtggtcccttgcggggccggcggcacagaacggtggcgtgaggagcaggaggcggcggcgcatcgggagaacgcgtgcgcaggaggaaggggagcgagaaaaggccgaaggaaggagaggaatcgatctgattcctttgaccgctcggtttgattggttttttgaccgaaaaaaaaaccgaaccggttttttggagaaaaagaaaaggggttggttttgtccgactggtgactgtgcaagtttagtcggtgggtcaattaatcagggcagatcaatttaacagggcaacagctgttgagttgattatcgtcgatggcggcgatggtggtttccaaatttgaggtggtgaagttcgatggcaccgggaatttcattctctggcagatgaggctgaaggatctattggctcaacaagggatatccaaggctcttgaggagacgatgccggaaaagatggatgctggcaagtgggaggagatgaaggcgcaggcagctgcaacaatacgcttgagtctctcggattctgtcatgtacccggtcatggatgaaaaaacgccgaaggaaatttgggacaagttggcaagcctgtatatgtccaagtcgctgacgagtaagttgtatctcaaacaacagctgtatggtttgcagatgcaagaggagtcagatcttaggaagcacgtggacgtcttcaatcagttggttgtggatctaagtaagttagatgtgaaacttgatgatgaagacatggccataattcttctgtgctcgcttccaccgtcatatgaacatgtggtgactaccctgatgcacggcaaggatactgtcaaaactgaggagaaaatttcatcgttgcttgcacgagacttgagaagatcaaacaaaaacgaggcaatggaggcttctcaggctgagagtttgctggtcaaggcaaagcatgatcatgaagcgggggtgtcgaagagcaaggataagggggcacggtgctataagtgtcatgagtttggacatataaggaggaattgcccgttactgaagaagaggaaaggtggcattgcaagtttagcagctcgtggtgatgattcagatagcagcagtcatgagactctcacagtgtctaatgagaagtctggagaagcgtggatgttggactcagctagttcctatcacgtgacatcgaagcgggagtggttctcttcatacaaatctggtgattttggtgttgtttacttgggcgatgacacgagttatcgtgttgttggagtgggtgatgtcaagttcgagatgtatgatggaaacgaggtgctactttcagatgtgagacacatgccgggactaaggaagagtttgatttcgcttgggagcctacatgagacaagttggttgtatcaggtggattttgataggaagaccatgaatatcatgaaggacggcaagactgttatgactggtgagaggacaagctcatgtttgtacaagttacaaggaagtgctgttgcaggtggagtcatggaagataggcatgctggtgttgctgtgcacgatcctgaaggcggtgagcctggcgtaggctcgtcgggtggctcggcgtgaactgtggcagaaccaactcaagtcctggtacacggaggttcgagcaagtaacaaattcaggttggcgtggcatattcgtcaaggtggagtttgttagagtttgtgtcgaatatgtgtacgtagtcggttacagtttaggacttggagttataatgggtattaggactagagtatgagtcggactctatcctaggttctctcataaatagaggggcgtgcctgttgtaaccgcatggcgacttagcatagcaagagggagcggctgccggcatcgaccggccgtgagtcgttgtaactctgatatgctgtatatgctggatcggggaggagcgcccgtaatcagtgccccggagatgtaggctacggctgaactccgttaccaaatatcgtgtctcggtgtcgtcatcgttttagatctcctatggcgttttcttccgcgttttagctaccgatgtcaatttcggggctggttttataacatccgcttatgatgttaatatgcttcgtcgaattgaatgcatcaaagcgttcttggacattcagatacctaaagctcccgttttatttcctatacctctcaatcccttgtatgcaacaacatgtatttgtatattatgtgatgggcctcttgcatttgcatcatggaaaaccaaaatgtgttataatctcctgcttaattctctcggttctgttaagaatagcataatggtagaatttcgcttataaatatctgtcgccttcagaagccactgcttcctctccttccaaatataaatcattttggcgtcaaaacactacctatataagtcatctgagaacaacttttctcccctttttttctctagctatatattcttgagaggtttaactgtatctgcatagtttgcatcctcagcgctgatgcttcaacaaacatggacggtcaaaacacaacgcactcctttgcttcaccacgtctcccaatcctatatatgttacgaagtagtactctcttcgtcccaatcctagatcttcgaatagctattatatatgctactatgctttttcacacttgacttttatatggaacgtattttgttagttatattgtcttgcgattctcatttctcagctagccctagctagtcttccactaattagccatggcagcagcgcccatctgcatctctagctagctaatgtatctcagtccggtaagtcgattaccaactattgtcaaggagtaggctatgactacagttcttgggttgctatctacactattaatttgtaccgtgaattaagagcaggaagcagttgtgttacaaacagtggaggttttgtagcatcaggattccataagcttattttcaggttgtgatatgacataacttgctgtgctcccttgattcgcaacgcctcagaatccaacatatatatgtagccatcttgcatgcttgcgctcaaagcacttactctctcactctggtatctagatttcgtggagtggttatggattcccctgttttgaccttgctactctctccgctgttgtattttatatcttacgaagtagaaaatataaagcataaatgatgtactataagtacacccgtatataaagtccatgacttcgatgttactcaatatggacacactactgagaaaaccctttctataggtggctaaaacgcatttacagagatgggtccactgattgccgcttaaaaggcatgtgaagctaaggtatttgcataggcgggtaaagcaccgtctttaaaaaggatcatcgcaggcggtcatcttaaggcggtcctctatgaaaatgaattttacaggcggtgatctgcgtaattaagatgacctcacaaccccgcctgtgtggtagtgcatttcacaggtggccgccttaagtcagacgcctccggaaacctttccaagattttgtaaagtgggatgtatataccattggctctagcttcggaatcaagtaataatatttacaagttaacttgcttcacctaggcatgatcactgtatattttctgttgaattatagaactgaatattgacacctgtaacgatgctagaggtggctgctgcctgccactgtgttttaacaattactgattctctgaaacctagaaagttagtggacggagactcattgcatagcaaaaccccgagtccccgaccatccttgtatgaccataggtgatcgtcgcaaggagcttgagcatgatttctacaccaggcgatccatttgcctgctggtcttggaatatgatactactgatgtttttacattacttttcctaggtctctgcattgttttcttagttcatcagcgaaaagtgaaagaggtagcagtgttgcagataaaccggagaggttttagcccatcagtagattgctaccaccgtgctgatatttccaaatttgtggatggctggccaactaaaatcgcactccattgcttcaccatgcctcccaattctacgtgtgtggctaactaaacacgttcaaagcaaataaaaaaaattctcactggaatgtggagttcatgtagaagttcccagttgttctcccttctccacactcccgtttataactactgccatacagtgataaagcaatgaataaatgcacacccttattcaatcagtttattctgaccaagaaaatggctaagagtacttcggagcaaaacgttatatacaatcaagtggtccttattctaatttcctttgctgcaattatgaagtttgggccaacaatcttagaccttattggcttattctggtaaatggttattgattcattagtttgttaagtgtgattaactaagagtaaaataacacatttccaaattgcctgatggcctaaatttagtttcatagttgcggtactccatggaggatgactgttggggcaaggagagcgacattgcaccattcactccctggtagcttcggaggagatagggccccgtcgggaggcccgccaccagtgccatatggagcccgtctccgcagggagaacccaatccgaaggcctaggaagccagctgagcccgaagagggcagttcgctcccaggagttcggagtcaaccggaaggcccgggggatcccaaagcccagtcaagggcctctgaaggccctagagctggttcaagggatctggaggcccatgagccggctcaaaggctccagagctcttgccatggctccaaagccgaagcctacagaggacaccgggaataactatggggcactataaaagcgcactactcttcctccaaccatcaccgtcgtcacgtcacgactggcgatgtgaaagccgatgctagtcattacctggagcccgctattacccaagtaaacactagcatcatgatggcgccataccgccctccttaatgggcgccactgactcttggtctggtgaatgggctcccgaaccgttggcgggcccacctgtcagccaccccggtatagtagagagataggggtagggttgtaatttcctttacatgtaactcagtataaatatataaatgctaccctctgaagagggagagagcaatacactggttgaacactcatgagttctgttccagcaatgactctgtgcctttgctcaccgccgccactgtgtttttcattcttccttgaccctatatgctgctgttagacaattattcctgatcatgaagatctgttggatctattactcgcacattaaggatgctagctggatgcgaatgctacgattttgcaaactgaaaatatgctatgatcttcagttgcagcatctattcatgactgtattgtctggctatgtcatcgagcatcgactaccagtacgtattttgtttgataattaattaagcttagatttggcaactctgaggatgttggaaagcttaatgtcgttctgtttcaaattagtctttctatgaacccattggatggatatgttgttggtgcaatgaaccctaatcctgacaatcccttcatcacactgttggtgtggaaactttagctgggagattcattttcctgctggtctgtgagctgtgatgtttcttcattgctccgtctggaccccctccatcctgtttgctcgcggtggttcttgtcacagttgtagagacagtgtagtgtgtgttgctgtttgaactgatgtttctctgcatcaggagtatgatatatatctatcctctcaatgcggcacttcaacaaccatacatggttagccaactcactgttagctacactaactagagaactagatggaaatgaataatcgctcgagaacacgagatagtttcaccaatccgacaggatcggcggcgccactgtgccttctttttcaagcaaaacaaaatcttacaaagaagttaggtccattccggcccaaacactctaggattacagttactccttcttactggtctactccttaaagtctgtccaacctcctcctgatgatcagagttctgtagcttatctggcacgcccgcaaagctgagactcacaaagcactgattttgttcaccaggcctcctaatcctatgtgcgtgattgtgtgctataaatctctcgtctcatggacaacttcatggttgctaacctttccctcaatttccgctctcgttttatgtgctttcaaaagctcaaagtaaaatctatatagaatgataaatgatactatatcactactatacccccttataaactccctagcttaaatattattcagtctatgcatgacaacataaagcttgcaacctagcaacgggcaccctcggccatggccaggggcctagcattgaaagcccattttccatgataaattctggtattggctttaggctatgtttgccccaagtatatctatgttttagagactagcacaaaatttgaagagcaaattaaatgaaaagcaatatgttttgacatgatattcaatatagctatgtgtactcatacatgattggacatgtcttctgctagcactcgaaggaagatcagacctcagagctcaatgctcaacctcagagctataccgtttggttgggatagaggttaattatgacatacctacactcctacagcctgttttggttgagccactaacatggagcaactgccccatgagatcctcagatcctgtcccagcgcaaccacgatcatatgcaactccacctgccgccgtcttgttcatcgtctcgataagccacaggggcaatttcgaaacaagggttttagccagtgggaccgaaagaaccaaaattcggtaatttcagaatttttggccaattttttttgaatttttaacatattttgactgaatttgaacaaattgtgaccaaatttacaaatatttgacaaaaacgtgaaaatttcggggagatttgtgcttgccggtggggccgaaattttaaaccatgatcagccagtagtagctagatgccggcacactgccccactgattatacgggtgtttatgacctcaagatctactaattgcatagcagctagctctgcaaattgaagtggtatagtactataatactattcagcagtaaaagtgaggttatggacatgccttggtaaggattctggatgcctgaaaaggctgctattgcagtagtttattcatgtatagttaggtttccactgttctattctatagttgcttgactaactacgctggcatgcctctttcattgactagaacagtaggcacaatcactttttaccgcgtcaagatgatttctcgtccggtgacttgttttgccttcttgtctgcatagctgatatgatgttcttgcatctgcacagacagaagctgttgtgtgttgcagtttgttaaaccggagaggttacactgcatcacgattgctcctgaacaccgtgacttgtatgaacttggatgattggccaactcgtaatatgcttattttcttccttttgtctcccaatcctatatgtgtgtatgctacagtaatgtgtacacctgtgaagcacagaagctcgcatacaggtatcggcctcatagggaagttcttgactgacaacggtctgaacgatctcaccctgaccatctacggctttatgcgataggtggtgtatggagcttcagcatgtcttctggtctagtaatgtggtgatcacaacgttgttgttgcagtgcttgtcccagtcctctacattgtttgcttggcgattcatcagaacacatagaaaaacgtaaagcagagaggttttcgtgcatctgtggttgacttcgatgctgatacttaaacacaaatagatggttggccaactcataatgcacacatatgcttcaccatgcctctgaaccctaacatggctatgctacctgcgaagcactgaatcactcagtggtatgtatatctcatagagaagttttatctctggttgcttggctttctctccgactcttgttttatctactgtcgaagaggcgaacagttaagtatttgttggcatttctcattttacatcactaataaaactttttaggcccatgttggatgagccccaacaagtttactgctagctgatatggtttggaagggcgggcaagattc

SEQ ID NO: 48804 - DNA, 11513 bp, Oryza sativa
  unsure (1)..(11513): unsure at all n locations
ggacgatttattcagcaagacagccacccgatgtcaggtttcagagtttgatttgttagagcaaggtcaataatatagcctactgtcagctcctaaaaatagccatgtcatctatagtaaacagtgtagctaatgtgtacaatagaaatactatagcactaatattttttatcttagtggaccctccatcttctctaatctccctctttctccctcccctttccttccttttagtgggcctgttttcttggagcgcgtggtagcccggcgcttatttagtcgcttgctctcgctctctcttccgttttctcctcgagcaaatcgtccgagccgacgtggagattttatcgccggttctggagccctattgtatttgctcttacagaatgtcaagtttgacccaaccacatttatcgttacgcctcaatacctaccatgttgactttgaaatcaatcgactaacgcctagctggccaacgtttgtcttcttcttatgtagtactatctcccactgccccataaagatttcattttatttttcaccatttggagacaaattagtagtggcgagatacgactatggtgacggtcaacaactctaatttcaaagtttactgatcatatgcatgggttgccggctagtcatatactgtatcgtaatatgttcaggacaatacatacagggccacacatacacacacaaacagtatacataaaaaattaattgtttgatggtagtttaaattcagcaaaatatatatcaatatacgtcattttgtccatttgattattgaacagctcaattttttttagtgaactttggtgtatatgtatattatgtgctgggcctcttgcttttgcatcatggaaaaccaaaatgtgctatagatttcctgcttctctcggttctgttaagaatagcataatggtagaatttctcttctaaactcactcaggttcaatttatatacgaggctgttgaatatctgatgcttcagaagccgctgcttcctctccttccaaatataaatcattttggctacaaaactctacctatataagtcatctgagaacaacttttctccccttcttttctctagctgtatattcttcagaggtttaactgcatagttggcatcctcagtgctgatgcttcaacaaacatggacagttgaaccacaacgcacacctccgcttcaccacgcctcccaatcctatatatgttaaaaagtacatcgagataccggtacctgagggtactaaatcgtttccgatcgttggatctaacagtacccatcctgcccagctagattcaacgaccggaaacaatttggtaccgtgaggtaccagcggtacctcgaggtactttttgctcgaccggagcaaatctcaaatatcaaatacaaagcataaatgatgtactataagtacacccatatataaagtccataacttcgatgctattcaatatgaacacactactgcgaaaccgttttctataggcagataaaaagcatttacagagacgtgtccattgattgccgcttaaaaggcatgtgaagctaaggtatttgcacaggcgggtaaagcaccgtctttaaaaaggatcatcacatgtggtcgcttaagacggtcctctatgaaaatgaattttataggcggtggccgagacctcacaaccccgcatgtgtagtagtgcttttcacaggtggccgccttaagtcagatgcctccggaaacctttcagagattttgcaaagtgggaagtatataccattggctggctgctgcctgccactatgtgttaacaattactgattctctgaaacctagaaagttagtggacggagactcattgcacagcaaaaccccgagtccccgaccatccttgtatgaccataggggaccatcgcgaggagcttgagcatgatttctacaccaggcgatccatttgcctgctggtcttggaacatggtaccactgatgttcttacattacttttcccaggtctctgcattgttttctcggttcatcagcgaaaagtgaaagaggtagcaatgttacagataaaccggagaggttttagcccatcagtaggttgctacctccgtgctgatattgcaaaatttgtggatggatggccagctaaaaccacactccattgcttcaccatgcctctcaattctacgtatgtggctaactaagcacattcgaagcaaataaaatctcactggaatgtggaggtcatggagaagttgacagttgctcatcccttgtccacactttcacttataactactgccatgcagtgataaagcaatgaataattgtgcaccgttataaagtccataatttggaatttattcaatcagtgtatgctgaccaagaattaatggttaagagtagttgggagaaaaaacgttatatacaaggaagtggtccttattctaatttcctttgttacaattatgaagtttgggccaacaatcttagaccttaaatattctcgtaaatggttattgatttgttgcattggatctattacccatacaacgatgctagcagctggatgccaatgctatgattgatttcgcaaaccaaaatatgctatgatcttcagttgcaacatctacttatgactgtattaatgtctggctatgccatcgagcctccactacgagtattttgtttgataattaattaaactcagtttggacgcctctaaggttgttggaagcttaatgtcgttgtgtttcacaattagagtttttatggacccattggatgcgtggagattgttggtggagactcgttgtgcagtgaaccctgatcctgacaatcctatcccttcatcacacggttaggtgtcgaaacttcagctgggagactcatattcttgcttgtctgcgagctgatgtttctgcattgctcccaccggacacctccatcctgttttcatggtggttcagggcacagtttcagagacagtagtgtggctgtttgaaccgtagatgttcttgagtttttctgcatcaggagtatgatatctcaatgcgtgacttcaacaatcacagatcattagccaactcacaaaacattgattttcttcaccatgcctcctaatcctatacatctacgtgattttgtgctatatatccatgtgtgaatcaaatctctcatctcatggacgacttcatggttgctttaggagaatacttatgctcgggcctccgatcaaagaagaaaaatcggtcgctcactgccgcatgcacggtatggtggctgtatcaagctggcatctttctccattcctccttctcactgcaaaagatttttctcctaaacgatttaactattttacgatccgattacaccatgatatttattgtaactaaatatttacaccatgatatcgcacgattatattttgatgaaagaaaaatatatgtttcaaacagttaaaactatatatttcatacgagatagttacatgtttcaatttatattccacttcgtttcataaaatttaagcaactacatgccactactttctttcatgccatacactacttgctctctctccacttcgtccacatatgcatgcacttagcaatctatagaataattgttctcataaactacttatccgatcaacgatctgatcatatcgttgtattcattctaataaaatttttagaataagatgtcgtatgattatattttgataaaagaaaagcatatgtttgagactattaaaagtcaatgtttcataagtaatggcgatatgtgtcaacttgtgtcttcactgtgtttcacaaattttttaatgtttcaatcactgatcttcttttgtttcaccatgtagaacttaatgtctcacatatgatcaattgaaacatttgacctcccgattcttttttataaagtcggccatccgatttgcagattccgcttgtttttccctcaatttccacgcgctcttgttttatgtgcattcaaaggctcaaagtaaaattcatagaacgataaatgatataacatcgtaccctcttataaacttcgtaactttaatattattcagtctatgcatgctaacacaaagcttgcaacctagccccgggcatccttggtcatggccatgggcctgggattgaaagccaattgtccatgataaattttctacgtggtttgctgatctcataaaagaaacaccataggatggcccggtcttgggtctgcccgaagtatatatctatgtttttaaataacattcaatatccacgtgctagctagggaagcacaacatttgaagagcaaactgaaaggcaatatgttttgacatgatattcaataaatatgtgtgctcatacatgattggacagaccttctgctagcgctcgaaggaagatcacacctcagaggtcaatttgaacaaattgtgaccaaacatacaaatatttgacaaaaacctaaaaattttggggacatttctacaagccagtgtgggccgagattaccaaaatttcgaaccgattttttagaccatgatcagccagtagtagctagacgtcgacacactgccccatggattacacgggtgtttatgacctcgagatctactaattgtagaatcaagtgatgatttaattgtggtgataaacaattgtcaaaggtgagtgttttgtgaaaatatggtgaatagtgtttttggttgtcggctctgtgtgggcggtcagaccgggcaggtgccgtcggtcagaccagtggtgttggagcggtctgactgagttgcttgacggtcagatcggcggattccaggttggagttggtttcgggttgttttcgtgagatttatagattgcttcatggatatgacttctagatggtctctattcgtatgtaatactgttgtgtgctgatatgagtcaagttggagcgaacttgtacttggatatggagtttctttgttgttcatgtgcaggtgttgcttgaagccatgggagtatagccggtgatggatcgggactaggcttgggggaagttgaggtccagatggtcaaggatatcatgcgggatggataggtagagaataatgcacgtggtggtgaaggtttccatatggaatacacatggtgttgtgtgcgcatggaaagcgaagtcaaatttggattggagttcaagtctggaaagtttggagtttgttttttgtacgggaaggtttcctaggggattaggactttttgtatgagttggatttgtggctaggggcaaccatgttatgggtataaatagagagggagcatgtggtctccctgtatcggatttagagagagttgagttaagagaaaagttagtgtttcgagtttagtcgagatgttggtaaggagtgttgttggtgcactttgtaaaacacattttgatgccataaagttgttataatttcaagagtttcattaattcctgtttttttagatcctgacggtttaaccggaagcgagttggcggtcacatcggcggcagggaggtggtccaaccagtgacaagacggtggtcagaccgcggtgtgcaggcagtccaactagtggcggcactgcggttagaccggagttgatctaacggtcagattggctacgtcgagatctccatcgacttcaagggtaactttgaattccgctaaaagttttgatttttggtagtacaatcattcacccctcctctagttggcttggtttttactattcgatcctacactaattgcatagcagctagcactgcaaatcgaaatggtatcatactataattttcagcagtaaaagtgaggttatggacatggcttggtaaggattctggatgcctgaaaaggctgctattactgtagtttattcatgtataggtaggcttccacagttctatagttgattcaccaactatggctggcccatctcttccattcactagaacagcaggcacaatcacttgttaccatgtcaagatgatttctcgtgtggtgacttattttgccttctggactgcaaagctgttgtgttgcagttaattaagccagagaggttacactgcatcacgactgctcctgaacaccatgactcgtatgaacttggatgatttgccaattcgtaatatgctcattttcttccttttgtctcccaatcctatttgtgtagacaacaggaacttgtacataaagcacagaagctctcgtatgggtatgtaggcctcatatatagggaagttcttgattgacaacggtctgaattcatgcgataggtggtgtatggagcttcagcgtgccttctggtctaggaacgtggtgatcacaacgttgttgttgcagtgcttgtcccagccctctacattgtttgcttggcaattcatccgagcaagctgaaaaatgtaaaccagagaggtatttttgcatctgtggtttgcgacttcaaagctgatacttcaacacaaataaatggttgaccaactcataatgcacacatttgcttcaccatgcctcccaatcctaacatggctatgctacataagaagcactaaatcactacttagtggtacgtatatctcatagagaagttttatctccggttacttggctttgtctcccgtctcgttttatctactgtcaaagaggcgaacaattaagtattggttggcatttctcattttacatacaaataaaactttttaggcccatgttggaggagccccaacaggttaattttggaggactggctgatatatatggttgggaagggtcaagatttcggacgattcgttcagccaaatagccacccaatgtcaggtttcagagtttgttttgttaccgaatgtcaagtgtgacccaaccacattcctcgtcgttacgcctagatacctaccgtgttgactttgaaatcgatcgactaataatgcctacctggccaacgtttatcttcttcctatgccgtactagctcccactgtccccataaagatttcattttatttttcgccattctaagacaaattagtagtggcaagatacgactatggtgacggtcaacagctctaatttcaaagtttactgatcatatgcacgtgttgccggctagttaatatactgtcttgtaatatgttcaggacaatacatacagggccacacacacacacaaatagtacacacatgaaaaattaattgtttgatggtagtttaaattcagaaaatatagatcaatatacgtcattttgtccagttgattattgaacagctcaattatttttagtgaaccttattaattacttgaaaccttattgaccagtttgctcacatcgctgcggcccgcatgggtcatctacagaaagctgtcgatagcaagaaaatcaattgggaccaaaacaaggatgtttaattaactggaggctttgaatggctttgttaaagttcttctcacacttgatttttctatgaatccatttgataagttatatgtatagtctcgcgactctcactgctcagctaaccctgatttttcattagctatggcagccggaaccatttgcatctctagcttggttacaaactggtcaatgtgtgctggcttgtcgaaaatttggagcaagaggcagacaggcagttgtgttacagtgcaaacatgtggctttatagcatcgatcggactctgcaagctcaatgtggatacgtcctcaggtcttgattgctagccaactcgatgtgtgctcctgtgattcacgatgcctcacaatcctgcgtatgtcgctaaaccacatgcttgggaagcgaactaaagttctcattggtatgtagatttcatggagaggttgtgggttcccttatgcttgtatacatcttgcttctctctctgctactctttcgactgaaggggaagaaaatacaaggaaaaaataattcactactgcacacccttataaagcatagaaaatccaaaaaataccatcgataaacattcaaatccaagaaatattatgggcgagtgcgagttccatatcaagcaagcgatttatccttgaaatatcatcaccattatctagggttccgtgtatcccacaccgttaaatatattattcatcatatagcacttaacagaatcagtcgcttgtacgatgacattttatggaactccatgaaatcgtatttgtagatatcataattgtgcggttgttaatggcatttcttgaattttctctaactttaatgccattccatttgtacatgttgtaattgaagcatgcgggatccacggagttgggagaaatataaaatacaagaagttgaaatacaagaccaaacctcatctaattttattttgctatatctttaaaatttgagccaaatactttttgagcaaaaatgttcgattccctgacttcagtttgccccaacgtgctctgtaccaactgagaaagcagctagcgttggttgtatagcaaatatgtttaacctttgagtcaaccaaaaaattcataaagaatgtaatgtagttatttattgaaccgacggttaaaccggtgaacaagcggttggaccagggagcctttgaacaggtagactcactgtttcgatcaccggtctgaatttaacaactatgtgtgtgtgtgcacttctgtgtgttcatctccagagatctattgtgtgtgtccactacaatttgttgctcgtgcgtgtgtgtcatcgcttgagtttgctgctccgtgagttcttcgcatccttgggcaaagctgacattactctcacatcatgttcttgtctgagactctgaatactactgggatctagaagccattgcgtttacaggaattcagttattcataagccatttcattcagtttacaggtattagaaagattttgcattccattcattgttcaaaacatttctcccagctgcttgcaagatgaatttacaacttactagttgtgtgcccgtgcgttgcaacaggaatcaaaacaaatcatgttcaaagctagatattcaccccgccgatagccctttaatgattcatcaaagccaatctgtgtaaagctcgccacatattgattatccgatcaagtaatttgcagtccaaagtaaatcaagtattgccttaactattctcggtttataaagctcccctagaagttcatatcttcacatctgtgcatgccttcagaagtcaaaacacaagctggcaaagatcttccgagcacacactgtccccatacttcgctccttgacttgcctggtggtgaacattctacctatgagctgtaaaatgtttacgaaggtgaaatacatcatatagagaacagaaaggatgaatggttcaacatgttgtcaattaaaaaattggaaagaattagaacgctaacctttttgttttcaaaaagaacaaattattccttgagcttaggccttcacttacaggtatttctcatttcacaattgaaggcagcaaaatgaatcactgaaacatatgaaaaaaaaaaactgcttactcacatctacggaaacaaaattgagagcacttatttatttaatatatgtatgtactccaaccagatcactattgcgcagagcaaaatatgtagaacatcacataaataaatctaagccaagatgctgcaaaacagtaccaatccgtccttaaaaatgttagaattagaattgaacaaagaccctagaaacaaatcgagggtgtcaccagacaagctataagggaataatctcactcttctgattttgcatataaatattaagaaatgagatgtaatcatgtaaataatgaaaatcacttccattttggagtgaggacgaagagattggtatccgaatagaaccagaaattccaaagcaaaagttgattgtccaacttcaggtttcgaacaaaaaaggaattcttaaattatacagatatatgatatgctccctccattccaaaatataagaattcacactttgtaccacaatagaagcatctgcactgattcccatcacttcaattattccagagccaatcagatgctcaggaaaggaatttaagcaattcaaaattcaaaaattgataactgaattagtaactaaaataaaatcttttgagaaatccctgtatttagaacggagggagcatatcatcaattcgtcgatccatcattccaacaaatgaaaactaagaaaacgctaattagtaaattcatgggagtggcagcaggtaagtttggcatgcggttgcgccagcaattaccctggtaccagcagtgcgatgccatcaaccagagttcgtcacctggaagcgagaggaccggcgtaggtggcggcggactgaacagcagtggaggacctgacgacgacgacgctcgctgcaaacgacaacaaagccaaaagctgtcataagcatccatgccaattttagaaatctaaagatttgtttgtacgcacgcaactgcagaaattgtgcagtagtatataatttcactttattcaaaccatgaaaggcattcaacacggaatgtggttaatgcgggacaccatatctaattaacactccaatactccatcctccagaagcatgtacatatcaaatatgaagaactanagagtacatttttgttttgatattgatatgaactccaaataaactatagcaaatacctcgattatttttgacatattaatgtaattatgttaaggtatatagaccaattgtaatctaattttcacttcagagaaaacattattctgaaaccaaccacagggctagcgaaatattgtgtatcttacttctttgataaaacatatgcacaaaatgaggtagaaaatgtcctgctcacgtgagaactgtttacatacccacattgccatggctgagaaaccacaataccactccattaatctggaagtagtaaaacatagtagtggactatgggcttttgatcacaaaagatcatgatagttcttgattatctgacaaagggaaagaaaagcgcctcttaaagataatagcaattaataataactatatagtccagcgtacggggcggcggactgaatggtggtggaggattaattagaagatttctttagaagcattttgtatatgttgtataagattaattagaagcacatcagatttaataaactatactgaaagctgtagcaaaaagaaattagttaaacaaacccttatctttttaaatgcacaaaagcaatctgtcaaagacaaagagaaaaatccaaattgtttttgtttttcctctagatttatgtcagatcattactaaattatatctacaataatgcagttctcatattttggagatatagaggtagggttctgcaaatagaacaaatcttcaaatagaacgatcacattgtgtatcctgatagatttgtcctcgatattctttatataaagtagaaagatagcccgcgcattcacgcggggatgtattgtacacagggttaaacttttcggtttagccgatttgatcgggcat

SEQ ID NO: 48805 - DNA, 14534 bp, Oryza sativa
attcttcttcctcctccagcccactctctccccccattttcttcttcctctccctcttttccccctctcctccctcaaatttccatggagtccagctgggtagcgggggctcgagccctccccccttcccccgcccccatactggctccgccgctagcgacagatccagccggcggcggagctcgagcgcggccgtgtgggcgacagatccggtcgacggcggagattgaggtgcagctagggcgacggctcggagtgtggtggagctcgaggcatggatccagcagtcggcggctcgaagtgtgacggcggatcctgggcagtggctcgatcgtgggccacggatccggccgacagcggagctcgaggtgcagctagggcgacagatccgggcggcggcggttcggaacgtggcagagcctctaggtgtggccggagtgcgacgacggatctagccatgcagctcgggggacgggcggcagcttggattgtgggcgaccgtggctccgggcacgggctgcagatccgccggcggcggaagcttcgggagtgggcggcgctgcgacgatactgccacgatgacggtcggcacaacaatggtcgacggttgttgatgcaatttcatctacatgtattgatgtttgcttgttgaaaatgaagtggaaaattgatgcagtgttctctggaggtggattttagtatggatctgatgtggatttgaatttggattggatttgaaactgcagctctagatgtttatttggcttgaatttggatttggattttttttttttgcaaaaatttctttttgctggcggtcctcttaatcgtccacctatgaagcggatcgtaaccgcaagcgaaaataatagattttcgctggcctttgattactggcggttgtaccagccgcttgtgaatttcggctgcttgcgagaatcattttttatactgattattagcctggtgaaagtttaaattgttaacaaagaaatactccctccgtcctctaatataagggattttgacattttgtatatactgttttatcattcgtcttattaaaaaaatttgaaattattatttattttatttgtgacttgctttattatccaaagtactttaagcacaacttttcgttttttatatttgctcaaatttttttgaataagacaagtggttaaacagcgcaagcaaaatatcaaaatcacttatattagaggacggaggtagtaaattaaatacgagtctagtactggtttaggtctcgcaacgagttgcaagtacatggttgttgataaataaatacatccaacctagtacagtttcatcagggagtacattttgacaagatctataaatatggtacttggtcagataaaatgagagctaaaagagaggagaagagaagggatgtgcattttaaagttcttttctacgcctcaaattgaaaacttcagctcgagctgagggctcaaaagagagaaaaaaaataagataaaacttaccagtgagttcatatcagcgagggaacagagagattttatagcttagctagcatgctgtaatgaacttacatatgggattgggaggtattggtaataaaagaatcactggtcgtagtcgttcatcgtcacactttttagaccctgtttgtcacaactctaaattctaactctcaactctaaactccaacttaaatggaagctagctcctataaaagccgagatgtgtatagaaagtgtttggctagattactcagctccacgccaccatgtctctcgtcaccattttatcgaacaccatgttagcgtcaccctaccgttgccgttgccggttagccgagccgctgccgcgggtcagcctacggggccttaattacaggaggaattgtccattgtgcttgtcttgatgagtttaattcctggtgtttaaatctccttgtaacagagttgccacttgtcttttcaaaaaaagaagttgccacttgtactccagcaaaccgaaggtaccattcaggctgtatggttgcctttgtttcagttgtgcatgtcacttcaacatttggaaggaaaacagtagacgaaccttctagaatgaaagtgactctgttgattctaatcatcaaggaggatgtcaatccattagtgtaaaacacacccatgatgctctaattaattacttaattggtaggagtatatatgtacatgcaactgatgtaagctgcgacgacgtcttgtaaaaacaaaccgcatgaactctgaaaccttatctttgctttgtattgtaacacatttttagcacctgctccctttacaaaaaaaaaaagttatgacaaataaagcaaatcaggtgacaagtttgaatctggtgatgcacagaatgaaaaggaattaaataagatgacttttactatacaatatactggtagtatatattgctagtataaataaggttatgttgggaatatgtcgcaaaatagaaaatgatcagtagttatttcgtgttatatcttcactccgatagtaattcttattgtccgtatgtcagatcggattactgaccggatatggctgaatacagggcacaaccaaatgtttttgattggatcgatagattcatcaaacacataaaaacattaacccgtgttagataactagtgaaacacataagaaaaataaaccattttacccctattatactatagtcgatttaagtgggtactaaaatcaatctacacccttagattgtttatactaccagtatattgtaacagttcttaaaataaatagtagaatgagagatgaacagaaacaaaagcatctcgttctgtcatcaaaagataacgtgtcaggttatttggcatatcaatgcgagggtatgcaaataattaaaaatctcacgagaagatgtatataaaaactactcacgacaatgcccttctttaaaacataaaaactactcagtgcagctcttttaacagcatatattggtttccattctttttgagcagaagatattacaactaatcagtcagtataaccatagctcttcaaatgtctatactttgtcttaagggttaattattggctaacgccagatgacacaaaacacctactccctttgtcccatataaaagccaatcctagcatcccaagaaaaaatagtgaaggacgaaaatgaccaaaatgcccctcattatttttaaaagtagtaatggtgagtgatatgtaaagggtattgaaagaataaaacttcttgtttttttatatgctgagggtaggtatgatggtagaagctggttttttgggacaaaattcaaactctaaaagttgagtttaattttttggggacggagggattatatgtgaaaagtccaaatgatttgaaaatttgaatatgatttgacttgatggaaaacctgattgttttgttttacttttacacactgtatttattcttgcaaagttagcaaccatggtttagaattcataattttaccaaaagttgaggtgaaggtcctggatatcaggatatgcttagtgaacattgactcaacaataatgtagtgattttttttctgtccaagctttcgactcaataattatttgaattttctaagacaattttcagtagttaactagctaaaattccacacatacaaaacactagcatcggttccttgagctttaatttagttcatctcactacattatttctttcaactgttacttggacctaccaaccacatggttcctcggcacattaattcagactgaaataccgaatgatacaaagccagggagttcattactcagtttgtctggcaatagaacagagcatgcataacagggcatttctgtacgttttatactacttcaacacataaaactagcaagacccagagcagggaatatatagagcaaccatgaaccttcatcttcagagtatatagaagaaagagattgcatgtctagcatgcaaatgtcatagtccatttcataggattgggaggcatgggaaatcaaagttgtgcaggactctaggctttctctgccagaattgttaatctctctgaattagccgggtctttttcgagaacacatgggcaaggcagatctatcttggtagaagtggaccacaatgaaatctcatcttctcccacattgcatcctctaatattcattttggaaagatccatcttataaattatcatattcatcgctcttatttgccatggaacaaggtatttgtagcacacatgaaacatgaatgttctcttccaatataataataaataaagcaacccttgtctattaatgattcagatttcttgtcatcaacatatgatgtgtgcactctcaagttggctaataacaatatacattgattaatagaaaggaatttttttaattattccttgagagagatggtttaacagcattgttctcttgactactaccaattgttcttcatcaatgcctccatatatctagcctctacatgatatgcagaagaaagatctaacagagtggaagaagagagatcaagacttctagcagaagagagtacatgtgcaattgaaagatgtgtgctgcttcatgcctccagatgtaaagtactagagctgagagagttcaaagagagcagaagatcagtgttccatgatgagcacacatataccagtatgagattgattcattgcatgcgcatatagtacagacgaattacatgggattaggaggaaccgagaatgaaaggagtgcgaatggtttccttctgaccggccacattcagaattcaaataccaaatggctctgctgtggaagctgagcgacatggttgcgttgagtgaaactactctggactcctatgatcctatcagatactcctaccttccaagtatgtgcttaaccccgatcgagaagtactgcgattgattcgcaggggatcccctatttgttatttttttgtcagaagaaaaaaatgacagctgaaacaggttgatgatgaacgaaacagtaaggtagatcaaacaacagtaacagaatgtacctatctcccatccgcctatagcagtatacatgcacatagatcggtaaaatttctcacaaagagaagcacatatatttgtttcaaatcccttgctcttttcacagaagatcaagaaagagctgcaaagccaatttggaccataacatgttccatagtggtcttcaaatatgccttcagaagttcacgttgagcttctgctgtatgttcattatctgaagaaaagaagtccacctaaattatgctttacaatagttttcgtatgactcgatcacttggtaagttgatattggttctgaagagagaaggctaaacttcagcagaggagccattttggcttgacagcaaatttcagtcaatcatttggctgaccttgtcggatgctctgctctgtaacaaccaaaacacaaatttcgatgttataaccaggtggtgaaaacatatctatctatctatcttctattatatactaaaagtccattaaacctgctacaaacgctcctaagctgccaagtagcgctcctaaaaacactcttaggttgccacgtggcagtttataatctcacaatcgattttcatttaaattggtgggcccattagattagatctattgcttcgtcttaatattctctgtagatataggtgaaaccgtttacaccagaaaaacatacgtacgtactatggaaagaaacgatcaaacgaacccttcagcatacgtacgcacgtacgatgcatcgtaccataaatagctattaaaaatgataaaagaaagatactattcacttgaaaaaaaatacttatatatgcacgagtaaaaataataaaagctataagacctaaaaaatatataagactagaaaatatatgtacgtcggtataagaaaatagacgttttttaaaataagactttctatactataaaaaacaaaacttattactccacaaataaggtggtctagcgtttctacaattgccacatgcatggctctctacaattttgctatcaattttcatttaaaatgatggatcattattttagatcattagatttgctcatttcctcttaatttcctcggtatacaaccgaatgttctattgaaaaaaaatacaaagacaaatacatatagacgataataaacctttagatattgttcccttaaaaaagtacgtacggatacacgagtaaaaataaaagccataatactctaaaaatgtatatacgtcggtaggaaaaaatagacggtcttttaaaaatacgattatctatactataaaaataaaatttattactccacaaatattatcatgtggcgtttctgtaagcactcttagaataccacatggcactctataatttcgttgtcaattttcattcaaaatgatggatccattattttatatcattaaattagcctgcttcctattaatcgagagaaaccatttactggatgtttgattgaaaaacaaatataaagaaccatacgtacatacgataagaaagttataaagccaaaaaaatatttatcagagtacgtactacgataaaaaaagctataaaacaaaataaacatttagatatactgttcccttaagataagtatgttataaatggtctttttaaaataggatttgctatactataaaaaatataaattatcactccacaaatatggtcatgtggcgttttagcaagcactcttagaatgccatgtggtactctataattttgttgtcaaatttcattcaaaatagtggacctattattttggattatttgattagcccgcttccttttaatctcatctatacgagcgaaaccatttagcgatgttctattgaaaaaagcaaagaaacatacgaacacatgataataaagctataaagcccaaataatactaatataagttggtagaaccatcgaaaaaatatagacgattttaaaactaggattttctatacgatagaataaaatttattactccaaaaataaaaatgcaagttaaactagatcaatataaaaaaaattaaatgtgtttacacgcaattttttttgattatttttaaattttatagtcaacttataatcaggtgtattcaaatcttgataacataacatagttatattataactaaatacattatagcacctggagctgacatataataagtaatatcataatatttttttaaataatttaggcgtcatataataattaatgtcatgataatcttcgaaataatttcacatcataatttatggtcaaatatcacttaacaattatataacactaactgaaatctacatgcatgaaaaatgaaacaacattatgttttttaattatatctgatttaattttagtttgtgtgagattgagattctcaaagttttttttttatttttcataactattggattggtatgctcaggcaatgatcttgctataatacgaccccttaatctatcacaagaattatggtcatatatgtttttctttgccaaataggtttgataacaaatgaacaatcctataacatgagcatgaaactattcatgatatattttcttatagtagaggaattataatataatggtcataagtgataattgatgaatgtaatgccataaaccacagtgacataactataagtgcacctcaacaaattagttattataaataattttgggaaataaataaaattttagaattagtaaaggtgtctcatgcaattatggacaataggtgatgaaaaaaaacaagatgctaaaatatagatctttgtcaaaatataaacaatgaaataatactctgaacattgtcacggtcacgtgtttgtttagctatatatatttttagtgatcaacttcactcatttctaaagatgacattgtatttgtaccataaaaattaagcagctttgattaacaccataaacaaaattgtgtctaaataaaacataaagaaactatattttatgggaataactgaataactatttacatcacatccatcttctctttgtttccctagagggcaccgagcatggataccacaactatagcgtggggcacacatatggttgacttgaggcaggctcagtggaggccaccattgataatagtgctcaacttcctacttactggtgcaatcgtctttaaggatgccgatagtgaactaggattaattcaaattgtgctccacactggttgtgagactgtgagaggcacgactatgtcaacccatgcttgaaggaatcttgatggttctccccattagagggacatgtctattttttaacggtgctatcctaataaccaatagaagcattagttttagaatatttatcagtagatttagaaataagtgttggcataaacatttaggtacatagttgaaataatgttttatgtattaatgatgtattagacttattttggtggtttagatggagttccatttattaaaatcatatctatcttttaagaacaatgataataagtaatggtgataatagcaaagtttacacttacctggacaaaagtgaattttgattaaatctaagagacattcttatcatttatattaaagtctacggtctatttcacaacataattttttgttactacgaggcaaaatctataatttgttatatgtatatggtgagatatgacttaattctcttagcattatttatataaacaataaataagatgcacgcgcatctgcgcgggcttcctttctagttttattctaaaagatcgaatgaatgtggagtatgaatatgtatgttctaattatgaaaaactactagatcagggacttgtctattttttttcttcactaaagggtattcagtcaatgattcatattgtttgctaattataatatagactgctcctccatttgccatgttagcttcatactacctgtcgcaaaataagtttagctgtgagtatctatgccccatgtttgaccgtccatcttattcgaaaaaattatgaaaaaattaaaaaaatagtcacacataaagtactaattatgttttatcatctaataacaataaaaatactaatcacaagaaattttcaaataagacaaatggtcaaacgttggatataaacagtgtaaaactgcatttattttggaacggagggagtataaatttgcatagttttaactgaagaaggttaattttcggtgcttacagctggtatagtactacatgcaagtgcatgcttcatcaatacacagtacaggcatccaacctcagaagtattaagactttatttgggagcaaaagtaaaaaaacagtaacacaaattttgacaagatatcttttggcttagaccaaagtactcacaagaacagatggagagtgcggaaatgagataaaagggcaagtgaggttttgaggtctctcccacagaccacatgagagttttttcacttctacatatgtaagttactagagaacagagagttcaaaagaggacaagaaaatactctcccatgagtatttatcaataagagatccaatgcttaacatatgtgtggttacatatatgggactgggaggtttcagaaataaaattaaggagagatgaaatgaagttttgggcatcccaaaatcaaaaggtagtaaacatgaagcttatggttatgcatgatttactagcttctagctgtcagctctcggatcgacttagctattctctaatgcaacaaaccgaagaagtcaagtcgtttgtccaacattttcttgaagcttatctggtagatcgtgttcccataatataattgatattacaacacttactgataaattggctcttatcaaagggaacccttgtactttgattgtactctcgtgtaacaggaaacgttatttcaatcttttccagatgcattttcgattcggttatggaattcaaatgagataatcatttcagtaattcagaaactattaagggggcttatatgaaaagttctggcaaaatcaacttttcatctcccctacccctggtcctgatttcctgaatgtgtctcactgttgtctataaatggatgcaggtctctaacttgttgtacccgataacaaattttatttgggaaattatagatgcaaaatgttcctgtgacacaggaggaagagagattagaaggcaagcaacgttctcacacaagagagaatgtgcaatcaaaagatatgtgctagttttcatgtctccagaatttcgaaagaactttagagagctcaaaaggagaagaaaagcatttcatgaacagataacaatgtgagatggattcagtgcatgctcatggtaattttcaaggatgaacttgggattaggaggcattgggagtaaaaggagtgcaaatgatagatgaccaacttttgaattcaaacaggagtgtgcatgaatatatgtatggtttacctgtttgttctcaggttcctttataatttaacagcctcatgccttctggtgaagatttggcgttgataagggcattctcacctttggtgaagctgctctagactctaatcatatcactgcaagtgagtgcaatcaaccaaaccaattcggaaggaaaaatcagagagaaagtggtaaacaagatgagcaaaatagaacggtaaattagcagtaaacagatccaatatacatctagcagtagacaaacatcaagtcatcaatgatgtggtattcacctcaatgaattgcaagtaaaatctcttacagaagagctatggagtacagctgtttcaacaatattatgtcccatagtactcttcaaacattccttgtttaaagttgacagggagctctggttatttgaacagatatcgcatcaaatttattatgatgtaatttatgcattatcacaattttttcgacataactcggtgataaattggttatctgaagagaagtctaaacttcaccacaggactacaggggctcattttatgttatttttatgccacggtacaatcctagtagaaaaaaccggaccggtccttgacccggtggagtgctcggttcactggtccacccgttcaactgttgggtcactggttgaaccgtggtttattcctaagtacattttgtgtttactctcaatcaaaatatcctagcagccaggtatcatttcattttgaaagagacatttctttttgaaagaaattgagcgcatgtaaataacctgtgactattctcggggatctgtcttggcattgtgatgtacgattcagattggcttaattgatctcagtcacatacgtcaagtgatacaattgccccgagaacacttacttcctagaaattttaattgtttagtaaatataaaatgaaatttttggtggtttcagtgaggagcaggggcggcggatacaggcatggggcagctagggcttgagccccatgcctagcttcatgatccccattataatcttgaaaaataccatgtaatttctaaaaatatttgaacgctcgttagttcagccctacgcgtgtagattttctggctccgccactggcgaggagtgaagtagcattgtcctctcaactacatgcattcaagctcaatggcacagctttatctgggagtatgtgtcagtatgctcggataaaacgagagaccagatcgagggagaagcaggaagagagataaaaaaaagggaaatgtgatctctcccacaacagtagttacgtttcttctacatgttaataattattatggatcagaaagtacttatcactcgagagaccagatgcttaacatgtgtgtaatcatatatatatatatatatatatatatatatatatatatatatatataggacactcatatggggcaccatggtgcccgggcaccatggtttcaaatgcacaaaattactcaaatttttcaaaatttttaaattgtgagtatatacctagttataagaattcgattcatacatatatctatcaacaaaacaactcaaatttaactttatttcacaattcatgattacatacctaactaattatatgtatggatgctatatactagaatcaaaatctaacaaaaacaagttcaaattcagttcaaacttgctttgaagtagttagtaaagtagttaatgttaatacctaaataattgaaaaagtttcatactcatttgaattggttatatactcaatttcaacaatggtgcccgggcaccatggagcaccaaacaaatttaatatatatatatatatatatatatatatatatatatatatatatatatgggattgggaggtttcagtaacaaaaaggagcacaggagtgaagatttgagcttggtagcgaagaaaaggaggcagcatggagttaattgtatcgtggtgattagtagtcatcattcctctgctatctcttgtattacaacgaagcgaacacatctcgtcattggttttccctgctgcttcagtggattgttctggaacatgtcagactgacatgattgtgttttcccataattactattacaacttactgataaattaattgctgcttatcataggaaacaaaatgtatttttttctcccgtgtaatagaaaattgagacagaattgttttcagcatttgatatagtctctcccctttatttccttcttttccaaatgtattctctgttcatattaaattgagtattgtatttcgattcggttatctcaaattctaataagattgttgtttcactaatcgtgtaaatgttatgcgcttatattaaaagtttaggcacagttcactttttgcctccccaaccgttaggcaatcctccataatccagggtttctaactagggacggacccagaacgactggcccaaggcctggaacagcctacccggagaatatgactttgcatggtggttacatggtggaaaaatgtatatccccatgagcctccagtcctagacctcaggccacagtctaggtgccccgaggcttaggtccccggtctcttactcaatgtacccgacaacaaaatccttcaagaaattatatatgttgttatttccttgagaccaatcataaatatggaacttttttatttatacaatgcaattataaattcatccataatggacttaatagcttcattaatgcatgcatatatccatgctcaagtgggcatgttactttttgctcagcaagagagataagaaggcaagcaaggctctctcacacaagagaaaattaagtgtgcaatcaaaatatatgtgctagttttcacgtctcctgatgtgaagtagagcttaagagagctcaaagggagtagaaaagcacatttcatgagcacaaaccagctgtttgagatagattcagtgcatgttcatggtaattggtagggacgaatatgggattaggaggcattgagaataaaaggagtgccacgatgaaatatttcacttttgaattcaaacaggagagtgcatgaatatatataccgatgattcattgcctcccagcttactttatagtttaacagcatcatgtgctctaatcaagacttagcgctggggaagacgaactcgcctttggtgaagctgttcaagactctaatcatatcgatgcaagatataacaacttgagcaagatgatcgaccaaaccaaggaggaaacacaaagaaaaaaaagcggtaaacaagatgagcaaaatagcacagcaaattgggagtaacagatccaatctccacctagaaatagacaaaacatcactcattgattgttggtattcacctcaatgaaatgcaagtaaatttccttacagaagaatttcggagtgcagggcagctgttccaaaagtagcacatgagattaaataattaggatcaataaatcaagttggagagcaatatatgtaatatgtcctatagtgctcttcaaacatgcaagcattgcttaaagtttttgactgaaagcattgcttaaagttgacagagaagtctagtcatttgaacaaatgtttcttcaaatttttctaaggtaatttatgcttatcacaaatgtccacctgcgaaatgaaagggggttatctgtaaaatcgttttttaacaatgctcatcacatggttggctgtcagcttgctctacacagggagacgaaggacagggtggaggggccggcgtcgcggcgacaactagggttttcatccccgagccacccatgcaaggggtacacggggggtcacgggttggatcaatagttaaaatcctcaaagtacttaacaattatgatgtagattgatgttccaccttccatgttagttggatacattcatttatttttaacaaaaacaaaatgaaattttggtgctttcaatgagagtgttgtagcattgtgctccatactacatgcatttaagctccatagtacagctttttctggcagtaaatacagtaagattagcaggatatatgttactttgctcatataaaacgag

SEQ ID NO: 48806 - DNA, 1399 bp, Oryza sativa
  unsure (1)..(1399): unsure at all n locations
acagttttagaatagactcagttagtccaaaagtctaatcattgctaaacgtgtaggattcgaattattcaaacaggaattatacaggttccagaaactgtaagtagaaattgtgactagacacacggaatgattggtaatgttagataaatgaaataaacatctgtatggacacaaccaaagtagaaccatcttgaagtatattgcaatcttagatgaagccaaatgttttccttaacaggcttgtccgtctttcctcatacattgttccattctagtatttaccatcccacatcgagtcaatcattcgctgaacaaaaccgaaaaggtcaaattcgaaatattttgaaagatcatcgtcagccgcaaaattgaataagttattttcctttcttttttctatactttttgtcccatgcagaccagcgatttgatgatgtctgtgagaattgtctgtttgaataagaccagaagtcacccgttcgtttatgaatcccgaaaagtgcttcatttatgagtcgacctgtcgaagcaatagagtacgagtataaggcctcaaatgaaaaacgtgtacatgtagcagatattaacagcttcataatagtgcattagaaaagtgacagagggcagagtttacttgcacgcaggctcttcaaactagaggaggcagcccccttaacctcccccattagaaaaattgtgccgatatgtgccctcatgtccagtagcgtatagggaaggtatagactagggggggggggttacttgaaatgcanaaaaacaagctcatcgaatgagagtgaggtgtcaaaaaggggcggatcatctttatttaaagggtccctccaccaatcacaatttgtcgttattcaccccacccccccccccccgaaactatgcccctgtgtatatgctcntgatatgtcatccataacgaactatctggaatagtttgataatgaagaagtttggaaaatgatataaaaacaggtattaaaattgaaattagacacttctctctatacaacttcaacttttggcctgtgaaaaaggtaacgaaatctaaagatactgataaagcaatatgtcttgattttattttctgtgtgctcgttttcgtttttgttacatttcaatatttttgtgtttgattgtttatttgtttttaagtgtatgtgtgtttgtttgtctctttaaatacgatgtatgcgtaagatctgtataatttcgtcatgacaaataatatatttgagaggaacctcactgaaagatgttcgaggcaactatcatgactatgggattgtaaacaaaacctcaatgaaatccattacggtggcatatgtttgttattttccacaccactgaattctgtccaatccaattaaaattggatgatacc

SEQ ID NO: 48807 - DNA, 1426 bp, Oryza sativa
tacccgcacaaatgcagaacccagagatacagaggaccagctgtaggattatttcatacaagggacttgagcatctgcaaacttcagtaacctcagtggacacctggaaccaattcttcatacatactgagggacaactatacatgcaaaatcctttaaagtgtttcaaagatattcttcatgagcacaacaagccttaaatttgccttttttttgagacggagtcttgctctgttgcccaggctgcagtgcagttgtgcaatcttggctcactgcaagttccgccttccaggttcacaccattctcctgcctcagcctcccaagtagctgggactacaggcacctacaaccatgcctggctaattttttgtacttttagtagagacggggtttcacgatgttagccaggatggtctagatctcctgaccttgtgatccacctgcctcagcctcccaaagtgctgggattacaggtatgagccaccgcgcttggcctaaatttgactttttaaaaaaactttactgtgtaatgcaatttagcatacttatagagactttattggacaacaggtaagtaaaattatccttattttacatatgagaaaactgaatatgccagctactatttttgcattgaacacccagaaatgtggtgatgtaaagcaaccattttattaagttcacagattgttagtattggaattttggatagggtatagaaagaaaatcttgtctgtgctccacattttctagagcctcatttgggaagactcaaaggcaaggaatgactcagagggaagaatcatctggaggcatgttcatcagcatggctagagggtgatgttggctgtcagctaggacctgagcaggtctgtaggctggattgcctccatgtgccccctctgtgtgacctggcttcctccacagcagggcagcctcaggagagtggggcttctcacatgcagtccagagtttcagggatccacgtagaagttgcatcattttttgtgatctatccttgaaagttgcacagcatcattttattaccaaaatgccagaggtttggtctaagtcctgctgttcactccacagaaagccaatcactgagacaacaagtattgccagggaagaaggctttaatcaggtgctgctgttgaggatatgggagatcagtctcaaattcacttccctaactgactaccattaggggtttctaaagcagggaagaaatgtaccatgtgcggggaaacaggaattagggagaggtagggaagaggagttcaccaacagaaagctggtgcttatttaagcagtcatgatgggtgaggactctggcatcccattgtctagatgccatgatctggtaagtttccttccttgatactatctgggaagcatggggatcctctagagtcgactgcaggc

SEQ ID NO: 48808 - DNA, 1049 bp, Oryza sativa
ggcgaaatagtgggcgcgagaaacgaggagccgggcatagcgttggcaagggtataaaggcactgaggaagggacttgtttccttcctttcgccattattccccttgtctttgctgcttgcgccctaactcctcctttcctgcgccctaccctcgccacacgcgctcgctcttaatcttctcttcctccggcgccatggcacggggctccgctctgctcgatggtagcgtgctgccgccctcccgcatcgtgagcgagaggcaggctgggctgccgcgccgcttcatgccggaatcggccaccggccgggagatagtcacgctgggcgagggacgcccggcgccagactgtcacgtactgataaattcatcccgaattaaaaatcattcgctaaaaggaataatagaattaattaaaattcgaaaagaaattggcaaacactaaaatacgtacaagaaaaattcaaatgtggcccggagaatttttgttaaattctccttggtctaaaaagagccctcaaattttagtggaattttcagagcacaaataataattattaagaaataaacaaagttaaaaaggtttataaaaagaaaaaccctaaaagaagtcttctttcccccccttcctctcttgggccggctcggcccacctcgctctttccctctctctcctccccgcgggccactcggtccctcccccgcgcgcgcgccgctgacaggcgggcccgcccgccaccctcgctgacgggtggggcccacctgtcatcgcctttctcgcgccgctcccgccgaccggccgtgccctagcgccgccgccgccgcggattccgccggattccgccgtccccgcgcgcattaaagagggggaaatcactccccgtgattccctctccgtttccccccgcttttacctgtctctctccctgggattagctcggaatctttcccctaaacctagccggcatcaatggcgcccgagatcgacgcggccgtttccttcccctccggcctctatatctccctcccggcgctatataattggtcccc

SEQ ID NO: 48809 - DNA, 2150 bp, Oryza sativa
gccgcgtgcacccggtccaccgtggaccgaaaggctgacgcgtgggccccactcccgtggacccggtccgcgcgccctctctcccggctgacgcaataaatgagtttttaattaaaatttaaatgaagaaattcgtaaatatccatttaaagagcatataaacttcaaatggctatatcttggccatttgaactcggaattggaccgttcaagtctctaatttttccttaagaagtcaagaacccatttttgtgctttgtttctgctgttatgtggagtttattagagtaaaagccgtttcttttccgttagtcgtgtagacgctgcagcttcggaagatccgctcttcgtggaagttgaagccggtgtttgggaaagcgagcaaggcaagtcacatcatccttgagcatattgaatcccagtttataaaattattttgatttaaattattgcattaccgctttatttaaattcccgcgttatcactgttttatttagccatgcctatttatcgttgttaagacattattattgctattgttattattaccttgttcaccctaggaaaataaaaccccaactagtgggtactctatttatggttccactagtatgaacttaggtagatgcttcgctggttaattaggcaacattaggtgattttataactttagactttgggaattctcatatcatttggacactttggaattgttggtttatggtggaattggacatacacctctcttcccctttcaaaacccctaaaacctgttttcggtggggtttgggtgcatgccagttgtgggaagtagcaccccggccactataaggattaagctcgggcctctgttgcaaagcactaccgtacttccacatgtctagtgggtaaggcttagtttgtggctcagtctggttataaacaaaagtacacggattggagatggatgaagtcgggggtcgatggacattctccagggcaaatgaaggctacacgagctgcggcccggtagtcgagatgtcgtggcagagggttggtgccctgctgcttggggctcagtcctgcctgcctgtcccgggggttccggccgtaggcaggattgggtcggtactcttgtttatggctaggatgggttgggaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagtcagtgttttaattcttaaaatttgctcaacaactaaaatgtggaatggttggcctgggttggcttgggacgagctgggacccagggtcgggttgccagttcggtctgaatcatcgtaggccttgggttaaggcaggttcgtgtgggttcacggccttgattaataatactgtgtagctctaggatcgtctttataaaatggctttgggcaactaagtgacttttaaatgccgtttactgcaaaacttaacccctatcttattatccccttgtactcctttgcattaattgtgcatctccggtgtggcctgctgagtactgtggttgtactcattcttgctcaatcttttccccccttcagtaagagaagctttggagaagaagtcttaggtggagtcctggcttataccccagttgagcgcctgtgaagatggagccgtaggcccgctagtccgctgctgtttatttttgtttgtcaggcctgaagtgcctttgtaataatgtaaatattatcgatataataaagatgtgtcttttataccatgtttgtgtggtgtaccccggcttttcctgggacggggattaatacactggcgttcgggaaaaggcaattttcccggtcgcgacacagactacccggggcggtccgtcttctttctcccttttgcaatggcagggctggttccgctattttcttctttcttcatggatgttctggagttctacgatctccagatggcgcacctcacccccaacgcggtgatgacattggccatcttcgcgcatctgtgcgagatgttcattggggtgcgcccatctcttcggctgttacggtggttctttaccgt

SEQ ID NO: 48810 - DNA, 1151 bp, Oryza sativa
gtgacttagccacccgcctcgcagctaccgaactcaccatcgccgacatgcagcgcgcgctagactcatccgccggggaagccgaggccctccgcttggcgggcgagatagggcccggcatgctttgggatgcagtctcccatctggatcgcgccggtcggcaggcgggcctctggaaaggccagacaatgaagtactccaccaaccagggaggcctcgctcagcacctctcgaagatggccggggctctccagcagctccccgaggagctcgagaagaccgtcaagtcatcctcgagggacctcgcccaaggagcggtggagctcgtcctggcgagctaccaggccagggaccccaacttctctccgtggatggcgctggatgagttccctcctgggactgaagacagcgcgcgcgcgcaggtccgggatgccgccgaccacatcgtccacagcttcgagggctcggcccctcggctcgcgttcgcccccaactccgacgaggagggcgacgccagcggtgcagacgacagtgacgacgaggccggcgacccgggcgcatcggattgagcccccaggcccccgctaatctctagttttttctttttctttcttctaaggccttcaggcctcttttttgtatagatcaacttaatctgcaatcaaaaatgatgaaaatttttgtgttaattttactttgctatacaaatgagatgaggatgatctgtgccgtggtccttttgtgtcttagcttgatttaaggactcgtgcccaagtcccagtcctcgaaaggcgcgggtcggggctagtgcctggggagatccacatgtcgaggctggccaggccgggaacgtggtgaccgagggttatgggtgacccgattgtgggtttttgccgattcccccccccggagttcaccacgccccagggcacggctcggttctgggccccgtttggcgattttagctgaccgaaccgagcccccgagggcaaggttgagcacgagtgatcttatttcaagtcaaaattcttcaaaaaggaaaaaacggcacagatacagcccttaggaaattgaaactgcttttattgaaatactgaaataagagaaaagagaatgtgcatgtgtggtagcccccggccaaccatgcacac

SEQ ID NO: 48811 - DNA, 3031 bp, Oryza sativa
tcggtggaccaggtcgaccgcatcattgagagctgtcggccaatagaaaccttggcgaaaagctttaccaaccaaggtgcgcgaggcggagtgtgctccgcattcgccttcatggatatcggcaagaagcacaacgccttgttcccgaggagtgcacttcaggaggattccattagccccgcgccgatagagggtcccttctaccagcacgtagcgtttggagatgcgatggacgccttcactcccttcgcggtcctcgggtagagtcttatctgtgaggtatgcttggatctcggcgattcaagcaatcaatctaagggagctgggagcactcccctcgggtcccgaggcctggactccgacgggcctcgggggccggttaggcgcatccgtctcccctaaggggtcgggtcgcgcccaccgctgggcaagcctttcttcaaaggcgcccggtggggtctgggctcgcgaggacgcgagccgtgagagctcgtcggccatcatgttatcccgtctgggaacgtgccgaagctcaatcccgtcaaaatggcgctccatacgccgtacttggcgcacgtaggcgtccatctgcgagtcagagcaccggtactccttacagacttggttaacgaccagctgggaatcgcctaacaccaggaggcggcggatccccagtccagctgccactctgagtccggcaaggagtccctcgtactctgccatattattggtcgctcgaaagtcgaggcggaccaagtatttgaggacgtctccactcggagaggtcaacgtgacccccgcaccggcgccctgaagagacagggagccgtcgaactgcatcacccagtgggcggtgtgaggcagctgcgagggacccgagccggtttcggggaccgagacgagctcgggagccggggtccattctgccacaaagtcggcgagggcctggctcttgatagcgtggcgtggttcaaagtgcaaatcaaactcagaaagttcgattgcccatttcaccacccgtccagtaccctctcgattatgcaagatttgaccgagggggtaagacgtaaccacagtgacccgatgcgcctggaaataatggcgcagtttcctcgaggccatcagaacagcgtaaagcattttctgggcctgagggtatcgggtcttggcatcccggagggcctcactaacaaagtagacgggccgctgcacctttcggtggggccgatccttttcgctaggggccgcatccctggggcgctcttcacccgagcggcctcgcggggcgcactcgtcttctgtgccgacgacctcggggtcggaggacgacgggggcggccttcccacagtggcttcggggccgtcctgggggtcgggggcccctggcgtcgtcggacaagcgggcagagggccatctccggtcgtcgggagccttgggccaccgttctgctcgggggcctctcctccctgctctctcccgggccaaatcggcacagggttagcctcggggtcagagggcgataggtgcggccttcccgcagtggcctcggggccttcctgggggtcgggggctcctagcaccgtctgacaagcgggcagagggccatctccggtcgtcgggggccttgggccaccgttcggctcgggggcctctcctccctgctctctcccgggccaagtcggcacaaggtgggggtgcgcggaatgaggattgtcctcatcgcgttccacgaccaacgccgcactaaccacttgcggggtcgccgctaagtagagtagcaagggttcatttggctctggggcgaccagaactgggggagagctgagatacaccttcaactgagtgagggcacgttcagcctcctccgtccaagtaaacggcccggagcgtttgaggagcttaaataagggtaacgccttctctcccagcctcgatatgaaccgacttagggcgaccatgcaaccggtgacgcattgcacatccctaagcttgctgggggggcgcatccgctctatagctcgtatcttctcggggttggcctcgatgcctcgggcagagaccaagaacccgagaagcttgcccgtaggtacaccgaacacgcacttatcggggttcagttttatgcgggcggagcggaggctctcaaaagtttccgctagatctgaaagtaacgtttcctggttgcgcgtctttacaaccaagtcatcgacataagcctcaacattacgtcctaattggctacccaaagaaattcgagtagtacgttgaaaagtaggacctgcattctttaacccgaagggcattgtcgtataacaataagttcctatgggggtaatgaacgcagttttttcctcatcctccctagccatgcgaatttgatgataaccagagtatgcatctagaaaacacaaaaggtcgcaccccgctgtggagtcgacaatctgatctatgcgaggcagggggtaaggatccttaggacatgccttgttaaggtcggtgtagtcgatgcacattcgaagcttgccgttcgccttgggaacgaccaccgggttcgccagccactccggatggatgacctcgcggatgaatccggcctccagaagtcacgccacctcctcgcggatgaaggcttgacgttccggggcctggcgccgcactttctgccggaccggccttgcgcccggccgtacggcgagacggtgctcaatcacctccctggggaccccgggcatatccgccggtctccatgcgaagacgtcagcgtttgcccgcaggaaagagacgagcgcgtcttcctatttgccatccaagagaccaccgatccgtgtggtcttggacgggccgtcgcccaggacaacctccttgactgggacctcatcgcacgtgactatccgctgcctcggggcggcgggggcggatgtgccaagcctctcgtcgccaccctcgggcttggacacgacggcgaggcggtccgcgcgctgctccatacaagcgagcgcgactttgaggtcgccatggacagagatgggg

SEQ ID NO: 48812 - DNA, 1144 bp, Oryza sativa
gtgtgccccggcgtcacaccgatgattggctgggacggccggagcatcatccccggggccttgatggcatcaaaggctgcgggggaaaggatgttgagggctgctcctccatcaatgaggacacgccccaacttcacgttgcaaacggtgggagaaaccaccatcgcaatctgccctccccgggcaacgcacggtgggtggtcggtctggtcgaaagttagggcaacctccgaccaccgcgcccggcgcgtcgcctcatgagtaggggccgcggccagaagctctcgcttcatggccttgaggctccggcgagaaatgtgagcacacgctcctccatcgacagtggcaatggtggccccaggctcttggaaacctaggtcatcatcgccgtcgtcgatgtcctcggcgggggccttcttcttggcctcacttcgccgattgccggaaggaaccgccggggacttgccctctcggcgctcctgcctcctctcttcctcccacttcctcgtccgctcagccaaacttttgactgcacggcagtccgcgaggtcgtgaagggaagtgttgtggacggtgcaccacttgccggctgggcgctccctgctgggagcgccggcctttttctttttgtcgctcgctggcctccccttttgggtggcccgcgaagcgccctcgacggcgaggacatgaccctcgtcgtcggaatggactgacctcttcttcctcctcctgtcacgccgccctgtctgagcggcggatccgggggcggccgaagctgccactccggaaccggaggggttccaggtccatgcctcctccttacgagccactcggtccgcgagctgaaaaagctccgcggtagtctggggctctttggaggcgatcttttcgagcatgcggttgtgccgcacgccccccctgaacgcgtagattaccgcgtgtgcagggatgcatggtatggtattgcggacttgacagaaccgctgaatgtacgatcgaagtgactcatcgtcccttcgctgtactgcgtgcaagtccgcttcctcaccggggcgcggatatgtgccttggaagttcatggtgaactgttggcacaaatcctcccaagagtggacagatgcaggtggcaagttcattagccaac

SEQ ID NO: 48813 - DNA, 1252 bp, Oryza sativa
ttcctcattatccgaatcttccctctccatttcatcaacaattataccgactctctccccctcatccgccatgcccatggcctgctcctcccttggttgattttcctcattttgcatcgatggtccaacaacatcccctgcattgataggaccctctacatcttcggtttgcattgaaacatttatatctttctcttgtaccgacacaaatataacgaggggccatgaccgttcaaaagccatttccacataccgtctccaagcagcagtgctgtccatcggcattagttcccaaaaataaccttctgttgcacgactcactacaactgatactgacattgtgtagacttcttggtctattctaaatcctctcaacaaccaactataaattgactgaaatgttctctccgcaggcctatcgatgcccttagatgtcattacaaaatctgacagatcaacaccatctggaccaaatctaatatttccttcaccgtgaactatctaaaatgtgaccttatttgacattgtgcctgatgaaaacaataactgcgttaacctcgcatttctgtactacgccctaagttacattctctacaatattgttctccaaaattctaaaagtaggttacattctccagatcaaactaaactacatcttacaattaacactactgtctatgtctcaattcatactattatattctatgctctggatctacacatatgtgctgtgtgctacagatctgctaaaatatatggaactaaaactaaaacgcaacatatatactcaaacataacatattagtacaaatgtaaaagatgtatgggagcatacctgtgatgaagtgagcgaaccagcagggcttcgccgctccccttctgctgccctcccctctctctctttcgttttttttggatttttagtgaatataatgaaatttcagagaggagggactgggctttataggggggaggcaaaaatcgccctcccccagggcggcaagggggccgcctgcaaaattccatgccccctcgccgcccatttgcaggcggccccccgcacagtacaaaatcgccctagcggagggcggcaagggggcccgctacaaatttcgttgacggccgtcgccgagagcgaacggccgtctgacacgtaatttttgccgccctctgggatggcgatttttaaaaatcgcccttccagagggcggtaggcgactactttcgtcaattttcaaaatgaaaaaatatt

SEQ ID NO: 48814 - DNA, 3147 bp, Oryza sativa
  unsure (1)..(3147): unsure at all n locations
nnnnnnnnnnnnnnnnnnnnnnnnnnnnnnnnnnnnnnnnnnnnnnnnnnnnnnnaaatccactttttcctaattggggctgatgccgagcaggcaggggcagcccatcgcgcgcgctagaaagctagcaggccgcggtgggccgcgagcccgcgagggaggggatcgggaatgcgcgaccacgcgccgggagtgagcgggaggtcgcatgcgcgatccgttgactgatttctctgcactaatttccaccgttcgccttgtcccacgtagggatggcaatcgggcgcgacgggcacgggtagtgcctacctatacccatgcccgtgagattatttgtgctcgtgggtatacccattactacatgacgggtaaggatggttacctatgcccattgcccgcgggcgtgcccgtttacccgccacaacaaaagcagtggaacaaaaagtctacaagctactaagttcgaatcgaacttaaaacatcaaatattctccacctcggtgtcgtgtctctcctctggcggcgatagagtaagaggagagaaataataagggaaataaaagggaaaccgaagaaatcaaagaactgggcttatgtattctagtggattttgctcctagcctacatataagttagatttcgtgggtaaacgggcaaagcgggcatgggtagtgattacccatacccatgcccatttactcatcgggcatagcttttgacccaataagatacccatgggtataaaatggagaacaaacccaaccctaatagggtttttacccgcgggtaaacgggcaaacgggcacaattgccatccctagtcccacgttgacgaccggcggaggttgatgccaaggatattgtcgttgccggcttgccgcgcatccatcgccccggtgcctggttacgtgcccgtcgcgctcaaaaatctcgtccacgcactgcacaaaagatcaggccggccaccgtgcccaggtgaaacacgaggtggccagtacgtgacagagccaggcagcgtgtgacgtctgtggtttttgcatgctcgcattgcccgcatccgcatgccgtcgtgtagcgtgagcaattgaccgatcgatttgtggccttggccttctcaacctgctcggctgcacctgacagcagcagcagtgtcgcagcaggtagaaacgctgttcagagagttttttttttttcaacgcgtgccagaccacaacattcccattacggattcacatggatccatagtaaagagggcccacatgttagtgactcaaagtcatgtggcttagtccgtgtttagattttttttttttgctaaaaaggtcacatcgaatgtttggacacgtgcatggagtattatttgtggaaaaaaaccaattacacagtttgcatgtaaattatgagacgaattttttgagtctaattacgccatgatttaacaatgtgatgctacagtaaatatttactaatgatggacacattaggcttaataaattcgtctcgcagtttatatgtggaatctgtaatttgttttgttattagtctacgtttaatacttcaaatgtatatccgtatactaaaaaaaatttggccaagaaactaaacacaaccttttttttgtgggagaagtttttaccgggtctccgggaaaccgggaaagtacgttggtattgcaaaaactattagaggatttcagctaatcctttccggagaattagacagcttaccccctaagaggatctcaaattctcaatcctcctcttacatgaacagaacgaagtacagccaaaccgccaaatgtattggaacttggtactagtactactagcaatgtagcaatagaatgctagacacaatagtatttttgaaagcaacacacgtttggtcgtaatcgccaaagcagtggaattacgccgcccatcatcaccatcagttggggatcaaccccagggccttgccgtacgcgacgaggtcgtcgtacatctcgtccaggttcttgtacttgaactcgaacccttcgccgatgagcttcgccgacgagagcgagatggtcggcttctcggggtgatgctcttcgatgctgcgtacatagcaacgcatgatcagattcagataaccaaatgcacgaatgcataaagcttaatttcttaattaccaatcgcatctgacgttgtactgggggtacttggccgccaggaagccggcgatctcggtgaccgtggtgttgaggctgccgcagatgtacctccccgacgccgactcctcctcggcgacgaagatctcggcgcggcacacgtcctcgatgtggaccatcggcatcgaccacccggacgccttctcgatgcccttgaggatgttcatcatctcctcgtcgcctgaaaaaaaaaattcacagatcatcgatgcagcgacccaaaaacgttcagaagtcgagttcttggattgcttcttgtttcattcattcggtgatcgctagatagttcctcaccggttatcaacgagaggcaggccgggacgctggtatcgaccctcaccgccggcgatgctccgacggcgacgaccgggcagagggtcaccaggctgagaccgttctcctccgcgaacttggtcgcctccttctccgaaagaaccttggagatcgagtacgcctgcagtgcatgcagcaacaatggcgccgaactcatgttctacgagacattgctgtggttcagtgacatggaacagctcgtgtgtatatatgtgtacctgcgtcggcgacagcttctccatggatctgaggtactcgatgtcggaccaggacgactcgtcgaggacatggccggcgccttccagcggccgcaggctggagacggcggccgtcgacgacgtcaggatcacgcgcttcaccgtgccggctctcgcgcacgacctcatcacgttcagtgtgccctcgacgccgccttggactatctctttctgccatggccaagttcagaattcagtaactaactaactgactacagatactaatcgagcttgcaggttgcagcagtggtcacctcgagatcgtcggacttgtggctcttgtcgtacaccggagcggcgacgaggaaggcgtagtggcagccggcgacggcctcgtcgaaactgccttcatcctccaagttg

SEQ ID NO: 48815 - DNA, 2791 bp, Oryza sativa
ctgaaattcagagttacaaaagcagtttcagaggccaaaccaaaattgtactgacacaatcaatcccaaaactgaacgtgcaaatactcctctgaaacaaattatgaactgatgacatgttcttcgattttcagtaaaactgaacactggaaaaacatgtacaagaaagaaagggagtagaatctcactgggatctctgacgcttgtctgaacagcgtatcctttctccaggagcatcttgacgagcaatgaagcaacgtacccgttgccgccggtgacgcacaccgtcttcctctcaacctccgacgacatcgtctctctctctctctccggtcagttaatacctctcctgtgacagagaaggtgacttgggtttactcccaggtagaatccgagcagcacactgatgatgaggtttcttttgctgattgcgctgttgtggcacttgccaggacaaatcccggagagcaggaacataatacatttgacttagccaacactattttacaagcgacgacgccagtcgccagacagagaggcagaacaagaaatgcttttcgtgatgcatgcaccatacctgctcttctgattgattttccttccttagataatgacctgcactgatcgattatgtcgatcgatgaacatctcacgcttcacatttttaatgcggtcgatcgtgttttcaaaaggtaaagcttttgctccaagaaaaaaggatcatcttatcttcccagatgacgtgtgtacaggttcattcttagaattgaacttttttttttaggatagaggtagtacatctgacgctgaagcctgtgacgatttaacatcgttgaaaatgataggatccgtttctttctctatgcaaacaaaagcgagagaggaacagcacacgcgccattgaaaagtaacccaacgctgcatgcctgcgaattggacttctcgtttgtgtgtgtgattaatcataccaaaaagtaattcctgcgatgcccgcaaagttgagctgagagagctagcataaaaaaaaaagctagcaagttagttcatgttattagtactccctatgtttacaccattgactttttagcacatacttgatcattcatcttattcaaagaaatttgtgaaatatgtaaaactatatttatacatgaaagtatatttaacaatgaattaaatgatagaaaaaaaataataattacatattttttttgaataagacgaatgatcaaacatgtttaaaaaaatcaaacggcgtcaaatatttagaaaaggaggaagaagttgtcttcgcatctctgtaataactttcccacactaaggttgtgtttagttcacatcaaaattagaagtttggttgaaattgaaatgatgtgatggaaaaattagaagtttgtgtgtgtagaaaagttttgatgtgatggaaaagttgaaagtttgaagaattattttggaactaaacacggcctaacacgacctgatcttcagatgctgaactggggaccttgaaagaccttgtgaggcttcgttgttccaccagaatattttctttgctacttaatgaaatgacagatctcttgcttgtttcaaaaaagaaaatcatagagccacaattaggttgtgttctttagtgagggttgtgaatcctttcctcccgacacataaaacggagtgacggattagcgcatgattaattaaatactatttaactgaaaaacttgaaaaatgaattgatatggttttttaaaacaacttttctatacttttatcttgtaaaaaacatattgtttaatcgtttggtaattgtgcatgtgaaaattgaggggtagaaattgagaaaatgttgaaaggagcacaattttattgaacagtttgacgtgtcaataggcacgtttttcataaaagcggatgggaacaaattcactgctgttttacacatacttatttttgcaagagccgtttggttgcgaagctgggtagtaacagcattgtcgtcggcgtcagtagtgcagaatcccgagtgccatgccgtactccacgaaggcatcatcgtacatctcatccaccgtcttgtacatgaactcgaacccttcactggtcagcttctccgacgagaggaggatcgtcggcttctcagggaggccgccgccgagtctgcatgttccgccgccaccgtcggagtcagctcgcagtggacacgcataatctttgagaccagttcatgattttgtcttacgcatcgatgtcaacgttgtggtgcgggtatttggcggccagggaacgggcgatctgccgcatggtggtgttgagggcgcagcagatgtacctccccgacggcgacggcgacgctttctcggcgaggaatatctcggcgcggcagaggtcgtcgacgtgaaccagcttcagcccgccggagtactggtcaatcattctcagggtgttgatctcctcgttgcctgaaatcgaatcggacacgtgagtccgaaccagatactccctccataccatgaaaactctcgttatactaaattatattacattctaatactaggttgggtttttggaagaaggagtttattctagcacacttaggtcgtgtttgctactgagggttctcaatcttctctctcgtttttctcgcgcatgcttttcaaattgctaaacaatatgtttttgcagcaactttctatatgaaagttgcttaaaaaaattaaattaatctatttttttaaaaaagttaactaatacttaattaatcatgtgttaatgaactgttccgttttccgtgcgg

SEQ ID NO: 48816 - DNA, 832 bp, Oryza sativa
tttaatgagtagtacatatgcaattttctcctccctcgcgggctcgcggcccacctcggcctgctagctttctagcgcgcgcgatgggctgcccctgcctgctcggcatcagccccaatgaacacggtgcacagggatagtcacacgacacggcgcgattgcagtagcactgtacctaccgtccgtcccatctctcgatcggcttatggacaacgtgtatgacgcacgcccgtattaacgtcagttggatgccgatggacggccatgaatccatcggtccagacgcacgcatgctcctttgactctaccagctacgcataccattgctgagagcgtgatatgacgatcttgttgtccactccatattgacactttaacccagctgacgtgcgtaatcgacgctccgactcaggacctgtttagattcatgggttacttttcagtcctctttcaaatagctgcaaataatctaaaagttataaataggtgagctatttcagggctatttgaaaataacacatccaaaaaaactatcccccttaagaatactaattagggctatttcaggtggggcccactaaaaaatgtcttttctctttatctctctccatgagaaagtgcattaaagattaaatagctcttaaaataacccttggatctaaacaacttgagactattttattggatggctatttttttcttaaaaattagtagtttttaaaataactcttagctaattctctatacatgtctcaatcaaccacccaactcgcaccgcaccggttttattttacaataaggtgatattctggatatagtgcatgatgtcagc

SEQ ID NO: 48817 - DNA, 2443 bp, Oryza sativa
  unsure (1)..(2443): unsure at all n locations
ggaggagggggaggaaaggaggagatgggccgggggcccatccgaaagaaaggaggaaaaagagaaaaaaaagaaaaagaaaaaagaaaaaggatttttttttcctggaattaaaattgcactttggtgatttttaattggttaaaattatttctagggctctgaaaattccactaaaaatcctgttagcatattttgacatgtagaatccaagaaaaattccacatgccgattccgattattatttgcatttattactttagggtttctctctaggttaaattaaacaatttcttcggacgatttattttatgaatttagagcaagggaggggaacttcagggcgtgacaaacctaccccccttaaacagaatctcgaccccgagattcggaagagctggcgaagaggtgcggatgggcggccttcaattcatcttctctttcccaggtggcttcttcttccgagtggtggctccactgaactttgcaaaacttgatcaccttgtttctggtccttctctcactggtctcgaggatacaaatcggcttctccacataagtcagatcttcctggatgtcaatgtgctctgagctagcttgttcctcaggtaccctcaaacacttcttcagttgagacacatgaaacacatcgtggataccaaccatattagatgggagctcaagctggtaagcgacttcacctctgcgttccaagatcctgtatggtcccacaaagcgtggtgccaacttgcctttggtttggaagcggtgtactccccgaagcggagtgacacgaaggtacacataatcccctgcttcgaaagtaagctctcttcggcggttgtcagcataactcttctgtcgagattgcgcaattcttagcctttctctgacagtcctaactttctcctctgcttcggttaacacttctgtcccaaacagttggcgctcacctgtttgatcccagaaaagtggtgtgcggcactttcgtccgtacaatgcttcaaacggtgccatttgcaaactggactgataactattgttgtaagagaattccgcataaggcagacttttattccaggctccgccaaagtcaagcgcacaggctctcaacatatcttccaagatttgatttactcgctcggtctgaccatctgtttgcggatgataagccgtgctgaaattcaaacgagtccccaattcttcttgcagtttctgccagaactttgaagtgaactgactccctcgatcagatactatcttcttaggtaccccatgcagacacatgattctcgagaggtagagctccgccaaccttttgcccgtataggtagggtgtactggaataaaatgagcaactttggtgagtcgatccacgaccacccagattgaatcgtgcccccgacacgttctgggcaaacctgntatgaaatccattccgatttcttcccatttccattccgggatctgaaggggttgtagcagtcctgcgggcctctgatgctctgctttgactcgctgacaaacatcgcagagtgcgacgaattcggctatttctcttctcatgctggcccaccagaatttctctttgaggtcctggtacattttaatactgccgggatgaattgaatactgagtttgatgagcttctgtgagtatgagatccttcagttctttgtcgtcaggcacacacaatctttctcccaaccagattgtgccattctcatcctcatggaaatctcgagcttttccaaccctcatattctttttcagctcagctatttcaagatcatttacttgagctgctctgacttgatccacgagcgtaggcccggcctctagggcagctacgtacccgtgttctacgatgcccaaatttaggtgctcaagatcttgctgcatttgtcacacatgacttcggtatatactgcattgcaatagctctttctgctcagagcatctgctaccacatttgctttgcctggatgatagtgtatccccatgtcataatctttaatcaactccagccatcttcgttgccggagattaagtcgggctgggtgaagatgtacttcaggctcttatgatcagtgtaaacttcacagcggttgccaataagatagtgccgccagattttcagagcatgaaccactgctgccaactcaaggtcatgagtgggataattggtctcgtgtgggcgcaactgtcgcgaagcatatgcgaccactctgccttcttgcatcaacacacatcccaatccttggcgagatgcatcacagtagacctggaagtctttcgtctgatctggcagaattagaactggtgcggagactaacttcttcttgagttcttcaaaactttggttgcactcagctgaccatttgaatttttcatctttctttagcaactgtgtcatgggcctggcaatcttagagaaattttc

SEQ ID NO: 48818 - DNA, 1712 bp, Oryza sativa
  unsure (1)..(1712): unsure at all n locations
nnnnnnnnnnnnnnnnnnnnnnnnnnnnnnnnnnnnnnnnnnnnnnnnnnnnnnnnttgcactcagctgaccatttgaatttttcatctttctttagcaactgtgtcatgggcctggcaatcttagagaaattttcgatgaaccgacggtaatagcccgcaagtccaagaaaactccggatctgagaaactgtctttggtggggtccactttgtaactgactccacatttgatggatccactgccacgccttgagcagaaatgatgtgacccagaaatttgacctccgataaccagaagtcacacttgctaaacttggcatatagttggtgctccttcaatatctcgagtaccaggcggagatgctgctcatgttcctcttctgattttgaataaataagtatgtcgtcaatgaataccacgacaaacttgtcaagaaactccataaacactttgttcatcaagttcatgaagaaagccggtgcattggtgagtccaaaggacataaccgtgcactcaaacaacccataccgagtggtgaaggctgtcttgggaatatcctcttcccgaattctcaactgatgatagcctgatcgtaggtctatcttggaaaacaccttagctccttttagctgatcaaacaggtcatcaattcttggcaacggatatttgttcttgattgtgacctcattaagggcgcgataatccacgcacatcctcttggtcttgtctttcttctccacaaagataaccggagcaccccaaggtgaagtactcggtcggatgtaccctttctgcagctgttcgtcaacctgcttcttgacctctgctagctcattagctgccattctgtacggcctcttgtaaattggagcagtcccgggtgccaaatcgatccggaactcgatttctctcttcggtggcattgtagtgaggtcttctgggaacacctcaggatactcttgtactataggaatatcctccaacttcctgggacttttctccactgtttctgtctgaccctcaatagcagcctgattcagactcgctacggacttctgcgacgctggggaacggaaggtgatcttcccccctttgtcgttggttagggtgatggtgcggcttgcgcagtcaatcactcccttgtttctggtcaaccaatccattccaagaatgacatccaggtctttagattcgagaaggatgaggttggatagaaacggtgatcttttgatctctatagtcaccgaggggcagtagtgtgctgtcctcatatcatttccaggggtatgaacctgcatcggtattttaagttccactaccgataatccatgtgtcccagcaaatcttttggaaatgaaagaatgcgaggcacctgaatcaaagagaactgttgctggatatgagttcactggaaacgtgcccaacacgacctctggtgctgcctgtgcttcctctgcagacacatgattggcgcgggcctggatgaacctgggtccagtgcgattcagcttcggacacttgccagcaaagtggccgtgcttgccacagttgaagcagggtcctggctttcctacagcccccttcttgggttgttctgactgaactgacacagttggcggatctgactgagctggtgccattagtgggggtggagtcgagttgtggttgcgctgcttactgttgttgtgactgccaccgttgtaatcgttg

SEQ ID NO: 48819 - DNA, 1121 bp, Oryza sativa
  unsure (1)..(1121): unsure at all n locations
nnnnnnnnnnnnnnnnnnnnnnnnnnnnnnnnnnnnnnnnnnnnnnnnnnnnnnnnttccttgctggagcgcacggaactctctcttctgttgtgccataatcccttcaggaatctgtgccttcctgaagctttgacaaaactctgcccaagtaacctccgttgcatctagacgggtcgccacgtagttatcccaccaggcagaagcgggaccttgcaactggtgtgtagcaaaagcaactttctcttggtcgttgcattgcagtaggttcagcttcttctcaatagcacggagccagtcgttggcctccattgggttggtggtgcttgagaaagtgggtggctggatacgaagaaagtctaacagtttggacacgtgtgatggtggaggaccaaactgctggttctgttgcgcctgctgcaacatctgatggtaatgttgctgcatctgttgcatcatcattgtcatcatttgagtgactgttgggttttcgggcggtggagatgatctgctgccagatgcaccactgacatgagctccatcggtctgctcttcgctgcccctggcgtcgctggagtcacggggatcattccttgtcttcaccatctggaggggataggtagaaataagagaaaggaagaaaacggatggctcggaaactaatttttcttatgaaattaagtgccattatcttaatctggattaaaacactgaaaaagaggcacacaattcctaattaaggctgtcataccactcacacatgatatcgaccgccgactaacccacaagcaacaaacctaagcacggaaactagcaagcaaacaaaactaagaagacgataaagctaagggcggcgactctgaagcttggagcggcgcttgcgatcgaagaacaggtctgacatctaaagagtacagagggataggaaccaacacatgctcaaaaccaaattaaataaagcaacaaatgactaagtaactcgccgagcatgatgatttttatgcatagaacatttttcatgaacccggataaagacactaatgcgactgactaaaccatagcttaatgcataaacttgttgcatggaaaatgatgcgcataaaattgccccatcgaacata

SEQ ID NO: 48820 - DNA, 1224 bp, Oryza sativa
  unsure (1)..(1224): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcttgcctccttattagtcaaggatgcaacggtacgagcctatagaacagatcctgttcaagtaaggtcgtgcttagcggtcaaaggttttgcattttaagctagattcatttcttgaagacttccgaggtggtactatgtttggcaaatgacgccctcccatgttttgttttgtattgtctcaaactctaggtctgtgcacatggttgtcatgtactgggctgctgggccttccttcctaaaatgaacccaggccttcggctacaccatggagccgtagaaagtggaaacatggttagtggtaaaaacagttacagaaattcttaaccaaccaaaataaactagtaatttgcccatgctaacgctacggcgatatctagcaaattttctacttaaaaattattttactatttcgaggtccaaatttatttaaatattattatcacaaaccggagtagctctcagtatgaaagttcaagtcgcaatcaagagaagtaatctgttcactattatttttctacttctacatgcataaacaaatatcaattaaaggttttctatttttttcatcaataatcaccatttgtatcacaattctctatccagcatttaagaaaggtttaaaaatatgtatggctatttttggaaatatcatatttgatagagaacctccgtccgtcgctcctccgttggcctcttcctgtcccagcgacagtacgccgtcgatcttcttcagcgagccggcatgtctgaatgccaccccaccgccaccccggttgatgctcgggccaagctttccgcctccgacggcgcccccgtcaaggatccgaccgagtacaggagccttgcaggcactctgcagtacctcactctcactcggccagagctcgcctatgctgttcagtaagtctgctcttcatgcatgatccacgggagccccaccttgccttggtcaagtgcattctgcgcttacgtcaaag

SEQ ID NO: 48821 - DNA, 4049 bp, Oryza sativa
accccccttattggggagagtggtgttctctcctattctctttacaatatatatgttaatgaatctagacacacattaacatatatatatcaatgtgggcaatgctagaaaatcttataacctaaaacggaggcagtaatatatttgttcagaaataacgaaatgctctattctcattcatcaaaagttgcaagtaacgattgtggttacgctgttatacccaaattaattaataatggactaaaaagctatggttatcctttaaaatgatttagtagagcgtgtacacatagatggtaacattatctgcaaacgatatatgtaactcgttttccctaaataaataattttaattaagtacaaagacatagaattaaaatttttatgcaattaagcaagagatctgctggttgcctgggcatataaaaggctaaaacaggttagtgcatactgtgttggagtcatgattgtcaatacacatagaaaggagattcatggactgaattgcttgctccaagtatagacaagcatatgaatcagctccattttagaccagaaaatagtgcactatgcatctcgaaacatatgaaagcccctcattcttttttttttccgggttgaaagcctctcattcttcattgttaagataatgttgtgctgcttttatactgaataaggtgtgtagatcaacgtcagcttacagttgaataggacttagcaaattggtaaatgatccaagttaatgagctagttttgcaatttgcagtacattcagttattcagacgatcgcacccgaacttgcagccatatatagtacgccaaaagaaaatccgaatctcattctgttggacatacctggtccaaatcgaatttctagaaactaatctagacagcaatgagcatttgtttcttttgcaaggacccatgaacaacttacagaaagggcatatcaaacattaaagtatcaaagtaagattaatactattgttttagactaatagagctttgatagccacccatcaagaggtacaaggcaatctatgaattaagaagacctaaattataaaacaagaaacacatatatattacatccaaatcaaggtctccaaaatactgctacgtacttatttgcaaatgcatatccacatgggaaaaaaaaacgtgaacagtgatttgacaaactgatatttgcactaagttaagatagacaaggttcggcaaaaccctgatcaatctagtttgtgaaattaatctgaattatttctctaaaaaaattaatctgaattctgaagctctttatacaaggagcagatcatgatgatatatgccatagacaaatcactacttgcagtgcttctcccctacttacatactcatttactcacacagaactcaacacttcctgaagactgcacagatcaatattcatgtttctcaattctgaacattaccgatcgatttgactttcttaccggaaccatcatacagttttgtagaagtgattttagcaggtatagacaagcacgatataagctagcacatcaaatggtttggtctaaaagattttaccatgtcccagcagcggaacagcacctcgccatggttcgtgtggaagcccagtgggcgtaccttgacaccaagcatcactgacagaacagatcaggaacatgtaatgggaaggatgccacgatccctcagcatatcaacgaattaaatcaagattacagcaaaagctcatattaaaagttgttggcctataccccataatacaaatgaaatgtacattcagactttaattaagtgccacaactccataatttggttaaactatcccattgcagacatatcaacaaaaagaacgccacaagtcttatctatggcaacccgggcggctaggaaattttgcatgcaacattaagaatcaggttaatttgagataaatgtacctgaccttatccgcaaattccactgctgaagcattatgattttgaaattgcaagatcaaattagtggaagagcaagcagcagccgaccaaggactaaatgtggtggggcgttgcgatctattgaccggcgagttgggtagacaaaaaaccgcttatggcacccgagccgttactcgcatcggtgcaaaagggtgcaaaccatttgtgggttgggttggagtctgggcttgggcattgcgcttgaccctcgccccattctctagcaacagatcaatagggaaaggaggcgctatcggctgtatcggtgacggcgaccaacagattttgaccgtctctccatggtcatcggcaaaggacttgcacgtggcatggtgggcagagagggaaacgagggtgtcgtcgcttcgagtgagggcgacctaggcgcaaaaattcgcgagacaatgaggaattgaggaggcgcaatctgtagcgtggaagacgggaaggaaaggggaggaagaatcgcgtggaagacgggagtcgggttggggttatggtgcgaggtgggaggtggagatgacatggagcgttggatttcacagggatgatctcaaccgttgagtgatgaatgtaagagtgtaagagtgaaagatgagtaaaacaagttggtgaattatagggtagatcagcaggtagccagttagcaattccttttattttactggtcgagttatatggaaagggttaccgacaaaaatgaaaacggaaacaattttgctgttatattttactgtttctaaatgcgccatcatatatatgatctaattctttactcaacccatagtctatagtatcgtcaattcatcaatcaaacccctaatctattgttgaaagaagggcaaattgtaatttacatagtgtccttttgattttatttcatcagaacatatagctatgcaaattgaattgtgatttttatggtcaatgtttctgatatttcttaccggttttccgttgataatcatccgtagtatcagttgtttttttttatattttcgataccgttttctttccagtatttatgttttgaattccgtcttcgagaaaatatagtgatggatacgattgaaacgttttctggccgttttcatccgtagatacagtgttgcctcgttcacaggtgtacacctagcttggagctctctcgcacttgctgcattcaaaagcaaaagcaaggtattattacgtctccaagttgcgccgttgcggcacatctgcatctgtattttcggtggtatacactagtcctacattggtacagaacgtgccaatcaatcactcgctctgcattccctctacggtctaccactctaccggcatacgtatagtactactgcgacctgtccagctgtgtagctggcaaaagaaagacaagccgagagagtttggctaaagcgaaaactaggctggtcccttcagaacaaagtgagcatgcaaaagagggatcaaggcgaaggcaagagcatcatctcgtgaccatctcagctgtttcagtattctgattctactgacccgtgatgaggaggggcaaggcaaaagcctggtcagtcctagtactagtactgatcgatgccttatctcttcggactctctcgtcctgcaccccaaacagtgagatctgtaatagtaataatgtacgagtcgatcaaatggaccacaggtttattgtacctctcggtacacctcttcttattactcggttgatctctgaattaaagccatcaatacatcagtgatctttcagatggcattcattgatttttcaccgtgaggaggaccaaatgaatgaatgatggcattgggcatttgcatttcgatttgaagttaaaagtgagcatcgtccagatcggaagactgaagaaatgcagcagcagcagaacagcagtggaagccgagtaacaattttttacagatacacccccacagagacacagaattacgatgaactaccatcacctaagttcatctgagataaactacctgccatttgatttgctaaccaagaaagaaaccagcagttccatccatcgatccatcctaaccggcgacgagatcgacgg

SEQ ID NO: 48822 - DNA, 8514 bp, Oryza sativa
cagacatggtcaagcatgtccccaacactgcctcgaaaaacgtttgtactgtatttactacagtagtgcatactactaatggtgtcatttaccccagttaatcttgtttaagctaatgcaggatgaagaatcaataatggcaggttcgaagcagatggaggaaagcgtagcgaagcacagagcacagcctgatgcactcactcacatagaaagcagtgacaactccggcggaatcccccgccacgagcttcaggtcggcggtcgccttgccgtacaggaacttgctcttcgacgcgaacccgccgcctgcatccacaacacaaaacattctggtcatctgtcccccaaatgcagatcgagaacatcttcacccattcaccacaaaaacttcaacggcgaagacgatgaacagttgaacacgtaccggacgagctgtcgaggcggagcttgaggaggtcgccctcgtacacgacgtggtcgttggcccagctcggctccaccacgtcgtcgaacttgcccgccgccgccacaccggcggcgcacaccaccgccaccaccaccaccacgacggccagagacgccattgtcactgctcacttgctgtgctgttcgatcgactcgactgatgggctcaatctcaagctgaagctgggtgcgatgtttatataggcgagacgtttggcttacggtggaagggtggcacgtgacacgagggcgccacgtcggaggccaagctagccgttgggcaacgggggacccacgcgtcaggagatagggaccagtggtcagtctagcgctctactactactacagtctgcgtgcacagctcagctgctgtggatttctccaacttttgcggctttgttcacagcgagctttcagcacgcttgggcctctttagttccccaaatttttttcccaaaaacattatatcgaatctttggatatatgcatgaagcattaaatatagataaaaagaaaaactaattgcacagttatgaaggaaatcgcgagacgaatcttttaagcctaattagtccgtgattagccataagcgctacagtaaccacatgtgctaatgacggcttaattagtctcaaaagattcgtctcgcggtttccaggcgagttctgaaattagttttttcattcgtgtccaaaaaccccttccaacatccggtcaaacgttcaatatgacacccaaaaatttccttttccccatctaaacacaccctttctttctttctttctctcgctgagctacgcggctactggccacagccgctgtgaccagtcggggaaagaattgtttctgcctcgcttgctcttgcttgctcagcacagctagccagctagccgtacgtgaaacagtacactagttggttacagctggcgagtgggcccgtatgtaggactagtacgtgcacggtaaagagaaaaaaaggtgacagtaaaaacagcttggcccaaacagagtcgtgcaggggaagtagaagatcagcgatacataaagtgctgcgccctctgttgctagcctgcttgcacttgcattgcacggctagcacggcttgatggagtctgcaggatggcttgcaacggaaggagcattcaaaaacctgatgcagatctattgacccacttacccgtgtggattatagtcaagtctttgattaagtagaactaacacagcagtacaaagtatcactatacggggtacttggattagaaatgtgaaatgctagatgttcagatcagaaatggaatctcagctgcagcaactatactacaagcagtaaaaaacattcaaggatcaggcggtgacgtcgaagcctaataccagcaccctattttaaggctgtcaatccacgtgattagccaatttagttaatgctaatcactcgattaggaacagttccccaggagggagcagggaggcgtaggctccagctgtgaatgagcagggagccatcaccaccctttatcaaaggcgcccccccggttgtgaaaaaaatgctgcgatgcgatcgatggcatgagttttggtgcagagaacgacgatgatgcctctcctgccccgtcgattttttactgcagagaacgaaactcatgacgcatcattccacgggctctctcctcctcctcctttcgctttcgcgacgccccagccgatgcgcataatcttttgtccttgtcgagttcacacaaaagtcacaaaaccgctcgtgttaacgttacagtttttaccgcgccatcagagtttaatcgtacgctaagcttccattttagtaggactagtgggcagtggcttactggctttcatcccccgcaaatctgcattgttcttcaaggaagatacagtcggaaagaggtgatatatggctcatgctggtatggtacggtatggaggatgcgcataaccaatgcgtgcttgcctggtgtccatttcaatcgtgattagctttcggaaaatgatactctcttcgttttaaaatataagtatttttagctatgtaaaaattattatattttaagacggagatagcatattacagtattccattcgaattcaaacggaattatacatcagagatagcagctgatattaggtatcaagcttttgtccaaacagaatatcaaccgataattattggatacactcatttcgtccgaacggtttaccattctgtagtattttccttataacctttactgtactccagtaaagatatttactgaatgtggggacattcctttacagcggataatagtgacatcacccactgaacctgcaataattatgcttttctcccgtgtacaacgcgagtactctccccgtctcccgtgtcccgtccgtggaaaagcaaaagttttgggagtttggactcatcttttcaatccgcaacttttcgaagtgaaaaccgcaaacctctcctgctgctggaccccctctccagctgtcaggtctcaagtgtttgatttttgttttcaaatttaaaaattgtaccgttgatggtagagacaacgtttagggcgtttaaaggatttctaaatgttttccttttaaaaattgaaacctttggattttttagtattaaaatggatcaaatcttatttaacttattttgagacaaggggagtagtagtaaaattgtgtgtcatactatctcatactcgtatctcattctaaattagtttaatttggaatgtaaggagtactcttgtcaacattagcactgccgcactaaaattgttacgtgctccctctgtcccattttaagcgtagtcataagttcttgtgtgcatctttgatcatatatcttatttaaaatactttttaaaaaattaaagaacataagtcatacataaaagtattatttatattttatcatctaaaaataataaaaatactccctccgtcccaaaatgtagcagcataggatgggatgagacccattatatgactatgaatatggacatactcattacaaaaaaaggttaaataagacagaggatcaaagttgaacacagaaacttatgactgcacttaaaatgtaatgggggaatatcattttgtgtggtactgttactagtgtgctaacagctgtataagactatgtttagttcacactgaaatttggaagttggttgaaattggtacgatgtgattgaaaagttgtgtgtgtataaaatgtttgatgtgatcgaaagttgaaagtttagaaaaaaaactttagaactaaggctgtgtttagttcagcgcaaagtttggattttggttgaaattgaagatgatgtgactgaaaagttgtgtgtgtatgacaggttgatgtgatgaaaaagtttggatccaaactttacatctaaacacagcctaaacagcgcctatgtatacgagaaatgaatgtactcgtacgtacatatacggccaccgtatattatacaattatccgcacagcaccgtgcatttcacagcataaatggccgtccaatcaacgtgacccgaatgctctgctctggacgctgcagtttttgagcccattttttacctcgtcgtcgtcccggtgaaaatttgctcccgccacggtgcgtcgctgttcaccgcggcattggataggttgatatggacttgctcggcttgtcccgttgcactcgtgacgcatccgattcaagtatgcagtataccacacgagctgcaaccgctgctcgacaacgacctgaggctggctgtaaacgtcgttcgtgcacgcttcagcctgcagctcgcactgtgcttctcccatctcttgtactactgataattgtgttcagcggagcacagtaaactgcccccacggtacggagtactacgtacagtaactgctctagtaactttggaagtgtggtttaagactgtcagtacgtgaagctaatggtgctcagaggaggattaattagtcctaaatgagttgtactacatgaaaaaaaaaagaacacgtgatggttatggctagtggctagcccttggccattggcagcatcgtgttggcagtgacttgacagggttggctcggcgtgtgtggtgatgatgtgtgatgagatgatgggcttctgtgtgtcaggcgtgcgaaattattgcgaaccagctcgcgtcacatcgcattgagcacagtaccgagtgactactcccgcggcaatggcgttgttgttggccatggccgggaaatggatgcatggggaagaagctggacatgtcgttgcttccatttctgaattccttcagatggccacttgcgtctcaagcggtcacgcatttcgcatcggcatggaaggtagaagtaggagtatactagggtggtaagcaggtgatagagatcagatgtcccgtaggatttgatcaaactattatgatgcacatttcaggttattcagctaaccgatgtccccagtatataactgagtctaccgttgccgttgcagatccaagatgtgggttaagggctgtgtttagttggatccaaagtttgtattttggttgaaattggagatgtgactgaaaagttgtgtgtgtatgacagattgatatgatagaaaaggactgaagtttgaatccaaactttagatctaaacacagcctaagtgcacagttagtattctgaagtagacggcgctttatagtcttgtaccggtgcagccaacagcggctctgttcctgctcgtttcagtgtttggagttgtttcacgagtaaatacggctagtggctcagttaactacccattcaaacgacaatgaatttcgatcaggtactcacagtagtagttactggtacgaagcaggtttcatgatggaggctgatcggttcagcgttttcattactagctcctgaatgagaaaggaagaaattaagacgggaacagagcaacacagcaagtgtagtcaggattccgaaagaaatttgctgtagctgtactgcttagtagacttgctgtggtagtagccagggcgactcatgagcgtagtcacaaaagcccagcccaaacacggtgtttccagcggaaaacggcccaaaatcaatttgtctccggttgcacgagcgaccaacacgtagaagaatccaccaattcccgccgattccgagcagaatcactcgcatcacatgcatgttttccatgatcattttaggagggtcttctccccttcctccaggccggccatggtgtcgtacatgggcttgttcttcgtctccggcaggcagaacacgaggaacccgccgacgaggcccgacacgccgaacagcgcgaacggcacgcgctccccgagcaccaccaccagcggcgccaggatggcgcccatctgcgacgcctgcgacgtgcaccccagcgccgcgttccgcaccgccgtcgggaacagctccgccgtgtagatgaacagcaggttgtacgtcgccgccatgccgaagatccccaccaccccgcacgccagcctcgccaccctgccctctatcgatcagaaatttgttcgcgtagctgaatttgattggatgattggagattacgtatacctcatggcgccggcgccggcgatgaggctgccggcggagcaggagatgccgctgagaagcatggtgccgatggcgagcggcttccggccgaagcggtcgaggagcagcgcggtgaggaggtaggcgggcatctcggcgagcgagttcaccaggacgctgacgtagaggttggtcttgaggttgacgacgttgaggctgaggccgtagtacaccaccgaggcgagcaggttgatcaccaccgagagcaccagcctgaacctcgtcgtccgcgaccggaacacgtcgatgatggagcccgacgccgacgctgacgagtcgacgaccttgcctgcgccggcgccgttgtcgtcgtctccctcgtcgtcgagcttgagggacacgtcgtcaggaatgctcctgccattgctggacgcgatggcgcgcacgacgcgcatcgcgtcgtcggcgcggcggcgcacaaggtaccaccgcggggactccgagacgaacggcagcacggcgacgacgaacacgagcgacggcagggacgtgaccacgtagagcatcctccaggacgtcgggaacagcgccgcgatgccggcgagggcggcgatcccgccggagaagaagtagaaggtggacatccccccggccccgcgtcggaagggcccgacgggctcggtggcgaggacgaagaagcagaggccgacgctgccggcgctaaacccggtaagaaggcgcagcgcggcgtacgcccagtagttgggcgccatcgcggtgagcatgccgaagacgccattgaggacgccagaccacctgcagcgagcccttccgaccgaggaacgaatccgataggtgtccgaacacgccggcgcctgccaagacaacacagctaaaattatttctacttcttttttttttctttttctttgtggaactcagctacaattacttctgtcaccaaatcaaaaaggaaaggaaaactggcccatcgactgtgtcagctactgggccaaggcccagcctaataactagcctacgttgatgatgaaaattaggcccaaatgggccaccagcgccggcgatcttgactggttaatgccaccgccgaaacagacatggtgaagtagctattagtagttctaaaaaaaaaaggttaggagctattgatcactaccaggattcgacaagcttgattttggtgattatgtagtaaccgatataatgcgattcaaatgatttattgatctcacatcttggcttccagtccccatccaaaattccaaagataccggtgtcaggcagggagatgctagtaccagtcaaaagattcgaaagtatatcttgttctggccaatccaaacaaaaagcttgaaaataacagctatttaaacatgcgctgagaaacaaggaaggaaatttctgcgagacacaatctgcatccggcctattgccacgtgatttagatcagatcagccgaactagacggctagcttttcatcgagcaccgtgagataacgtaatcaattcagtgacctgatcaattatattgacagtaggttaacaacagtgacaggttgggctaaagcaaataacgacagtgagcgcagccacgcatgcaggaacccacggctaacagggtccaggcagcatattgggttcgatcgatcgacagcttttggaattaaagttagcgaaagatgatgttaagacggtacaggagtcaagcaaaagctgaacaccgaactgtccggaacctaattaattaatctcccagccgccagcagccgcggaaagataagggaggcattggcacggcgccgcttgtgcagataatgctcagtaatttacatccattatgtcgacgatgctaatgctgagtggctgatggcataaagttgacctgtcaaatctaatctcatgtgtaatgacaaccaatctaaattgttaacgagtgtgatgcaaatatgcaattgttcagtagtaaatcggaccctttatctgttactagtagaaaaattaaacggatgggacaatgaactacagtagcacacgctgggatgttggctggctggctggctggctggctagctagctccaagatgcggccgtatgcaaccaaactagctggagccacacgtacgattccgggctgcaaaaatgcaccaccacgaaatctcccggaacgtcgcggtctgcaatccatcgtccaatctagtttgaaatgctagcctatttttgtttcacggattagtctcgtatattacgtattgcctctcacgtcgatgccacaattaaggcaagcgcttcatccaatcttagtattttgcattttggcattccgttgcgtaattcgtcaaaaaaaaaaactacttggaaacgaaggttatttggacgagaattggagcactgaccaatcatgcattcggcgaagaagatggcctggacgaggccgaccttgtaccgttcggcgtaaacgaggccccactctgacaccg

SEQ ID NO: 48823 - DNA, 5728 bp, Oryza sativa
  unsure (1)..(5728): unsure at all n locations
gcgcctccgtcgacatggctatccgctcggtcggcgcgcgcgtgtgcgtgcgtgcgtgtcgctcggtggcgtggggggcgatgcgtttttgcacggtgcgccctgttgtatttgtagggagagcgagttgcctgtgtttgtgagttgtgtactttgtgtgagttgtgtgtgttttgtttgttttatttggaagttatttacgcagtttcttaactctgcttactgtcaacagttgcgacaaaatcatttttctggactactgctagtacatgctcttccgatccaggatttggatctacagcgtatttgtcacatctggcgtggtgattaccatcgttggatgcattagggctgagtttagttctaaaccttttttttttcaaactttcaactttttcatcacgtcaaaacttttttacacatataaaattttaactttttttgtcacatcgtttcaatttcaaccaaatttttaattttaacgtaaactaaacgcactccaaggtgaagtatctttggacaagttggaattggaagactgtaattgcgattggctttgcattttacagtcatgtactagtacttgtgtgctttttggacaggttgccgtgctgcacaaaaatacctatccgataaggcgactttgaatctaacatggattaagtatggcaatgcatgccgtggctgatatgggcgcctgcgtttggttgtcttgagctgtttattagtggcgtatatatgctcaagagaaatgtgcgtaatgtatttggtctactcatagtccaaccagatgatttgagaagtcaattttttatatctacaaggctttatccggctgagaagaaaaggattgccatcgatgtatcggagtggggcagtgctgcactgctgcccaagtgcccatagctggccatgcccgacacatccctaatgataaggtttttttttttcatttttatggagaactatgattatttagttcggcagctatatattgagagaagatttctctttaagaccgtgttatgcagttgtacactgagaaaagatttctctcattctctgcacacacgtttcccgaactattgatggatttttttaagaaaattatatagaaaaattattctaaaaatcatattaacttatttttaaattcaagatagtttataattactctccgttttaggttataagacgttttaactttggtcaaagtcaaagtttataggtaatatagtaatatttataatactaaattagtttcatcaaatcaataattaaatatgttttttaataaatttgtcttagtattttttttacaaaattgttcaaacttaaaacagttaaaacgtcttgtaatctagaacagaaggagtaataaattatatactaatacttcaccatacgttccttctaaatcttctcttttcctcgtgtccaccatgcgctcccttccaattctcccgtcatcgatcgagcacgtacgatcgtgtacgtttttttagtcccacatggtgtccgcccgggcagtggcgttctattcgctcgcgacgtctcaagggttttggcatgcagtagtagctgctgccaccacgtcagtccaagtccagcacgtgtacgtacgtgcaggatgtcacgactcctgcgttggatcttaacgccgcacctcactcgctccgagatcaatcgtcgtcccgtccggatcccatcccggccgcgcgcgatcgattctgcacgcgtcgcgtggcgtcgcgcgcgcgtggcgcacgcagattcaccggtacgcgggggggctcatcgcgaacagcattatgtggcggtttccgctgcgatcgcgggtgcctgcgtgcggagtgcggtgtcgctgttgcccgtgcgggcgtcgcgtcgcgtggtgtgattcagaatcgtgcgggatatgacgcttgcattgtgatgggcctaatttgtgcggccgatccatcgcttcgttatttgtagtagagcccataacaatagaagtacttatcgtatcttgccataccgtgtgtcgtgacaagtactaacacaccacgacaatgacttcatttcacacaagagtgaccagtccaaactccaaagtgaaggagcatcatcagcggttcattgcggtagaatccccaggaccttgccatactcgatgaggtcgtcaaatacctcgtccagatccgtccacttgaactcgaacccttccctcaccagcttctccgacgaatagcacactctcggcttctcagggaacccttggaagctgccaatatacgcatacaagagacgatcaccgattcaccgtcagttctcttccctgattcaccgtactacctccgtaaaaaaaaacccaatcctgaatttatgtccagattcaaatttagaattggattttttttaaaacgaatgtagtagaagtttgtgtcgctataactcgaaactgagagtgccagattgccagttcgtacgtaagtacgtacccgtcagttttgacgttgtaccgagggtgctttcctgccacgaaacgggcgaatgccacgacggtggtgctgaggctgctgcagatgtacctccccgacgccgactccttctcggcgacgaatacctcggcgcggcagaggtcgtccacgtgaactgtcggaatggggccggttgctgccaggcctttcagggtttttagctgcgtctcatcacctgaaaaaacagaaaacagctagcatcgatcagtcgaatttgtgctcgctgatcttcttaaactaatttggcgcatgtctctcgatcaggttctcactagatagcaaggagagcatagctgagacgcttgttgcggccgtcggcgtcggcgctgcacccaaagtgaacaccgggaacacggtgatgaggctgatgttgttctcctccgctaatttgcatgctgccttctccatgagcacctttgagacactatacgcctgcgaaaaacaataatggggtatgctaacgttagtatagatgccaaatagatcgcccggcacagccatgcctagggtgaggtcagtcgggccggcctggccctacacaccgggacgtgccgtgccagctcacgggctacacacacggcccagtaagactcaagccgtgctgggctagcccgaaggcacgacaacctatcgtgcttctctacagaataagtctatttttcctacctaaactctgtgggctgtgttcatatggctgaaaaataaatctattttgtattcctcttgtctttgggctagcataagtctattttacatccctccactatttttgttcgatcatgccgtgccggaccggtccaccgtgccaagggagtggcccaagcacagcccggctgtcgggtcaggccggcacgagcacgaccccggttgggctgtgacgtgcttgggccgggctaaattggcatgccttgggctgggccgcgggtctcgagccatatggccatctataagcattagggcgtcatcatctttatggagtatactagtcttctagtagtagcattgtttcttctttttagagtttaagtacttctattcgtaacgtttgtttgagtggatatagagatggatttctatgcattatcaaaaaaattgtagggatgagatggaggctcaaaaaaggtagaacgtgacccaagctggtggcttctctttcgtcaggtactcgacgtcggaccaggaatcctcgtccaggacatggccgtcgccttgcagcggcctgccggagacggcgggcgccgacgatgtgaggatcacgcgcttcaccgtgccggctctcacgcacgacctcatcacattcatggttccttggacgccggcttcaataagctctttctgccataaattaacgtacaaatgcagctttgtcatcgtagaaatcaagagcaaattaatttcagaactggagacttagagagcatatatatatatatatatatatatatatcatcagagatgagacaacacaacatgcagtggtgtcgattagagaaagcgcgctaattagctagctgttcacctcaggattctgtgactggaaattcaccggagcggcgacgaggaaggcgtaatcgcagccggcaacggcatcgtcgaagctgccttcttcgtccatgtcagcgcggaagacctccaaggggcctagtgcttccaagtccttgagatgggaagtcttcttcatgtcatctgaatacacaagagtaggatcttcagaggcagaactgaactctggaaactcgtagtagcgtcgtcttgagaattgagatcataacgatttgcatcctttccagcatatttcactatatgaattaggtgcgactatcggtttgaacatgtaaatattttctacattatctaaaaaaaatattttctacatggtgcaggtaagagtggcatttggcatttgctaagtagaagggaaaattctattcatcctcaggaccctggtgctctggtctcttggcagccgtggaaggaacggaacttctgggtttttgactcggtgctctcttcagtccctgtggtcctggaatccatcctctcggagggtcatctgtggtgccacttttggggattttttgggagtgtagcgtggctatgccccttcccgctgttaggagttgcgtttagccgccgtagtacttcctaagctttagtttacttttttttttttttgcttttttcctctttccttggcataagccagtctggctgattgtgttgtgtaacaaaaactcattttcttctaatatatattgaagtgcaatctttttgcgcgttcgcgaaaaaaatattcatcctcgggaatgttctctcgttattttgcatttcgccaaaaaaaatcattatttttcttaaaaaattaacaagattgatcaatatgtgatatattatttcacaaacaatacaagttcaaaatcagcttacataagtagaaatgaaaacgacaaatttgactcaaataaaacgtgtaatttgcaaccaaatttgttatttttgttctaataattgtataagttgaaatttgaatatatctctggattggtatatatcttattatttttctagaatcttttttatcacaaagtaggactttctttctgttgttcatgacgacaattcagaaaatatgctactgcggaccaaagattccacccctgaatctgaaaggaaggaaaactttaactgtgcttagttcacgtcaaaattggaggtttgcttgaaattagaatatggaaaagttggaagtttgtgtgtagaaaagttttgatgtgatggaaaagttggaagtttgataaaaatgtttggaacttaacaagggctgaatacgtatgaacagaagattaaaacgggaaataataccacctgggtttctgaccgtcgtgttgacagcatatcccttctgaagcagcatcttgatgagcgccgaagcgatatacccgttcccgccggtcacgcacgccgtcttcatctcaaccgctgacatctcgtcgggaggacacgccgcctacttcgacccctcccagtccgcctgagaactagctaggacgacgatagttcagttattaccggcgttcctctgatctgatcgcctgtcgctaaatgcaacaaccagagatggtatcatatcatcgctgtttcaatttnnnnnnnnnnnnnnnnnnnnnnnnnnnnnnnnnnnnnnnnnnnnnnnnnnnnnnnnn

SEQ ID NO: 48824 - DNA, 2799 bp, Oryza sativa
ttaccggcgttcctctgatctgatcgcctgtcgctaaatgcaacaaccagagatggtatcatatcatcgctgtttcaatttagggcgatgatgcaatcatgcaaggcgttgtttgtaattcattaccgaaagagtcttgcatccacaaactagtcccgtgtgtcccctgtcctgtccaccccttctccactgtgcaccatgtatatttctttttcaggtcaaagtacgtccaccatgtgtttatacacgtctggttgtacgcgcatggctcgagcagtgcaggacgcccgtatcaagattgctagttcccgcaagtcagcgagcgtttcgcgacggcagcgcctcagcttcgcgtctgacatgggcctgctgggcctagtgacttttcaacggtgattaacgatgattcagtcatgtacgtatatatgccccatatgcacgttgagtaacacactcaattagtaatagtatctcctaattgtaattggacaatccacgtacatacatgcacgcagtgattagaacatttaactaaactttttaacagaagattaaatttttaaattgaaaattttgaaaactttcaactcaaaatttgaaaacttttcactcagcatttgaaaactttcgatttaaattttgaaagttttcaactcacaattttagaattttcatctcaaaattcaaaaactttcgattcaaatttgaaagttttcaactcacaattttagaattttcatctcaattcaaaaactttcaactaaaaattcgaaactttcaaatcaaattacaaactttcaagtcaaatttcaaaactttcaactcaatttttgaaacttttactcaaatttaaaaactttcaacttcaattttgaaaactttcaactcaacttgaaaacttctatatcaaaatttaaaaagttgaaatcaaaatttaaaattttcagctcaaatttcaaaatcttttgactacaaatttaaaactttccattacttttctaaaaaaaactggtaactgaattatttacgttgttactgttttaaaaataatactaatgacagtaattaacactaattgccataattagcggcggaagcgcgcgtacaagacgtcgaggagacgcgcgcggctgcgcgaattaagcagtcggcgcgcacgcgcctcctaggaacccccggtaagtccgcgctaatgctagttagcgcgcgtgctgccggcggcgcgcgtttcaggcccaaaaggcccagcgccgctgcgtcggcgcacgcgcgacttctccgcgctttttttcgtttttttaacctttttttccttttctttcctacttttttctgattttttttatctttatcatgttttgagtttgaaagtttataaattttgagttgaaaattttcaaacctaaacttgaaagttttcaaatctcgactagaaagtttacatatctcgatttgaaagttttcaaaattttcaaatctcgagttgaaagttttcaaatctcgagttgaaagttttcgaatctcgagttgaaagttttcaaatctcaaattgaaagttttcaaaattttcaaatctggacttgaaagtttttgaatctcgattctcgagttgaaagttttcaaatctgagttgaaagttttcaaaatttgactttaaaatttaaaacttaaatcgaaagttttcaaatctaacctaaaatattttcaatctgttagtaaaaaaatctcccaaaaaatctccagaatctttcctagttaccaccattagtgttaactatattaactaatatagtggttaagactaaaggggaggagggagtgctcgctgttggcgcgcacgcgccagctagcagcccccgtatcgtatagttgtatgcgccactgttaacaacagaatttggtaagtattcgtatcagtaaaggggatttggtcaagaagagttggaggcggagatcgagttctggaacagagcaagaatcggctggagtctgaatcggctacggttaggatcggctatggctaggatcgcctaatgtcgggttaagctaaataagccgatacagtcgattctgacaaaagaacttgtgcgcgacgtccggctcaggttgatgtgcttcaagatgattgccacgcatggatagagtcctgggaaatcaattgtatctattaattaggattatttatgtaaattccttatagataagtgtgggcaagagtctgccgcaaagacttgtgatagtttagagtttgttagagataatagtcgtgtccggtatgggcatatcttgtaatcctcgggtataaatagaccccgagccctatgtaatttagacagacacattcaatataattccggcgcatcgccaccttttgctttagttttatttcgacgagttcttgctttcgggttgagctgcatcggtttcgatcttcgacaagaggtaaaactcgttatgacgaattatgttcttagggattagcgcttccatcttcatgacactcgtatctcatttatataattcgtcaagttatcatatattttacataatctatagcagtatcattgtctaatctatcttcggcagacatttgcacgcaaaagacagccgattaggttagatctcaacgttgatttagattatataagatatctaccattctatgaatcttctagcggcttgattgtctagatattgttcttcttttcatacttaatgctgcatcaatcgagtttgatctattaagtcgtgcttagaatattgatctctagcctgccacctagttgttgattagaatag

SEQ ID NO: 48825 - DNA, 2978 bp, Oryza sativa
ttgcgtgggcagcacttcggtcattacgccggcgctcgatgctggtgcgggcgtcctgctccccacgcagatcttcccgggtcgaagaagtcgacgaaggagtgacggccgaacggcgaacagcggctgccgctcgtcgtgccctccgtcttgacgacgcggagccggtggtagcagcaccagaggccttggtggcggaggaccgcccaccagcatctaggcgctgccgcgccgtcatgaccaatttggccacgtcgtccagccatcgttgggctggagactccgggtcagggacgacaggcgggtggcgtaagagcgcgcccgtagcttggagcgcgccctggggcgtgctgccgtcgccgtagacgaggaggcgacgctccccatctcgccgttcttttccatcgcccgcgatcggtgaagtcgcggatctttcgaccctctcgagcgcctccccccgcttaggactttggcgtgaagggggcggtggagtacgagctcgacggcgtgggttcggctccccgtcgtcgccactcacactcggagagaggtcgtgcgcctttgcttgctcagccatgaggctgaacaggaaaagcttggtgcacacgaaagagcgcaagagctcagaagatcactcgcagagtcccctacctggcgcgccagatgacggagcgtggggctcctcaccgggagaccgcgctggcccccctttgccggttcggccggggaccctgggtgagactctaagctcccaatctgtatgtggaaggttcgcgagaccggaagcacagaagacaccggcgatgtatacaggttcgggccgctgagaagcgtaataccctactcctgtgttttggtggatctgtgtatgaagcagctacaaagtgtgagccaacctctcccttgttctaggttccgaatctggaaaaaatcaatccaagaaaaagctcccccttctctcagtggtcaaggtcctccttttatatcttaaggggataccacatgcaccatttccctcttttttctgtggggatttcccccaccttctcagaaatagacggagatttgcatggttgccgttcgagtcaccttctgatggaacggcccgcacctacctccactttcgccgggagcaggcgcgacgtagaatcatggctgtctgctggcgacatgaccggtgtcagaatggtcacaaatcggtcattcttgtccaccacgcgtcagcttagctatctgcacgttggctctccttcacactacattttgcctgtaatggttaggatgaagcctggcatatatctgatcagggctaacgtgccatctctgggaggtaacacgctagctccagctggggacgagcgcctagaagccctcgacctgacgggatggggcgaggcgtgcgtcagaccgcctgccgccacctaacccgcgatctgaccggtctgtgactggtcacagaccggataaacgagtgcactgcactgcgctacatgcggtgtgacacgctcagccaaaccgcaattaatgtggttaggtgagccccggtgggctcacctaacccatacacgcggagcgaaaacccacgaggggtcagggcgcctcggccctcggggccgaggggggtgcagcccgaccccctcggggggactaagaggagggcgaacacatcaccctcgggcccgacgtcccccgagggtgccaggccacgtgggcgattgtgtctgcctcaaacctctagtcatgatactcccgatcccatgtcaccgacaacctgatttaagtatacatcgacataaaaattatatatcgttaatatctacacccgatcaagtagatttagtttttccttaatcattcacgattgccgatcgatacacagatgacatcggctcggatataaatgatatgtcatcggcatctggccgatcggctatcatttatagatttaaccacggttcttttgtctttatttcttgttgattgcaggatcaaatcaactgacacgctcacacatccgaaggcgagttttggacctgcactggagttaagtagatctcccaggcctcgtgttttctgtcaacagccaccccttctccccaccgaccaccgccctcctccacgctgtccgtcggccgttgcgcctggagggaggagaagagagaggagagagatacaatgaagagagggagatggggagagaggtggaagaagaggattgtgagaatgacatgtggggctcacgtgggccccaccggtcttaattatttttttctaactaacatgtaggctaacagtttttattattttccaaattaaattgccacgtaaatgccacgacaatgccacgttatccaaaaacctaattaaattagccacgtaggtgccacgtcagcgaaaaatgagaacaatgttggtgatggatcttgtttgcactggttttgtaagttgagggacccatcatacctagtttttccagtacaaggacgaaaatcagattcaaattaagggactttaaatgaacttattctaaatttgctatgggccaccttgtttacgggttagagagcccataacaataatggttaattggatccagccatgcatcgagcctttttatagatcgcaagtggtctcaaaggtgtggtttttaaaatgggattggtgctggagcactcattggtgccgcatccctagtgtcggttgagaaaaccgataccttaagaggtttttcacatgttctgtggtagtgaaagggtccgtatcataaagagattaccataccgtaacacacaacaatgacttatttcacaagacaagaggactaacaatttcacaagagaatttttatgtccaaaactccaaattgacggagcaaccatcaattcagtgcggtagaatccccagggccttgccgtactcgacgaggtcgccgaatatctcgtccagatccgtccacttgaactcgaacccttccctcg

SEQ ID NO: 48826 - DNA, 936 bp, Oryza sativa
catactctcttaattctaaaataaacaaatcaaatataaaatgtgatatatcttgaatctgaacaaataaaagagtagcttcttaaatttgccgtatgtttctcaggctctcaccagacagcaaggagagcgtagttgggatgcttgttgtggtcaacggcgtcggcgccgcgcccaaggtgaacaccgggagcacggtgatgaggctgatgtcgttctcctccgcgaatttgcacgccgccttctccaaaagcaccttcgagacaccatacgcctgcaaaacgcaaacgcaaaaacaatggggtgtgctagcatcagccagccgtcattttcatcagcccggtaaaaaatgtatatgaatgatttgatggaggaccaaaaaagaaaggagtagaatgtgacccaagatggtggcttctctctcgtcaggtagtcgacgtcggaccaggacgactcgtccaggacatggccgacgccgccttgcagcggacggagggcgacggcggccgccgacgatgtcagaatcacgcgcttcaccgtgccggctctcaggcacgatctcatcacgttcagggttccttggacgccggcttcaatcatctctttctgccatcaaacgttggcaggaaacccagcttaatttgtcatcgtagaagttaagagcaaattaatttcagtactagagactaaagagcatgcttatcatcagatgacacaagacaactgtcaactgtgacgtcgattagagaaaaccggattaattagctaagctagctgttcacctcaggattctctgactggagattcaccggagcggcgacgaggaaggcgtaatcgcagccgttgacggcttcatcgaagctgccatcttcgtcaaggtcggcacggaagaccttcaaggtgcctagtgcctccaaccccttgagatgggaattc

SEQ ID NO: 48827 - DNA, 2316 bp, Oryza sativa
aatcacagcctgtaactgaaatcatgaacaacaaaaaagggggaagaatctcaccagggtttctgactgtcgtgttgacagcatatcccttctgaagcagcatcttgatgagcgccgaagcgatatacccgttcccgccggtcacgcacgccgtcttcatcccaaccgctgacatcgccgtgccgccggctacttcgtcccctccaggctccactacgtcctcctgagagaaatagcttactggaatgaagacggcggttgtaagagtacaagagtacagtcactgtcactgacgttcatctgataggatatgcttgtcagttgtcaccaataagaaatctttgttatttagatgcaaaggtatgtttgtattcagggagtaaactttattccatgtcacattggatatttggatgctaatttagagtattaaacatagaataattacaagactaattgcataaatgagagttaattcacgagacattttttaagcctaatcaattcataattagcacatgtttactatagcatcacatagactaatcatggattaattaggctcaatagattcatctcacgaattagtccagggttatgtaatgagttttgtcattagtctacgtttaatctatctattaatctaaagccagtggttatgccagcttttgattgggccacgtggcgcccctagcttatcaaataaatcatgaattttgtctaaggaaaaaaatacagaagatcaagcaaaatagaaaactacagtgttatgtgataattctaaaagcaagtagtaccttagcagtttcttttaagaaaaagttgtaccttaacaacacagcatccagaacatctagctgttcccacccggtaaaaaaaaaaatcagcttccagaagcttctaactgtacatcacttcgcaataaacatagagactttctagaaccactcaaatataaatcataatttaagataagtctagttaaagtatctagatccatagacttatacatctagattatagtcctttgcaacaacatcactcctagaggcattcaaatatccgatagaagaaaactcagaattattaaaaaaaaaaagggaaatccaataaaaaatatgagcaacagggtcctcagctatcgtatcaccgtgtagcaccaagtcaattgaccatttcaattcctccttttttcagtttccagttaccatcgtatcttatgaaccaagtgtacttcctccactaatataaaatattcccaatctttttcttagagagataagtatggagtgaaaaaactataatgccatttattaaataaaatatagttgaaaaatgacagaatggttagaagtaagacatgaagaaaattaaatcaagaggtgagtgatacgacacgcagtgctcaatttggcaggaccttccagcttttctgtagctaaagctcaacaaagttttttctgctctataaaaaagagagtggagcagactatagtgacctagaaaaatgaggggtggagtgaacacaaagaccgtcaataggccactacttaacttcaaattctacttctagcatttaggagttggatccttccacctaatatttgtggacatcaagagtattatggattattgagagcaagctttgtaagtttacgattttctgtaacttttttttattacaatcactcctttttttaaaaaaatattaatcttctaatatttttttcagagaaccttctattatttaactccacctactttctactttcttaatactttatagtatttaattatatcaaaaatttgttagaaactcaacatctataattaatcgtccaccagaaacatagagaacacacaatcccaaattaacattacaggagattatgctcagaacgatatgcaagagaatacaatatttaatggaacatagaagttgaacgaaatgctaaaaatatcttacaaaattttcatgtttcaaacacacgctaaacaatgtatcgggctataaagaaagtgtgccaaccggcacactaatgttctggtacttctaattagtgtccaaacatccgatgtgacatggcttaaagttttagtccctgatccaaacatttcaaattattttaggacgaggatgcaacactatgtgcggggttggaccatctatggaaagaaggatggaccatttacggaactgtccttacagaactgttcagttgatatgaaagtgggtggttgtttggttgatatctgattgaggagtactcctttcgtctcataaaaaatcaaccaaagtatcgatgtgacacatgc

SEQ ID NO: 48828 - DNA, 1540 bp, Oryza sativa
gggctataaagaaagtgtgccaaccggcacactaatgttctggtacttctaattagtgtccaaacatccgatgtgacatggcttaaagttttagtccctgatccaaacatttcaaattattttaggacgaggatgcaacactatgtgcggggttggaccatctatggaaagaaggatggaccatttacggaactgtccttacagaactgttcagttgatatgaaagtgggtggttgtttggttgatatctgattgaggagtactcctttcgtctcataaaaaatcaaccaagtatcgaatgtgacacatgctagttgttgacgagtactacaaataaaaaccaaatctatgaccggatgtatagatggccattcgggcggcacggcccaggcacggtcgtgtttaatgaaatatatttaatgtagtgtttaatgaaataaattttgtgttgtaaatgttgctaattttttctataaacttagtcaaaccttttactgaaaatgtttgacaaaaaaagttcaaaatgatttataatatgaaatggatgtagtattaactactataaatatgccaaatggttttattagattttttaaagaaacttaaaaacatgtccataatatacatcttttaacagtttatgaagcggctaaaaaaacaagtggcatccctaacagaccaacgaacggagccttaggtccctcaaaatggacatcccctaatttcttacgtatcaaccaaatgattcttgttaaatttttttataaaaaatatataaatgacatgcaagaacgaaggatatgctctaagggtattaaacttcattgccattatccactgtgtattaggctcatcttaaaacactgtactatttttttttctttaaaaacactgatcacttatttcgcaagcgcatactccagttcggtcctcgtgacagctaggttgaaggtagagcagcatcagctattcgttcaatgtggtagaattcccagggccctgccgtactctacaaggtcatcgagtatgtcgcccatattcgtgtacttgaactcgaacccttccctgatcagcttctccgacgaacagcagactctcggtttctcaggcatcccgtcgaagctgcaaagatacagagacgatcactcgctcgtcagatcgaacacaacaatatttatctattttggatttccaagttggtcaacaattcgatcgtaccggtcggttttgacgttgtactgcgggtaccttccggccatgaaacgggcaagcgccaagacggtggtgttgaagctgcagcagatgtacctcgccgacgactctgccgacgacaatgacgatgactccttctcggcgaggaatatctcggcgcggcagaggtcgtcgacgtgaacgatcgacacggagccggtgacccactgcaggggcttcaggacttcgagatgcgtctcatcacctgagaagtagtagtaaaaaaacagcagccaacttaaactgtgtaacacgcgttgcaaagagtgttgagacttggggtctgttt

SEQ ID NO: 48829 - DNA, 1729 bp, Oryza sativa
gccaccggcgccggcgatgcgcccaaggtgaacaccgggaacacggtgacgaggctcatgttgttctcctccgcgaacttgcatgcggccttctccaaaagcaccttggacacactgtacgcctgcaaacgcaaatgccattgccaattgggtgcaagcttattttcgttggtaaatttaaagaacttttcggtccaatatactgagtattttaagaatttttatcaaattaaaaatggtattttagtaattttcattctagtttgcaacagcgcagtgtctcatggtggtgaaaataatgcctatctctactccctctgtccttaaataactcaacctcttatgacacatcctactattctagtaaaacgaatctagacactctaggatgttacgagatttttttttaacggagggagtatttcgctataagttgtgagtttacataattaccctcatccaatagtatggaaagacaattttaccccctttaattttatactataatatattaaagcacaaggaaatattcataaaaatctttgaattgtttgtactggcagcacatactagtagtagcatatattagtatatattgtacggtaaaagttttcttgaatttatggataagatggagatgtgaaaatgtcaagagagaggaacgtcacccaggctggcggcttctctgttctcaggtagtcgacgtcagaccaggactcctcgtccagcacatacccgtcgccttgcagcggccttctggagatcgctgcgtccgacgatgttatgatcacgcgcttcaccgtccctactttcgcgcacgatctcatcgcgttgagcgttccattgacggcggcttcaaccagatctttctgccaccaccatcaacatcgcaaaaaaaaaaaaaaaaaaaggaaatcaagattagtagagcacatcagttacagagtatcagagtcaatagtgatgttaattagctgttcacctcaggattctctgaattgaagttcatcggagcggcgacgaggaaggcgtagtcgcagccggcgatggcatcgtcgaagcttccttcttcgtccatgtcggcgcggaagaccttcaaggggccaagtgcctgcaagtccttgaggtgggagttcttcgccatgtcatctgaatacaaaccgcagcaattagtggaatcttcagagatgaaactgaaactctgaaaattcacaccatcgtattgataaagtcgcatcatattttgatccatcatatgtcacgatatatatatgtaactatcggttggaagttggaaaaggataagatttgacaacttctccctttcgaaagatatgatattgtccacatgtgcggctaagcctgccatttgctaatgagtggttaagcgaaaacactcgctaattagctcatatggtactagcaggccgaggatatgatcatatgaatggaagaaacactgcaaaaaaagtaaaaaacacgaactagagagtgaaaaaaggaggagaatcttaccggggtttctgaccgtcgtgttgacagcatatcccttctccaacagcatcttgatgagcgcagaagcgatgtacccgttgccgccggtgacgcacgccgtcttcctctcgaccgccgacatcgtcgtcgtcgatcggtcgctacaacaacccaccagcccagatgagacgaagaggacggggaatttatgtttgttgctgtactttgggaagag

SEQ ID NO: 48830 - DNA, 927 bp, Oryza sativa
tatttcagctggttattatggagaggatttactagacaaaccaagtaaattaatcgtgacgatacaagtaaaagtactcttccgtttcaaaataaaacaacatagtattggattggacacgtacataataaagttggttattattattattattattattattattattattattattattattattattattattattattatttcagagacaagatttttatgggaggaaatattattccttccgtcctataataaattcagttttagacttttctatttatcccaaaataaatttatttttaaagtaatcattacatcatgtgaaagtatgataagcctctcccatttatcccaaaataaatttatttttaactaatcattacattagagttcttgaaaatatgatagtatatatgtattgagaataaataaaaatagaaataattatattgggatttaataaagtgagtatattataggcttgtaggtaaatattggtttgtgtgagataggtaaaaaacaaacttattttggaggaaggaatagtaattaatgtgacataattgatatctaatcaacagtggcctggcagcgatcagagacttgacaagtggcaattactacctaggacaagtggacaacatcgagtggcacttggccccacaatggcactgagtttggtgggagatgtgctacgtgtctgcatgcatttacctcaggattctgagacttgaggttcatcggagcggcgacgaggaaggcgtaatcgcagccggcaactgcctcgtcgaaactgccttcctcttccaagtcggcgcggaagatcttcaaggggcctagtgcttgcaactccttgaaatgagagttcttctccatatcatctggaactcaaaatcacaatgcgctgcagtttcagaggccaaa

SEQ ID NO: 48831 - DNA, 8682 bp, Oryza sativa
caaggggcctagtgcttgcaactccttgaaatgagagttcttctccatatcatctggaactcaaaatcacaatgcgctgcagtttcagaggccaaaccaatggtgttcttgtgaattcccgaaatagttttcttcggtcatatcaacttgaaacaaatcaaacatcagcatttatcttctaccaaacagaacaccgcaaaatcttctatgcacacagcatgctgttactgcccggatctatcgtcaccgcatacacacaaaatcaatgaactgaagacgatctacagaccattgttggggtgagaagtaagaagaatctcaccggggtttctgactgtcgtcttgacagcgtatcccttctgcagcagcatcttgatgagcgccgaagcgatatacccgctgccgccggtcacgcacgccgtcttcctctcaaccgccgacatcgccgcggttagttggctacttcgcctctcctagtagacgaagaaagagtgagaattgcttcacgcaccaaataggagcagctaggaccccaagcactgagcagagcgtactgaggttgcttttggtcggggtcattgttggtgttgtcatgtctcgtggtcatagatcatcatattgggaggtacaactactttgagaaaagagtactccctccataaaaaaaaagacaaacaaaccctgatttccgtgcctaacatttgaccgtccatcttatttgaaaaaattataaaaaaaagtaaaaagacaacttacgcataaaatattaatcatattttatcatctaacaacaataaaaatacgaattataaaaaaatttcatataagacggacagtcaaagttgaacacggaaatccagggtttgccttttttttggatagagggagtatgtgtattagaatatatcacatcatatactaagtgcatttatattatgcattaagtgtatttatattgggaccaaaggagtaggaatatatacatagcatgctcaatgcttacaccctctgtcctataaaaaaacaatttagcactggatgtgacatatctataactataatctggagatacctttgttcatgtttagattcgtatacatccattactagatttatttttttcggaacggagggagaacgtgtcttgtgtgggtctttgattagtagcaaacgtaggtaccctgatttatcctagactgagatcctttgatttaaatcaagtgattttaggatcactaacatgtggatacatactctattcgttccaaaatataaatatttttaaacttcgacacagttttcgagatgctattttgatcaataatatatatatatataatgttttaaataaaaaagagttgcatattatgatagtttgtttaatgataaatttagtaacatcaattttacatgattgatcttttttctactaataggtaaagttaaaaaaaataacttgacactattctaaaaatgtttatattttggaagtaagaaggatctatatgttggtgactcaaagtactccagtagaaaaaggaggtcgagagtattcgttcaacgtgtctttttttttaaaaaaaaaatccgggaacagcaattaagccatctaaccaacatcgttgctcctctccccacccaccctatagacttaggggctgcttgaataggaggcacttatatttctgtgaaatcagtctctcccattcaaatagggcattatgttctaacgagccatttggttctgatcaaggttttgaatatcagttttaaagagcacctaaaaatcagtttaaaaaattattgtatgaagtagtatatatgcatctcatacaattaatttttgaacttgaaactgttctcgctgttgctgctaccggtggtaatgtacgctaagatttgcatcttttcgttgtgatcactgttagatagatctctctccccttgagcccaacggctcaagggggccttgaccgcgccctgatcgggggcgcccagcccaatggctggtgggcccccgtcacactgcgccatataaaagaggggtggaggccggcacggcacatggtacgagattcaccgccgccgccaactccaccccacaaaaccctaatccgatcgagagggggcgcagccagtgacgggaaacgccaccgccgcgccacgcctcatcgccgggacgtctacgaccaccactgccgcagccgtcatcaccgtcgacctcaccggcgccgtatccacgtcaagccgcgacgacaacgacgatgtccggcgcctcttactacacgaacttctcaaccggtcggtatctaaaccctctccctttcatctacaatgtcgttcatcaaacccaaatagaaccacccgactagatctaacctaggtgatcctagagcaaagtctaacaatggtatcagagcaaccctagtgttagatcgtttcggggaaagaaatccaaagaaagaaaagcacaagatccgcacggatcaaaagaaccaaaaaccctaaccctaattcttacctcgtcgccggccgtcgtcgacgccggcaacggagggggggaggggcaaagaggcgccgcctaggagccactcgacggccgcgcgcgcacctgcacgcgcgtgccggcgagggggcccgcggcggcgccgccatctccgtcgtcgccatctctctctcacacggtgggggttagagacggtggggggagcggataaaagaaaagaaaggagcgccggccatggcgcggcggcgcgagggccgccggcgtcggcgacgccgctcggcgcgaccgcgcccgcccgagagagagaaagagaggagaagctagggtttcggcggccggccggggcacgaggggttttgatccccgttttcggcgcccggccgtccgatcgcaaaccctaagatcggacgtccggcggcggccggaccgaaatcggcccaagtggggagcgcgcggcggcggctttcccggcccaggcccaggttgcggcctgggggaggggagggggcgctcgcccgcgcgcaaggtggccatgggccgaccggcaaaggccggaacaaagtccatataaggtccctccggggccgaaaatgaataaaagagaacagtagcaatttttccattttattttgtcaattttcatgcaaatttcaatagaattttgaatagatttttgcatgttttacctctgtttaaatttgaaccaacgggagaattttcacagagagagaattacagagatttagctactgttcatatgattttatatagtcttccgctgcaaatagatgaaattgatgaaaattagtgtttctaaaattaaatttcgaaccaacgggagaatttaattttaggaacattaattatgtgctatgatgttgtaattttctgaccaacgttgttaattgcaatattatagttatggttatatgtgttatgtctaattctgcccaacggtgatgtaggcttaatgcataatattttaatgttaattttgttctcaccgcacatgattatttcaggtggctactccttgatgggttgcattaaagatattccgaccctaaaaggagataactacgcagaatggaaaagaaaactcgaccttgcttttatcttgggagaggtggactgggtattgactaccccatgtcctatagaacctgctgaccttgtcagaggtgaaaatgagtcagatgctgactggcaaaagagacagagggacaatgctcctctcgtcatgtcgtatgacattgaacaaaagaaatggtccttagccaacaagaaatgtttggctgtggtaaagaatacgattgagcctaccatattgggctcgatcccagagtgtgacgctgtctcagagtaccttgaaagaataaagagtcagtttactggctcttcaaagacttatgctacacagctgatcaagcagcttgtgacagaaaggtaccatggaggtggtgttagagaccacatacttagaatgagcaacatggcttccaaattgaagccaatggatttgggcataacagatgactttctggtccatctggttatggcctcattgccaaagcagtttgacaattttattgtcaactacaacataagtccagagaaatggaactttgagaagctcattgctaattgtgtgcaagaggaggagagaatcaaagaatcaaatggtggttcaataaactatgttaaagataagaaaaagaaccacaagtctcccacctcaaaaggtaaacagtctcagcatctgcctcaacaacaacagttcgctgttgagaaagatcaatgtctccactgcaagaagacaggacactacaagaaagattgtcctgactttttgaaaatgatcatggcaaagaaaggtgagaacattattacatttgtaaatgaatctcattatgttggttactctagatccacatggtggattgattctggagcaactattcatgcttgtaattgtttaaaggcattccgttcgacgaggactacgcaaagaagagaaagcaccattagagttgccaatggagttgaagaaaaagttgaagctgttggagatcttcctctagagctcgcgaatggcttcatacttttacttcgagatgtcttttatgttccttctttgcaaaggaacttaataagtgtatcaaagttggattttgatggatatgattgccgctttggaagtggcaaatgtgaactatggcataataatgcatgtattggtcttgctgtgttgcgagacgagctttatttgttatctctttctgagaatgtgaatgttgtgtcctcgttgacaaaagaaaacaagaaaagaaagcgaactcccgatgtctcatcgaaattatggcactgtcgtttgggccatatttcgagggggagaattgagagactagttaagaatgaaattcttcctccattggagttctcagacttagaacaatgcatagaatgcattaaaggaaaatttgtaaagagcatcaaaaagggtgcaaaacgaagcgcgggaattttagagatcattcatacagatatttgtggtccatttcctgtgaaaagtgtggatggctatgactcgttcataacattcacagatgattactcccgctatggttatatttatccaattaaagagcgatcagaagcattggataaatttaagatattcaaagctgaagttgaaaatcagcatgatataaagattaaagtagtaagatctgaccgtgggggggagtactatggtcgacatacgccttatgggcaagtccctggaccttttgcaaggttcttgctagagaatggaatagtagcccagtattcaacaccgggcgaacctcaacagaatggggtagctgaaaggcgcaaccgtacccttatggatatggtgcgcagcatgatgagctactccacactaccactcggtttatggatggaggcgttaaaaaccgccattcatattctcaacagagttccaagcaaatcggtgcccaaaacaccgtatgagctatggacaggaagagtaccctcgctaactcacctccgtgtgtgggggagtcctgcagaggccaaagtatttaacccaaatattgggaagttggaccccaaaacagtcagctgccattttattggctatcctgaaagatcaaaaggctatcgtttctactgtccaaacagttatacaaagtttgtagaaacgagacacgccgtcttcttggaagacgaaatgattagggggagctcggtagttcgagaaattgatcttgaggagaggcgggtgtctgtacccgctccgtcgactcaggaacctttcttctctctacctgctgatgttgtgcctgcaatgcctgtcattgaggtaccagcacctgttgttacccctcctgtggcaacaatgaatgagagtgaggaacctgttatacaggattcaacagaaatggttgccacaccagaggaggagctacaacaacctcaaatagataatgtgccagtacaggagactcatcaagagcctcaggtacaggatgtgccaaatgtgcaggcccctagaaggtctgaaagagtcagaagatcggctatccgtgatgactataaagtttataatatagaagagtcgcatatggaggatgatcccacctcatatgaagaggccatgagaagcgctcgctcatctgaatggttggaagccatgaaagatgaaatggaatcaatgaaactaaacgatgtttgggatttagaagaaattcctaaaggagccaaaacagtaggctgtaaatgggtctacaaaaccaaatatgactccagagggaatatagaaaagtttaaagcgcgacttgtggcaaaaggcttcacgcaacgagaagggattgattacaatgagacattttctccagtctcttgtaaagattccttcaggattataatggcactagtggcacattatgatttggaattacatcagatggatgtaaaaacggcatttctaaatggagatttggaggaaaaagtatacatggcacaaccgaaaggttttgtcatgaaaggaaacgaaaatatgggatgtcgtctaaagagatccatttatggattaaagcaagcttcgagacagtggtacttgaagtttgatgggacaataaataaatttgggtttcaagagaatgtcgaggacaactgtatttattcaaagtttaagaatgggagatttattttcctaattctgtatgtggatgacattctactggctagtagtgatgtcagtctactgcaggaaacaaagaaattcttgtcctcaaactttgacatgaaagacctcggtgaggcttcatatgttttgggcatagagattcaccgagatagaacaaagtatgcattgggactttctcaaaagacatatatagaaaaggtgttgaagaaattcaacatgtacagatgcagtgctacacctgctcctataatgaaaggcgaaaagtatggggcatcgcaatgtcccagaaatcagtatgagctcaatgaaatgaaaacaaagccatatgcgtcagctgtaggaagcctacagtacgcgcaagtgtgcacacgacctgacttggcatttgttaccgggttacttggcagatttcagagtaatccaggcctagagcactggaaattggtaaagaaagtcttgcgttatttgcaaggaacaaaaggcctcatgctgtcttacagaagatcagaatcactccagatagtggggtactcagattctgactttgcaaaagataatacaaagtcaacatcgggatacgtgtttaccctggcaggaggagctatttcatggaaaagctcaaaacagactatcactgcagggtctactatgtatgccgagtttatagcatgctatgaggcaacggggcaggtgaactggctaaagaagttcatacccggtttaaaggtggttgacagtattgagaaaccactaaagttatactgcgacaacgaacccgcagtaatgtacgctcacaacaatcagtcaagtggtgctgccaaacacattgacataaagtactatgttgtgaaggacaaagtccgggatcaaacaatcagtctcgagcacattaaaacagaaaggatgctcgcggatccgctcacgaaaggcctaccacccaacgtgttcaaggaacatgtagccggcatgggtttaagggaagccttatgaatcctggactacagggcccaaaagtaaagtatctgtttctgaatagagatgtgtatagtggctgtcgaatccatcggcgattgaccgtgacgatgaaacatgctctatttacaaatctgtgatggaatagaaaaagctaaaagaaaaagtgagatcaagggggagaatgttagatagatctctctccccttgagcccaacggctcaagggggccttgaccgcgccctgatcgggggcgcccagcccaatggctggtgggcccccgtcacactgcgccatataaaagaggggtggaggccggcacggcacatggtacgagattcaccgccgccgccaactccaccccacaaaaccctaatccgatcgagagggggcgcagccagtgacgggaaacgccaccgccgcgccacgcctcatcgccgggacgtctacgaccaccactgccgcagccgtcatcaccgtcgacctcaccggcgccgcatccacgtcaagccgcgacgacaacgacgatgtccggcgcctcttcctccacgaactcctcaaccggtcggtatctaaaccctctccctttcatctacaatgtcgttcatcaaacccaaatagaaccacccgactagatctaacctaggtgatcctagagcaaagtctaacaatcaccaccagagaaacagatgatatacgaggggaacaacatcgttatcagtatggcagaatcccgagggctctaccgtactccaagaaggcatcatcgtacatctcgtccagcgtcctgttcttgaactcgaacccttctccggcgagcttctccgacgagaggcggatcctcggcttttccgggaggtcgccgaggctgcatgaaaggtcaccatcgtcagagctctcgataagatcatggagacgcatggggaattattactcagtgagatcagctcgatcttacgcggcgacgtcgacattgtacttccggtatttg

SEQ ID NO: 48832 - DNA, 4183 bp, Oryza sativa
  unsure (1)..(4183): unsure at all n locations
nnnnnnnnnnnnnnnnnnnnnnnnnnnnnnnnnnnnnnnnnnnnnnnnnntcatctcctggtcgcctgaaagaaaatcaagagatgaacaaataaatttcacaggaattgcttttcgttgccgcatttgccatggaccggccggttcttgattcgattagttatcaccggagagcaaggagaggacggcggcgacgcacggtttggcctccgctgccggcgccgggccaacggtgaccaccgggcaaacggtcaccaggctgatgccgttctcctccgcgaccctgctcgcttccttctctgaaagaaccttcgaaagcgagtacgcctgcattgcatccatgtcttaatattttcgatatgcacaaatctatcagggacccaaaaaagtttgaaatttaaacaaatcttgaccgaatttaaatatttttttctaaattaaaaaaaatatgaaatatttggatgaagtaaatgcttgccggaaatttcgaaccgaaattgtaaacgctgattgcatcagcacacggagctgttctcatgtggccgatttaatgggctctgagcctctgattgactgacctgtgttaaataaaatctgtaattttgtgtgtacctttccgggagatgtcttgttggctggtgagctgaggtagtcgacgtcggaccatgacgactcgtcgaggacatggccgtcgccttgcagcggcctgccggagacggcggccgccgacgatgtgaggaccacgcgcctcaccgtgccggctctcacgcacgacctcatcacgttcagagtgcctcgtacaccggcttccaccagttctttctgtcattaccatcaggctgaccaagtaaaaaacaaaactactcccttcgtacaaaaaaaaaatctataactgattatgatacatttagtataacgaatctggatagagatatattcagattcatagtattaggatatgtcacatctagtactgattggtttctatgagacagaaggagtgcgtgtatgtgattctgtgtatgtgtctgtgtcatcgcaacagaaagtagcattgtttcgcttatttaaatcgcttattagtaaataaaaataaactatgatgagaaaaagatcaaacttaaaattaagttctaaattttaaatgttagcttgtaaatgtaagcataagccaacaatgaagagtgaagtgcaaagagacatttttatggaggaatacttagtatcattaatggcctggcaaccataagagacttgaggagtggcaacccccatctagctaaatccataaagataatcttaaaatatgtttccccttcctccgttttatactataagatgatttaactcttttctaattatgttttattatgataagttcataaaaaaaatacagaacatttctcacatataacaaacataccatctaaatacattcaaagttatttttaatgaaactaatttgatgttataaatattattaaattttctataaacttaatcaaattgttgtagacggctatgtaatacctgagggttctctgacttgaggggtcaccggagcagcgacgaggaaggcgtaatcacagccggcgaccgcctcgtcgaagctgccttcctcctccaagtcggcgcggaagaccgccaggggaccaagtgcgtgcaagtccttgaagtgggagttcttctccatgttttctgcgactcaaaattgcaatgtgtagcagcagtttcagaggctaaaaccaaattcctttttaaaaaaaaaaagaaaagaaaaacgaggttaaaaccactgatgctactgcaaatctatgcacgagtatgcacgaaattatgaactgaagaagaagaatctcaccggggtttctgactgtcgtgttgacagcacatcccttctgcagcagcatcttgatgagcgccgaagcgatgtacccgttgccgccggtgacgcacgccgtcttcctctcaaccgccgacatcgctggtcagtcggctcgatttcctactagcagagaacgatcgagaattccttaacccaatagaacaccaagcactgatataatggtagtggtttgatgattgtgctaaggaccagtctcatcgaagcaacaagagggtgtactatgtccgtgttgaatccggatcagctgcagtcgctactgggactgcaatttaggcggtaccagttttcatcaacggatgtagatggaacggtccagatcagcgaggtgcactattcatcgtactgtagcataaatactgtagcacagaatataagttgcagtaatagctataactgcgcatgatctgaatccgtctgtgtgtatagatccaaagtttggatctaaacttcaattctttttcatcacgtcaacctgtcatacacataacttttcagccacatcatctctaattttaaccaaaatccaaaatttacgctgaaataaacacagcctatataggagaggtgaggttgctggcctaatcgaaacagtctcatcaaagcagaaacagagacagcatttatcatatcgtaattgtggctctcgctggagtcactgcaacgtatagacactgggccaggaggacacgtgatgctgaaccttctggatacgagtactgtccaaattcatagagcaaccactgtgagcgatgatataccggcttcattctctccactcacaaaagaatacaccagcacttgaaaaatcgatgatacacggtttgtgaaaccatatttgtatacgaaaatcattaactgaaggagtcaaaattttggccagtagaccacaagaattggcaaacgcaagtacaaaaaatccctcatttccacgccttccgtcctctgaattgctttcccgagcgcttttgcagttttttcttctcctgtcgagaacgcgctgccttcgctctgcttgcagcgaggggcattttcttcttgtgttgtttctgcctattgctcaagccaccggtctaaaacgcaatgagaagcatataagtagagaaggaataaaagcaactacgaaagaacaattcatgatcagatttcacaaggttgtgccatatagccaacataggtcaaaataagcaccaaaaaggaggatcatataaacgaatacctttttctgtttcacagctgttcttgcttggtattttcctctatcctctcttccagccttcaccatttctaatctctcctctttcgtaagctttctctttatgtgagcctacataaaggaagatgttcatataagcaaagtgtggatgtgtgtgcatgagcgcgctggcacgagtgcaatgcgggaggggaagagagaaaatgcacctcaagcttggatgggtcaacccgtttcagactaagctgatcagaagaaggcattttaaaggttactgattttgtgtcatggcccttgccgagtccatgttgtgccagagccagttttgcttctttttttgcctgaaactcataacaatgtcagatatacacaacttcactttctttcccaaaagaaagctccacagcatgaactacagctggaaaaaactcccatacctttagctccttaatacgcttaaaatcttcatcagataagattttaccagcttcatcgcacgaagcttcagccttcttggctcctgccaacttcttcagagctcgaaggcttgcatctgcagcattaagttgccctatataatcactcaactttctcttatttgccttgcgactgctgttttttgacttatcatcctggtcactgtcatcatcctgatcagagccttcatcagaatcatccaatttctcactgagttcctcatcatcatcagattcagatacatcattctcctcatccatatcagagtccaattctagctcatcatcattttcttcactatcattgtcagagatgtcttgatcctcatctagttcctctgtatcatcttcatccccagatagttgatcttcctctttcataccttcatctgtgtcaagcttgtttgcttcagacgaaccatccaaattttgtttagtaccacgagcagattgcaactctttctcatcattagaatcaaaagcatcagactcatcgtctgagccttccccttctgatgaaaaatcttcatctagcaactcagctccaggcacatcagaagcgatagttgcttcgccgaatgcttttgg

SEQ ID NO: 48833 - DNA, 5901 bp, Oryza sativa
gaaatcacaggaatatgcaaaatgataagaactgacctaccggaataaagtacattagagaacgagcggcaatggaaacagctttttcatgggactttttgtataaaacaagggcctggagtagatcttcattcatcaactgcaggtataacagaacgattaacagaggcctgctagatgaataaaataaatagaccaagaatatcttcctaaatatcttacaacccgcacagtacctcaggtggtaatgtagtatacaaacctgcatgtgtgttctcaacttctcatgcataagtgactaacgtgtcaggctacacaagactaaatgtggcctggtaaaaccatgtttataccttttcaattcttcattaagttacacttatatgcttaaaacctgtagcaatcgactatcacatccttttggagtttggactacgcaaccagtcatttaagactagtaaaaaaatgaaatcacaatttctactagagcatgtccagggcacaggaattaggtacaacaaaacatgaccaccataaaaatttaatgaatccatcacacaaatttaaggggtgtctggtcagaggtcagtagcactagaaagcaagagtacagatttgagcaaggtaagtaccaaaggtattctcatgcagatctctcgcacaacattcaagccaacagcaatagcctaaaatgagattggttagaaatatgccatgttagttggaaaatacttaaatatattagatatgtgatgagtgttatgcaaacctctgggcgagaacgatcatgcacaaattgatttactatctgcttaaacagtggttcaactgcatcaggaggcacctgaaattgaagcatattaatttagctgaatttggacaaagcaaaagaaatgatataagtagtgaaatataggagaagagcaaaagtgtttcaaccatatcatggcaagcctgtactgctgcagcaagtaaagttgttacatctcgttgatgaggctgcatcacagaaaggtagaaaacttattatcaaaactagtatgaactagtataatgcacgtgaggtgcaacggtttttttttctaattgtctattatattatcattatgctaattttgctgtcatttcgtaaagatgaaaattttcataatattctattgtcatattttcctttcgacgggatctatggcatgtgggggctaagagatacgcaactcacagtccgtgggtccaccaccactaccatcttttatattagtatagagtatagataaacattatatctaccataaggttgctacaagaagaacacatgccaagttaagaacatacctgaacgtatctttgaagatatggatagaagttcaacaaaaccaagtgatgcagcccaatagtcctcgctataacctttaacatcatcatccttacctgcaagcacccaaccaacattctctaaatttgaattaacgtttattttcgtttaaccatcggatggaactcacaacagacattgtgtttaaaaaataaactattgcacatctgggttccaattctcctacttgaatgctggttccaactatatacactcatgtataaaacttcagcagaaagctaaaagtactaagtaatgatagttctgacaattatatataactttttaaatctttacagaacaaggaatcttcagaacaaggaatggggccaacctcaaaccgctcattgcatttctggagccgagagaagagcttctcagcaaaaccctgtcagccaaaaaacgaaagcttcaatataacagtcaatatgtaaatgataacactctgaacaattatgggattacaccatttcccacctgaggatcctttaaatacgtcagtggtgaataataattggagccagtgtcctcagtggatttacgttgttgccttttcatactacgaatcacacgctgcaatttagctttcttctttttcttagtagcagcagtgcccttgtgatttgcctgagaaagtaatatgacaataaaatacattatatcagaaggcacgtaacagaaaaaagatgtaaaacactataaatcgaaataatggtaaaaattcaaataaccttgtaaacatcctctttactaagaataatttgagggttttgagcttcatcttcactgctggatgcatcactatcatcttcttgctcaacgttttcatacccaagaaggaatgaaatagcggctatcataattctgcatgtaaaagatatattttagatcaacacctattaataaacacaaagatgctggcagtatgtacctagaagaaccatggaaacaagcattgcatatagcatttgctgtgcggtcatcaaaccagacccttcgacggtgaagatcacatagaatagtaaaggccctctttgctctcgactcttcctcgccctgggaaacagcgaagcaagatgcataactaaacgaggtaggaagagaatcatgaatgtattcttgccactatgttaaacccgataatactaatcagtgcaagtgtggtatagtggtatgtcacaaacctgtaggaatgtgaaaaggatgttttgcagtttacgattcctggcttcattcttgtgggtctgattcattctcctgatactgtgtacaatatgtgagaatgctagttttttgacagcccggtcccctataacttgaagctccataaataactccattgtgtcctccagatcaacaatctaaacatcaaaaagcaatgtatacgaggagaatttactctacagtcatacgataatcccgttccaatccacacgatttgaacaaaatttaacttaatgtgaaatgaacagatgaactaaacaggcgtcaccttccgattcaccagtagtatcagcgcctgcacgaggtgcacacggagcccggacggcagcgcgcgcgcgttggtgtcaagcaggccaccaatctggtcgggcaagtcagcgaggtcgtccgggtagaagggcgcgacgtgggcgaggaacagcgcgaggtcgccgagctccttggccacctcccctccgccgccggacgaggacgtggaggccagtgccgcctgctgcgggaagaggaacaccgatgactcgaagtggcgccgcagctggcggagctcctcctcgtacccctccgggtcgcgcttcatcttcgcctgcagcgccgggaggctctgccgctccccggccccgccggtggccgacgccgacgccgcctccggcgtgaacgccggcgcgtgctgacgaggcatcggagcggaaaatccggtgtcccccgccgccgccgccgctgaggtgagaatgctaaaaccctaggccgccgcaaaacttcccgggagaaccgatggcaagaggtagtcgacgatgcgagtgactgggctggccagttacagtacacgtccggcccattaatctagctaaatttggaccagtaaggcccatttttcctccctctagcaaagaaaataagtctaatttgaaagacctcggtcaaattgcatcaatcaaccgcaaaaccgggtatatcgcactctccaacttcaaaaaccggtataaatcgactcctttgatggtttgaaaatcgattttctactgatgtgttaaattaaccgtgatcaaacttattatatccgaattttactattgaaggagacaattcaattagaagcaagagatgagggaagaaaaatatacttagagcctctttatttagggaattttttcttggatttttaagtcgcctttttagtttatatgatttataggctaatggattgaagtactaagtttaatagtagggtcataactctatctagcgtaagaaaaaaaaacttcttcaacataatttttgatgatgagtacaaacgaaagaactgcatatttgttaagcttagactttccagctcataaggttaagagcctactataagcttcaaataatctatagtcaatctaatagttaatttatacaatagttaactataaatatacactaggggtgtgtttggttggacttttcaacctgcttttccttttgcaaaagtcaagagtcaaccaaaggacccaaaagcataagtgcttttgctccaagtgcttttgagggaaaaattacccacctctgccattatgaaaaaacggtccgatattcttttcctcgtctcctccttctcgcgagtcgtgacttcatggggcgagcgtcggccatcgggcgcattgggtgtccgccatcggcgcggcccccgcctttccccaaccgacgccgcccaacctgatgtcggcgcagcccccgcccttccccaaccgacgacgcccaacccgacgccggcgcagctcccgtccttccctgatcgatgccgcccccgcccttcctcaacagacgccggtcaacgcgacgccagcgccgctcccgcccttccccgaccgacgcctcctcctcccgacgccgccgccccttcgctcgtcggccatggaggtgggagacgaaggtggtgaggtggccgacagcggtggcgtcaccactgcctcatcctcctggcgccaccgctcctcaccaccgtgcgtcctcttcgtcgctgaaccgccgctaccgctcctcctcgccgagacgccgctgccaccgctgaggccgacgacaccgccgttgccatatccatctctccctcttcttttatttcaacgtgtgtatgacatgtgggggtcgctgtcagcgggactagttatttcaaaagccacagctattgaaccaaatgagcttttccaaaagccaccgtacatattccccagctacttttaagaagggagtacctatacatctttcgaaagatttttataatcgtatcacacagatttttaatctttatattaaaatccgatagatataataaaaagcaaaaagcaattaagaaacaccataatgaacattaaattaccatatcctcaagaaaaagaccaaatccaatacaaaatttaaaatttacatgtgaagattcaaaaattacagtgtaacttacaaaagttacagtgtaagtttcataaattacactgtaacttacaagaaaatgcactgtaaatttgaatgagaaaatcgagtgagagataagaaaaaaattttcgagtgagatatagcaaaatcgtttaagaaaactacagcccacagatatttttttcaaagccagagctcaactaaacacaccttaagagcttagactttccagctcataggcctaaacaaagaaggccttcttcctctcgcgaaccacgaggcccagttggctagtaatcgttcgcggctagccggcccaccggaccagcgcttcccccgccggcgtcgcgcgtacgtaggagacgacacgacgacttctccgtgagatcgcgcgaaaatcacgacctcaaccgtgcgacggggggcgcaagcgcgacatcacgcagcgttttctccccacccacccgccacgcgcggcaccggcaagcggcgacgcgcgacggctgcgcggtcgttttcggcggcacgccctgcgcgcgcacataattcattctgctcttcccccacggtcgcgtggtcctttccgacgcccccgtccgtgacaaagccaggtttggtggcgagcgaacgagtgactcgatcatgccccgggtcgccgtcacgcagcagcgccctgtgtctgcccccgctccggcgatcgacggcgaccgatcgatcggcagctagcgacgcccgagcttacatgcgcgcgccgcgtcaccttcccgcgaccgatcgatccgtcaatcttccgctaccgtgtatacgcagcagtgtcggctgggacatgtacatacattatactaaaatacagtactacgagccgctttctgaaaaagaaagcgaaggccattatt

SEQ ID NO: 48834 - DNA, 6247 bp, Oryza sativa
  unsure (1)..(6247): unsure at all n locations
catcttggcaagaggtacaccggtctaacattgactataccattgtcacgttttgcgtgaactgcaagagaacgcattactgggcatcgctaggccactatcggtgccattatgtaggagtacaaggtaatcaatacactccctaatcaaaacaggattgcaatccagaacagcggtgacatctgtattaagctcgcagatactgtaccaattataactcgattactcaaacaacaaagcactggcacttcagtggaccacgtttggcaaggacgaaacgtggttttaaggcgaaaaaactcaggagctttgagaggggacagcagcggtcatgctcttttcccccaactaataaagcaccagaaatagtaaatggctagctgacaacgtacgccaagcatcattacaccaaacccccttcacaaatccatctttaaggccctcgtctgtgggccaattgtcgaaaatacgtcgtacggcgcgttagaaaagaatagtttataggttaaatttttctatatactagaaaaaaatgcccgtacgttacaacgggtgaagtcgattttaatcttattattgttatatgttttagttaaaatgaaattcactgtgagagttcgctttatatatttttagaaaatcatgagctatatttaggagtctaatcatctcaagttagcatgcaagttttttaaaacaaatttcttatatgatttcttctgtattaccaaaagtggacgattttaaaaaccgaatcaaatacggatacatatttttaaaagcaaacaaacttaaaaactgacgtatacacatatgacgtaccaaaataccgataaaaacatcttaaatttttataatagtagagatatgttcaatgaaaaaaattaaaataaactctaaaatttaaattttgacagcggttaattctatatagaggaaccaatgggagcctaagctcttttcagttactgtctgttggcttatgatgacacgctttttatactgtttgtaaaaaacttctctatatatatttttaaaatagtcttttaaagaaactataataattaagtatttaattaattataaactaatgatcttctcgtattgcgtaagacaaataagatttgaatacgctctaccgaacgcaacctaaaccggtaaggcacaaggcaattaagacctaatctcgcaacttgacgagacgagacaccaatttactaatactaacaaacagcaaatttctaattagcatcgcgtcgattgtccgatcattctcaggttccagtgcgcgaggtgactgacaagctagcttaactattcgttgagatttcaggaagaaaaagctgtcaaaagcttaataacaagacgtggcacctctaagctgttgattcccgaaaaggacaaagaaaacgaggagagcaacgtcgcaacatgccccggcccggcccggcccattatcagcaaggcccaaggcgacgcgaatctcgaagcccacaacatcgaagttgaccgttcaacagaaataccgaaaatacccctgactaaccaatcatattacgcgaatgaccctgcccgagccggccagccacttagacctggtcaccgccggcttgggctttaaactaacaccagtggcattgggtgtaaataaatcgaaatcggaggggtggggtgggtacccctgatgcgtcagcgttcaaaatatttcgaaatagctcggccgcctcgtcctcttcttctccttcctctctctctctcttctcccacacatctctcgctcagatccgagcgaggcgagaaatccatgaaaaatcgagggtaatctccgctcggtggcttcaaaaacttcgaatccttccccaatttcatcggctccgcagtttttttctcgaggtttttcggatctaaagcgcggctttgtccgcgcttgtaagccacgagagagagagattcttgtgccttcgagctcactccatccggccccaagaaagcttcccttcttccacccaccgccaccactgaggaggagagaaccctaactataacccctaatcctgccactaatcccagttcatggcctcctccctcacgccccgtagcccttacccggtaattttctctcttttgtggaaaagaaatcgcctattttgggggagggttgattcatgggagcttagttcttgcgatttgtggggtgtggttgttgttgttgttgttgcaaaagaaggagaacttgggcaacgcgcggcgggggatgggggtcaagcctggcccgcgccgcaatgtcctctcggcaatcaacaatggcggtggcacgaacagcgacacggcgtcggtggacggcggcgaggccggggctgggccggcggcgcctgtgatcgagttcaccgggagggaggatgtggagcggctgctcgccgagaagatgaaggggaagagcaagaccgactacaaggtgggttcttttgggggatttcttggcgttcgttctgtttgagaatttttggggggcgggtttcctgaatttggttggacctgtgcaggggagaactgagcagatgagtgagtacatcaagaagctgagagcttgcatccgctggtacattgagttggaggacggctacttggtcgagcaggagaagctccgtagtacgatggatgcagagaatgcccagcacgccaagttgggtaatgaattcgaatgcacttctcttttttttgtatttatttgatcacaccaagagaacaagatggtactcttttgggttttgagcattcatgtgtgctgtttggtcatcagagtaccatctcatcgtagtgactgagtttattctggtcatttatgttcttggggtactgtacttccagaggcccagcttagcagtgatctggaagagctgaaagctgcacacctgaacttgacgcggcagtgcgattcgttggaggaaagcttcaacaaggagaaggccgacaggatggttagaactcatctatcgcataataagctgcatagttatgtactgttgctgtgtgcctgtgtgattggtttcagccacggcttacacttgttgacctttaaactggcagcttgctgtggagtcctacgagaaggagaggcagcaaagggaatcggctgaggcgtccctcgacttgctgtcggtggacctggaaagagtcagccatgaagcaaaacggtttagtgagcaagtacgtgttcagaaatgttctattagtcttacatgaatttgagtcatatataatgtcctttctgatggatggaaattgtgaactagctgaaaatggtccaagacacgaacaaaagactgcaggagtacaacaccagcttgcagcaatacaacagtaatcttcaagctgatgcctctaagagtggggacatcatctcaaaactgcaaaaagagaagagtgccatgatggaaacaatggcttctctgaaagatttaaacaattcaatgaagaaccatttggattcttctagggtgagttgtgttttttcgtgaattgataatttttttgggcagtatagttcttgtttcacttaaacatttaattgttttgatttctgttagacttctcaacaagaggccattagaatgaaagaacaacttatgaaagaagtggattgccttagaattgagctacaccaaattagagaagaccgtgatcagtctgtttctcaagtaaataccttgagtgctgagcttgctaattacaaggaactagcaggcaagtctacaaaagactgtgaaagcttgagtgtaaaagtgtcagcctttgaggttagtggtttcagattaaccaaatcaatactttctgtgcgcaactatttggctcaccattatgcttctgctcaggaaacatgtagtatgcaacaagaacagattcaaactttgcagaaacaacttgcagttgcaacaaataaactgaaggttagaaataatattttgtcagtgctgatttacatgtgagatatgattatatgacatttgatctaattgtttacttttgcagcttgctgatgttactgcaattgaggcgatgacaggatatgaagaacaaaaggtgataataaaagatctggaagaacgtttggcatccgcagaatttcaaattgttgaagctgacaagctacgaaagaaactgcacaatacaatattggtaattgtttcagcatactagcacttcttactaaaaacaatttctctattttactgacagaagaaatttttgagtaaatactgaaattttttcatcttgctattgctacttgttactgattagcctttctatttgcaggagcttaaaggaaacatcagagtgttttgtagggtccgaccacttttgcaagacaacgattctagtggtgcagaagaagcccttatttcatatccaacatcagttgaatctgccgggcgtggtattgatttgatgaaccaaggtaaaatcatattcattgttgaagctaaacagaaactatgtttcccccactaagttttcagtggtaaagttaatcggagacttcattttattgttttgtgttgatgtaagtcagagattttccttctcatatgacaaagttttcgatcacggtgcttcacaagaagatgtgtttgtggaaatgtcacaactagttcaaagtgcacttgatgggtacaaggtatgaatatttcactacaacaatgaagtattggtgaataatctgttcatgaggttcctgtctctaataactcaaatatcctaactttattttttttatttcaagaacaaatgaaagttgttttaattgatatggtggcaccccaaaatttatctcttcagcaccaccacataagcacaaatacatgctaaaagccgtgaacatcttacattgatgtttctagtatatatcacctgcatcctgcatttgtataatcaccattattttgaaactctgactgatgtttctagtttaattcagttttgaagtacttggcaaattggtatgcttaagtatttnntgcatgatgcaggtntgcatatntgcttatggtcaacaagggtctggtaaacttatacaaatgatgggtccacaagggcgtgatcagaaaggcatcatacctcgttctttggagcaaatttttaagacaagtcagtctcttgaatctcaaggatggaagtacagtatgcaggttagtatccatagtgcaatgcagattctgaagtgtacattctatgtagtgttgctgagagtttttcctatgtgcaggcatcaatgttggaaatatacaatgagacaattcgtgatttgttagcacctggtcggtctaataactttgatctgtctaccagtaaacaatacaccataaagcatgatccacaagggaacacaaccgtcactgaccttactgttgctgatgtttttagtagcgccgacgtaacttctcttctagcgaaagcatcccaaagcaggtaaatacgctttattcatttttaatcattcacttgtgccttgtaactgtttgctctaagggtattgaccattatcagtttaatgttatatttgaaatagcaatgctttggatatgtctagatgattctctcatctatcactcaaatatattagagagagcagaaacataagagggtttaccttttatacaagctagcacttattatctgaattcacatgtgtctgttagccacctagtctacatatcaacagtgagtctaaattttttttcaccacattgaaccaggtctgtgggtaggacccaaatgaatgaacaatcttcccggagccattttgttttcacactgaagatatctggatcaaatgaggtactcgcttcacccatattttagaatattaatcacagtgctgaaactttacaaactggtcacaatattttttttttcattttcatgctaactaaacagaaccactgaaacttgagcaaatgtatgtcactaattttcttttgatcttaatgcagaacactgggcaacaagtccaaggtgtccttaacttgattgatttagctggcagtgaacgccttgctaaaagtggctccacgggtgatcgtttgaaggaaactcaggtgagtgtgttcatcacaaatttacaatattcttatttgataatcacattgtcttatctgtttgttttctttatgtttcaggcaatcaataannnnnnnnnnnnnnnnnnnnnnnnnnnnnnnnnnnnnnnnnnnnnnnnnnnnnnnngggt

SEQ ID NO: 48835 - DNA, 1292 bp, Oryza sativa
ttcaatttttctcagactattatgcccctgagactctttcttctcctcggttcaatctagcgagcgtgagaaggtgagaagagaatcggcagcgacaccggcgcccgccaccaccactgagccaccgttacctcagctccagccgccgcgccgaggtcctccccagctgtgccgatcgtcctagtccgcccaattgtgccgcctcctcgatgacatacaccatgagtccatgacatacaacctcaattcatgagttcatatatataacttgcaagcggtttaattttcatttaatttcgcatcaagcagagctgccgacttgtttaattttgtatgagcaagttcgttcgctttggttaacccaaacgaactttaaaaagaagttgcaaaatgtttttcgaacatacaagaagatactactagaatagaagtcgctttgtgcttgaaaattatacacagttgttgatttcagaatgtaaaatcggcacatcattgacacaaaatgtgaacaaaaatatttaccaggcaccagaggaaattacacaggaggcaaaaaaaccactatgaattcagagaagagaagaaaaaaaaatgaaagctaagctcaggggtcctcagtgatgcacgagaggtgcggctgccacggcgaggcatggctcccggtgctcatgcgccgccggtgttggtggtggtgttgcttctgcaccctcatcatccttgtcgtctccggcgacgcgctgcactggctgcccaaccaatcggcgacggcggcgttgccctccgacttgctgcggacgtggtgcccgtggccggcggcgccgccggtgctcgtccttctcttggcgtcggggacggaggcggccgggatgaggaagtagatctcgccgcactccagcttcgactccggcgacacgatgtgtatccggcccatcgccccctgctgcgacgagcactgccggctaagcacgtggttggggtgcgccgccagcacctcaccggcggacacagcacggccgtacgcgtcgatgcggccggctcggtgcctagggtttcgctgaggataggcggcggctggggaggagactcaccggggagaggcggcggcgcagctgttggggggcgggaccggtgaggcacgccgcggcggcgatgcagtggtggtgggcggcgccggtgtcgctgccgcttctcttctcgacttctcgcgttcggtcgctagattgaaacgaagagaagaaagagtccgactgaatcagttgactcaggggcataatagtccaagaaaaattgaa

SEQ ID NO: 48836 - DNA, 2398 bp, Oryza sativa
ttttaacaagaaaggaaattggataaagtgttgcactacgtactttgctagcgcatatacactaaataaggaacccccgaggctgcatagcacgtttctttttgggcaaagtggatggccactatccggataagctcttttgggctgagtttggatgtggtgctagaaatttaggatttttcacaaatgctaaatgagactaaattattagtgtcaggttaattgaatactttctccattttcatagtattgttgttttgaattttttttctattctacctttttaaatttaatcaagtttataaaaaatatagcaatattttaaaacagaacaaacacattattaaaatatctttaatgtagtatttaatgaaattaattttttttacatgttgctagtttttttttataaacttagtcaaaccctttacttaaaaggtttaactagatgatttataatatgaaacggagggagtattaattactataaatatgacaaatggttttattagattttttttaaagaagctttaaaacttttcataatatacatcatttaacagtttgggaagcggctaaaaaaacaagtggcatccctaacagaccaaatgaacggagccttggtccctcaaaatggacatctccttatttcttacgtatcatccaaatgaatcttgttaatttttttaaaaatatatataactatttaaatgacatgcaagaccaaaggataccctataaggtattaattttttttgccattatctactgtgtattaggctcatcttaaaacactgtatttttttttctttgagatgtttaaaggcacagaccacttatttcacaagcgcatatatagtttggtcctcgtgacatctaccccctctatcccataaaaaccatcctaaaccatcctagtactgaatgtgacatatcttagtattacaaatctggatatacacctgtccagattcgttgtactagaatatgtcacatccagtcttagtttcgtttttttggacgaaaggatatgtcacatccagtcttagtttcgtttttttgacgaagggagtaggttgaaagtagagcagcatgagctgttcgttcaatgtggtagaattcccagggccctgccttactccacaaggtcatcaagtatgtcgcccaaattcgtgtacttgaactcgaacggtcgaacccttccctgatcagcttctccgacgaacagcagactctcggtttctcaggcatcccgtcgaagctgcaaagataacagagatcatcactcgctcgtcagatcgaacacagcatgcatgtatatctatgttggatttcgaagttggccaacaattcgatcgtaccggtcggttttgacgttgtactgcgggtaccttccggccatgaaacgggcaagcgccaagacggtggtgttgaagctgcagcagatgtacctcgccgacgactctgccgacgacaatgacgatgactccttctcggcgaggaatatctcggcgcggcagaggtcgtcgacgtgaacgatcgacacgtagccggtgaacgattgcaggggcttcaggacttcgagatgcgtctcatcacctgagaagtaataaacagaagccaacttaggtgtgtttatattcagagacgcggtaaagttttggcgtgtaacatcggatattatatagggtgtcgtaagagttgttggggcattaataaaaaactaattacagcatcgctaataaaccgcgagatgaatttattaagcctaattaatttatcattagcgaatgtttactgtaataccagattcgtctcacaaattagtcgtaatcttgtaattagttattttctagcctatatttaatattttatatagctgttcaaatattcgatgtgacggggtgtaaatttttaaggtgggatctaagaaccacctgcaagtgttgagactttggtgggagctagcttgttgatttgatcgctggtgctggtgcttctaactcaccggatagcagggagaggatgccggggacgctcgtcctcgccaccggcgccggcgctgcgcccaaggtgaacaccgggaatacggtgacgaggctcatgttgttctcctccgcgaacttgcatgctgccttctccaaaagcaccttggagacacagtacgcctgcaaacgcaaacgccattttcaaccatacaatatttatttttggtaaacttataaaaaaagtctatgtttagtttattgctaaatttagtcaatatataagaaatcctgccaaaattttgataatattagcatcttgccaaaattttaacattgccaaaacttggtaaggtttatttttgttacaatctaaacaggccctaaatttagagaacttttctatacaatat

SEQ ID NO: 48837 - DNA, 2804 bp, Oryza sativa
ttcgccatgtcatctgaatacaaatcgcagcaattagtagaatctttgagaggtgaaactgaactctgaaaattcacaccatctttttgagatcatataaagtctcataataattcgatccatcatatgtcacgatatgtatatatgtaactatcagttggaagttggaaaaggataagattttgtcctcatgtgcggctaagcctgccatttgctaattggttaagcgaaaacactcgctaaaaagctcatatggtactagctggcctatgatttcacacctgaactgaatggaagaaacactgcaaaaaacatgaacttagagagtgaaaaaatgaggaggagaacctcaccggggtttctgaccgtcgtcttgacagcatatcccttctccaacagcatatcttgatgagcgcagatgcgatgtagccgttgccgccggtgacgcacgccgtcttcctctcaaccgccgacatcgtcgtcgtcggtcgctacaacctctccagcccagatgacgaagaggacgatgaatttatttttgttgctgttctttggaaagagttcaatttgtgtagtgagccagtgaggtggtctggcgtgcttatcagtaagtattcctaaaagaaacattctgacgagcactatatccagaatatcacctttattataaaataaaaccggtgcggtgcgagttgggtggttgattgaagtgtcaatatggagtggacaaatagatcgtcatatcacgctgctctcagcaatggtaagcatagctggtagagtactacacaatactacggtggtgtttgaatattgaagatgaagatggagattaaggggctgtttggttcagatactaacattgactaggtttaccatgctttcttaaccaaacttgccaaagatgaggccatcaaaatccaagccacactctagccaacaaaatgaaaccatgccacactttttagagacacttacatgtgggacctagattacaaaagaggaatcttgccacacttgtggaagccaaccaaacaatcatctaacatggtcaaacttgtctaaccttaagtatggcaaagtgtagtaacttatggccatcaactaaacagcccctaagtttttatgcaaaacaatatgctattaacgtatgattgattgagttttaattcttacaaacttgaaaaatagattaatatgatattttagtgcaacttttatataaaaagtttttgtacgaaacacatcatttatcatttaacagtttgaaaagcgtgtcacgaaaatcttaatatttatctaagtcttgtggaagaaaagaactggacctgagtcatgcattcgtgcgtctggactgacatgtagattcatggccgaccatcgacttacaactgacgttaatccgggcgtgcgtcatacgcattgtccgtaagccgatcgagagaggggacggtaggtaaagtacaatcgccccgtgtgtcgtgtcgtgcaccgtgttaattgggggaaaaagtacacccaaggtccctcaacttgtcagcgagataaaaaaacatacttaaaccataaaaccatatatatatatagtcccttaactaaacaaaaccgatcacccgagatccttcggtggttttgaccccgatttcggtctatgtggcggctgagtcagcatgggaccaacgtgggtcccatatatcaggatgccatgtcagccggtcctcggttcctcctctctgttgagcgcgagcgcgaggcttgcaggcgagcagatggttgaggactctgcgagctcggaccggtgcacgacgcggaaggggtccgggtgaccggcgagggcgcggtcgacggctgcaacgcccacggcctcggcggcggagaggaggagatcggcgaccagcgccgccgccgccgcgcttcctccacgcgctagccaccaccgcctccacggggacctcgccgtgggcggcggccatcgtcgacctcgccgcccctagggccctccacgccggcgcacaaggggcttgccgcggaggatgagcggcgtggagctccagacgcgccgccagcgggaggcgagcgcggcggtgcgagtcgcgcccttgaagggaggcgggcgacgaggaggtcgtcggggagcgcgctgacgcggtcctcgccgtcgtatccctcggcggcggaaagcatggcgccgttgtcggaggcgggatggccggggaaccaccggaggcggacttggacgtggcgctgtcgtcgtcgtcgtcctcggcgtcggggaagaaggtgggcgcggcggcggcggaggctagggggttgccgcggctagtgtggatggaaagctgaacattgcttcttcagctccaatatattgtaattcacgagcctttttattttgatggttgcttcttcagttcgaaagatgtctctgtttttattcttgttcaagccattggcaagtctgaagaacctagactgaattctatactgtagtacagttctaccatcgtcagtacagtataaagaagcaatcttttgaatccttttcaagtaggagtatagtatgagattattatagcctgtcaacttgctgtttgtaactagccaatgctaatcttttcagctcgattatgatatatatcacgtcgtcagatttgtgcaaaattggtatagagacattctgaccgggttatggtcgatgacactgtccatcatctgagagtttgcaagtctctgaactctgaacattgcccagaatctcttacaggaatctttttgttggtcttctcatacagtatatatcattggcc

SEQ ID NO: 48838 - DNA, 1604 bp, Oryza sativa
  unsure (1)..(1604): unsure at all n locations
gaccgggttatggtcgatgacactgtccatcatctgagagtttgcaagtctctgaactctgaacattgcccagaatctcttacaggaatctttttgttggtcttctcatacagtatatatcattggccccttgcaagcagaggacaaattctctttgcattcgtatgcattttaattctgcgaaacctgtagcttgtcctgtgtataaacaacgagaatatcatctgtttatcattccaatttccaagtatcaacttctacctcgaccaggagtaatacagattctgaagtttataaacacatctctgcctgaacaagatggacacctactgttttcagttcaccatttgatctttaccagataaacctgaagttcaaaccgtgcagcactgcagccatgtttcccaagatagaatgacgcgtacacaagcttccagcgtgtcgagggcgaggtcgacggcggcgccgcaccgcgtgtgccagcaaccccaggcgccgcaccccgggagcgggccgctattgggagccgccaccgacgcctgcctgctgtacagaaactgcagcacgagcacgagcaccagcaccttgtaccgcaccagccgcggcaaccccctagcctccgccgccgcgcccaccttttttctcgacgccgaggacgacgacgacgacagtgccacgaccttcttcttctcggcaccggcgcccgccacctcttgcgcgtgccccacgcagcaccacccttcccggtggcgccgccgcgccactatgttcgttgccggccggcttccaacaggagaaaagagtgagagagagagagagagaggaggaagggaggatgctgacggcggcgttgcctccgccggcgcgacgccggctgccggaccttctnctctcccctccccccggcgcctcctcccccacagcgccgcccgtcgccggctgagaaaagtgagagagagaaagggagaagaggggaaataagaggaaagagatgaggtggcgtgggttccacgtgggtcccatgctgactcatccgctataaaccgccgaggaatctcgtatgatcggttttgtatagttaaggaatcccgcatatctggttttgcggttcgaggatgattttgtatctcgctgacaagttgagggaccttcggtgcactttttccgaattttttttatttttaattttttttattaaaagttttacaaaaataatttttcattttgaaaattgacagaagtggtcgcctaccgccctctgggagggcgatttttaaaaatcgccatcccagagggcggcgaaaatgacgtggcagacggccgttcgctctcgggcgacggccgtcaacgaaatttgcatgcggcccccttgccgccctccgctagggcgattttgtactgtgcggggggccgcctgcaaatgggcggcgagggggcatggaattttgcaggcggcccccttgctgccctgggggagggcgattttatactgtgctatatttttttttataaatatcaatagttatcaaatctttttatattgaaaactatacaagattaaaatctccaagactggtaaaatacaattttattattttttaggg

SEQ ID NO: 48839 - DNA, 1075 bp, Oryza sativa
atggattaattactacaactgttttactgctttcaactactgctttgaaatgccggctttatgcaaaagaacctttagcctcccttggatatatcttgcatcatacctcctcttccggtgtgacttgctgagtacagtgggtagtactcagtcttgctctcttttcccccacaccagagttgaagtccttctcagttgaagatgtctcgaagaggttggtttcgtcgctgccgtcaagaatgcctgtggaatggagtcgcccgctgcaggagtcaagtcttcaggcttagctcgcttttctctttttccgctgcatttgtaatcttttatatttttgtaagacgtggatctgtatgtcaacaattgtcgtttgtgtaccctggccggtcctggacaggggtttaatgcacattcagcttagaaattctggttcgtgaatttctgggcgtgacaagttggtatcagagccgaccttgaccgtaggacaagccaactggaaacctaagagccctctgaacccctcttcatctgcatatgctttttgcacttggatttgtttcgggaaaaattttggggttttgttcttctgagtttgtgggaaaaatcttggtcgcttatttaattggatttctcgactagggacagtctagggtttggtaaaagtttatttggagtttatttgacagtcagttgggaatttatcgggtgatatgcattaggtcgtgtctatgttcgatggggcaattttatgcgcatcattttccatgcaacaagtttatgcattaagctatggtttagtcagtcgcattagtgtctttatccgggttcatgaaaaatgttctatgcataaaaatcatcatgctcggcgagttacttagtcatttgttgctttatttaatttggttttgagcatgtgttggttcctatccctctgtactctttagatgtcagacctgttcttcgatcgcaagcgccgctccaagcttcagagtcgccgcccttagcttaatcgtcttcttagttttgtttgcttgctagtttccgtgcttaggtttgttgcttgtgggttagtcgg

SEQ ID NO: 48840 - DNA, 849 bp, Oryza sativa
taccgtacaaatattttgttagtgccaaaatataagcaagttttggcactaccaaatatttggtaaggtaaaattgcatttgatcatatttggtttgctgccaaaatgtaaaattgtagtgaagaatgttctacataatctcaaatctagattatgtattaccaatgaataggcttccattttcgtgtgttgtgtgctagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatgtcaacaggcagcgccgaaagttgatagtgataactcgagctgccgcttttcatgtgtgctgttgtggactgtacgcgctactggatctgacactaccatgaagcgccgaaagtgcgttgtcgtgagcataagttgttctagcaccatatgaatgaaaagaactatgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgcccctgggagtacgtgagtcggtccgggggtacggcacgggcaactcgttctgcctgtacaggtgtgacctctggctgctcctgagtgtgcgcctctggagctcctccagctgagaggagcctagtacgtcgtggtggtgtgcaccgtgcaagtcgtcgtcgtagaactggctagtaggac

SEQ ID NO: 48841 - DNA, 1496 bp, Oryza sativa
cctatgcaagatggaaataaaaaattcagtagttgtcctatattatgcaagataaatgaaataattgtaagaagtaatacaaattcgacgtacccccacgaagtagtctcggtcacggtgcgtgggatacgcgtccgtgacagcggcaacgtgcggctctggggcgtctggagtgaaggtcacacgcgcacgagtgcgaggaaggtaccagcgaaggtagtcacggtagttctcctccgtgtgtgggaagagctcgttgatcacctcctctgtagctaacacccagtcgtcaacgtactgctgtacacgtggagcccaaagtgcgcctgctagctgtccccgtcgagtcaacatgtgaagagaggtacattatatggctcgatgatcgcttaattatcataaaaatttagaaatgaacaatccgaactcacgagtggtcggcaaggaggacggtcggctgcacgttgcccggaaacacctgcctaagtccgaactgtctcatcacatgctgcgggcagtgaggctcaacgaaaatgtcgaacaccatcggcaggatggtgagccagtaagcctggtcgcgtgtgcacaaggacgaaagtcctagcggtgctctcgcagcgacggcttcttctgtgtacggctcccagatgacgtcgctcggcaggagacggtcaaactcgaacacgaagtccgggtaacctcgtctcacctggacgtgagcgtaacgacgctgcaataaacatgatcggaattagacatgttatgtgaagaaaaaaagaagacgactgataaacttataacgcagcgaagttgcactaaccccacgtcgacaccagtaagtccccatcgtgggaccgtcctctggccactgcgcgctgcgaccaaccccgtagggtgcgctgtccaccactggtcgacctatggcaaacctctcggctgcccaaagctgaagcaacatagggcagccagcgatgatcgctcccgcgtcagtcttcgtgcacgcctcacagagggcacggtacgtggctgctagcacggcagaaccccagctccactgtggcacgtcctgtggctgagcatccgcgatgaaccgtgcgtagtggaccagccggaagtccacagcgtgcccgtgggtgctagtgaacatcacccacccgaacaacaacaacaggtacgcctcaagggagcgtcggaccgagtaatcatcagcgtcagggtgcagaaggtccgcctacaattaagaatgaaatgttagtacaaaacactctgttgatcgcaaataagcatgtatgataatacaacttatttacttacagtgaactggagcaaccaagccttgctaggcccgactgtagagtacgaagaaagggtgttggccggtcctaggtgtggaaggcgcatcacctgctcgaagcgcgcagtgatatcctcctcccacccaaaaacacagtccacgggaccaactggtgctcccgccagcggtagcccgagcaggt

SEQ ID NO: 48842 - DNA, 5245 bp, Oryza sativa
attaataatactgtgtagctctaggattcgtctttataaaatggctttgggcaactaagtgacttttaaatgccgttacgtgaaaacttacccctatcttattatccccttgtactcctttgcattaattgtgcatctccggtgtggcctgctgagtactgtggttgactcattcttgctcaatcttttccccccttcagtaagagaagctttgaagaagaagtcttaggtggagtcctggcttataccccagttgagcgcctgtgaagatggagccgtaggcccgctagtccgctgctgtttatttttgtttgtcaggcctaaagtacctttgtaataatgtaaatattatcgatataataaagatgtgtcttttataccatgtttgtgtggtgtacccggcttttcctgggacggggattaatacactggtgttcgggaaaaggcaattttcccggtcgcgacaagatggtatcagagccatctcgactgtaggataagccaagtggataaaacctaaggacatattttataaataaaactatttgcgaaagttccttttttttctccttcccctaatgctatttgcaaaaggtttactcccttcttccttcttcggatttccactagtactagatggttagtttgcgaagaagaagatgtcgccaattgttcgccgaagctccggaagactgcaggatccgctagcgaagtggaggaagcagtgaagccagctgtgaagcagtgaagatcttggagaacccgtcgcagaacctaagccaccctgtagggtagtgttgttagtcgtgtgttccttgcttgtgtgtgtagcgcgtggtttgcatcggggggttgtgatgtaaccatgctaggttgtttgcttaatcaacttgcagaataagtgaaacaaacaacacatcaacaaagagagttagttcctttaaggtcctgtccctagttctggtctattctttcctagcttgtttcctctctcacctcaatccctgtaacagatgtttaacagagaaaaaggaaagaatgtcagagggtatgcctccagtaactcaagttttcaactcaatccaccactggcctcaagagagttaaccagggcacacccttggtccattccaagcatgccgcttagttcacagctaccattggttggaagtcaagaccaaaatcagtatgtgtttgatcgagcatttgccacccaggtcaatgagcttccaatgccagaagaggatgtccccttttgtcacgattgtagagaacaaggacactatgccctgaattgtccatgggtatatgccaaagaagccccttcctttggtttaacagggcagacatcgctaaaccagcctcctcgcaccaagtcaagcttgcagcctagtgtgcaaagtagagagcccaatggagagaatccattgaatcccgggaattgctttcctcctagcccttcgtaccacgtggggtcacgtactaagcaagccaaaggcaagaagagtaagaatcagaagagaaaagcgccgatgcgaactgaagaagaagtacgtaagatggctattagcagcaccgaatggcctcccgcagggataactattcctagacgtcaaagaggaaataccttccgaggtgcacgacagttgacccagcaccttctaagccatggtggcagagtatctgatagtgaagggtcagatcaagtctcctcggatgatgaagatgagtctccccgacatctcggtgaggaagagatggaatcaaaagcatgtatccgttgtggagaaattggacacattgctagcatgtgtctcacactctgcgcttattgtgaagaagaccatccaccaggggagtgtcccacccgcaaggtcacatgctttctgtgcgaaggtacaaatcatgtgcccaaggattgccaactcagtgtgttgttgaccaagaccgcagaaatccaacgaacgaccctacgattgtctcgtcagctagtcagctccaacagcaacatcgacgatatcatccacaacaccaatgctcctcctgctccacctaactctgcaataaatcatagcaataatatctttagcaccaaccattctctgcaccgacagcctcagcaaagagttgtcgtcgatggaagaagttgtgtctctccccgacctactccaggccaagcaaagggcaatcaacctcaggagggcgataccaagcagaaaaccgtcatccgcttcaaccagcaatcagaaggaagcttctcctgcgaatgatagcattatgcagtcctatcacatcatcacagaaccaatcaaggatgatgcagtcactagaacaatgccagctatatctctccggaatcaaaatgagcagccatgtttgtggttttcagtttgctacttatcattgtgtaatcgaaagtatgcagcaatcatgtaataaacaaatatattcatgattttaaacaatgagcttgctatgtttagggatgattcatgttgaggatacaatgtaccaatgataagcaccttccctttttgtttaaggcagtgccttgtattcgtgtaataagggagaaatgggtaatacagacaagttctaagaggattcttgtggaagatgcggatatgtgatcatatgtataattgtttactgacaaggagacctagggtctcgtgtcagaagaactatattataaactcgagttaataaccaacctgttgatggaaaagaaaaccaattaaactgtgttgggttaaaaagccaatgagacagtagttggggataggagtttggatacgccttttacagatcaagataaggattgctggatgaaacccataagggtacccgccatgcctctacattgataagttcggatatacctgcaaacagttaagaagatccaggagacatcaatatttgagaacatagtagtcgatggttggtaattagtctatcaggtatcagaaaagggtcaaaggtgatatggcagaagaacaatttgggatgctccccatctcgaggaagcactaaagatgatcatcggcaattaaaccctagtggcatagatacagatagcaagcaacgtatttccttgaaggtagtcagtgcagctttttgacgaaccacatcaaggtttcacggaaaggcagcaagccaaaggacctcatcgtccccagaagcgtccgcaatccacattaaagaataccacctgttagagataagccgaaagatgattgataaaagagattggcaaagacgttctccagcatgaaagaagtaggccgaaaggtgattgataaacagaaacatgctctgcatcgctcaaggaagacccctgatagtaattgccccgcaacagtcaccttgtcattaagtaagcaagatgacctaggtaaaagtgtttctatgaaggcaaagagtgaaatcttcaactcggtatcagatgctgcacggagtgaaaagtgcaagcaccggttaccaggcaacaccatgtcttgggagattgtcacgcccagaaattcacgaaccagaatttctaagctgaatgtgcattaaacccctgtccaggaccggccagggtacacaaacgacaattgttgacatacagatccacgtcttacaaaaatataaaagattacaaatgcagcggaaaaagagaaaagcgagctaagcctgaagacttgactcctgcagcgggcgactccattccacaggcatccttgacggcagcgacgaaaccaacctcttcgagacatcttcaactgagaaggacttcaactctggtgtgggggaaaagagagcaagactgagtactacccactgtactcagcaagtcacaccggaagaggaggtatgatgcaagatatatccaagggaggctaaaggttcttttgcataaagccggcatttcaaagcagtagttgaaagcagtaaaacagttgtagtaattaatccatattaaccaatcactgtccaacgttacaccacgttgcaacaggcccaaaccaccacctgacctaaccagttccaaaagctaactagggtgaaactaatcacggtgaatctggtcgaccgcccataaccgcgggcacggctattcgaatagttttactctgatcagaggtgtacaactgtacccacaagacacagccccacgacacgttcccgtgcgccgacatgccaccacgacataccggaaagaggccgtgacaggacccttcgcataaccccctctaacggatcgcaccacacttaagggttcgcccccgtccccagcagcaaacggcaagcccccttttcgtgccgcggtgaatccggcagccgatcaaccggacaccccggccgacccaattccatcacgcccaccctcgcctgggtacgtcggctagagaaaagctacactacaagcccagccgttgcccacgctggcttgtggtaagtacgataaattcttccagggcatcccgcgaaccggtctttaatcgccatgggcacgtctagcaaaaccatgcacccacagcccaccatgtagtgtattttaattagccaacaccattgcggtggcactaatccaaagctattgccaataatcaagtctatgctttaatgtggtccccttttgtgcactagttgaactaagcatggctaagcatctcctaaaccaacatctagtcattttaatacccaagttatcattggcataagggaaacaacatatagctgagtaataggacccatcccacatgatattgtaaaacaatgcaatatttaatagaaatgcgggacatttgtaaattaggtacaatatgatcaattgcaatgtatgacttgccttgctctcgcactgatggaaccacagcaacgtcttcgagaaactgcggatcgacgaaacgggcgaaatctacgcgacaaacaaagcacacaagcaaaacatgctataagactactgaaacaggaaacaaaaccatttttaatggattctacacatttttcttgatttactgagacttgaatggacttaaacggagctcggatgaattagttatgaattttagaagattcactgtgtttttactaataaagaaaaagtccttaattaattattgcgcaatatattccagggctgacgtcagcacggggtggcgcggcgccgacaagcggggcccaccggtcagcggcccggggagagagaggggaagggcgctggtacacgggcccactcggcagcggctcaagggggggg

SEQ ID NO: 48843 - DNA, 725 bp, Oryza sativa
  unsure (1)..(725): unsure at all n locations
ccgcccccttggttgtacgtcgctgcaggaggtcatcttttcattaccggacctggttttttttggttttgcctctggggaataggtcataatgctaatgaaccctttattcttttggcactagatatctggggactcaacagttgtcagaaaagctcttcttcaagtgtcatctcgtctccatgacaacccatctaggtcacagcatcttcttgcatccagcatgacacagccttatccagtgggctcccaccttggtagttcctcaactgcaccagttgtggggattacgcctttaattagttcttatggaggatacaaaggtgatgtggctggagattggccttctatatatcaaccacggagggaggagagctctgcaaaggaatttagcttgcgccttctttgtgctgcatcaaatgtgggaggtgtaattggaaagggtggtggaattatcaaacagattaggcaggagtctggagcctttatcaaagttgatagttcaaatactgaagatgactgcataattactgtttctgcaaaggaggtgcttttctcctacggtcctctgctgatttagcatccatgcggatatttaattctaagcctgatcaattccgctttctctttctcatgcagntcttttgagatccttgtctcccaacaataaatgctgcagttcatttacaaccaagatgcagtgagaaaactgatccggaatcagc

SEQ ID NO: 48844 - DNA, 2033 bp, Oryza sativa
  unsure (1)..(2033): unsure at all n locations
taaaataaaaaaataaatgttcaaaaacaaaagaggtatttttacctttattaaacaaaaaaaatagatccaaaaaatttaattaaaaagtaaaaaataattactttgaaaacctggaaaaatagactatcaaccnttggattgcagattataaatttgcaaaaaaatcgttggataaaacaaagtagcttttttcatgggttaagggcatattaatccatagtagcacttgaataaaaatttttaaacgtcttgctttttgtatggaacttaaaaatatgtataagtatattaaaaaaaaatgtttaggtatcaaaaaaataatcttaaaaatatttgttcgatatattaaaagccttatgttaggataaatcaaaaaaaatttttataagaaaaggtaaaaaaagtcaaaatatttaatatgcaaggaaaaaaaaaaccataacgaaaaggaaaaataatatacaaaaaatgggttaaaggtgtaaaagtgaaaaaaaaccaagataagagataatccaatgaaatttgtatataaaaaatagaagaacaaggcaaaaaatggaaaaaaatttaatatacaataaaacccgccgctgctgccgtctcacgtggccggcgtgcgctacggccaccaacaacaacaacaacaacaacaatacgtacgtgaaaatcaaggaattttttcttacatcatccaatcaaaaccctagctgacgatgatattggtatttatatgtgcaggttggaaatggagcagcagcgcgaacaagagatcaccatttcactccgtattattacggctcatcgccactgcagaagcagcagcattacactactactcctaatgatgctttgaccaggcacgtgcctagcttaattttgccttttgatactgacaaagtcagagcaaaatcttacttcctactcgtcctgacctagcctccattttaccctctgctaatcactaaattttcttaattctgcgtgtttaattgtgttattagcaggctattacttgcatcaaacagcagcagcagcagcagccaagcttatttccaacgtcagatcaatcaggatgcttcaggcaagtgcgtcgtgaacgcgtcccctctcctaagacagcaacagggttcatctgatcaggtatatatatgtgtacttgtgcaattgcgcgagaaattctgctagttaattagttactagatagtagcaatataatataatagttaatttgctgctacagttgttacatatatactgtagcagtatataacgtaaaagttacagttttgtaataatttttcacactattgctgaagcaaactaaaacatatcgctaaaattgcagtaaacgaatagtttttttaaattgcagttttctgaaatttactctataatataattgacactgctctaatgatatatatgcaggagctatacaggatgcagctgcaggattatcgccgccgtcgagcgcagccgcagatggagctgcacggcgagacgactgcggcggcgagtagatctcagagtattattccgtttgtgaacctcgtcgacgacgacgacgacgaggaggctgctgccggcgacggcgccgggaaagaattggacttggagctcaggctctagacaaccacgcgatcaaatcaaccatttgtggatccgcacattgctgtcagattgttgagatttaaactgaaacgaacagattctttgttctttgcatagaaagttcagttgtactagcatttgggggtaacttattaccccggagacgccctctttcttcaatatatatattccaaaatttccaattcagtggtataaatttgcaactcaaaagattggaacgttgagttcagtagtaatttatttatactctgaattcatagtcgctcagaattcagaaaacacttctgatttctcatttctgtattgaaaaactctaagcttacgtaattacgtttcggtttaaagtttacgtaaaagtggagggcgcctncacccccgccgtccaagtgccagct

SEQ ID NO: 48845 - DNA, 1734 bp, Oryza sativa
  unsure (1)..(1734): unsure at all n locations
tagggncttgatggaattgcgttctactgcaagtagttcatcatggggaaggggaggtcttggaagccaaggtcatctatgacagggagagtggcaggtcaaggggatttggttttgtcacgtatggttccgctgaagaagttgagaatgcagtttcaaatcttgatggcgctgtgagttttcactaagtctggctggtttcttattctcatatgtctttcagcatcattgttcttttagtgtgtgctaaaacaagcctattttctttgttgtgcaggacatggatggcagacagatccgagttacagtagcagaatcgaaaccacctaggagacaatattgaaattcgtttagatgccctgaagcctatggttagtccagatatgaatcatactatcgtcatgattgttctatagcatcgatggaattctagtcgtaacttccaccatatggttcaaaagattggtttggtgatgagatatatatcattttgttttaactttttgaacccacttttttttgttatgtatggcttgttccttgaattatagagtaaagtgcacggccggtctctaaacttgtgctattcaggtctcataatttgacaaagtgtgtcattccggtccaaaactgtcataatcctttcgagatcctggcgctgacatgatataccacatactaagcaccaacatggtatcatcagtaactacgcagtatgtccacatctgtatttctagattgacctgcccttccaacttggcatctcattgaatctgctcagtatcttgagcggatagaccaggttgggctgatcttgttttattttgggaacaatttcgattgatggggctctgacgggaccaaatatacttggactttttttttaccagtatacgttgtacgactccattttccaataaaaaaaaaggtgaatagcctatgaagtttcgcttcgagctcaatttagttgttgatgtttcaaaccgtccaaaaaaagtcctccaaatttattatttgggttaatatagtccttagaaaaaaaaagccacgaaagcatatcaagtcatccttgtatgtagcggtatgaataaaatgactattctacccttatataccatatagaaaaaaaaagacaaacagaaaaaataacaggccagcccagtcccaacattgttaatttacatgatcgctgcagcaatcgtaagtgataattataaaacgatcatatacgtgtgaaacatttatcttcttttatcttctttcttttttatatggtatataagggtagaatggtcattttgttcataccgctgcatgcgaggatgacttagcatgctcacatggctttttttttttggtcaaaggactatattaacccaaatgattaatttggaggacttgtttggacgatttgaaacctcaagaactaaactgagcccaaagcgaaacttcagtgaccatgttagttattcacccttaaaaaaaaggaataagttcacttggtgactctcaaaagtgattgtaatctaatccgtgaccctaaacccaagaaccggatatcttgacccccaaactatggaaatcggtacaatttgactccctcgccggttttagagggcggtttcgctgatgtggcgctgacgtggcggtattgaccgggtcttttttaccacgtgggcgttgaccgtgggtgatgaactacttgccagtcgaacgcnaatcaaaagggcgcgg

SEQ ID NO: 48846 - DNA, 732 bp, Oryza sativa
  unsure (1)..(732): unsure at all n locations
ttgggccctttattggactgcgtttgactgcaagtagttcatcatactttatgagtcagcagtatagacagtacctgtcataataccaaatatttatgtttctctatgtatggaaattcactcttaagtgtgcactaattttttttaggcctagtctacttaatatttcattaatctttatatcatatgttttgctcacttagcacatttcatttttcatcaagttatctggccctagttcattttcctatggaaagcgacatggttattaggacttagattgacaaatgcaacaggtatggttcatccaccttgtcttgaaatgaacagaatgatcatgcgatcaagacttgctccttattgcatttctgccttttaaacacatttaacccagctcagctatcttctgatggacctgttcttttcacctttgccccatgcccacctcccttactaaaaacagccaagacaaaagaatgccaagaccaatgaagtatggagcctgcttattggagccccttcccaaaccagatgaccaagagtatggccccaacctggaagctttgcctaagagggacctgcctggatgccatagaccatcttatttccctagtatacagcatttacttatattttcctctgggactatgttgattccccgtcttacatggtctaaacctatgtattgaaagttcacagttgagacttcctgtatgtgttctcgtgcacccn

SEQ ID NO: 48847 - DNA, 1932 bp, Oryza sativa
  unsure (1)..(1932): unsure at all n locations
tctggcccttgatgagctnctnctgacagcaagncatacatcatcatttttcttaatgaattcttcctagtattatctaaaacaagacaaaaataagggaagaagcaatcactttccagatctactctgaacagtaaaagaagctcgtgttattgatcaatgatgttaaaattcgaaaatccatgaacataacatccataacatcagatgggggcaccacagcataatcaaaaactggagtagagcatggtaaaatttcacataatcgagttaaatttatcaaaactacatgctgagattacgcaaaaaattcaacctgtcaactttctggttcaatctcgcaatggcatatctgaaccaaatgctaaatgtgcaagaatgcagcatactggtaatcttataccacacttctaaatgatatcaacaactcgctcgtctatttcttgtacaaatcgatcagctaaacaatcgcactaatagatcaaacgggtcaaaaattccacaaaatctgtagcgaactgacctccgcagctccatttcctcagaacgaccacagcctgcacaacccaaaaaaaaaggggtcaaaccacagcaccaactaacctacttcagcgggggtaactaagcaactcaccggaaccacggtggagagcgcggcgatctccagcagggaagaccccgtcaagttgctgacgaacctgcgcgaggcgaagaggacggttcttaggaggcgtaccagcgagaggttttcagggggggtttgggggacattttgggactcactgctccttgaggagcttgtgcgcgttgatgggctcgtcgtccattggtggcgcctgctcgaggggcggtggtcgcctcgcggcggcggcggcggagtggaggagaagggaagcagcgcaactgcgccgggggagagggagagggggggggatctgaactgaactggatcgcgcgcgacggcggaaaagaaggcgagaagccgagaagagaaaccgaaggaggagaaagtgtggcgcacgggccaagccggagcagaaaggaagaaaaatggcactctcaaaatataaaaagtaaattgtactagttgttcgtataagcttgtaatgaggttttatctagatctacaaacttgtagaacgtgcatcgatattcttaaaattagtttattgccatgtgaatgatgatgtgacactttttaatttttttcccttttttttcttctttcttcctctctccgataagcagcgacactgacgaccacgacgggtaatggtgatagcgatggcaggccaaaggaatcattaaaggggccgccaccactggtatcatcgttgcccgctgcctccaatggtggcgccgcttgctggagggaggactaaggagaaaaaagaaggaagagagtagataataaaaagagtaaatttcactttggccatgtatatttatcagattggcgcattggaccagggctaaacgtatgttttcacttaacaccacatttctttaccatactttacaggttggaccagagtttagcatctgggccatcaggacagcttcgggctagtccatgtgaagcgtttgcttgtatggaacctcttcgcttctctgtgtcaacccctgcatgtccactaaagccgcatcgcgagcttggcctcggcacgtagacatcggctggtatcgacgtctcttcagactcttcaaaggcctcatcatgttcggcggngcgcgtctttcgaccatgttgttggcgtcaaagccaacgaccattctggtggacatcgacgccatcacatacaatggcatnctgactccnaanggcaaaaactgtggaaaccgcccngatcgtacataggcttggtggaggagactatatatgccataatagcccgtaatttcgtcttggatgtatcataaagaacaatcaan

SEQ ID NO: 48848 - DNA, 1151 bp, Oryza sativa
  unsure (1)..(1151): unsure at all n locations
aggcccttgatggacttctcntgtcngaagncgttcatcaattgcttttcactttcatatatcactatcagtataaaaaggagcaaaagcaactaagtttcgtcataggaacctaaccttaagtagttaactgtcttaggtcctaggactgaaagctaagtcatgtgcctggaccatatgaaatgcacgtgattacagtaaaagagcatgtagtctagtggttacagtgacctaagtagcatcctaaagtcctgagtttaaatcttcataagagcgaatttcagattgggttattcgaggggctaagttctcaatttgtaaggttgcatatatctggttggatgtagaggccaggtaaaaaaaaaaacccttctctaagaaaaatgaaatgcacgtcattgatcattaccttttaaagaaaaggatgacgacataccctgtagctgtaaaaaacatgatcactgtcataaatggttagtttcatgtaaagaagtattagctgattcaagtatccttgtctagacaataagtacttaatcttaaatagtaatttacttgcatgagacatcctatttgacaaactactatttacatcaattacctttgtggcttactttttgtgtaaaaaggcagttgtagttggataaaaggcagttgcggtcgggatatctcagcatttggcatctggtgaactgaatgatgtcacctttgactggcatgtgtaaatattttcttatccaagctgaaaagttataaattacccaactcaacctctagtcgtccttagtacatctgtacatgtcattttagtgtgcatatatttgcagtccctagcactttgttaacacagaagggcaataaattaatcatctaccttgtgaaaatgtaatgaaaatgaacaagaatttacttaatttgcagaatttggttgagctggaatgtgaggattgggcaagcaaaggtctaaacattaagtatgccaccaggagtggccgcaaagggttcaaagcaggagccttgaagaagggaatggagtgggactatgccaagcaatgggaatatgttgccatatttgatgctgatttccagccagaaccggatttccttctcagaactgtcccgttcctcatgcacaaatacaaatggtgggc

SEQ ID NO: 48849 - DNA, 3133 bp, Oryza sativa
  unsure (1)..(3133): unsure at all n locations
tagttgnacagtagattaatcatctaaaggtaaaacccataaatgtgatatgacttaattagaggaaaaaatgagaaagataatttggcccatagattaatcatttaagcactaactaagtgaggatgaactatataaatatataggatattataaaacataataaagatatatattgaaacattatgtgaattatattggatgataatttaacatgtttgtatttgaaaagctcttaaattataaaaactataaagatatagcatgtttgcatgatgtttaaatgtgggcatcttgttaattagtggatgatgatgtgtcatcttgttagtggatgatgatgggcatctttgcatgttaagcttaaggagttagtgggagataactttatttacagtgagataggataccgtggcgacaactgctataccaaagaacattcacctacttaagtaatggcgatctgatgaagcagaaaaaaaaatcattgcaccaattcagttttgctgactaataggtgcaaaaatggaatccttattgcttggaatgcaggttcacatcatgatgtacatttctttaagataactatgatatcgtcatcgaatatttaccggagccgacgaaaagatctcgttctggtctaatataacggagcagaaagatagaaaataaaaaaaaaggagtgcagaaatcctaaacacatcagaacgtatgggtatggattaaaacatgtacttctggggggcctaaatttttggaggccatgtacggtcgctcatcttgcatgtgtctatggacgggcctgtaaatgccgacctctgcaccgactctttaattatttaacaataattaataatataagttttagtctgtgcatcaagtaaggttacacacatctatatatttatggaatattgatgtacatgagatttacccttttatagggtttgcgtcatgcatgcacccacaactctgtcaacccaccaatggtgcatctctaattaagagaatgaaatataatggccaagggacaagggttacgtgacaatgggagctgatagtacatggtggcaaaagtacgatagagctaagcacggcctaattatcatctaatatctctccttctcaagtcctaaattggccaggcaattaattaatcaaaggacggtcctccgtttcaccaaagtatgccaatattttcttatacttgctataattaatggtatggctaaaaatttgaccaccttatttttattgataaaacattcatagtaaagtgtggctgacaactaaacaaccccttaatattcagatagaaaaaaaattaaagaactataattagcggtggtaactaatgggtaaagaccaatgcatgggttctttcacaattctacctagcccttctatatttttagattaaaaatacataaaattttaatccacactattttagattcagccctcaaattttgtatgctaaaaacttgttggatcatttaaaatcccttgctatagtatttgcagtgataactgggcttacaatgttgatgaagattagttgaaaaatgattttaattacaattctttttctctgggttctttagctcgtcacttcattttaaaatataagcatttattgctataaatcaaaatataagtatattcatacccatcacttatatttttgaatccgagaaagtgccatattttctaatgtaaatatggtcttgtatatatatatctcgaatattttggccatgccaatgcaaatattgggtatttggatgcattgaatcctcggcaactgtacgtaggacaagtccatcgttttgccggtagttattaggcatttaggctacaactgcaaggatcagacgcgtcaattaatagtaagaaggaagccaatcacgcaaacaacgaaattaaatttgaaaatatactgtgattcgtttttttcttagaaatattcatgatgtaatttttttagcagaaatataccgtcgatcttgcgcaatcgttgcgcgaaagtgacgagagcgtgacgatgcacgcggtgtcgcgcgagaccgcgtggtatcgcgagataaaacagcgagagcgaacggtcccgcacaaggaatcagcgagaccgaacgtcttgtccatcagtgctgcttaattagtgattaattactctaattaactattaattatcctaattagcgattaattaatattaattaattgctaattaggataatcaatcactactctctccgtttcgcaatgtaagttattctagcatttcctatatcatattggtgttaaagaatctagacatatatatctatctaaattcattaacattaatatgaatatgaaaaatactagaataacttgtattgtgaaacggagaaagtaactaacaattttcaaccgttgctatcgctcattgggtgagcgagattgctcggtctcgcggtttggccgtgcgagaccgcgtggtctgacgccgccaccacacacgtcctcgatttcgccgttcggtgtcgtagtttcatcgtgcgagaccgtgcggtctcacgctaccaccacgtgacatcgtgcggtctcgcgctgtcattgtgcgagaccgtttgcgtcgtcacatccacgtcactttcgcggaactgttgtgcgagatcgacgatatatttatgctaataaatttacattccaaatatttgtgagaaaaaaacgagtcaacaacagtgtattttcaaatttatttccaaacaacgcggaacgctctatatatcttcatattcgtgatgcctttaatttggcttaaatttgaaggaatgtaaacaagacaccaactatatatatagctttggattctttaatttgcatgtcattaattatagctacagctagtagctactagcttagtttgtgacacgttttaatacattttttatatgattaattgtcggtcatgattgataaattacatacgtaactcttggcgagattaggaattgaagctggccacagcttatatgattaaatgtcggtcatgcttttatttctgcttaccgtttcggcgtaactggaatatatccgggaagaaattgtgatgaactactgtaccatacagcgngttaccaagcct

SEQ ID NO: 48850 - DNA, 2351 bp, Oryza sativa
  unsure (1)..(2351): unsure at all n locations
tagccccttgattgttggacanncgccctaccgcaanaaggcatcagtatttctgccacatcggtggacaaccttattaacacacacaatttcgggtcacttttgttgacaaattattagatccctttttcatgaatttagtgaggaatgttcttcccttttaatttggaaattttatctaagcatagaactagccaataatatgcaaacatttccctcttgcagcgatctggacaaccttataagcacacaatttcggttcactttgttggcaaattatcagatccgttttccatgaatttagtgaggaatgttcttcccttttaatttggaaaattatctaagcatagtactggcctattatacgcaaacatttccctcttacagcgataaaattttccgtatgtgttgtgttgtaaaaggggaaactctctcccttcattactactccgttccatattgtaataagttgtttttgtattgtcataagtcaaacttctttaatttcgattaaatttgagtaaattttacaaaactattagagtaattttttaaaaactgtttgtgtcgacgtttgatgtcgcgattccggtatttgcatagtatggggatcgttggtactaggatatatgcgagacttaggtaaaagagacggggacaaggatttttatacaggttcgggccccttatcttacaggtaatagccctacatcctgtttgccgaagccggtgttgctctttattcaccataatcacaccagtacaatatgtggggtagtctatctaactgttgtcgacttggcggtctgaagtgctgactcgtagtcgacaacagggtagccttcctccttgaatctgcatccagcgaggtcaaagatagtgctatgtctctcctgacagtatccgtagacaccgtaggggactagccatgcttatctctgaagtcgatatccggcgtcttgttttgatgcatgttggcttgtatgttgatctattgttccgtgtcccctctcctcctagggggccttgtatttatacccacagatatccccttgtccaagtagaactagagaaactaatatggatacaatccgagtagttcttgtcgtttccatgtagaactctattcatccttccttatgcggaacttctcctatattcgaaggttgtttccgtataagacatggtatgtggtgggtcctgtctagatttagtcaactactattaggtatgtggtatccataaccctgacagtttgatcgtttgatactttgctcaaactgttgaaaaactatagtaacattttttataacacaactagaatatttataactcaaaaataataataccgtcatgatctaaactgcaaattttggttttatgataacttcactactattgtaatttcatgatactctgctttaaatatgtagtctcatccatgataaagtaggtgctaaaactatattttggtaataaacgtcttaaattggtagctttacgatggtttggtcaagtatttttagttttgcaaatgtacttaaacttttcatgtcaatataattttaaccatttgtaggttttgtcttcaaaggtgattttgtaattccataacttttcttttgaaatacaattcatttcgagtagccacagcatgagcatttcacatatattttggtttgatttttcttaaaatagtattttttttaccagcttgagaaatgacttcttttacttcgatttgattttcattcttaatttacaaaccagttagaaatacgagtattcccccaaacttttagagctacacaaatttaggacttgttttggtttattgcaattcttagccttgccaaattggccattgttaatattttctccatgaattgggaaggacttcaatgccaaaattacattttgacattgaactaaaccaaataatttgacgtgccaatttctctataaacaaaacacacaactgatatttatagagtaaattacattttggaccacatatttttatcaaaattttactttaatctatcctcaaagtgtttttttttactttgggcgtattattgccaaatgttgcactttaaactggttgacccacatatcaatgagactaattacctttattgtacataattcacttatataggccaccctatctaaagggtaacatgtggaaacaataactagttcaaaatgaaaaaaaatactataagaataatataaagtgaaactttagtcagaagtgcaatttacctatatttatatttgagtaaattgcacgattagtacttaaatttcctttatgaactactgcagcgaacgtacacaaggggggg

SEQ ID NO: 48851 - DNA, 734 bp, Oryza sativa
  unsure (1)..(734): unsure at all n locations
ggaggacctttcaattaatgngactngcgtttgactgcaagtagttcatcaatagagcttccaaagggcaccaatttccaaaagcaatcgcataattccaaattccgtttctcgcaaaagacgagaactccaaaccatatacagatgcatcttgaaaccccacacgagagagcgagagcgagagatcaagagatagcacgagagcagtagccacagctagcacatcgtgattcgaatcttacgtgaccaccgcaaatatctcactcgctcacctgcggtggcggccatcgacggagggcgcgacggcgctgcaccacccggtgaccgacgacgatgccgcccttccggaccaaccaccacccgccgcgcgtgccgtccacgtgccgcgcgacgagggaggacgcgggaacgcgtgggccctggaggaagagaggaagaggcacgacggcctgggcgcacggcgacggctccggctccagcgaggcgaggcggcgacggcttccgcgaggcgaggcggcggcggcgtgcggctagggttagggtgcggcggcttgcagcgcaactgggagagagcatgcactcacgggagatagcaggagaggagaatagagctgaaaatccttaggggcaaattagtcattttcatacatgggtcccacatgtcagagctatggaaccgttaagttctaacagaaggtggacggaatgtcacacgggtcaacgaaagttttctt

SEQ ID NO: 48852 - DNA, 724 bp, Oryza sativa
  unsure (1)..(724): unsure at all n locations
cgccgcccttgattgatcgttctactgcaagtagttcatcagagttcttacacctgtttttcttgccacattctctctaatttctattacaattctagtcgaccaccctatttcctttatgcaacaaaatccatgctgattagaaactaatgcattccctatattctaaggtctcgatctcatctcaaagctggaccaaatgagctgcctttgctccgagcagatatatcatcatacagagtatctgtggtacgtaaaagttgattaattggaaaaatactactcatttaattacttctcagtactatatatccaacagaactattgaagttaatggtgatggggtgttttgaaggttctagtaacatgcctgtgcatattagcagtggacttcaaaatcttccctagacgttatgccaaggctgaaacatatggttgtggcatcgtaagttgtatctttcatctttttcattggttgtattttagttctttactgtctcaaagcatttttaatgaatcatgaacttgtttttgcaaaagtagacactggctgcaaattgtgcatccactctgttacctattctgcatgcttgtgatttggattatttgtgtttcccatcatgtttgaaacttaaaaagtttctgtgttttctttcccaatcaatgacatgatactaanggtttctgcctcattgtccaacaagatggatctcggagtangtta

SEQ ID NO: 48853 - DNA, 721 bp, Oryza sativa
  unsure (1)..(721): unsure at all n locations
cgccccctgattgacgtcctctgcngtagttcatcaaattcgaaatgaaacccggttggagtcatatgggttttcttctatgttttagctagccagctatggcgcctatataaatcccccacacgaacgaacaaaacgatcgatgtgtcgaagtggacaagctgattaactaatcagctttccctttcggttgcgcacgtacgtacgatacgacaatggcgccgccgtcgctaccgattcttctcgtcttgctctccctgtcgtcgtcgctgtactccttctctgcggcagcagccgaccgctggaccgacgcccacgccaccttctacggtggcgccgacgcctccggcaccatgggtacgtaaccggtgcacgccgatacatatacatctattttagctcagaattgatcgaagtggcggcaatggcgccgccggttgtgtgcaagtggcgcgtgcgggtacgggaacacgtacgggcaggggtacggcacggacacggcggcgctgagcgcggtgatgttcggggacgggctgagctgcggcgcctgcttcgagctgcggtgcgggggcgggnnnnnaaaaaaaaccngnaaaggtggactgccgccggcagaccggcaagccataggggggagagggacacgaccaggtgtcctgggaaaccactgccttcacaggtatcccggctggtgtgtgaaaccccaccgtttcaacatttc

SEQ ID NO: 48854 - DNA, 870 bp, Oryza sativa
  unsure (1)..(870): unsure at all n locations
ctcaaaccgaagaagtccaagaagaagagtaagagggccttccgggccaagaagttctccgacgacctgagggtctttgtcggcaacctgcctttaagcgtcgccagcgcccagctcgccggcctcttcgagcaggccggctccgtcgagatggtcaaggtcaccaccccattcgtctcgccttactaagtactcctatcacaccaccttcgtcgagtcgctcgctggtgtgtccctgtctttgtgaaaccaaaaatggaccgctggtcgctggtgaagtggtgatgaatgattgtgtctagttgcttcatattacagttcacgacaaattcattctgttgttaatttagcttaaaccgcgatacaattgggttgcatatggtagtgtgggcatattctcgttcttttaagaaaaaaaaacttatttcgggtgctcattgtgaggttgtatttggagatgattaaggatgcgataaggttgccattatttaaggttgttaaatttggtgtgctggcgctcatgctattaattctgtgactggcgaaagatttaggattgcatttttctggttaattgctcaattttaagagtagtactcggctttggttgatttttcctatattgtatcatgctaaactgcattgttgcaggtcatctatgataagctgactggaaggagtcgtgggtttgggtttgtgacaatgtctagtgttgaagaagttgagccagctgtcgagcaattcaatggctatgtgagtatatgcttccatacttttaagtcattatttttgctccatgttggtatatgggctggctaaaaatatattgcataaagttgatggaaagggcgaactcaccttcactncaat

SEQ ID NO: 48855 - DNA, 864 bp, Oryza sativa
  unsure (1)..(864): unsure at all n locations
cagaaaaccatgaaagtttgtcagttcacaaatttcacaagtacatacttatgtactactactacttccgtatcaaaatataccaatttttagctatgaatatggaaacatgttagatatataattataaatgtttatgagcctgttcaatttgatgccattttcaaccatatcattttttttaaagttaccaaaaaatatctacgtctagtttgttcacaaatttagtcaatacataagaaatcctgccaaaattttgataatattgccatcttgctaaaattttggcattgccaaaacatggtatggtttattttggttacaatttgaataggccctatattttaggataaagggaatataggataaagggagtacttacttaaatactcttacttcataaggttttggcaacaaattggtcagcaagttttcttgaaatgtagccaagttgctaaaccaattggtccatcttgtcatcaattctgcctattttctgctcgagtttctctatgttctatcccatttgaaagcctcctaacgttctaaacagatcgcaactggtcaatcttattaaaactgccgtttacttttgagttttgacgttgaaaaagactctattacagatcagctgaccgaattgaatacaacatgtgaagagctcattgttacattaatttggcgttattgtcagaatttcacattcagtatcacatactgctctccagttctcgcctgtcacgatagggtttaaccatcaaatcagtatgaaaatggcacctcccttgattgttactttctgcaattgctgtcttaagatttttaaactcgatcgatgtcataattttaacctgctacagctan

SEQ ID NO: 48856 - DNA, 1101 bp, Oryza sativa
  unsure (1)..(1101): unsure at all n locations
ttatctattgaaagtaggaactcctagtttagaaacctagaaggtacaggtacaaagcaagtcaacttcaccagttcgagctatctataaaaaaattagcttggtctgctgagttagttcagaattggcacactgaagataaattatgctgatctccacaattcttatatttgtatatctggagacaagtcagaaaagtaataacgtcaagttgaagctaagattgacttgatcacttttcacccacaaaagctttattatccatcaaatttctgcacctgctctgttttattgtaggacgatatcttttttaaatccttcccatttatttctctctccaaataataaaccatcctgagaaagtgacatgttgacaattcatcccacctttgtctaatataatcactaaaaccttatttagactctattttaatgtttgactttcgcagacatcattgtttgaatatttgaattttctctggatagtaagagtatattctgattgagaggtctgcaaatagtcactagtatgctgtgtcttacaatgcaacttcatgtgtgtccttaggacctggaataaagcactgatgtctataagccctctaatatttcttggttttgctcgtctcatatcgacatcaggtgttgattatcaggtatttttattcataaccatgtcaattacctaaattatgccttcgccacaatttgccatatgcattgacattaaatttacttcgtaattatgcacaatcctcaaactttgctttccttatccagcattttcaattaccatgtgattattttctcttgttgacttgttctagataccgtatatgtactgcacaaaacaaaaatgtactgctgtcttcctaaagatgcatattctatttctcattttctaggttcatgtaggagaatatggcgtgcactggaacttctttttcacccttgcagcaatttcgatccttacgtccgttatcaggatccatcctaagtattgtggattagctggtctgcttgtgcttacaggtactaaagattcatttgaatagttttgatgaactacttgcatcagaacgangatccaaaaaaagcctc

SEQ ID NO: 48857 - DNA, 2592 bp, Oryza sativa
  unsure (1)..(2592): unsure at all n locations
ccgcccctcttattgacngcgctttctgcaggagatcatatgctgcctctgtcttctaactattacatctgaagtttttatgaactcttggggatgccattttctaattacctttcatcatcacgcttttccacggtgtagggcacctccctgtttatccaagttattgatgaaaggttaaattcccaacctttagaaaattagtacatctatggtgcttcttttgtgatcattttgtggttcttttatccatctattagcaatacaatatagttccattcgtccctggttcatctgtctaagatcttctgtcctctttgtctttttggtggacaaaaggataacctttaagagtttcctgccagatagaatatttaataattgattttatgtactacaactacaagatttttatatgtgctgccagttcctggattaattttctcttttactcctatatatgacccttctattatatttcaggttttctcagcttttggatttgttcacaaaatagccacttttgagaaggctgcaggttttcaggttacttgaaatttcaaattctgttaatatacttgattgtttacaaaggcgatcttcccaccttattttcttcccccgcaggcactgattcaatacacagatgcagccacagcttctgcagcaagagaagccttagatggaagaagcatcccaaggtgacatctttgttctctgcacattgcatcttttaatactgttcacactttgctcctcctataaactgaattcctctgagactttaatttaatgtaggtacttgcttccagagcatgtaacatcgtgttgtttgcgtatttcgttctctgcgcataaggatctgaatatcaagttccagtcacatcgcagcaggtatcacttatatcttttttgccttgagttaatttacaaagatcaaatttcgcggttgttaagatggatctctatatgtctaggaggattgtaatatcaacatactacctggtaccatattttaatgtctacattaagatttatgcctaggcattgcaagatcatacctcatattttccctgcaaattcagaaatacgtgttctgccacatcatgggcattttacctttattcatctttcctgttcatcctgctgcctccttatatactgacacatgattactttgaaaacctggtaaaatagactatcaaccactggattccagatttgaatttgcaacctaatcgttggctaaaacaaagtagcttttttcatgggttaagggcatattcatccatagtagcacttggcttccatttttttagcctcttgctttttgtatggaacttccatatttgtatgagtatattactgcaaaatctttatttgtcagtggattcgtcttctccatctttgttccttatcttatttgccttgtgttattatagatcaaaatgcttcttactatgtatcttgttaaacatgttttcttttttattttgcagggattacaccaacccttaccttccggttaattcatctgcaatagatacgttacaggtactactattggatatcaccaacatttgaataatttaattgtctttttttttccatttatatgaacctgcctttcatataaactgccttttgatgttccttcacagcctgctgttggtgccgatggaaggaaagtggaagctgaaggcaatgttcttctcgcatcaattgaaaatatgcaatatgcagtcacggtggatgttctccatactgtaagttaaattggaaagcacttattcaaagattttgttgttttgtagttactatatgctgactaagattaatcaattccaggtgttctctgcatttggtacagtccagaaaatagctatttttgagaagaacggtggaacacaagctttgattcagtaccctggtatgaaccttggaacatatcatcttagtagaattacagaataattatgttttgtgttgaattagtgctttcattttcaacatttgacctagcagaccacacctccaacaaagcttgatattgttatttcgtttacagaaattattttcctatttttgtaattgaagtgaatgtgcagaagttgtgcagaactaaccaatgtaaacatgctttcctttacatcgtaacaaacatgtgcttgttctgtttatgatttcatgtgctttaaattcagacattttttcatgatctgacttcattacattaccattcagatgtaactacagcttcagttgcgaaggaagcattggaagggcattgcatctacgatggtggctactgtaagctccacctgtcatattctcgtcatactgatctcaatgtaaaggtataataggtgtgcattttctttagtgtattatgggcatgaaacctgtttagacgatatgatttactgccatcatagaacccttcatcttgtattcaagcacagactttcctatcatatgaattatgaaccatgtatctgtctgttctttcaggcacacagtgacaagagcagggattacacaatccctcaaggtgcgatgcaagcagtaccacaaccgcctggtgtaccaacn

SEQ ID NO: 48858 - DNA, 946 bp, Oryza sativa
  unsure (1)..(946): unsure at all n locations
acgcccatggatnattttatggnccagtagttcatcagtcagatttgtcagcaggccaagtctgaacactgcaagctccctggcttgttaacaccattaccaattcctaaggaagcctgggtggacatatcaatggattttatcgaaggtcttcccaagtctgatggattcactgtcattcttgtggtagtggatagattcactaagtttgcccattttattcccttgcgtcatccatttactgcttcccaagtggccaatgcagttgacaaaacagttttcaagacacatggcatccctcattctatctcagatcgggataaaattttcaccagccgattttggagtgatttgttcaaagtgtgggacactactctgagtatgagcttcgcttatcatcctcaaacggacggctagaccgagcgtgttaatcaatgtcttgaaatgtacttgcgttgtatgactcaagcaacaccaactaagtggaacaaatggctgcacttggcagagtactggtacaatacctcttttcacactgcattgggttgttctcctcataaagctttgtttggagctgatcctcatgtcagtcaagtgctagtacttctctcctcggtccatcagtcagtggttgatcttgtttctgaacgcaatcagctatctgctttcttacaacaacaactgcaacgggctcagttgcgcatgaagcatcaagcagacaaaggccggtctgaacgatcctttgcagttggggatcatgtgtttctgaagttgcagccatatactcaatcttcggtggtgaatcgtccataccccaaactagctttcaagttctttggcccatttgaaattctggagaaaattggtcagtcggcttatcggttacagttaccagactcaagtttgattcatcccgtctttcatgtctctcagttgaaagcacatg

SEQ ID NO: 48859 - DNA, 2632 bp, Oryza sativa
  unsure (1)..(2632): unsure at all n locations
aaaaanaaggggaacggtaaaactcttaaagccttgaatggtatgacatcgtacgggaaactacaatgaaacaaacaagcctggaagagaaaaatatactttccgatcaaaagcatactatcacgaatttgaaaacttttggagaaattcaaatttgaaatgaacaaaccataaaaaaaatcctacaaatacgattatattgatagtaaaaattttcaaaaagaaatattgaatttacccatcgtttttgaatggaacagatgggaacaatatgtgaaaatgagaaaaaaatgcctaatgggctgacgactcaataagcccaaaacacacgcgagtccaaagcatcacagcacgagccgtcgcggcgtctccggacgccgacgcagccgccgacgacgtagcacatctcccgctcgctggagtatggctgcttcgccgcctccgcggagccctagctccggcgatccggctgagcccgccgacctggccgcttccgccgccgccgctctagcatctcccgctcgcgtatggagctccctcttcgcccgccttccctcgctctcggactactcccgcctcctctccgtaggccgcggccgcggccgccgacggcgtcgcgccgctctcccgctccccattcggcctgccgccgcccactccgcccggtgaggaatcccctcggctcctatgcttcttatgcttcgcaggcttttcatggagtagtgtagtaactagtaccattaccatgtacttgtgattcgtggattggtggacatgacaggtaaaacaaattggggcgaattctcggttagcaggtggtgtatgtggaactcgtactaatgtgtttcgatgttgatcactgcttgcagtatgtgctaatgtgcatcagtttttcttctactatattcgatgcatcttgttatgtggctggttcatgtaatgcattactgatttttcacatgccattgattattggtgtgcacagagttacttggatatgtttctgactatatgttattcgcaggattgccggtcagatgcccaaagcttttgacatcctacaagatgttgcgcaacacactctgtctaatttgcatgatatccagaagagcttaatattttggcagtccaaagcagaggtataaagttgattcataaaaattgaagtgcttctacacttttaatatgtagagaagtccactacttactcatcttccgttgtcctatgctattttctccagggaacaagttcacagaaactgtattttatgatctttgaaagaggtccaagggcctttgtcgaagcagcatggcaaacactgactagactcaagagcaatgggagtccagtcccgcaccttttgcactctgcttctgatatggtctcaacaaaacttgctgtcctgacaagtatgcaacactgcttggctgcttttcttgctgaggtttgtttaatcaaatgcgattatcaatatcaaatgctgatgtcaagtagaataaattgttctttacaatagtttcaatatcaactttgaagcagctcccctatcaactggtgtactatggtgtccaaattattcaagctcttctttttaatactttggataaatttacttatagaacatggctactgtttctcatacatgaattcgaattctaccttgcctcttctataggtttactttgaagttgataagtgcagaaaaggactaacagaaagttcagataaatcgctacatactctattcattgttctgaattctgtcttctccaaattggaggtatcatttagaaatgctgttgaggtatgcaatgttctttttgcatgttttggatgttacaagtatgacatgctagctatttcacatagtttcatttcttcagggacaaactctattatgcacacatgatgggaagtcgcctgaacttatctttgaaagattgccagaagttgatgttgagagttcagagtggacagaggtgttatcagcaaatgctataacattgatctaccaaaacctccagaagttcgatgattttatttctgatcaggtaatcaactctcctttttacaacaagacacatgccatattgttacttctcagccttgcgggttccacattaatgctaaccgagttggtgaaggcgtattgagggagcatttctatagatcaccctctatggctgtacctgtttgtgcttcctgtagaaaatatttgtgtttacacaacttagcaactaatttctgtccatgcaatgtgaatgctttcagtctagaaactagtggtagaagtatagatataatgcaagacacaacggtagttgattctaactgacaactcttttatcataataaccgtgtggataagaaggttaatctgttgaaacaccaaatattctcaaagtactagtttagcattgtccagtgaatcttttctttttcttttttgcaaaagttagttcccttttcactgaaattacacatgtttaacttcataccactgaaatattgctgttaacttttattttcaccgcgatgttactccattaactgctattatcaccttaaatccttcctttttctcttctcaatttcctttctaccctccttttctcctgacctgatctttac

SEQ ID NO: 48860 - DNA, 7350 bp, Oryza sativa
  unsure (1)..(7350): unsure at all n locations
nttgaacccccgttgnnaagngncnannangctnattcnnnnngagcttgacctgggccgtgtcctttatcatgcgtgccatgcctctcgctgactggcatgtgcactgcttgctgccttcttctctactctcacacagggtaaatacgaaagtacacgtgtcttttgcctaaaaaaaagtaaaaacaaattataattgttatatagaagtgaacaatgcaaagttttagtggtatagaagttaacggtgagatttctatagcataactctgagctggtgcggttttggtgatatgaaaccaattcttttggttaaatattttcaacttattctgttattaccgtaataaacaattgagttaatctgtaattcttacttggaataagtgaggattgttcacttttgaaaatataaatttgctactgttcgcagaagttagaagtatgtatatgtgttacagttccattatgtgaagcaatatgttgcataattatctcaagcatattttttttctattgtagttttcgaaccacaaaagaccaagaaatacgaccatatattggttgccctacacatgtggagcattgggcctctctgcatgttctttatggcttttgcgccacagtagcttgatgggaagttctgacattgacaactggattcaagatgcaaaagaatcgatggttggtttttgggatgtgcatgttgggcaaccagtaagatactttctggatatgtccttttattgtgtaccatatgcatgatgctagcattagttaactaaagtcgaattgagttactttagggctcattttgataggtgtagtttatgtccaatcccttcaagttggcaaggaatttgaactaaaatctccaccaagggatgaggtctaatccccctatatgcagtatgtgagggtagagatatcagataatcacattaaccagtatagataattatattggaagacatacaagatgttctatgaaatactgtatcccaatatttatctgttaaaaatgaaaagcagattactgcttaattagcaagtgtggtatgctgttttgtgtactattagctgtgcttttgtgtcaatgttaaaaaatcgacttgcctttaccggatgacttcacttattagttattaccatcaacaatcttaaggcaattagtatatccaggttaagaaacttgttaatatgcaccttcatcagcatgcacatttcatcagtgcactaaattctgctcattcaactcctatgtgtgtccataacattttttacagaactcctgcaattatgcttgatttggctgataacttataattgaccttactatgtcaacaaaaagaatgcatccctctgtgactgtgtccagctaaactcgatgttctttgtacttttcaaatttagaaatcatctatattactaagctctatcatgacctcattcttctctttgagaatcattagatcatttccatcagggatgaactttttgagacattcaaacaaagatctaaacatgaaatggaaaaacaagaggtccaacaaactgaagaatcattgcgcaggttattccaatgatgcccatgctcttttgtaaagcttacacatgcatgcttccttactcaaaacttagtaaagtattgttctgaattaggcttttctccttcaaacctacacgtgcctttctccttaccaaaactttttatagaagtgttctaagttaatatccatttgatatggcctaagtttcacctccttacccaaacaagatgacatgtatctgcagtttcaagattttacaatgactatatatggttcagtaatgtaccagacatccatgccatttgaattatatgcgcccttttactttcttggaagtgttcctgtatgaaattgtgggttaaaattaggttttgcttcttgtgccttttttatatatctcaggtaatatcgatctgttgactgttgagattgactaattttcgttagtaatcaacaaaaagggcttcatctcataacctacatcctgtttcttgcttgcttccttctttttttttctttttttcttttttgccttttctagtcccttgacaatattcatcaccctggagctatgtactttattcccacattttcttggaactatgtaaaatttcaggtttgcattgcatttattttctgaaacacattgagtattataaaatggtcttgcattatctcaccgtacatgttacatgttgcctttgtaggatgttgcttgacttttgtgggaacacttcaaatgaaaaaccgccacaagatatgtcagagctagcaatgatggagattgtcatgaagaggtaagagtgtttgaatatttatggtgtcttggctttgacagtcatagcttatttcaaggggaaaatttgcacgctcaaaagtcacctggaattattttgcttttgtatcggaatctattgacaagaaaaaatttgtgtttgtcaagtaccattttttaatttttgtttgtttcgaaactaaattaattcagttggtactggggacagaccttgtcttttttttttttggtggaatgaccaaaggaggtcattcaatgtaattaagataggaagaaaaagttacagaccttgtaatgaaaaactaaatattagtgattctcataaggctgtacataagtgcatcccttgatacctccgaggggtataagtttcgtttgaaaaaagtagaaacgaaccccacccaacactaacacgtaacaccccttactctatacttttctaacaaactacatatcttattccaaactaaactgataccttcctaactaatagatatgatagcaaataagtactctctattattgcaaactaccgaatttatttggccaataggcgttattattgtgtaaggtttaccctttcctagtcatactgctgcagtattgctgcttgaaaaactgacgcgcgttccagctgtggtcacaaaaagcttttgaacttccattttattttctctgcctggtttcacagtgtaggctggtagcaactggttacccatagttactggccagtaggtttttctctgctggttactagttaccactcggtggtacttgccagtaactaaagcctgtgagaccaaaaaaggcatagcacatctttggctttccaactgtaattttctcaaggatttctctcttttgtttcagtaaaggtttataacctgttggtgaaataatggtactatttagagttaaaacttcaagatgggtttgactcagttccaaagtgggctgaatcaatattttcttagtcaaaaataaattttaaaatgatttgatcttgatgtgcataacagttaagttcgtgttgtagaattctaatctatgtctcatcttgcattaaaaatgatgaatttttgttaacaatcctaagtttagtatctttgagtttctgccatgatcgatgaattaataactttctaaattctaatattagacacaagcttcaggaagttaagaatcatttgtatagttgcttctatgactccttggagtgacttgttgcatggcttatgtcaatagaatctgaacttctgcaggagactttttgtgtattacatgctttgtatgcacttatgttgcttacataacttaatgggcacttcacattttatccttatttatctgatacctaaatttctatgcttttgacgatcactcaatggactaaattgatggagcttcttttgttaaaaaatgaaaactaaactagctgtttacattttactgactcaagcaatgaacaatgacacttctctaatatgttgatacagatatgagaaggaagcaatgcatccatttaaaggtctttccagtggaaaattaacatgtgcattgtctattcaggttcttccccttctatctctatttaggatgcactcagttcaagttaacctgcattttttctaacattctgatcctaaaaattcagattgagaagcataaactggctcttctggagtaagttatactaatgtattctgacaatactgcttaaaatgcatgatgataaattttttatgtctaatattaaactgcaagagatgattgaattgtttttacacagggcaatgctggagctggaccagatccttagggcaaatgagataaactttgctattcttgcagcactacctgcatttggtgtttcacttctgctgctctttgcagttcgagcatgggctacacatgtatgtataaccatatagacccattgctgtcttattcaggggcatctagcacaaatagggaagattttcactactttctttttgaaaaaaaatacaaattgatccctagcaaaacatttttgcagaaatggaactttctgcactacaccgtgatattaagcactatatattcgtagcatgggatctcaggattcggggctgtgtaaactaccacataggatggtccctagatatgctagagttctacaaaacatcccatgtggtagtatacaccgtgtcatgtacgtaaacaactaatgtcatggctctgatctatttttagcaaagtttcatgaaaggtctatttgtaataatattttctaaaaggggacaaattgtgaaaacactatccgcaactagcaggagatataatcttgatatattatatcccagtggtttgcagttttcaccatggacaagtgtgcatgaaaaagataataggaatactaggttcagatatggttaattattgtcctcactatgaaatagggccgtggtgctgagggaagaggtaggactgcacggcgtcagcgaaggcttgcttcttgctgatgtagagaaaaagcttatggagtttcagaattgcatggctaatggaatggtaaccttatcattatcttaaattagactacatgaccttatcttgatcttaaattagactacattgacatttatttggatgagggacaaaatacttgatctgggttcctgttgggggctattcccttctctaagaaatactaccttcgtttttaataaataacaccgttgactttcagaattacgtttgatcatttgtcttattaattaaaaaaactagtgtaaatatactaaagtacaagtcatatttaaagtttctttaatgataaaacatgtcacagcaaaacaaatgacatttgtataaatttttttaataggatgaatggttaaatgtcatgtcataagtcaacaacttgaaaaaacagagggagtatataacgctttcctattgtattttggctgcaaaaccttattccttcacctagtatgagaaaacaagaaactgccattttcaagattggacatccccaccttcgtcttgaaaatccaagattgaagtgctttcgtattgatgagaaagtcattttctttcgactttcgaattacaaacttgaaaaatattaggattacaatacgtactaataaatgtctggctgaatttcctaattttacaggaagaagaggcatgctgtaagttcgggttaacactgtacacccttgatagactatacaaagctgttgaatcgcaggcgagagaaacaggagagtggtcaaggtgagtctcaaactcatagctctttttgatacttcccttggctacctaggtttgattgcctgtgaaccaaaaaaatcgttttccgattgcagcttgagagaagacatgtttgatctggcaaagcctggtgtgggcatggaagacaagctggttctgctgtcccggctcaaagggatgtacgactgcttacttccatcaccgtcaggtgtcttgccccgtctgtagtcttctcatcttcctttcctttccttttcttcttttctttttggtcacgtgtgacgattagtgaaccccaatcttagacgacatgaatttgcttggcgttttaagagtcgtcaaattttgaattttttatgccccgggtactttgattgtagccctttcggctccatggagtgatgatggcttttgtgctgctgcaatgtttgcaccagagattactgactgtaaatccaaaatctcttctaactggatgcttaattcatgtgccacacccattttacatttgtttctcatcattgaagcacatcgaaatttagggtggggatcctctaccataatatcactatcattataagtcacttggtatgtgggtctcattctcctattgtcctacacataagtgtctataattggagtgccactatggtagaggatgtaaaccctgaaatttggccctggaaagcgtgaatgtgtccagatactccatgttactagtatttcgtagtatatgttagctgtgatctaaggttgtgttttttcctccaacttcaatgaacgatatgttttttcacaaattttctataggaaagttgtttaaaaaaatcacatttatctatttttcaaaaaaagttaatacttaattaatcatgtgctaataaatcgtttcgttttatgtgcgcgtgagatgggttctcaactcattgggaagaacatagcctaaatccacactgcaacttccatttttagttagtacgcttttcaaactatattaaaatagtatattttttcttaaaaaatgtttctaaaaagctcattttaaagtgagtaataattaatactccatccccaaaatatatgacactgttattttttattttttcataaaaaatatagtataaatatgtaaaagtataagttaagaaattgtagattacagtttcttttgatgataaaacaggtaaaaaaattattcagatggtttttgaaaaaaaagagactaacatccattttcattttccatgacggagataagaaaatactactaataacctttcatcaaaagattagtttatgaaaaaaaaatgctatctgtaaattagcccttaaagaaagaagcacctcgacattccttctatttactttatacttaaacaaagggaaagcattgcatacttacatttgcatgcgagtatatacatagatagcacggcaaaatcctagttaatccagatcaccctttcttaaatttgagaggagttattaattaatccacatcatctatgagcacacgcggaagaggaggaatcggatccgtgccgcgttgctccgggcccttcgcgtcatcgtggggcccgcccatgaccagnacgctcagnaccacgcgccttccccttattaccaccctcttcccatgcaccatngncagcancaccttcttcttcttncgcttcgnncgcgttgncggcgggattttgtgcccgcacaaagggcagctgtcgtgaatccccaccaacc

SEQ ID NO: 48861 - DNA, 2054 bp, Oryza sativa
  unsure (1)..(2054): unsure at all n locations
cgcgcccctggtttgacnccgnnttnnngnnngnngnntatcaccagccaccgctccacgcactcgccgtggaaccggtgcccgcacggcatctccttcctcctcccgctcccgcacgtctccctggactcctccccgtcgtcgaggcagatcgcgcagtcggacgcctcctcgccgtcgtcatcctcctcctcgacctccctcagcgccgcgatcgatgccctggacgccggggccacgccgccgccaccgtcggcgctggcgctgccgtcctcgtagaagacgtggtgcaccaggtacgcccgcccccgcagctccggcgccgacgagacggacgccccgacgagcaccggcggcacgcccgccaccgtccgcccgctgtccctgtccgtcaccggcgtcacgatcgacaccatcgacgagggagcattggtgagcgacattacccgatctcttcaatttcctcttaataattcttcgcgatgcttttgctaccatctgcctcgctctcgctatcgttctcgctcgatttgatatagaggaggaaaagacgccttctcgatgatcggtggattgggttgatgatgcgcatggcgccaaagggttcgaggtaggtgagccttttttttcttttttgtctcacaattttgcagctccgacaaagcggtggcgatcgattgggatttgggctccacatgtgcacttcgtcttcttgcagcaacacaaggtccatcacttcaattttggatgcatgctgattttgcttggattcaggctgaatttggtttgtttggacaccagaaatgtccttttttgactaggaaggttgttgctgttcttgacatcccagtgcaaaaggggtttgatgattcacaattttggaatgttcttggaagatctctttgatgattgacaattttggggtgttcttggaagatttctcatggtggagccatgtgcgcagaaactcagcaaaaaggcagacctgtgaatttgttgatatatactggattgttattgacatttttgaccttttgtaactatgcaaaatactacaggtcaacataaactgtgacgtactctacaatttaaaaatgctttctggagaaatttaaacacagaaaagaatcacatatcagattgatgaaacggcagcagatttgacttgatttgtcagaagcagcaatgatcaggtagagtgccaacgcaattcagccccagaagaaagaaggctaatccttggagatagagatttatgtagaagctgttctttccatggaagacaaggttgtaggatgcacaaaagatgaggaacaccgataatccgatctcaggtagattcactctgcagcaaatgacaatgtcaggttaagcatgcatgcagaactccagcacctaccactaccagcttatctaaagattgcagtagcaaattggagaaataaattttacctgtttattaaccttttcctggatttttgaagcaatggagtctcattattctcgtcgaaggcattgttccccactttcttcgtcacaatccattggttgaattcttgcagttgcagcagaccagctacagcagctctcaaccgatgcatggacatgacgctctcgaataaaatccacagtggcactgtgtgcagatttctggagtgaaaagacagttatggcaaatcaaattcatccaaaagggtaaagcgatgaacaaactgtttgagaattgtaacaaagattgtaagagagaactgactctggatttcttatggcagtgacaatcaggagtgctgtaggaatgtaggcaacgccccagattggcaggaagagctctgggatcatgaccgacacagggatgataacattgtagagaataaaggcaacagcaggggcaacaactctcctcaccaggaagaagctatacagtatgtagatcttcttcaaggatgacactttctgacggagcaacagtggcaggttatgttttatgcagatttacttgttctggttcatcaataatgatgaactactgtcccacaagcggataacaaggcgcg

SEQ ID NO: 48862 - DNA, 1661 bp, Oryza sativa
tatgttgccaattgaagaataccttatattacccatatatcctgtgttatcttcatctaactggtatgatattttagctaatgatcacatataaaacttttcttcagatcattttcatggtattcttaagcacacaaacagtgaaagtaaaagaaagaaatctgttagcaactaagtaaccaggtaaataaagccttttagggattacaaaaaaacatggcacattcatttcctaccgttgccttttttcagcagtgccaaagaagaagatctgcacactgtaaagtctccatccccactatcagcaaattgattctctaattttgattttgaagcactgcttggtcttgatattacttctttgatgcgagaatatcctttaggagcacatggatcaacaagtgtaccatttttggagtctgcaaccacatgagtcatgataaggcactgctttgaacttcagtacatgcagccaagttcctctaaaagctaattaacgaaaataaaatagaatttgtgtattcatattggtttcattcagagcataaaatgcataaaagaataacaatacaatgatggatgcaagtacataacagctttgatattcaacccagcactcatcaaacttaaaatgtacaactgttgctttgaactatagtcctgacatatttgtgtcactgtagcacatcagaagtagaatagccatagttagtatactaattattgatgttctattggctaacatcagcacatcatatttgttagctgtgaataatattctgatattctcatttctgggaacttagtgttcccttgtcaacctagctaccattgtaagggatgccaaatgtctattttttttgctatcctttacattgaaagaataagtaaaaagataccttttgaccgcagtatttcacggaaggattcttgtgcagcattctgcaaaagaaattgaatcatatggtcagcatatcgtatcatattacaagattgtccataacataagtggtgggtgattcaatgtatacaaatagctcacttgtccaaagtttagaaagctgttgctatagagagtatatgttgttccaccaaaagtgaaatttcttgacagttccggaggaagtacttcatcagaaacaaatgtcagctgaaacaataagcaataattagattggcagaaaatcattaatataaccaaagcattaagcaccgtgttaacattgatattcaaatgtggagcttggttctagataacaccatctcaggtaagtgagtcttttcagattaaataacttaactttattacttattagtaccatcttattagcatggattttaatttaaagaggattcatggctcaaaatcaaaggaaaggaaaggaatcaaagaatttatctgtctttatcagagaacctgtgctgaggcgcccccaagttcaattattccaatggttttgtgtggatcccctccaagtgtgccaagagcatagtttgccgcaacccaagcatagataccctcatcagagcctataagaaatgaaccagccaaaaaatgagcatccatactgacaatatttcagctaatgatgaaaaaccatctgtatccaccatccaatggatgatgaactacttgcagtagagcgtacaataaggccgtg

SEQ ID NO: 48863 - DNA, 1552 bp, Oryza sativa
  unsure (1)..(1552): unsure at all n locations
ccgccccttgattgatcagctggttcagtagttcatcaacgccaatcgctcgagtcgatggaggggaaattgttggagaagttggagttactcactcagaagatggaggctatggacgacaagatgacgaaacacggagggcggctcgatcacgccgtcgtcaaggtggatctcgctctggaggcggtcgggaagctgcagcaagatcagcttcaggcggcgcagttgcaaaagagtttggcgtcttccaatcaagtgagtattttgggctccccatctgcggtttctcttggcagtgcgggtgtttccccaccaccaccaccaccgccgccgccgccgccgccgccaaggttccatactcatcctgtgtttactcgcaacgaagcggagtctagccagggttttgattagggtgttcgtgctaagagttgcttgcctaagatggattttcctcgttttgatggctctgatgtctgtatttggctagatatgtgcgagacctattttgacatgtaccagattccggctatgtttaaggtttctgcagcagtcttgcatatgtctggaaatgcagcatagtggtaccaatcctttaagttagtagaagagatttgtgactggtctcaattttgttatgcggttgctctcgagtttgaaagtactgcacagtgtgaaaaagttcaggcgctgcaaaccttacggcaaactggttcagttgccgattataagtcccagtttgattcactagtgtaccaggtgcgtgtgtttgatccatctgtgggagggatgatgctgctgtatcgttttattctgggtctaaaggaagaaatccgctcagttctgctggtccagttacctgacactgttcagcaggctgctgcaattgctttagtgcaagaaagtgtgttactagacagtggacagaaacctcttaagaaattgacatacaaaggggttggcactaaagtggatacatctgttcctatctctgagccatcggccattaaacctgaaagagctgaattatggaaagctaaacagttgaaggaatatagaagagcgaatggaatctgttttaaatgtggggataaatattcacctgatcatcagtgtgtgatcactggttaattaaaagctatgcaaatcactgaagttattccagatgatcttttgaatgcagtggttgccgaagaagattctgatgctgaggagcagtatcatatttctttgaatgcattatctggtgcatctcgccataatgctattcgtttgagagcattggttcagaataaagtattgttgatgttggtggattccggcagctctcatagtttcattgatctcaattttgctcagctgttgggtttgtagttgtgccctatttccccttccttggttcaggtagctaatggtgactttctctcttgtcaatatgtggttcctaatttcacatggtggatccaaggtcagacattctcttatgatctgaaagtggttcagttggggggccatgtgatgaactactgtacgancgagctgttcatcatgggcg

SEQ ID NO: 48864 - DNA, 1462 bp, Oryza sativa
  unsure (1)..(1462): unsure at all n locations
cgcgcattgatgaacangcggttcagnagttcatcattactactagtatcaaatatccagtcccgcgtgtatcctgcagccgcatcttatcaaatcctttacgatgaccgaagctcatatcaattccatcttcgcgatgtgttggcatagcaaaaaaaaaaaaaaaaaaagctaaaaccaagcagatgtgaggacggcatgtgagccagtgacccccactgtcccctaattacggactgcgctatactatccgagacaaaatcccctaattacaggactgcgctatacctatacggccgaatcgatagatcgtggattgaacatggcagatcatccggtggccgattcatccgaacggatctcgaatgagatcgagcgacgagaggggggagatggaggcgggccaggcgggtggggaaggggagggagaacggggggagggcttacgaactcgacgaaggcctggttgcggttggcgccgacgccgcacttggtgttgacgatgcggccgaaggggttgcagagctcgacgagctcctcctccgcgcactcccacggcaggttccgcaggtgcagcaccttggacggcgtctgcgtgtaccggaactgctgcccgccgccgccgccgaccgacgacgacatctcgccgggaggggaggagaggggaagggatctcgcgcgtgtggaggccggagggagcaacaaaaggctagggttcgagttcgaggagaccaacgtgtggctgcctaaaggttgtgcctgtgcgcagcatagatctctctacaaactgaccctttcagaaaactttttgcaacgaccgtgctaaaaacttatttgcataaataaatcgtcagctcaacgctattaagattagtggtgatatataatgctttagtgtcaagaatattgacactcacatcctattcgagaagacaaaaatttaactagtcatatagaattagcttcatggtgtttggtactaagttataagaaaatatataaatgcatgcttgtatatgtaatgcacatgtgagttgctactggatctggtgctcggtactaagttataagaaaatatataaatacatgcttgtatatgtaatacacacgtgagttgctactgggtctggtgctctcatcctgaagaccctggtttgagtccttccttctactccttttaaggatctttaccttttttaccaattctacacttgttaattatttttcgtattttattgggaaatgacacattttgtttaaataaatcatacacgaagaaaataatgaaatattttaggaattttaaaactaagaattatgtagaataagtgttttaattaaagtattaattatgaagtcaataattttaataaaaacattttcaccaaaatatatatcacaatttcttagtttagccaatatgatgagctgctgtacaagcagatagtcatcaaagggggcg

SEQ ID NO: 48865 - DNA, 2815 bp, Oryza sativa
acgcccttgattgacagcctgcttgtacagtagttcatcagaattgtatacaggccacttcaattcacttcctttcaggtctttttccatctttcaggtctcttccctacacagatcttaccaacaggttaacactgacatatctccatgtcttctgtcttggatcaagttttctttcagaactttaaagtgcagacccgtcagttattgtatccccaaagatgtttcaaattgatatgaacataatgtgagttcaagtagtgggatgtttatgagcttattaccaaactgcagatgtgccaggagcactgatgatgtaccagaaggggatgatactgctgaacaaggaggcgtatcggatgggctacaggggaggccgtccagcctgaaggacccaattcagactcggcgtccggctagacaggccaaggcgaatcctcgtaattatgggcctgattgggccatgtaagtgtgctgttgaaagctgtgtgaattggcgtgtgtgaggggaaagaacgagtgagtgggtgagattcagacataagcaatgtaatgaactgaattaaaactcagaacgggcaacttggtggcgatggcggcggcggctcaatcctgttggattggagcattgtaatctaaattggttgccctatttcttgtgttcttcctgaattatgttgaggtgttcgagttagaagagttgtttacaagatggcctagtcctgtcattctgcacattagtgtttgtagtctaattttctgaaccaaacaagcatcttacattggctgtgtttgagcatccaaagtctcaagatttgctatattatctcctgattttggcatgtgctatgtgaatttcataatatgatctttaacaatcatattttgcttgtcaaatttgaggatatgtattgatcagtaaaggggatatttgttgcttctgaacctgtacatgcaattgttgtcaatctttgagttatgataatttattaaatatttagtcacgtggatttcacgtgcatgcttactagtatgtaaaatgtagaaaaaataggagggggcccaataaaaaacctacctacatggtttattttcgtagtcccgctccctctccttttctcttctaccatgcgttaattccttttccatcctccctattactttacctatcctcctttcggcctctcctccctttatctcctcttctcgacggttggtaaccggatccgatagcggcgaaagggtgggatgagtggtggtggaggcgtcagatttgcctcgtgcgggaaggggcgatgccgtgatggttgctagggtgaccacgacgacggtggggaggggcgaaacatcggcttagtgggaccacgacaatgacggtagactcgaggtatgtggatccgtcggtagcaacaggagaagcggatccaccggtgacctctccctttcatcgcttttccccatacttagcgcatggatccgcatcgcccggcatatggaagcagcaatgacgactgtagaagccttaggagaatggatttgtcgccaccgggcggcatgggagcagcaatgatgactgcaacggcctcaagagaacggatctaccgccgccgacttcaatagcagatttactgccaccaggcatgggagtggcaacgacgaccgcaatggcctcgggagtgcggacctaccgccgctggccttgggagtggtggatccgccatgcatgggaggatcgactaacgactacggtagccttaggagtgcggatcgaatgctgcctgcctcaggagcggtgagtggtgactaaagattgtggtgaccttaggggcagcggtgacaacgaccctgggcatgggaacgacgaccgctaccaagctagggtttcaaaaattttctttttggctaaaaattctttttacaggcaagcatcgtgatgtgccacatgcaaaaatcctatttttcacttgcagttgtgttgatcgcctaggaaaacctcaatttttacatacacctagcgcaaggagttgctacttccacctataaagatgcatttcagccattttaaccttagccaaaaaaaatgaacttgacatattttcattcaacttgattgataagatgatttatatgtaagtgaagtagtagaatagatcgaggagtccaaggaagaaacggtacatatcatacatgtcatcgctttataggaaaacagatactttacccagttataaatatttaagcaatgtctgatccatttttttcaaatttttgaccattaattttatatatcagtataagtttataaaatccaataagttcatgatatataatattatttttcaatgcaaatgtaggtatactattttgtttgtgttttacactaagcatttgagaaactatttatcaaaatttattctgattgtcaaatatttatgatagaatagagcaggacaattaaattgcacactttatatcgagctggacatttcctttttgttttctccaaatccctgcatatatatgcagtcgcgcgcatgcatcgatgatttacccagcaaaacacacatatgatacggccgagatcagccagcttaattagttaattattggtggaccattagatttggcgcgctgtaaatttaagggcggagctagaacgaaatagagagtaacacttgcttaatttactttagatcaaatttaagcagatgtggatgtataagtttgtattgagagggtgtatatatggtgaaaataagtaagatatggctacaaaattttgtttgaccggattcgtgggcagcccctcgatcgg

SEQ ID NO: 48866 - DNA, 2936 bp, Oryza sativa
  unsure (1)..(2936): unsure at all n locations
acgcccctgattgattngtctgattgtacagtagttcatcatctgtgtcattgacaaatgggtcccacacatattttttaattctaaatgccagctaaatgccacgtcaacaccacgtgtaaagaagacccggtcaataccgccacgtcagcgaaaccgacctccaaaaccgctgagggagtcaaattgcaccgatttccatagtttgggggttaagatatccggttttatggtttaaggttacggattaaatttcaatcacttttgagggtcaccaagtgaacttattcctaaaaaaaactgtccattttgaattttggaacaagtccacttttactcccttaaaaatgacccgaatctaattcatgatcctaaactgcaaaaccggatatcctgaccctcgaactattgaaaccggtacaatttgactcccttggtggttttggagggtggtttcgctgacgtgacattgttgacctaatctgtggggttgatgtggcgctttggtggcatttgaattaaaaacgtatacgtgggacccgtttatcattcacacataaaaattgggggcccacatgtcagtgggccccacatgtcatcctctctctctttcttcttcctcccctcttcctttctctcggccggctgcggggagcacaggctggagcggcggcgggcgggggccggagtggtggcagccggcgggagctgaagcggtggccgccccgatcccatcgccgtgctccacctccagccaggaaggcgatgtcgtccgggagcgccaccccgaggaggatttccgactgcgccgccaccgctgttgacgccgacgacgccgttgccggaggttgcaaagcctccccaaaaccgatagcaacggcgtactggtcatggcgcttgaatgcgatagcaacagctcatgagatctctctccaccgattatcttctcctgtatgtgccgctcgtcgattagttcgtttcagagctttagactactcacgacgacgatcgccttgccgatctgcctcctgagttccgcgtgctgaaaacgactgccattgatgttaatccattttccttggatcattgtgtgtgctactgcaaaaccgatctaattctgtgttcttgcggtagtaattgtcttgtatatataggagcatttgtgaagaccaaacaactgggcattcaggaattcagagttcagattttagtagtgttgtgatttgcagggcggcagttgcgtggcagccgacgaagccaacggctcctgtgacgaggacgaagcgatgtcggcgaggggtggtggtggctcgtgctcgtggcgaggtaaaggcggtggaagttgtgaattagtgaaactgcagcttgacctatatttgagggagtccgccgcgccctaatccaagcgccatggacgaaggcggagccctcgacgcccttgaccggtcggccggcgaggaagacccacccactcccctgcatccgcatctctttctcctccctcccctttctcccccggcacggcgttcctcttgtcgcatgggcggccgcggcgcgacgggattgcgtccgctgtcgttgccgcgctactccaccgccggtcgtcgctcaccaagctcaagtcccgcttcgtcgagcccgcctgccgccgctgccgctccggtcattgccggccgccgccgctccagctcccgcccgctgtcgctacccctgcccgtctattgctccacgagagagaaggtggagagaaaagggggagagagggaggaggaagaaagagagagagaggatgacatgtgggcctcacatgtcagtggggaccacaatatatttttgtgtgaatcacagatgggtcccacatatatttttttaattgtaatgccacgtaagcgccacgtgtgacgaaaactaggtcaatatttccacgtcagcaccacatcagcaaaaccactgagggagtcaaattgcactgatttcagtagttcgggagtcatcctatcctatccggttttgcggttgagggttacatattagatttgggtcacttttaagggagtctatgtggacttattccttgaatttttgatcgcatgagcttcagttcgttgcgtgggacaatgggagtggtgggtttgtttcgtttggccggcggtccatctggtcagttaaattccgaagtgttagtggatttaactttgaaccctattttttttattaaagcacaacgttcgtaaatcttgaaaaaatcgctttcacggggagtcgaacctaggaacccagatgctactgagactcttgtaaccactaggttacaggtcctttcgcaactttgaaccctatttgaacttgatttgcagaatttggatatgaaagctttggttttaacttctctttttagagaatggtatttttttacccaacttttgcatcaaaacagatgtatgcggtctttttaaattgggaattttgtccctcaaacaacctaatctaaaattcttttatataaagatttgaactcagtatcttgaggtactacttaggtcacaaccactaaactaacttctcgcacctgcaaatttttttttcaaaatatctagctttctcaagcaattcagaaaactagaagtcaagagctttggattttttttcactttttcaaaattttaaaaactgactaccaaccacctgcatatgtagtgtagtcactccttaaaattttaaaatcaaagatgaatgggaggatcatgagaacaaggtggtcgttgaggcgtcaagctctcgtgcagccgcggaacagcaacaagaacaattcggaagagcaaacatgacctatacgtgctttctctctctctctctctctctctctctggataattggagacgacaaatcacgtgattggctnttcgngaggggcatcgaccatcatnnggctcac

SEQ ID NO: 48867 - DNA, 5135 bp, Oryza sativa
  unsure (1)..(5135): unsure at all n locations
ntttgtatattcctaatatgtttatcgtcagctcgttggtctgtatcttggaatttagtattccctcgttttttacttgtcactgttgtgacaaaaaaaatcactgctttaactttgatcaccaatcatttttttaagttgaacaaatccacatggttacatttatatcagacgcactttgattaatatggtactatttttttacaagtaaagtgcacaagcggttattaaacttataaggttatgtcatttaggttcctaaactcttaaaatatagatccaagttttagaacttgtcaaagtgtcatttaggtcttaaaacgtcacaacctctttaggatcttacgtgacgtgtgacgttgatgtggcatgccacacgaacatgacgtgacatcatcttgaccggcaaatgagacctagatgagatattttgacaagttttggaaattggatttgtatttgagagtttgggaatctagatgatacacccttacaagtttaagtatcacccatgcactttactcattttttaagtactaggaataatgcccgtgcgttgcaacggtaaagtcgtttgttccagtggtacaacaaaagccaaagccattttctccaatggcacaacaatcattaggagctgagcgataaattaaaacattggtaccgctatacattatattgaataagttaattaaaatccatacttggctttgggtcgaaagcccattctttcctttctttttagccgcagcccggttgtaagatttccataatacccgtgggccaaaatagagtgaaatggcatgattgaaataaaatatattaattgtgcacataaataaaaatctatcccttaatatcgtagacatatatggaccaataaaatattaaaacataacgtgacaattaacacgcataatttcataggattttaattgtatctcactttggggctataaataaagctaagtgtcaaaatgtcataaaaaacatataatggtttggccaaaatgaagctaaattaacattatatatgaataatggaaataaattaaattttgttgccaaatttattgttggttccatttagctacatatatgatcttaattgcacaagaaagtttataatgcaactttatgtcatcaaataattgcttaaacggattaaaatgctcttatgtaaagaggaaatcattaattcggtccgataataacggaaaatcaatttggcccgaagaccggcaacggctcggaggctagagctggcacgtgatcgtgcggcccatgaggcacgcgaagcccaagcgcggcccgttagcgtgagctgtccgatcctgatggatggctacaatctctgatgggtggctgatgcagtgtgggagagtcgtgggtcctctaatgctgatcggacggtttagattgatcaacccggataaaattgccaccagccgaaaccctaaccctattaccctctctccctggccctattttctggtgctaggcgaggggtagtggtcacggcgacgccgacggagcggcggcgatgttgaggcgccagtgtgtggcgaacctgatgtcgagcatggctccggcgaggccagggcggcggcgcgcagtgggatgccatggccaaggcgacggttcatgtgagctgaggccgtcggcatcgagcgaaatggcggcgatggtggtaaacggcgtgctgcgagctgataccatgcgtcgatccctctctcccacctcagttctcctcctcgacacggcgcaagactacaacaaggcgagcctcgacctcgagcggcaaactgaggcggcgctcaagttcgagttctcctcctcaacatgacggctaagggatgcacggcggtgcgtgtagctgtacaccagtcgcacgaagatggttgagagttcggaggtgcgcacacaggcggagctcatgccgtgcgccacgaagtccgacgaactaaccctaatcccggtgagtcttagggttttccattgagctggtgatttgcctgttcggggttaactgttcttaattttgggaatttcttaggttagggttcgtatttttcggaaaaatcaaaataagggtttcgaatttgggggatattcttactcttataccgatctgattcgcctcctcgtaacaatctcttattgtacttttaggatcggtaggacttaaggtttaggtagtgacaaacgaacaaagattaagtttccttatatatgagctaggggattgggggcgagtccatggcgtaatcggatgtgctcgtatacgaacgaaagattaccgcggaatcgacggatgaaagcttgtatatacgaacgaaagattaccgcggaatcgacggacgaaaacgcggtgacgatcggaaagttacccattttcttttccctttgtttttatttctttttcctgataataggagagcatgcatatttatatttgaccattaggatgggtcaattatttgactgggccaaaaatagaaagatgcacacacgcgcgcaggccatctccatctgaccttcccaggcgcattgtgcacctctctcatcgctacgttgccaagcccatctcttgattgctggatcgcggaaaaaaaggagaactgaatcggaggaggcgatgtgatgcgctacgggctgagaaaaaaaaaaggaaacacatgcgagcgccgagaaaaaaaaaacgatgacgagggaagtgattaggattcgaaggcaacggaccaaactatccggcaaaaatatttttaattttataatagtagagatttaataacttgttattaaaataagagtggtaaaagattgaacatgaatagtgttagcgacatgtaattggaaatggaggcagtgccacattcgtctgtcctgcccccctttgcttctgctgagcaacgcataattttcttgtctgttgtcttacggcccacatctcaaagtaaaaacatcaatttggaggaggcagggcaacgcgtttgggaggccattgtggtgccagcactgctgcagcgatcttggcagtaccagcaacaacagtcagccggttactaatatatactttccttggattcgatcggatgtcattatgaacgattatgggcatgttcactttgatgcaatttttaaccttaccaaattttgataaagttgccaaaaaaaagtggctacatttagtttgctgctaaattttggtaactatataggaaatccagcaaaattttggtaatataatgacaaaatttggtaaggttttttttgacatcaaagtgaacatgccctgtatatgtcaggagcaattaatcacatggcatatgccacgctgcaaagaaaaagctcaagtgactgtgcacttgtcaacctgtccacgcatctctctttgatttttcagtacggagtacccagcaatgacaatgcacgagccaaggttttacaagacatctccattatgtattcactgtgaaagtgtgaattatactcaccacattatttatttattttatttttggtttttttcttgtgaaatcccctggaaaccgcacttgggattgggagacaacaaccagcctactgccatggagtagcaagccactacttagcactagtgccgcgtagttacactggacaaaatcttgtgacactaaccatatggatcaaccaaattgatgtggacgctctacttgtcaccaaacttagattcagttaatgaccagagcttagtgacaatgcagtgtttcttgttcttatctctgttctctgcactcggattgccagggttggagtcatgatatggacaagcccaataaaatctcagcgtgagagctactcctaggaaaggttgtaagcaaatctttcttgtcactttggatatgcctttgtcagtagagagatttttcatcagtgaaaagaataagctctctcacggagaacattttgcagcgaattactgtacaatacaatgtgctctcctttctcggaatctccggctctcgcaaacagagctttaaatttcgctcctacttgtcttacgtcgtaccaaagaaacaggtgatcaatgaaaggaaatctgaaaaaacacacaccatgatttggaacaatggccggcttctttaatagacattagatgaaataaaaggtcaaaggactggaaaggactcaaagctgaggtggttaggcattggcatctaaagtaacaataaagtgaaaatgtcggtcacctacggttgcacctgtgccgtgctctagaaactgttaactgtccagtgtttacctgctgaattactagggttataactactgatggtcccttgaaaatcacaggattgaaaaaacgtagaaataagaaacacatagaaatagtaaagaaaatcatatgcaaaacagaggattaaaaacataggaaaactatagaaatgatcgtttgattggtgcataggaaaaacatagtaaagttaagtattaataagttaatagtaatcagagtttgaatgattttgctaggataaaccatatctttcaatagtgctttgccttgatcctacgtgtagcaaaagaaaaatgagctcacggtggatgttaattttcctatgattttttcttgaaatcatggtcgtaggaaaattttacatgcttttcctttgttcagttcctattaatcaaagggatgaatagtaccaattcccctggtattcttgttcctatgtttttcctccagttttttcccatgaatcaaaggaggcctaaactcttatagtagtattgagaaaattcttaacaaaaaggaattgctttactgaaagatacttcttcgatagatgcatctaagacacatggaaatgataaagatttgttatctgcatacggcaatttttacaggctagcttgtaattttggttcctctaacggtaaatctgtttggttgaacttctctgacatatgagtgtgctaccgacaagaaaaaaaatgtctgaaaaatatgggcctcagttttctgtttgttctgacatgacagcgaagatgtcaacactgaaacagcgtcccaattactgagccaccataattagcatcgtaaaatcttcgtggagaattctaagatctcgcagtgcacagaagcttctttn

SEQ ID NO: 48868 - DNA, 1643 bp, Oryza sativa
  unsure (1)..(1643): unsure at all n locations
atgggncttttntttatttgactcgcgttcgactgcaagtagttcatcagaagggaaatgcacaacatggttgtcgcatctagtcatttactacttcatataagaattaaaggtgtgaaacacactttgaagcaaaatgtagacccatttcatggttctgcattaatattttgcatgtggttttggctttgcaagccatctctgattacataactgaaggctgaatagcaggcggcctaaatttgaaacgatacatttgacttgcttttttctcataaatattcgggatgtaaactttttagcagaaatatatcgtcaatctcgcacaaccgttacacgaaaataacgacgcgagcagtctcgcccgacgaaacaacgagaccgaacggcgaaaacaaggacatgcgcggtggcgacgcgagaccgtgcggccaaaccgcgagaccgagcagtctcgctgaaccagccagcgataccgactgacatgccgattgaaaattgttaattagtgattaagtaccctaattatccattaattaattaaagaaacaatacatgtagtgtacaatatgaggtaaaatttagaacagaaactaaaatgatttctgaaaattggaaaaatgaaataaaagttcaagtagtaatataatttataaataaaaaatgagaatgaaaaatgttgaatgttgaaagttctatcagtataaaacacaaatagtagtaaatgaaaataaagtgggtaggagcaacttgctcttgggtgacattggttgatgggatatataaaactataaataaaaccttaaaaaatattatatttgatttttaaaattcctattacgattaaaaggagaataacaagcatatcgttaagcaactcagcctcaacggttggtgggacttttagccattaattaatcaattaataattactaattatgattaattaattattaattagggtaattactcactaattaagcggcaccgttggacaagacgttcggtctcgctgattccttatgcaagaccattccgcgcgtgtcgtcacgccaacatcattttcacacaacagttgtgcaagatcgatgatatatttctgctaaaaaattacatcccaaaatttctgagaaaaaagcaaatcattatgttttcaaatttaattctcgtagcaggccagccctgacctttttatcggcagatcagaactgtacagtgtctgtactgtagcaattaaccacatgaaaatatgcatgctacctagctttatattcttatcacccaaaaactatttgaactccttgcattttggagaaaagttgtagagtactacttcctccgttttatattataagactttctagtattgctcacgttcgtatatatgttaatgaatctaaacatatatatatgtttagatttattaacatctatataaatatgtgtaatgctataaagtctaataatatgaaacggagggagtatttattaaggtgttgtccttctacagcggtgatcatcaatgncccctgtggggggtgagggntatataatgaataccccgaatagcggataagaccgtttaaccccttaatcacaaaatatgcacgatttatcagcntttttacacaaactaaacggat

SEQ ID NO: 48869 - DNA, 1585 bp, Oryza sativa
  unsure (1)..(1585): unsure at all n locations
cccgttatggagcgtaatcccctacttcctgtgtgtggaatttatggttgaatgttacaagggttcctcaactccggagaacgttcttgctcttcgcttcctggagtttaggcctactgagtgtcgtcctctttttcggcgggaaaggtcctccttttatagttcaaggggataccacatgtgctgcttctacctcttctctcacgggagaggaaccctccttaccttgatcggaccacgatccgtgccttcgcccggaagctaagcagcagtccgtccttgagtgggacccggcgccgccccccgcctgacacgggggacagccctgtcattccctcttaaatgagcgaaggcttgtggcggtcctcctcacgtggagggaactccggataacgctccgatgggacaggacatacctacctccactccgccggatacagaggcgacgtgggggcacgaccgcccgtccaatcggcaataggccggtcacagattggtcacacccgattgacgtgggtccatcgggcggcaccgcacgtctgcccttaccgcattaaacgcggtgagggacagttgggacgccgcgcgcactgatggctgttcagcctgggtctcctccccgctcgcttcccccgccacatggcagttgggcgagggcctcggggcgaggcagcgcgagggcccgaggggtgtgacgtggaaccccgaggccccctggctgcttctgcgactcgcgagacgcggggggagggccaggctgtagagccacgtggctggatgggaaggtgacttcccctcactttgcattcccccgggcctatatctccgatagccctgtttcttttagcttgggattattataatctagattattgagtcagattactataagctagattgttataatctgtagtagaataagcggttagttgtttcttttctagattattagagcctagattattgggtttgcaagtctaaagagggagtggggtggcatggtgggtaatttttcacctaataatctggaaaaagctcaccaaaatgagcttatcatattataataagctgggctccagattataataagctactttaataagttatctgtttctttcaacttactcccaataatctggattataataatcccaagctaaaagaaacagggcctaatatacttagaaaaaatgcccgtgcgttgcaacgggtgaaaactattttaatcttattattgttatacggtttagttaaggtgaaattcactatgagaattcgtttggatatataattttctagaaaatcattagctacaattaggagtccgatcatctcaagttagcatgcgagttttttttgaaaagatttcttatacgactccttctgtatttctaaaaacggacaaacttaaaacacgacccaaatacggtttccaaaagagaatgaacttaaaaaccgactcatacacggatgacgtgttaaagtaccagcaaaaacatcttcaatttttataatagtagagatattgaaagttgttagtcatagatgatgaactactgtaccatcgngggntcaataaaggctg

SEQ ID NO: 48870 - DNA, 1135 bp, Oryza sativa
  unsure (1)..(1135): unsure at all n locations
agcccatgtttgacncctgntggtacagtagttcatcaggcagccgggcgcacgtcttcgccacggggcccggcgggcggccggatctggcgcggtcggccgtgatgcgcgtcaccccggggctctcctcgttcgccgacgagcccgcgcgggccggggattcgctgcggccgctgattgatttcgccagggagaaggtcgggggcgccgcggcggaagtgcggctcatggccaccgccgggctgcggctgcaggaggggcgcctccaggaggccatcctgtcgtcctgcagggacgtgctcagggcttccggattccggttcgaggactcttgggccgaggtgatcccaggtagtgtcgatttcttcccagttcgtaatgctcaagtgatatagctggttgccttatagatgggggactgggaattcgatttaggtgagacgttagaatttgaatctggtgatgaatctgacatattccatggaaatgctaaggtgtcatgctgagacagccgcggttgtcaattcagtcgttgttgtgatggttgcacattggtgattcctgaaatgaatgattttctgaaaaatgtgtagtggatattaccgttgtttcttctctaggctgtatcgttgcgggttgaagtgtagtactcctgagaaatacggcctcaattcggtttatattctggtttagtgagaggcatcaagaaactgaatccggctattcgaaagggaaagcggtgtataaagtaatttgggtagtgaatcagtaaagggaaaatccattggatggtggatacagatggtttttcatcattagctgaaatattgtcagtatggatgctcattttttggctggttcatttcttataggctctgatgagggtatctatgcttgggttgcggcaaactatgctcttggcacacttggaggggatccacacaaaaccattgtaataattgaacttgggagaagctccaccacaggttttcttaattcatgggcaaaaacaaatttggccattgttgtctcttcaattatatgaaagcaccctcgaaatttagggttggggatcctctaccatantatcactatcattgatgagcttctgtaccaggtgtatactaaatggcgt

SEQ ID NO: 48871 - DNA, 3526 bp, Oryza sativa
  unsure (1)..(3526): unsure at all n locations
cgcccatgatggatcgaactgtctgatggtacagtagttcatcaattgcgaagttgacaaattcaaagaaggattaactgaaaattcagataaatcgcttcacacactgtttgctgttttgaatactgtcttctccaaattggaggtatcactccaaaatgtttgtgaggtatgcattgtttgcttttcttgcatttggatgttatatgtataatatacttttgtgtttggcattatgtaatatattttcttcaggggcatactctactgttcgcactcgatggaagcccatctgaacttctctttgaaagattaccagaaattgattatgataactcagagtggacagaggcctcctcaacagatgctatatgttttatctaccaaaacctccagaagctagataaccttgtttgctctcaggtaagcaactttctctttcaacaacagcaacttgtctcgcatttgctacttctattaatgttacctgagttgtagatggggtatggttggatcaatgttatactattggaggttctatgattgggcctgttcggctgcctgttctgcagttgtggcacagccggcaccaacagtgccacatgcacacgcgcagccgcagccgccgctgccagcttgctgaacaggcccactacctgtttgtgcttgctgtataaaatgtttatatagctatatgcatatgcattgtttcagactataaatgagtggtattgtcatacctatagttctgaacaggcgccccattagcatgcatataatggagcaacatgctgattatcaaaaccatgagatttgagatgtgagaattaatcatgtggatgaactagtgaaaatgtgttcaatgccaaacttgtatctcaatacagagtaaatgtgtaaatgtatagcattctccaggtagtattttattttttgtgatttctccatttatcatatttttacttttataaactatgtaagttgcagttatgtagaaataagtgggtttgttcactgtacaacaataaatcttacatttcttatcagatgattatatgttgcttaattgcctgaagcaaatattttctgcaattatagctctcaaggcataaaaaaccaagacatatgaccatatactggttgccctacacatgtggagcgttgggtctctcggcatgttctctgtggcttttgcgacacagtagcttgatgggaagttctgacatcgacaactgggttcaaagtgccaaagagtcaatagctggattttgggatgtgcatgttgagaaacctgtaggatactttctatttatgtccttctattatttatcttatgcatttttaaatgatgctagtgtaagttaactgagggtgaatcaaggcattctagttaaagtcttttctcgttattccgacattgacatatatgagatgttctctgaggtacaggaggataagattttgttaatctattcatgcaaatatttgtctaacaaaaaggaaaaccagataaagggaaagaaaagcatgctgccttgtgcatactagccgtactgttttcttatagtataagcatatatgatagagtatagaaacaatttcatgtgtttgtttactgcagcacttgcacttattaccatgaacatccttaagtttacatgtgtatataaggcatataactaactactatctttgttgacaattataaggcacacacgtagtttcaaaattttggacattgtaattttttaccaataaataagtaatgtaagatgcaacattatatagttgtgtgatacaaaaatggtaattttgaatttttgtttgcaataacttatgatcatgattttgtagttacacacgctatattgcaaaagattcacagtcataaattcattttggcagaccacaccaagtcaaatcgcacacaatattatataaaaatcaacagatagtagagtaatatgcaccaacatctgcaccgaaatagtctaaatactattccttgtggaaccattgaatgcaacatgatataacttcagagagcattagtgtaggagatcaagtgtcaagttttagtggggaacttctagttggatttaatatagctgcaatttttttccacacctttgttgtggctgaattttgatattggtcttaaaatttggaaatcaattatgttattgtgattgcatcatgattgttttattctcatttgatgatcattagatcatttccatcagaggtgagctttttgagacattcaaaaacagaggtaaacatgtaatggatacacaagaggtccaactgaatgaagaagtattgcgcaggttattccctgatactacatctctaatatgcaaatttaatggtaatcatatcacatagttttttctgccactcgacaaattagtaccatattgcatatctaatattgcattttcatcatgttcatctgtttactcagatatgaatactttagatgatatttacctgtggtttcaagaattttaagtcgagtatgccagtatgggggtttcaataatgcagcagatatgcttgtaattttgatttgggatacccaccaccatattttgaagtgctttccaattattttaggcataaatagtggggtagtcactatgagtatttgtcttgtgtgacatgaagtagatgtggtggcacaagagcacagtggtaccagcttagaatttctgtttcctttttgttatcttttgtttactactgttaggattctgtcctcgtcctcaagataccaagtaagtagctgctatgctgagataagatatgttaggtcctttctctgtataaagggtcagacaaactgcacctgctttgaggaatcaatcaatggaaaaaaaatcctaaaatatctctcactccttgcttccctcgccatgcaacagctacactacagctagtcagtcatgcagtaggtgtctagggacatgtcctgaaaacttcccactacttccattcccgttttaacccacagtaaacaatatgaaagtattgtacaggtgtgatgattgatgaagccattgatgacatagtaaatactgtacaaaagagtggtgacgcctaaacaaaaagattccccaacccagcaccaagattttcttcgtttatctacttttttgttgatattattggttttgactaatgttttttcatcttggagtgctgtaactttttcagtaaaaaatttgcaatttcttttgtcttgaacaaaaaattacaaactttaattttcttgaatatgcaaaacttcagctttgcagccatttttttctgagtccattagaggagcataaattatattttgcattttttaagcccactggttacatattggatttgtaggatgatgcttgaattttgtcagcaaacttcaaatgagaagctgccacaagatatatcagatcaagcacttatggagaatttcatcaaaacgttgntcnncngnnnnnntnnngnnggncnntgncagtcgtcacaaggggcg

SEQ ID NO: 48872 - DNA, 1375 bp, Oryza sativa
ccgcccctatttgagagctcgactgcaagtagttcatcaaaaatttctgtttaggatgaccagttaatcacttaatgctcagattgtgcttctgtagtggaaagctaaattgacagtagacatatcctttatcttgtttatttgtgcattgaactatatgcatgtatttgcgcagatatgagaaggaatggacccatcctgttaagaatcttttcggtggagagttagcatatgccatgcttatccaggttagttcacttgactctattttggatgcatcgaatattccacttcatgatatttcctattctcaccttcaactttgaacattcagcttcagaagcgcacagtggatatcaagcagtaagttatactatttctgtctgacaataataactaaaatgcataaagatatatttttcttggctaatattcatcaacagatgtaattggattcttcttacacagggcaatgctggaactggatcagattcttaaaggaaatgcgataaacttcgctattcttgcagctttacctgcatttggtgtttcgcttttgctcctcactgtggtgcaagcatggattatgaatgtatgttaatagagttccgtgattctatcattctctctttgaaatatcatcatctgtcagaagtatctgtaggtctgtggggccttgttgtgtttccctgtaacctatttgtgccacagatctttgcagtatgtggacatgcgtgtagaaaagcaaaaaaatatggtgactaatgtcttaattataaattaggaccaaggcgccgagggaagaggcaggattgcacggcgccaaagaaggctgctgcttcttgatgcagagagaaaacttatggagtttaaaaattgcatgattaatggaatggtaatgttatctacatctatatgagttgctctttaggattcattctctcaatctttaaagagcttttcggcctaaatttgttgactgagaatgcttcttttgtatcgatgacaaagccactttgatgagtgctccctcttattattattaacttttggattataaatttaataatattggaatgaggggcaccctttacaaatgatgcctctgaatttcttcctttacaggaggaagaggcatgctgtaagttcggattaacactgtacaaccttgatagattatacagagctgttgaatcacatgcagaagaaacaggcgagtggtcaaggtcagtatcaactcatattctttaccatttgattcctggttactctggatgacctttccacaaaatcgtttgtgttgcagattaagagaagacattttggatctggcgaaacctaagatgagtatgacagacaagctggtggttcttta

SEQ ID NO: 48873 - DNA, 773 bp, Oryza sativa
  unsure (1)..(773): unsure at all n locations
acggcatgttganctacatggtacagtagttcatcaggcatgcataacaagtggatctgagacatatcacgtacatgagcaaagctaggttattccatcatcaaataaatagaataagtaaatggcaaaatgctctacaagtcctgtacatacacacatgctatccttgatctctcctctaaggctcccacccagctcttaaaaaggagaaagaatacaaagaattgaactcgtacactatggtacacataacaaacatctattcctgtcgtatatatatgtgattcctctgcacaaaggtcagcgtcagctgatgcgtgtgattatgtaccggcctttctccaagtcgtatatgatcttcgtcttgggcttcctccatcttgccaagcaaagtgctccacctagaagaaacacccccagcagcacagcaagcaatggtctacttctatgggctgatctaccagttgctgatggctctacaattacgccttttatgtttgagatgaaagcccccagggcccattcaacttgagtgtctccaacctgatttgaatactcaatcctgcggatataagaacatttaaatttaaaagtaggtaagcatataagatcgctgaagagtgaatttcagcggaagattgatgtgccatggtattcttgcctcttgtcatccagtggtacaccaagactgtcgtgcagtagagctacaatatatgcggatgagaagcaataacgtgaaaaatcatcatctgaccgattaggatacattttcc

SEQ ID NO: 48874 - DNA, 746 bp, Oryza sativa
  unsure (1)..(746): unsure at all n locations
agccaggtgatcccntgtacaaagctcatcacatgttttctcgatatgtctcgcgaactccatatatagtacctaacaagcacagaaaattgcgcaccaccaaaaacatattatcagtacaccaacaacatgcgactgacgcatggataaattctcctattacatactagcgtgatgctactatatttatggttctgaggtatttagccataatttacgtgtattgagcgtggaaataatatagtgcccttatttgtatggcactgacaaagcggatggtgtaaaatggtaagaaatttatatcgggccattgatgagataagcaatgctctaataataattattgtgcaacaaaatttacaattccgctggacaactgatctaagacggggaatatattacattagtgctggctggattacgtgagtctgacatattacatgcatcgcnctactaacaacatactattgcaatacagtggaattgctacgtggcaatcgaacctaatgattgatcgatcgatggagatccacttaataagtggcaaggggtatgcaataagtggcaaggggtatgcgatttcaatctgaagtttaagggatgtctcttcctcgaaatcttgtttttttatccgcctttttaaggacaacatacttatggntctaggcgcgcttctatacgaccaagtctctcatctgtctttctcagtgaaccggccttccggggaaagtcttgccggacaccca

SEQ ID NO: 48875 - DNA, 3065 bp, Oryza sativa
  unsure (1)..(3065): unsure at all n locations
aggcctgtgtagcccntcatggtacagtagttcatcaatgatgatgtggcatctttgcatgttaagcttaaggagttagtgggggataactttatagtaagataggattagtaccattaactcccaatttaatccgtccttagatttgaatttaacttgtacatttcattttgcagtgcaactttgcttatgttatgcttgtatttggacagaattttcaggtattgttcttcgcctttcttgattttatttaatttgcatacattgccagatttaggtatccatatttctcaattagcctctctaccattgggagaattagttacttgtactatttccagcaatggttaatagtaacacactagtacagtagtattacatgagtcaaggatataaataaaactatgcacttgaaatcttaaactgattgtgcatcggagttaacctacactgtgcatctttttttgtctgcatgctttaatattatcaaatgagaatgaaataatttaactcagtctaatgtatagaatatggttgaaaatttcttagtctgttggattcattgtttcactagctggtttcattctttgatgattgggggctacattttatgtattgtcagaaccatgaaatttggcgaggttcacgaatttgactgacataattctgttacttatggtttagcaaccatatagcctgttagagttttctgattgtatctttgctagatatagccatgttaaaattttctgtccagatttcactgatggcggtggctattttaaaaacaggttatatctattctcacactagctgggtttatttcatatgaaaagaacctggttcttgaagatgcattcaatcaaaatatgcttggttcattccttctggtaagacagtttggtcacaattttagaaaataattttcccaaaacagaaatgttccaactaatagatcctcaatttgagtttctagtatatttggaacttatttttggtaagtctgtatggagtaacatttaacttcatcttacaggcaaacatcctaactggtgtagtaaatctctcagttgacacactctctgcctcttccggcaccgccttcatgattntgttagtatactcctttactctatgcatgattgctgctntagctcagttttgcggtattaggatgaaattttggtgaattcaagagttatctaatacgatgtatgtatattaattactttctcagcaagctttcttggaataaagccaattgttaaaccaattagtctttcctgtcatctattctgcctgttttctgtatcttagacctagatctagatgattgctctagttccgtcccatatgaaaccttcaacgttctgagaagctgcaatagctaagccaataggttatcgtgccgtgtactttaagaagacatatatcacagatatgttggctaaattacgatctatgaacagctcattgttccattaattaggcagtactcaagaatttgacaaaactacctgcttagcattcaacgacccaaccttaatttctttcagaggaatccaacagataaatggtactcattccgatattttttgatgtttagcacaaaaacttataaaacttaatcaccactcatttctcaaataattagttttgggaccacctatacatttgttgacaaattttctcctaaaaatttgaatttgacaggtgtaattatagtacaatcatagtgtaattacactgtaacttgtatgtaattacactgtaacttgcatataactaccgtgaaacttgtatgtaagttccacataattttgaatcggtagatctattacaagatttgttctggtgagggagaaagaaaataacagtacacacatgtgtgaaaggaattgttcccacagccttattttaccgaaataagatgttatggggagatttttgaaaggtacatacaagttacattataggtagtgtaattacatgcaagttacagtgtaattacactacgattgtactggaattgtatctgtcaaatttttgggagaaaatttgtcgacaaatatatagcaaaattgttaatttttttagaaactatttagaaattaataagccgaaaatagggccagcttcaattgggccagaatcagacacacatcccgaataggaataagtccactttgactcccttaaaaattgacccgaatctaatccgtgaccctcaaccgtaaaaccggataggatgactccccgaactattcaaactagtgcaatttgactccatcagtggttctggatggcggttttgctgacgtggcgatgttgacctgatctgtgttgttgatgtggcacttatatggcattaaaataaaaaattatatgggctccattcgtcattcaaatgaaaaaaaattgcgaggcccacatgtcatcctttatctatcctccttccccccttcctttctcccttctctgtatgtttctcttcctccagattcggtgcggaatctggagtggcggcggcggcggcagggtgagggccggcacggaggaaggaacttgagcgggtcgttcggcggcgacggcctcagctcgccggagaaggcgggggcgttcggctggtggcctcccccacgatggtgccgcgccaggctgggacgaacgagagggctaatgtagacggcgaagcctgagacgccgctggccccagccgtgcctcttggtctgcgccggcagggggtgccgcctctgtttctttctgcccgaagaacatgcatgtgcatagcgttgcctagcagatgcaagtgcagcgccggtgtggggtagcaaggcgcggccgccatggaatccagtcgaattttggcaggaccagtagctgcaggacgaatccgtcctaccagcgtggtccacctgagtcctgcagatcttgaggtcgtggactggtctgattttattctttgtggtcactgtttgcaaggtcttcaggtcgtagacaatagctacttcattacgaaggacaacgtgatgagcgnctncagcaanacgcgaacataggcctg

SEQ ID NO: 48876 - DNA, 1075 bp, Oryza sativa
  unsure (1)..(1075): unsure at all n locations
agtccccacaatatattttgtgtgcaaatgacagacgggccctacaaaatatttttaattgtaatgccacataagcgccacgtgggatgaagaccgggtcaacaccgccatgtcagcgccacgtcagcaaaaccgccatccaaaaccgctgagggagtcaaattgcactagtttgaatagttcggggagtcatcatatccggttttacggttgagggtcacggattagattcgggtgacttttaagggagtcaaaatggactttttcctcccgaataaacaggctggaactaccctcctgccatctttaatgggctgtaattagcccacgatacccgtttaatggactgaaactaaatacttggcccactaccttattatctcaaatgtttggcccaccagttacaataaaagggctcaaacagtttttaggccctgggtgatcttaaacaggccaggacaaattaggcctatatatgattttggtaaggcggaattaggagcggaacaaacataaacaggccaggacaaaatttaggcacacaacagtttttggaagagcgaattttgacccataaacacgtaataatcaggctgaattttgtcgatttgtaagtctatatatccaataggcttcgctagcagctgttttctagcctcatcgtttgccctgaaaaaaattagcagcttccaaaaattaaattataaaattccattttgaagttaactttagggtattcaatatagttttgttttcagcattggattttaagtcatcaagtacatgcatataagagctttacctacaaattattgttggtcatgttttgtcatgtacgaccgccgttttttaatagatgacatcgtcgactttttctcacaggtatgaccattcgtctgattcaaaaattttaagcaaatgtataagatatacatcacacagagtattatgagtgatacaacaactcataacaaaataagttataattacgtaaattttttgaataagacgaatggtcaaacatgtaaaaaaagttgatgaactactgcaccacacgangggatacacagcgcgg

SEQ ID NO: 48877 - DNA, 736 bp, Oryza sativa
ccgcgcctgagaccccgtgtgatgccctcgttcatcaagttaagttttctgaaagggctaatttggcaaattttcgggctttagtgaaaagcttgagataaaaggcggtgtacacgggtgtctcccccttggccgcttccctaggcttggcgtaaaagaaaatctccccgtctcgtcgtctcctccgctccttgcgccatctcgcggctgaacaggggaggggcggcgatctccatccggcgagcggagcaagggaggggaggggatcttggtgagcatccatctgcattctctttctgattcatctatctctctcttccaccgggattgcacctccgtggaatttgcttgcgttaaccctagcttctcttatagatctggaagaggttcttctatttgatttcagagccttaaccttaatacaagtaacagcttgtttgttccccccaatagtttgggggttcaactgaacccccacgtcccaagttggatccgcccctgattcgcgtggttggagtgttttggttagaattttttttttgtcgggatatctttggtagttcttgcacctagatagtaactgcaccggtaaaaaagaagccgagagggtatcattgatagaccaaaccaattttgttcttgctcggtagatcctttactggcatctaggtgggatgaaccaaagaagacctcccgtcattgtggatgggaatggattcgtccatttggatccgtt

SEQ ID NO: 48878 - DNA, 17129 bp, Oryza sativa
  unsure (1)..(17129): unsure at all n locations
gtaatggggctgcagcaccagccttaaatgctgttagttgggcgttgagcgcgcccacctaactcacgcatgctgggggggtgcgtggagggggtccggatggcctgacccctaactgggagggggcagccgttgtttaaccccgggcccgaccaccccaaggggagtgccacatgagtttgggggcggcctcctccctctagacacaatacccccaggcttatatctccgacaatcactactctgttgcttttctgtaattatgagcaatcaatatacatttttttgacaataggactacaaaatgtatgaaataaaatgttcctactaatgcaagattaagttggtcagtgtcataccatatcatcaatctcgtcaagcgtcaaattagcaaccaaggtctctgcaacctcatccaaccctcttattaggatctgaaaaattagaaacaaagctatattagactattagcaaataaccaagaatgccctttacaacaatataaatgagaaatgacacaagtgatcacctcttctacatcgagcaactcaatccttggtacaaactaatgcttataccattttcgagttcaagtttagtacgaaatagatcaataacacgtccccctgcactaaaagctgattctaaagcaacaatgaaagcttgaatggacaagcacgtgaacaggatatacatctttgtgagctttccaccatgataagacatcaaatttatctccattaggaaccaacagtgatggctaagccatttatttatccaagtcacttgcatcacttccactatccacatgtgaggcatagacataattcataaaatcataatctgcttcttctatagtatggctttcttttgattcaacattgacactagttgttggtgcaatagtagtcttataaaaagaagcatattcttgataaaattgcttaacaacactagtaaacttttgcataggtgcatgatatgattgcttaccatacacctcagcatgttatactctactgcctttgtcttaaacctaggttcaagaaagtatgccacaacaagagtaagatttgacctcttccagtacttctcaaccttcttattcattgaggtggccattgttttgatggcaacatcatcacttgtcatccatggagtaattaaagccttgatttcacgaaagttgtggtaaaataaatttgcagttggataagaagtacctgaaaaaaaaatcttagtgatatcatcaaacctcttcaagcacatgcaaagtgtttagttgccttataccaatcttcagcttttggaacaagaccctcataaatttctcttttagtttcataaagcctctcgaaagactttctataatatatggcatctgacaactgacaacatatagtacgttgaattccaccatgtcaaaacatcatttgagactcccctcgctatatccaatccactctcagatgcacattttataaattcctccttctgtataggagaacacttcacaagaatcacgaatgatcgaatactaaaaacagcttgtccaatatgtgccaaaccatctctagcaacaagattaagtatatgacatatatctcatatgaaagaatgcctcatcacacatgaggggactttttctattcagcaccttaataacatccttaacacaaacatcatttgctgcttaattgtccaaagtaagagaaaacatttttttatcgatgaaccacttatgcaagcatggagaaaatacatcagctaaatttagcccaatatgcctccctttacatgcatgaacctgataatccttttttgaacacaccaattgtcataaacccaatgaacagtgatacacatgtaccccttgttttggttagaggtccatatgtctattattgcactaaagtgagcattaacatttttaaaaagctcatacaaccttttccattcttctgaaaatataccaagtatatccttcctaactgtgatacgactcttcaaaggaaaagtaggccaaagagattttatgaagtcaacaaaatactcattctcaacaatattgaaaggatactcatgcatgataattgccaaataaaatttttgtaaagagatctcttgatcatacctgtatgtttcaaccgatgttgtaccggaacccttatccattttgagttactgctatcctggaaccacattgtgggtttttgtgtggttcaagaacacataagtaccatttcctgctattgcgcctagctaaataggcacaatatttgaacttggcccactctttttaaccatctagccatttatcttaaccaccttataaacaatattgtagtgttcccaagctggcgaggatctcttctttgctttttttgctatatgttcatcattagtttcatggtctcaatccccatctgcaccattgttatccacatgaacaacaacaatagtgttggttgccactgcccacagttgatgacctttctaccccttcagttggagctagtgatgaggcaaccatgctagtttcagcagctgctgttgctttagtacctctttttctaggtgccatttttagggtcctaatgaatgatgaacaattaaacaaattataagttgctattgacataatttcttaaagcaaagctcatcactaaatttctaaatcccaaatttcaaattagactacaagaacacaatacctgatttggagccatggagagtattgttggtatttcttagcgacactactagaaatataattcccagcaatagcactagaaataatcctggtatattatggttacatatgtgatccgcaagtgcacggatataccattgtagcatttcacccgggagtattccaaggtgtcgtatttatttgatcccaatgaaagatatgataagagagaactttactaacaattcatatattacttatatacatgaaagtttatgcagaggttaattcagttcaaagggtagggtgacacacagaagaaaaaactaagatactctcactaaaatatagtctaaaataaatggagaaagaataagaaaagtatcattcctgtacttctagtatacatacatctttagtctatacttgctattatacagtcatgcaaccaataccccgtacctagtgtcctcctggtgtttcaagagactacccctggttgctgagttccttacgacaacctgtcctggccatccaaccggggctaaatacggaggagtaccctccccaggaaattgcacttagaataatatacacatgcagaggacacccatactgagccgtcaccatcagcggccagcctctgaaccactgtatattaccccaattaatggtatctaataaactaagcaccgtgcttatattactaaatactactctacatccttgcaaccgacatagagcaaccgaatactcagacactaaacccacaccaatacacctatctggaaagctagttgcatggctatattgattcaagtatgaagtaaagtcggcactcaagtaatatgaatggaataaaataccgaaaatgtataaagaagaatattctattaattcaatatgtcttacaaaagaagagaggaaagctactggagccataccagcaatctcctgaagactcgaggactatgaagactattctattttctactccactagcactagaactactaaactaaacttgagagagctctagatctttttcttgaggtgtgtgagggaatgaatgagaggaggggtatttataggtggagaggtgctctgggagtgtgaagatgctccaagcatcctatgagcatctttgctctcctcatgacaagtggcatactcaagcatccaaatagcatatttcatctcctcttgctatgtgtccatgacgatttcttcagatagaattagctccaaccgtcataggatgccggtagtaaccgcctggccgaagatgggttggattgggccaactggggggtcggccgaaccctggctggctcccctggcccacagccttcttcaggatgctgacatgtgggccccactttatggtacaccatgttttagctcagaataatttctcattttatatgttgtagctcaaaaccatgtgagtccatcggcgcaaaatatattcacattcttcacgttcattctctcccaactttggtggttaatcacctctcgacggcttccggattgattgttcgtttgttttccatcgattctcctccattcatgcgtgcttctcctgcatacatgttagtagcatagcacatagtggaagtagatattttatttgggaattatgcattgcaaacatagctagtcttcatatattgggtaataatgacggtcgaaactggtcgatagcgaccgtcaacaagtatcacctattgctgttggaggcgatgcgccaatgccggatcgatgatctgtttaggaggccgtcggcttgttgttgtcatgggaacatggaggaggcggtggggagcaccgaggctgattgcgtgggcttctgttttttttataactgttaaaatcttttatgatgtctattttttatccatatataaagttttcatagatgtttacacatacatagcagtcacacataatgtagttcttggtcattcaaacttacggtaaagaatttcacgcctttgcacatataaactttcagcaataaaactatagctgagatctttgataattaccaaactaattactctacaaattttgatatctcttttttttcttaatgactcatgagcatttaattttctcatgagttattgtgatatcaaattggacatcagcaaatatgaacatgtggtacatatccatttttcaggtgacctccgatccatgattccctagcttgtttgtagcctatagaacggtgtagttgaggctcatatatgcaaaaagttattgaaattaattatgccatataagggtacaaaatcaaccgaaatatttatgccatgattaaaaagtatgatttttccaaaatattgctcaatagcataattattttgatgctatactaaatagcttctaaagtcgattatatagtaacaaagaatatattttagaacacctatgtaaaagattactccctctgctataataactttattttgcccccacaccgtttgttttcaaataagtttatttttgagtaatcattgcattagagtttgtgaaattaaaggataaatatattgggagtagataaaaagagagaaataattgcattgggatttgatatagtaagggtattttagtcttttatgttttgtatcggtatacgtaggatgggtgaaaatggacttatttcggacatagcgactattaggcttgcttggattactcgagcaaatttcaaaaaaaatatagagtaattggatcctttccttgagcacgtgttgtcctatcaaatattatacaacccgttttttatgccgcgactttgactattcatacttgaattaattctatatccaattaggtataaatgtttgaaaaacaatgtatgatggggcaaccctgtttattgaactgtttcatacttttatgttaattcgcatgacatatgaaagggtagggatgttgtctctcgataaaatattatttaatatttgaatttgtaattttgtttggatattgtagatttaatttagatatgtatgtttatggaatgatatatgatgactcaatatatgctgtcaaatttttatagtattttattgctagattaggaatgagatttgtagcttgaaaatttttgctgttttagtatataaaattattgatttttctcgattaatttagtagctaaattaaaggaggaggagagagcatgagctagagaggaaagctacagagcagtgtgcaccgcaaacgcatgcgagtggaaggggccagcgagtggttttttacttttaaagttctctacatatagttctaatggttaaaacaaatgggtccatcgatctaagtgagagtgcggtaagttttttttccatttttgttctcagaatttttagatcaattttctaatttattagatgcatcttgtggtaggttaggagcacagttaagaatgtttaatggacttttattacataatatattgatatacacgatgtttaatttaatgaatatttattatttgctagctagaaattaaggaggccaaagtgagcaatgagagaggatttttggtagatggtattttgtttttttctattaaaatagatctaatggtgtaaaataatgggcctattaagtgaaaatcgagggtaagatgttttgctttttttagaatttcttggatttctctaatttattagagcgctaagtgatgttttagaagcgtttgtagaaattttaatgaacttttattatataatagatagataactttatcttttacctgtgatccctcttactaaaatcacatgtgacaggaaaaaaggagaaaatttgttgtggaaaccgccacctatattaaaacttggcaactcaatcggggaccattggatccaaaatgtgcagcctgatgaagccttgccagcccaaccgtccccacgttacattttatgaaatgccccccgcaccatgctgtgtacaatttcatatacatcctttaaatttcctcttttctcacgttgctacatctccacttcaacaccaaatggtctagatccaaaccagatccatggaggaggggggaggctgcacggcgcgtggagattgatagagcgacgacgagctcgggccagtcgaatagttgagtgaggagacacaacggtggaggcagaggcggctcatgagcttgaatctggtctttctcttccccatcgatcctgcggtgagcctctctgaagacctccaaatccctttcctccttagcagtcaaggctggagctgctgctgttctcttaattgccaagaagaaatgctccgagaactgagttgttgtggctgctgcattgtactctcgatgattttgtatctttagttccttagagcatcaccaacaatatctgtatatggttatcttgaaatttgaagattttcgttcaaaaacccagtccaacagaatccctagccaagcgcccaatagttcaaaaaccgaatttttcgttctccacaagtagggagaggcgctcgctcccaatctccctctctcgtgccgtcgtgcgaattcccacgcgcacgtgaagtgttctcgacagggggttcatcacgaggttgttcgccgtcgcatcgaggtgtcttacaggtgcccacatctcacgcgcgcgccgctgcctagagctttctcggcgtcgatagttcctgctctggcggcggcagcggcaccatctccactacagccaggcgaacttccatcggcccgagttggtttctcctcaaatcgggattggtctctcgatgatggagatgagcgaaggtatctgctagtgcttgctagttttggcgctgctaatctgctactacgaattctacagttggtactgaataatgttgttggtgccggtggtggtgttgaaagttgatgttggtgttgctgatgatgtgctgttgttgatgctactgacctgctgctagttgtgatctgctgcttgttgcttgccatgctattgctaattgccatgctgttgccgatctgaatttttttttgaacgacgtttgctgatctgagttgacgctactgatctgctattgttgaaaatggtacgatgttgttggttctggttggtaattagggactttgctgatgctgctacttgtagtggttctgcttgattgtttgcaggatcagatttgctgacgtgctactgcgtggagaggggtgacagggaggtgaccaccaagtggttcccgcgatcaatggtcacacgggcgagcgtgataatctcacaggagggagagcctgaaacagatttcagttggtagttttgtagagggaccactttttagatttagggagtcaattttagccaatctcttggagggctcaatattttaacaccttaaattttatttaagattcccataaacaaaattttgggatactcttggtgatgctcttactgagttattctagtacagtactgaattttaacacctatcattattctgaatttttttatgctacttgtagagaagtaaagagcaatactttctagtatatctgttagtgggttttattatgacccacacaacgggtaatgtactaatgagaatgatttgaactgaggaaattaaatttatattaatatttggtgctatccctaaatttatattaatatttggtgctatcccaatctgcagtccattggaaaagcttgagaggagagcaacatgcaacagacaataatcctgtgggtctggggttcagcacttcaaaactgacgaccattgtgagaatacataggaggtgctaactaagatgattgaaggtgacaatctagaggaggtgctgcaggaattggaggagatgaagaacttcatcaagacaatgcatagcacttatcatgctattaggatttaaaaagaaaattcatataagagttagtttgtaatcaatttgtctatatactgaaatgacaatattacacaatgtgtaaaatgcctctgcttcttccaacttgacttgcactgcttttgcatctcaatgacagcccgcgcacgagcagaactcgacggcaatccacgacaatgcacggcagtgagagttatcgttcttcccttccttaattcaaaaatgagcacaagaacaaggttttgctgaatttcaagtggacaatggacactgcagagcagactgaagtgaatataatctaccttatgcacatgacaacaggaaatcgtgcctagggtggaaaatggcatctccctcaccacatacacagaccacatatatggacgagggtgaacagatatataccttcatgaaaaaaaatngacatctgaacattcagggaacttaattctgaagaaactcaacatgaatatatttgtatagagacacgaaaaactttcatgaccatggtgtgcaaatgcagcacaccggtttgtgggaacacaggtgcagaaaattactagttcaagtagaaaaatacagcacacagaaaatttatccagttcaagtatatttaggattttcctagaaaatcataggtccagattgtggccacaaacaattggcagagtcaacctagtccatcaatgtataccgacatggtctgatattcagatgtcttctgctgacacaatttagatcccacagagttttggcaggtgataacattcataagttacaacacttgtgcacaaatattagttatccccttcaaggtgttgtctaatcaaaatgcaaccttgctattaaatggctaaaatctattaatagatcacacacgtgtgcactggatgatggcagtggctctactttgaacaaaaaactactctcagcaaaagaattctcgccagctgctctcagcaaaaaaaaacctgcacccagcaaactgcatagtgaaaaaaattgttaagaaggacatatatacttgtgagcatagataaaaaattgttaaggacatatatactggtgagcatagatacatacaaagttttattcacactacggaccaaactaagataacaaaatgttcctggaacacaatggttgttctaatatttttttcctgtcttcccatatgtactcttaaccatttcaagctgaatattagctgtccaaaatgtccttgtcgcaatatacatttgtatatgagccgaacttgtcgcaatatatttaaatattttccatatgtaattcttaaccattccaaactgaaaatgcaatccaaaatgattgtgcttcctacacatcccgctgtatattacatgcccacttgcccacctcgaatccttcccatatttttttatactttgttccaagttgataacactaggtcccaaatcatacagtcaaaaacttaaagagctataaataagaacccatgcaaaaatgcaagggaccacatcagctaacaggacaattgtacatttgcgatttatattattaattagactcacgacgacaatactaaaaatgttattacctcacaatggtcccaactaattatatttcaacatgtgttcactacctactgttagttaaatattatatggccacctattatcttttacatgaattgctactttgttccaaggaaatctacagtatgtccattagaaccagaatgttcttggcacactatagactttacgatacaccgttagttgaattttggatgacaacacacaatcttttacagagaaacgctaacttcttccaggaaattgtatgacaactattataagatgactgatagttaaggaagcatgatgtatagaaccttgcatcactgttgtggttctttgttaggacagttgcgcgaatcgtgcagcacgacttgtttgcacttcttgcacctttgtggtactctctcttttttctttatcttcttgttttgctttttctccttgtcattgtgccctttaattctctttatccgacccctggaacgagtgtcatttggcgggtggatttcaatttgacttggaatgctacatccaagatatgattcaaattcctcaatttggctaagctctttttcaggaaccatctcatttaatttatcaccaagcacaactagttcatccctcaaaagttgcatagctgctgctgattgcttagcttgtaggataagcttctccatttggttgcatgcttctgaaagcattttttgcatcacaggatcattactgttgcttgtgttttcttccaacaagataccatctgcatcgaacacatgtgtcttcttgcagtccttcctaaacctttctaataaatagtatctcggcagttcacttagctgggcacttcttaggactggaattagatgacgacatggtataccatgagtttcaaatagcatacatgtgcacgttgcaaccattgtctgtctatcataacgcacaactcttggcttcctggattcttcaatgatatcaatgattttgacctagccctcttgttgcacattgtcaataaggcaacggtccctggcagctagcacctctttctgaattatgctaaatacctcatgtgtgaagaactcacttgcatgcttctctatcacccattctgtcttcaaattgcggattgtgtggagcgtaatgttatcttcttctagttccttatgtctttgttcttctagtgcagcatcaaacctgagccaaaactccaccaaagcaagcttccgcccaattagacgagaaaagaatgaattggcactctctgaccttgaggtggtccttaacaatcctgacaaaggtatgtcactaaaataagctggcacccatgaacgccgttgatcgaactttgtactgaaccccagaccccagacccacatctcaccatcattctaatgcaatatgcaagataatggagaacataaagcacgacggcaggccggcagcagcaacatcaattctacgcacgatcctcccatcgatgaataacacaacagtaacagctgcagacgccgccggttgctccacatcagtgggtagctcatcataaccttacagaacagcagtaatggagggacaccattactaccttttgttggccaatcgatgaggggccaggcccaagtggagggaaggacaagaagaacaacaagaagaggaagctgtagctgtctctacaagaacaccgacggaatactaactctagttcatctgcagttgtcagtgttggtggcatcaaaaccctagttcatctcagcccccaaattgttcaaaccaagcacattccacggaagaacatacacgaactatagcagggatcaagaagagagaatgaccttaattcagtggatgctggaggagcaatcggcgaatcgaggccgccgttcgcagatgcctcgacgtcaccggagcagcatgggggttgattcgtgttgccgtgaatcacgtggaaaggtggcgctgctgccgaccaccgccggtgccccaccccaccccaccgccgtgccggcgccgcaccacccctcccccaaccccaccgtcgtgccgcagcagagagttgagtttggggatggatttggggatggatcccttctgaatcggagaagatgtgctgtgggacaatttgggggctgagatgctaaagtttggaattaggcggggtgttttttgaacatttcattctgtggtgacgtggacatatctggaacctacgttttgcatccaagtgtggtttctatgtttgcactagagatagtgtttccattacatatcttctcggaaaaaagctcacctctcctccctctcgcctcatatcaccgccgtgccctccagctggtgccgccgctgttgaccatgcaccctcgatctttcatgtatgcacaataatattttttaaaacaattgaaacatgcaaacaccctataagtaatacccaaacttcaatgatactctataaaaccactcaaatatttgaaataattttagaagcatacttagacaattgtcaataattttaggtcagtttttagaacgtatgatatgatgtgaagacatggaaaacaaacatgaatttaaacggttgaatggaaatagtatatatggataatattgtttacacacaaatttggcacctatggacgaaataggggaaaattaccaaagtttagaaagtgacgggttttcttcacagggccggtcagaccacaggtgtgtgggcggtctgaccggttagtaaggccggtctgaccgcaagtatgtgggcggtcaaaccggcagggtccgtgtccgagtctgttttcgtcgggtctcgggttttattgctcgggaaggcatgtttcgtgttttctttggtttctatcccgagttgggcatggagaagggcctgtagagggcaagaccaacccctatttaagggacaaggccggttcattataaaacccccgaatacaatctacttgaatcgttcttttaccatgtttttctattttaccctagtttagtccatctttgtcggtttgcgccgtaaaccgtccgccgccgctgcgggagtgcgacacttctttataggtttgtcttgaaaaccttccgttttgcccacgagacgggtagttatcctcttatcgatctaaatcggcctagaggctgattttgatatccaaatcggctccgttagccggtttacctgtttttctacgaaatccatcttgatttggccctttggctagatcgaggtggttggcgactccatatcaccgcaaggcgtttaggtgttacgatcgtgcttgttgacttgtcacagaaagttgccaacacgatttttggcgattccactggggaacgatctaatcggccatatcacggccgaatttcgtttaatctaataattactgtttcgtcgaatcatcgaattagtttcggctaaacagccggaattaacctacactgtaattattattgtcgccgacattggttttgtcttcaagcttaagcttaattgttctgtttgatcacggctagacgttaaaccctgttcacacagggagcagcagccggattagcaacattgtttcctttttgttccacacggcaacagaaagatttgattgaccaaagcttactgtacacgggttagaaaagatcaggctattcaagccgatctattactgttcacattaaaaaaaaagagacaaaaaccgattcaatttgtatcggttacactgtgaaactttagattagtttccaaattttgctaagtctactcggttgattaccaaataaatcaaatacttttgccgagtacagtagcatacaaggaaaatttatgaccgtatattaatttattcggtcaaatattttggctatgagctatatggccgaaattaatcaaggattttcttcatcaactatgacaagcgggaacgggttcaacaatactactacacaatacattaggaccgatcaaggcgtcatgagagaaaactttcaccaaaggtaacctccgattcgcccaacccatactttgctattcaaaaggttaatgatcgttgtgtagattcatatgctacttctagttttgctcctatacaatatgcttataatgatatggggggggggtcaatgggtgtttatacagccgattacataggaatcggctatatgcaaagtcgaactgacggtatgaccagtcgtgacaccggtctaaccgcaccctatgtcggtcagaccatgtccaacatggccggtcagaccatgtactatgccggtcagaccgtgcccaccatagccggtcagaccgtaccctatcctggctagatcaggcctcctatggctagcctgaccgcaccactgacctccggtcagaccgggccatgggccggtcagacgggctatctatagtcggtcagaccggttccctaggaatttctccaggttttcataccacgactagcagtactgattttaattattattcatcacctgttaatactgttagtcatgctactccacatgtccctaatacttacaatgatcctaatggaggatattctcacgatactaggtatggccaatataacaatattgtgccacaacaaccgctctttaggccaccaaatccaccaaggcctgaaatcatggaggtaaggaatcgtgctagggagaaccaaaagccgtattctgatttttatgacgttgtcccatatcctcctaattataaaattcctgaatttaccaaatttagtggtgagtatagtaggactacatacgagcatgtagatcaattcttagcgcaatgtggtagggctagtagtatgaatacatgtaagttgcgcttgttttctttatctttgtccggtactgctttgatatggcttacttctttaccggcaaattctattgatacttgggctcaattagaacaaaaatttcatgattattttcacactaatgaaactgatcttaagttgtctgatttaacatcggttaggcataaatacaatgaatttgttgctgattatattgaaaggttaagagatgttaaaaaccgatgtttcaattagaaaataactgacaaagatttggccaacattgcatatgatggattgcttgattcttttaaagagaaattgaatggctagatatttcttgatgttgatcatgtgttgcatgaagctctggctcaggaaagccgagtggatgacaatagtttaaatgccaccttagatgatagtgcaatatcatgtatagccgaaccaagcgatggttcggatcgtggtaataatttgtgcaatgatgccgtaacgagtatagccgaaccaaatgttgattcagattgtcttactagtttggatgataacgcaataaccaatatagccgaaccaagtgttggttcggattgtgttactagtttagacaataatggaatagtcgaatcaagtaatggttcggattgtattgctagcttacagaataatgccattgaagatatagccgaactaaatgatggttcggattgtatcacatgcgaaagtgaaatagcattgtcacctaagaccgagtcacaaatcggtcatgtggatgttgaaaaagatgataacaatgtcttgcgggatagtagtgaaatagaatccaaagttgccatacatacatatcaaaggccgtatcctgaacatgtagattcagttccatacccgcaaagatttgaagtgtcaaacttcacaaatttcacaggtgagaatgctataacaacaatagagcatatcgcccaatgtattgaacaatgtggtaagggtggtagtgataatttgcttaagttgaagttgtttcccctttccttgtcaaacttttgcatctacatggtatagttaacttgctcatagttcaatttctacatggtcatgaatggagcatgagtttcatgattatttcaaagatgcaagcttgatggagcaaagaccgattgatacttcatcggtcacttgtgaaactatttcggttacatctattcctaagaccggaattgttagtgatcctcttcctgttagttctattgatgttgacaaaaagaaagggaaaagtgttatttggggatcctcggcccaagaataggatcaaaaatacgaaggccgaagatcataaagttgcaaaggatgagtcatctatgtcacgtcctgataaattcatcccgaaataaaaatcattcgctaaaaggaataatagaattaattaaaattcgaaaagaaattggcaaacactaaaatacgtacaagaaaaattcaaatgtggcccggagaatttttgttaaattctccttggtctaaaaggagccctcaaattttacttgaattttcagagcaccagaaataattattaagcaaaaaaaacaattatcaaagtttattaaaaagaaaaacctaaaaataatcctccttcctcctttgggccaagtctggcccaaagtcctccctctctctcttggcccagcccaaagtctccctctcctccctctctttcccctctctctcccgggcctctcctccccctcccggcccactccctcctcctccctctctcccccgggccgcctctccctcctctcttcctgggccggccgcccggcccaagccgccccctgcccgagccgcccctccttcccgcgtgcacgcgcgtcgcacgcgcgctgacgccgcgcgcccgcgtggggcccacgcgccaggtcgtcgtcctcctcccgcccggcatcctctctctcttctctctcccgtgaaacctagcgtcgtttcctcccctaaatccacgcgattcaagccggctctttccaaattaattggggggttttaatccccattgaatcctcttcaattgcccccaatttcccccatgaatcgtgcccccaatcgccgggaacgcccgcgccaactccggccaacttccatggccgccggccgccttttccaccgtgatgagctacttgcagagaagttcatcgcgc

SEQ ID NO: 48879 - DNA, 911 bp, Oryza sativa
  unsure (1)..(911): unsure at all n locations
gtgcgnccnttttgtggattgactcgcctccttactgcaagtagctcatcatcctataaaatggaaccccctcgccccgttctctcgttttagccccctcccgcgctctcccgtggcctccccacctctccccgccgtcctcctctctctcccgtgccgccggccgcctccagccgcctctcccgcctcgcccgcgcgccgtccggccgtgccgtcgccttcctcggctctgcaacaccgtccccttcaccggtctcaccgtctcctcgccggaaactcgccggaacggtgcccccgccggcaaccagtggcattggtgccactgtactccctccagccggctactgtccctcgtcggtgcggcagccgtcgtcgtcgccacctccctcggctccgcgacgctgccctcatccccggcatcacctcctcctcgcccgaagcttgccggagtggcctcctcgtcggcgtccagtatctccccgcctccggccggctcctgtacgtcgccggtacaccgatcgacgtcgccgcgttgtcctctcctccagctgctcctttgtttcgccggaacgccgtcgcccgtgctggcctctccatcctcatcgtcgccgacgtcccttcggccgcccgttcatcctcgccggctcgtcgtctcgcggcgccgcctccgtcgtcggcatcgcagcggcgtgttccgcgccgtcctcgtctccgtgcagctgccgccggctgccctcgtcggctcctcgccggttccggtcgtcgtcctctcgtcgttcccggtcgtcatggcgttcgtccctccgtcaagccattctcgtccgtctcgtccgcgtccgtcaagtgtgccgctgcaaccccggtcgtcggcttcgtcctcngcttcgcgtcgtaaagccttgtggcggcgg

SEQ ID NO: 48880 - DNA, 8893 bp, Oryza sativa
  unsure (1)..(8893): unsure at all n locations
gtggcccattgtggatcgactgattgacagcaatncatcattgtgccggccgcgtctcgccttcgtccaaggatcgccgccgaagtcgttccctcgccgtccgtctccgcctcgcccgttcgtcgttgtcgttcccacgcctcgtcgcgtggtggtaaggatccctctccctcgctgccccgtcctcgtcctttaggtgtcgcccgtgcccgttgtgcggttgtcggccccggtacccgtgtatcggtgtcggcagtcgttcgcttgtgcgtgtggtgaccgtgttagtgtgtccgctcggtagccgcgtggtttccacgtgtgcaacccgtgtggtgtctagtggagtccgtttgtcggccactcgcctcggttgacacacggggtccgcttccgtcgacccgtggaccgtctctgtgtacccggtctaccgcggtcctttaggttgacatgtggggtccgcatgtcaatggcgcagccttcctgtcttttccaggctagcgcttacatatgttttatggttgcaaagcctaattataataatccgcaaatctccatataacagcattaaacttcggatgatcatatcttggtcatacgaactctgaatcgacccgttcaagtctcctaatgtttgttataacctaaagaaccgtgtgctttctttttatgtattgttattgcttctttataggcttgtagctttgcttgtgtgcttcgcgtagcttctgtcgttccggaggttcccgaagcgtggtttgcggtcgttgccgaaggttcggaaggccgttctctctgagcaaggcaagtcacatcatccttgagcatattgaatcccagtttataaaattattttgatttaaattaatgcattatcgctttatttaaattcctgcgttatcactgttttatttagccatgcctatttacctttgttatgaccttattattattgctattgttattattaccttgttcaccctagaataaacaaaaccccaactagtgggcactctattcatggttccactagtatgaatttaggtagatgcttcgctgattaattaggcaacattaggtggtttcataactctagactttgggaatattcatatcacttggacattatggaatggttagattattgtggaattggatgcatacctccccctctattcaaaaccctcaaaatggttttaggctgggctcggggtgcatggttttgttagtagcacctcggccacctaaggaccggtcttcgggcctctgttgcaaagcactaccgtacttccacatgtctagtgggtaaggcttagtttgtggctcagtctggttataaacaaaagtacacggatggagatggatgaagccgggggtcgatggacatctctaggacaaatgaaggctacacgggctgcggcccggtagtcgagatgtcatggcacagggctggtgtcctgctgctaggggctcaattctgcctgcctgtctgggggttccggccgtaggtaggttgggtcggtactcttgtctatggctaggatgggttggaaactatgtcatgtcttccgtccatatgccgtggtggtatgtggcacgtggttgcacgtgaagaagacgtgtcttgtgggtaaagatgtacacctctgatcagagtataacctatttcaatagccgcaccctcagttatgggcaagcctatcaatgtacccaagttaatgttttaaattcttaaaacctgcttaataactaaaatgtggaatggttggcctgggttggcttgggacgagctgggacccaaggtcggtttgccagttcggtctgaatcatcgtaggccttgggttaaggcaggttcgtgtgggttcacggccttgattaataatactgcgtagctctaggatcgcctttataaaatggctttgggcaactaagtgacttttaaatgctgtttactgcaaaacttaaccccgatattattatccccttgtacccccttgcattaattatgcatctccggtgtgacttgctgagtactgtggttgtactcattcttgctcaatctttccccccttcagtaagagaagctttggagaagaagtcttaggtggagtactggcttataccccagttgagcgcctgtgaagatggagccgtaggcccgctagtccgctgctgtttatttttgattgtcaggcctgaagcgcctttgtaataatgtaaatattatcgatataataaagatgtgtcttttatatcatgtttgtgtggtgtaccccggcttttcctgggacggggattaatacactagcgttcgggaaaaggcaattttctcggtcgcgacaatctagttcccaaaagaccaaaaagccgaagctcacttttgagatgcttatcgctaagttcaagaaaggattagccggtcagcgatttgataatcaaattagtgattcaaaaagaccaagatcatctcgtaggaagagatttggtcaaccatcaaagcaatcggagccatcaactataccaactccatacaaacctccggttgtgatgccatggtatccatattcaatgtcactatatggttatccttttatgtattatatgctatggatgcctcaaccacctatgccgtattatcaaggatggaaggaatcacctaggacagtgtcaaatcattcatctaacccaagacaagaccgtttcccacaaaagaatcggtccggtggatcaaaggtgaaaaaagtgtaaaaggtgtgggtgaggaaagaagccaaaactccggaggtcgttgctatcaaagaggagtctcaagatgttcatgtacctactggagatgcggtggaaaccacgcaagcaaaggagatcgaagccgacgccgtgactgtcaaaattggtggtctaaccgagacagctggccggtctaatcgccagtctacggccggcctgaccgaccttactggccggtctgaccgacggcttatggccggtctgaccgggcctagaggccggtctgaccgaggggcattagagaagagtgggaaaattgaaagcaatacatgagcttccacttcgacaaaaaatatcaagaatcattgcttagctcctggaaaacaaccacagccgaagtggataccttatggcttatctcgctctcaaaagaggaggctacagcgtcttcgggccataggtcaaaaagaaaaggaggccgaagatgcggagaacaagacatgcaataatttagagcctcaaacagcacctaggcaagtatggagacctaaagaagtaaaagttaagagaccggtgatttcccatagtagtagtgataaatccaatttgatgagagaagaatcatcggtcattagagataagtctccttcacatgatgctatggatgttggtgcggtgttcgtcttgccttcaaaatcgtgcagtcgagaaagccgattttgcttggggggcaagacattactatgctcgtgaagaaaccaagagaagatgaacagcgatggatacaacatcacatctttgagccgcattttgttggatgctaaggcaaggtatgggtttaatgtgttcatcatcatattatttacctatgtcatgttagaacattgcttactatctagcacatgtgtttgcttatcaaattgatattatacatacatgttgcaaataccagttctaagtagtgaaattggtaggttggcatataatttgtttgaagtatgatttggcttatgagtctttgatatttatttaaagtcaaattgtatgtgtttttatggatcaccatataagatatagattttataattattgtaccatggaagttttgcttattagtaattcggctaatgtcaatggtcaatgtgatgatttattctagagttgttttctttagaaacattggcattgttaatattttgcatacatgctcaagccgattacttacatttgtagtttattggaattcatgtctgtgaggcatatgactttggtgattcattattgaattggctaagtgttttgatgccatgatgattattgtttcaaaagccatttgaattagtattcaactagacatgttagttggatgttatattttttcatatgtctagagagaaggaatttcggtccaataatttgatacaccaagcatctggctattatgtgaagaaaaattatatactaaaggccgatgcttgatttcaaaagtttggacgaaattggcaaagtcatagacagaggtggtctgaccggcattgcacggccggtctgaccggctctgcatggccagtctgaccgggtagacagtgaggtctgaccggcattgcgtgtctggtctgaccgatcctgggcagagagctggggggcacgttacaattgatttaaagaccggattaattgtgaattcggacatttgtgcccataagtaagaaatagattggagaatcactttgaatagaatatttcaatgatcctagtcttgggattgatcggaagattcggcggcaagcgctcaaatattatatcgccgaaaaataaatgtagtattacttggataatgatcaatctaaagttgctaggagagtagtacatgaagggatttgtgaaattcatcaatcggcccgtaagataaattggttgcttaggagagtggggtttcattggccgaaagtaattgatgattgtttcaaatgttatagagggagtgaagcttgttaacggatcggcaatgttcaattagcgcctatcgctgtattgaatcctattatcaaatcatagccgttcggaggttgggctttagatttcattggtcaatcttatgatattaagttgttaagttcttactctcaggctaatggataagccaagtcgagtaataaaacattgttgaaattgccgtttcgccagttgaggtaaatcttggctctcttcggtatttcaagtaagacgagttgtcggttgaagattatacgaccttgatgggaagcaatttttgaagatgtcatcacgagcgtttgaagactttgaacgagatgaagacacttcaagacggtgttttcagagatcaattaatgggaaatacttgaagaaatacttcccgagcatttgacaagatgattaggaagtcctatggccggtaattggattatcaccctgagacaacatattctatgcgtttaggttcacatatgatcaccaaaaaggcggggggcacgtgtttacacccaaatttggcacctatggacgaaataggggaaaattgccaaagtttggaaagtgacgggtttccttcacagggacggtcagaacacaggtgtgtgggcggtctgaccggctagtagggccggtctgacctcaagtatgtgggcggtcagaccggcagggtccgagtcagagtctattgtcgtcgggtctcgggtttcattgctcgagaaggcatgtttcgtgtttcctttggtttctatcccgagttgggcgtggagaagggcctgtagagggcaagaccaacccttatttaagggacaaggccggttcactgtaaaacccccgaatacaatatacttgaatcgttcttttaccatgtttttctattttaccctagtttagtccatctttgtcggtttgcgccgtaaatcgtccgccgtcgctacgagagtgcgacacttctttgtaggtttgtcccgttttgcccacgagacgggtagttatcctcttatcgatctaaatcggcctagaggctgattttgatctctaaatcggctccgttagccggtttagctgtttttctacgaaatccatcttgatttggccctttggctagatcgaggtggttggcgactccatatcaccgcaaggcgtttaggtgttgcgatcatgcttgtcgacttggcacaaaaagttgccaacaaatatacctataactggcctcactttttttagaacaactggcctcacttagtgtatttgtcatggttatggataccacatacctaatagtagtcaactaaatctcggcaggacccaccacataccacgtcttatacggaaactgacttcggatatggagggagttccggataaggaaagacaaccagagttctacatggaaacgacaaggactactcggattgtatccatattgcttttcctagttctacttggacaagggaacacctatgggtataaatacaaggccccctaggaggagaggggacacggacaatcgacgaccacctcaatcaacacctaccacaatctacggaacaatagatctagacacaagatcaacatacaagccaacatacgccaagacaagacgccggatatcgactttagggataagcacggctagtcccctacggtgtctccggatactgtcaggagagacggaagtgctatctctgatctcgccgggcacggattcgaggaggaagactaccctgttgtcgactacgagtcagaactttagacagccatgtcgacaacagttagataggctaccccaaatattgtactggtgtgattatggtaaataaagagcaacgaccggcttcggccaacagggtgtagggttattacctgacaattcaggggcccgaacctgtataaaaatctctatctctatctcttttacctcagtcttgcgtatatcctagtaccaacgatccccatactatgcaaataccagaactgcgacatcaaacatcgacagtggcgcgccaagtaggaggattttggtgcttcaggattttgaagagatgggttcaagagatgaattctccaacaataaactactcgacgacttcactgtggggaagatcaaatccgaccggagtatgtcttccgacgagatcgaaattatcgccgtcgtggaggacgaacgatactggcagcattggtgaccgatccaatatgggactgttctggaagctgacggatgtcctcgcaggcacagacgtgttggtttgattcagactaaggtctacacggcgctgtactccttggattcatacgaaggccgacttcctctatgcgcgatatcgatttctaccgagacaaatgcatccatgtatgtcggttggatttcatatgcgcctgatccaaatatctgtatcgtgtacgtatacggcctgtattggtcctacatgcacacggacaccagatacatgccacgctggaaaagtcaaagcgactctatacacagtcgtgtactcagagacgaatcgaaactttacccaagtacacaggaacatatcagcgcgctaatcaaggtaattagtggattgattttttaaattaatctactaatttcgtaaatacatttggcatgtatctacaaaggtacgcaataatttatatccaatttatcatacctactttttccaatctatacgatattgtcagatctataatttattatgtttacctacagcatgtcttttatacaatatctgctgtgcgagtgtttccgatgttaaatcgactgcggtttaacgctgggggctcgctctattttcttatgtataaatcatgcttacttacggtttacataatgattgatatttaatctgctcgttatatcctgataatactagaagacccatgcagttttttaagtacatactcgatattctctgctatatgtcttgccttctagaaaatatttttcaggaacaattgagcactcgagtaggttgtggtcgagtacatcccactatcgagagcattctcgataaatgcggagttgtcgcgcccaacctaccaacgaagaccgacgacctacctcatagcaccggccatggctggactactcgagaaaaggttgttaacggataattcctcgcgaacgtcgtcggcttgatcacctgacatgattgcgaacggacatccagatatgttataagttgggtatgtgagtcatgctggccacatgagatacacatgtaataaaacaactctagcacttccattggtgttcgagagataattctactcgctcgctggttctcgaaccagtacacagcaatctctcgcaccgcaacttacattggtgttcgagatataattctactcgctccctggttctcgaatcattacgtagcaatctctcgcaccgaaacttccattggtgttcgagagataattctactcgctcactggttctccaaccagtatgtagcaatctctcgcaccgcaaactttcattggtgttcgagagataattctactcactcgctggctctcgaaccagtacatagcaatctctcgcaccacaattttcattggtgttcgagagataattctacttgctccctggttctcgaaccaatacgtagcaatctctcgcaccgaaacttccattggtgttcgagagataattctactcactcactggttctcgaaccagtacgtagcaatctctcgcaccgcaaacttccattggtgttcgagagataattctactcgctcgctggctctcgaaccagtacgtagcaatctctcgcaccgcaatttccattggtgttcgagagataattctacttgctcactagttctcgaaccagtacgtagcaatctctcgcaccgaaacttccattggtgttcgagagataattctactcgctcactagttctcgaaccagtacgtagcaatctctagcaccgaaacttccattggtgttcgagagataattctactcgctcactggctctcgaaccagtacgtaacaatctctcgcaccggaaacttccaatggtgttcgagagataattctacattctcgctggctcttggaccagtaccgagcaatttctcacaccgcaacttccaattgtgttccagagataaatgtactcccttcgctggtctccgaacaaatcctaacg

SEQ ID NO: 48881 - DNA, 8602 bp, Oryza sativa
  unsure (1)..(8602): unsure at all n locations
cgtggcccnnnggtgggatcaactgactggacagcagcncatcataagatctggtcgtataagagttctcgccgtgcgtattaaccaagccgtgtaatcggaaattgagttttccaacttcacagctgggggctaggatcagtgcttgttcaaccaaggcaggtcaagggtccaagagccttgtcctccgagaacgattctccgacgacaaggctgggggctagggagagtgtatgactctacaaactgactgatcaaagtcggtaagagagaagacgctcatatataaaacattggtcggtaaatttaattcatttttagttttccatacaaattataacatgtcaccatttgagcgtttgctcgggggctatttctatttgatattcttttctgagtattgatttctggaaaattctattcgacattgtggaaaactccatgtctctatggttctacaccaagatcgactaaggcgagtacgacaaatgttgacaaggctccgtcgcagactctacgccttctcgatcgctcgagaacggttgctggatctcgacaaggaatacggaataaagagatggtgtacccgccgagataaaactttttgacttcaatccaaattctcgattacagcaagacgggagacttagtcgtatgttatgtactttcttggttgacgtcggagattgactcaagacaaaccctttaggtgcccgcacgaggctgataaaggaagtctaacgttatctctgaactcaccgagaacggtcacttgagctcgataacagttactccatggtcagcggtcgagaatatgaattcgttcatttgcattgaagtcgggggctactgtcatggttatggataccacatacctaatagtagtcgactaaatctcggcaggacccaccacataccatgtcttatacggaaactgacttcggatataaagggagttccggataaggaaagacaaccagtgttctacatggaaacgacaaggactgctcggattatatacatattgcttttcctagttctacttggacaagggaacacctatgggaataaatacaaggccccctaggaggagaggggacacggacaatcgacgaccacctcaatcaacacccaccacaatctacggaataatagatcaagacacaagatcaacatacaagccaacatacgccaagacaagacgccggatatcgacttcagggataagcacgactagtcccctacggtgtctctggatactgtcaggagagacggaagcgctatctctgatctcgccgggcacggattcgagaaggaagactaccctgttgtcgactacgagtcagaacttcagaccgccatgtcgacaacagttagataggctaccccaaatattgtactggtgtgattatggtgaataaagagcaacgaccggtttcggccaacaggatgttgggttattacctgataattcagggacccgaacctatataaaaatctctatctccgtctcgtttacctcagtctcgcatatatcctactaacaacgatcctcatactatgtaaataccagaaccgcgacatcaaacgtcgacagtattattgctagctttctctctgtttttttttgataagctatattatctcaaaagtttctagccttctatcttgtacatagttgatctaagaaataggttacatcgaagtctataaatttaaaatggattggtgactggattatttctgtggattacatatttcattatagggataaattagatatttttagaaaataataaaataatgaaataagtggtcttactatacaatggaataagttttttttgggaaatgtatttttgagcaactaattaattgaatgatttagtaaataagctgacaacatggcagtcaagccgtctaactacctagcaaatcaattaatcctcgctcggcgagtgtgtaacacattactccctccctccattctaaattgatctacatatttcataggtacaccaaaaccaagaaaaactaataactctctcatactatatttactctaaaaacaagctcgatgcatacaccatcccattattttctattcaatagcaaatcaagatattgcatgtgggttataaatacttgtgtgcatggatacatgtatcaatgtccatttactccaatattaatgcacaaatactccaacgaataggcttaatgaatgcacataaatataatgataatttaggaataacctaaaaaactatatatagatcaatttaaaataaagggagtatcttagaaaatttccacggcaaacactaattagctaggtttccatcaagctaattagcgagggtgtaacacattatcttcatgaccatcttccgaattttggccatgctctatgatcagctgccatcgcatgcatgcatgcctcgatctggcggtgatctcagtaaccgaatgcttatcggagtcaacatatcgcacatggccctgcttagtaattaagatgcagatcatcagtgagccttaagcccttaattagcacaattttattaaatcattgagtgtattattatggcacgcgtggtataattagcaaacagctagctaacagcccacatttcaaaaagtcaatgtatgaaccttaacaacgctgctatacgtccgaccagcgtacgactcaacggcgaaatacacggcgcaagcccaattgaattagcgatcgttgcagaagttacggacggcggacggccaatgacgtagtcgtgcgctggtcgtacgcgtcggttggacgtatagcattttcggaaccttaattactccctccgtttcacaatgtaagtcattctaacattttccatatttatattgatgttgatgaatctagacatatatatctatctagattcattagcaccaatataaatatggaaaaaactaaaatgacttacattgtgaaacggacaaatagtttttttgttccaaaatcgtgagagcaaaaggatcacggatggattcgcgacatgtgctgggaacagggcatttccggattagtcgtgcagataagctgatccgagcactttccatttgtattaaatttgctcgctcatagtactgctgatgtgatgcaaagattatcttagtctaattttgttgcaccttcttctttaggtacaacgtataataatgatcagaacgcgtgacatgcatgtacgtgctggttattactcccttcgtttcaaaatatttgacaccgttgactttttttaagtacgtgtttgaccattcgtcttattaaaaaaatttaagtaattatttattcttttcatatcatttgctttattgttaaatatactttcatgtacacatataggtttacatatttcacaaaaatttttgaataagacgaacggtcaaacatgtgctaaaaagttaacagtgtcaaatattttgaaacggagggagtacgtgacagtacgccaatgtctgcagttaatcaggactcaggagcatccatgcatgcatgtttccaggatatcaatacgagcccactacacctccaattataattaagttggcataggtaatttggacagctagctagcgcgtcttcgtgcgtaccaattagaacaggctataaatgtaagccctcagtttcattcacatttcaccactcctccggtgacagtgagtgagccgagggttttcgatatctggataggagcagactcatcgctaaatgtcttacccgactattcaaaacaccggagtacgtgggtccgtgacgctgacgctgtgaactagctagccatggccatggctgcttcttcttcttcctcctggtgcgcactgaaacagtcatgcgtggccctcctgatggctttggcttgctgcctaactacgtgcgcgcgcggcgcagtcgaggcgctgtacgtgctgggcgactcgcaggcggacgtagggaacaacaactacctgccggcgtcgctgctcaaggccaactaccctcacaatggcgtcgactacccggggggcaagcccaccggcaggttcagcaatggctacaacttcgtcgacttactcggtgagtgtatatctcaaggccattcattagctagttaattatagtacgtttattagtaatatatatattgagtcaaaaatatattttgatagctgatatttttgggataatcgatctaacattcaacgcaaaaatccctctaaaaatatatcaaatataactccgataaatatatatatatataattatggtgtaattataatataattcgcatgtacttacgtccctaaaaaattcaaaagttgtgctggcttagtgggggctgcctgcggttgtcagtttgaccctcacctcgcgcaatgtcctctgatttttacccaatacaacatgcatagatcgtatagcccattcggtggctgaaaatttgatacgatttttaccaattttttttgtcgaatgtgaaataactaggctgtaaactttttggtgtattcggatgcaccaacactctagctcacccatagacatccaggcggttgctataaaaatagcaaggcactattattccccgggtgagggcgttcacactgcatcaccgtgacgttcagccctcgagacgccaacagagatttggactgccacgttctcgccactgctgcgctcctgcgaggaacgtgctaccaaactatgacgcgcgaacctcgtgttaggtgaggccgcgtgatgggcggagcgacgggatagagtctgcattggacctgcgatgctgtccggcccccacacggcacacccccactcccacaagccaccgcgggtacctcacccaactccggtaagagaacaaaaggggcagcaacagcgagatgggggaagaggggcctacctttccagccgccgctaaccggagaaagaagagaagacaaaagatggaggagaggcacatagccttgcaggcctcgtcggcacgagccgccgccggattccgaggggcgaagctcagcagcggcgtaggcccaagccaccgtggggacctcgtagcccgtgcactacgccactaccccgatctggtcggcggtcaccccgatctactcatcgccacaggtgtcggcgatggggaggggagggagaggtgtcgtcaacagggagggaggggagaagaaccggtgatggagagggaagggagaggtgccatcttgttaatagagaaatagaaagggctaaaatagaaaatatgaggggctaaaacaaaaaaacgaagccacacatagagacccatgcattgtgggagacaattttttttaaggtgtggttttagcccatggcacgtgaggcaggccaaattcttctggcacactgtgaacgccctgagcatacggtatgatcattataaatgatctcttgtgtcagtgcctgcatgtatgtactactttcgcaagatctataattcttagagcatgatcaataataaggtaatttagctccaattatgtccaactcatctataacttactttgcagcttgtacacgcaacatctagttgtattgttgggtcctatatgcttcacatcactattaaaaaattgcagcatcgatcctatgttgcaatttttgcatagcagcatttctctcactctctcacgtccaacgtttttatctagagatgcgtgttgcagcccgatgataaaattgtcgtccgctcgcgccagctcatgcatgttctctctctttagctcttttccctatatcaccattgctatctacgtggacttagtgtcgcctgactaatgtacctgctcttaagaaaactacgaagacccttgctcttaagcaaaccatgcatggttaggcaccgtaaaacttcgccaccgctaatcgattaacttcgccaccgcgcagagcgcttgcttggctagagccaaacaaaatagggaagttctaaattaaataacatgccgaaagtaaaggggaatcagaggaaaaattaactatgtgtagtatagcttcaatagggcaggctagctagtagcttagcttcagcatacacatgcatgcacacccgctgtgaacgaaggagcgagcgagcgacgatgggttcttgcacattgtcctccggcggcgtctgcgtcgtcgtcgtcctcctgtgtttggctgcttgctgcctaacgtgcgcgcgcggcgctgtcccggcgatctacgtgctcggagactcgcaggcagacgtagggaacaacaactacctgctgcactcgctgctcaaggccaacttccctcacaatggcatcgactacccggggggaaagcccaccggcaggttcagcaatggctacaacttcgtcgatttaatcggtgagtatatatccatcatcatcgatcgatcgctgcgtaaggctagctagctagatagggagtatgaatgtatgatcgatcgattgggagattggaggcacaacgttaacgtatgttgttgtcttgcgtgtgtatgcggtgtttgactgtttggtgtgttcggagaagacagcatgtcaactggcaatagcaaaagcgatggagatatatgatagttcgacgtccaaacgaccgagcgtatatggagtgggacttgacgggattttatttggcttggcgcgtacgtatacctccgcctctctttatctcttgggatacgtgttcacatatatactgccaatcctggacggcgatatgtatacgagcttgtgtgaaacaaattaaatcgctgtagttttttccaaacaccactacgcacggacactgatgccgcatattctattgtagtatatagtaatttgctagaacgcaatatgaccattattaatttaatttaacatttctatttcaatttggcatctaaaatttttacaaatgacgtttttacccctacgacaagttgcatgcatgctccatttgagtaaatttttgtcccaaaattcaaaaataaaaaatattttggaaaatttatgaatttcaaaaaattgaacatgaaaaattgaatgatattaatctaaattttaacagatttgcaaatttcgaaacttttcttcccaaattgcgaaaaaaaggtatttttgcggaccaacagaatggaatatttccaaatttaaaaaaactcaataaaatttttatttgacgagatattgaatgaatttaaacattttcttgaaattccaaaaaaaaaatttaaaagaaaaattttgatggagtattacaaaaaacaaccccttcacaattattactaagtcaagaaaactgaatgaacggaatgttatttactttttggacttgtagtagttgaattagtttcttatatcaagatgaccttagagtagaaaaaattaatggtatttgtacatatttattaatttccatgcatgcagattacaaatcactaattttaaatatgaatcagtttgtttatgaatatataaaagtaatatttctaaacttacgtttacatatgcttcccaaggaaatttctaaaaatattagttatgaaaaatgtagatttaggtgtttctgcaactattcaccctgctctggttattatagatttaagagttttagtcctacaatttaatgtggcattatctgacctatagaattaattgtcacagaaaaatacttttggattatttttattttgtagaaaatattatttttattaagcatctgacctttgcatagattatatgcatatagtaaagaaacattgcattattattgagcctgaaaaactcttatcttgcaatttcatccatctcgatcaatatgtctctaggtccatttcatagttgtgactgaatatttttctattaatttggtataacaaataaagatattataacggtggtggaacaaaactactttaacattctactccatccatccctttcaaattataatgcgctttgattttttctagattaagcttctttaaatttaatcaaaattatagagaagtacatcagatcaattaagaatgattatgtctacgcgcgaccacgcgaaaggaatcaaagatactagcatgtgaagcaccaaactgctagctgcattccgaacaggaggaagggggaaacagctagaataatgcaccgctgtactgtgttgccgatcgagcaaaggaaaacgatatgcgcccgcgcgagacggagaacatataaaaggcgcagctaaatcaggagccacactgttatgatctctattgctaagcttgcactatgcgcaaccttttccatgtaaaaggcgcagctaaatcaaatcgccgacgcgcgatcgatcgatggagacgtgacgtgcctgtctcgcggttcggtggtcctatatgctatatactcactccgtcccaaaataaatcagcttctaaaatttaaaatcaaaataaatcaacttttactcttttacctaccattagtttgcaaatctaaaaattttatttctttcataccctttacctacctattcatcgatataacttcacaattaattagagatatcttgatcattcatatctctgatgggnggtgtnccatcagtagtctacctgcgcag

SEQ ID NO: 48882 - DNA, 6485 bp, Oryza sativa
  unsure (1)..(6485): unsure at all n locations
ccgcgttgattgactgngctcgtctgcaagtagttcatcagtgtaaattgcgagacgaattttttaagtctaattgcgccatgatttgataatgtggtgctacagtaaatatttgctaatgatagattaattaggcttaataaatttgtctcgtaattttctagtagaatctgtaatttattttgttattaaataacgtttaatattttaaatatgtgttcgtatattcaatgtgacatgtaaaggcaaaatttattttgacaactaaaccggccctatgtgcaacctttttccatgtaatcttggccgcgttgttctgtatgtgcgcgtgtaattctcagacgaactggcaggaagattccagctcatataggctgtgctgtggccagtctgcgttgacccagaagcttctgtaaaagaatatctttttttgaaagaagtctgcgaaaagctcccccactattcgcagcggagtactgctatatatgtggaggctacaatgaaatcggtggagagtttggtcgtgtggacgacatggcctccatcaacacaagcgcaggttaatttggcgatattcaagactcgagttgcacgctgtctacatgtggacgatggaccagtacacaccacacagtgatatcactttcaagattgtacagtatatgcttggtggatctgttctctctccttttgccaaactggtagttagcgaacgttcgctaacttccgatccagcgaatatgtcagaactgataaatatgattttttttatttatgtataaagtttatgaatgtaatttttttatttaggtataaagttcatcaatagattttttcttttatttataaagtatataaatgaaaatgttttatctacgtagaaaatttctgaatctaattttttttatttacgtataaagtttttcaacagatatgttttcttttatgtataaagtttatgaatgaaaatattttatctagaaagtttatgaatataaattttatcaaagtacaaagttttgatgtcaactattagaaaattcaaatactagaaggtgttgataagaaggtttttccattgaattttttcagtataatagaatgtatttcttaatatttaatatagcaaagttaacagtaatcacgcgaaacccaattaattacaaagtcctcaaactaatctccaacatgcgtgcaaaagttcttttggatcgtccaactatttacgcgcatgtatgcaggagttttttccccggattaactggtcaactgccctagtaaatgttaaaatagaacgccgtcagcgtcgcacagccaattatcggcgtggctgagaatgttcgcaacagtagaaacacgcgaatgcgtgcgtagatcagccctccctccggttttgtgcagctttatctgcaagcggttttcattctttgtgatcccacacagtatctatgcgtgtttcggttgaaaagtttcttttttttcttctattttttattaaaaaattaagaggcatgaggcagatacgaaaaatgtttaatgaaagtaaaatggccaaaatgaccaggatagttaaatactcagaaataagtctgaccctcttttcgctcactctgtatactagccatatagtcatgctttgcgccactttgatatccatcttaaaacccaatatatattcaccgttaatatgataataagtcaaagtcatgttcatacaaaaatttagcttttatatcaccgttttaaaataannttatttgcataccgtttatggnntgaactattttttgatggagatatngtttactccatgatttggtattatttttgttcacatatttattatcctagtacattggtttccacattcaaaattattttagnatccttttatttttgtcttataaatttcaccttttagctcttaanaattagagtataacttaattagcctcttttcactattacaaaacacctcataggtataggttcattggtgttagttaatttaaaactggcacctatagtccttttcacacaggaaaatatagaaccagcacttttaggcaacaataggtgccgcttccggagcaaaaacatgcaccaatattataggtgttattttttaaaagaaccggtacctataacatattataaataccggttaaaaaatgggtacccatacgagccgagccagagctagccaacgtgcttatccataccactatgcatgtccttatccactacacagagccacacccagtcgatcccctctcccccttctcttgtttctccccaaccttctctcccctcttcgcgctccttccccactccctcgctgcgcatcctccccttccctcttcgttcgccacccctcccctctccctccccttctcttgccgcctcccctctcccttccctactcccttgctgcctccctctccctttcctgttcttcccttttccttcttcccttccggcagcggtggttggtggaggtgaccccgctgccaccaagccgctggtccgaagggggtactagcgccggaggagccgcggcaccggccccatcatcactggccttgtctgcgccttcatgccatgtgtttttgtgtgtttcaagatcgtgttttatatatatatatggggatgatgttattggatgggatctcgggtggttgtcaggtgttttcgtgattgtgcaacagcctccatcgctcgacacttttgccgccggccgcgagcgctggtgctccgtgtatgtctacctccaccggctgtcttttttttttttgtttcattgaaaactataggttctggttgttaggcaagaactggccactataatctctataagtgtcgtgaaccgtcacctttgcccttgggtattggtgtggtgccgttaaattggttccgactataaaaccaacatctatggtcggtttccaaccggtgccaatagaggggtctgtactagtgtttacttaatgtcattgtacatccaacaaacatcctagttatatcctattgctcatatttaggctgtgttggttgatttgggttggaaacccatctcctgcgcacagaaaacggaacgacccattagcatatgattaattaagtattagctaattattttcttcaaaaatgaatcaatatgattttttaagcaattttcgtatagaaacttttttaaaaaagtaccgtttagcaatttgaaaagtatgcggatgaaaaacaaggaagatgagttgggaaaactggggaaagaactcagccttaattgatgatgcactaagtccaggcttgttcttttttttcgataataagcactgtctcagacacgcgccactggaaaacttgtcactcctttcgtactttcctgcaagccacgcactagactgattaacatggaccaaacaggactctcgtgaacatatagtatcactatagtacacttgcaatccaaatcccactaactgttagttttatcttggccttctatgctaatgggcttcactaattatgtgcatgtgcacgtgacatgacttgttgaatcttgataccataccctatgctactaagtccaattatctagcgctccatgcaagagggtaggcatgtgtattcatgcctatacctgtcttgcccatttatccatctaagagcgactctagcaaggtgtcacgcccagaaattcccgaatagaatttcaagcagaatgtgcattaaaatccccgtccaggaccggccggggtacacaaacgacaatgttgacattcagatccacgtcttacaaacatcataaaagtcttacataaatgcagcggaagaaaagaaagacaacaagagctaagccttgacttgaactgcagcgggaacaccactccacaggcatcctcgacggcacggacgaagcctactcctcggagaacccgccatcggacacatactcgagctctgggattgggggggggggaaatagagcaaggctgagtactacccactgtactcagcaagtcataccggaatgggggtatgatgcagggattcaacaagggatagctaagcaggttcatttgcataaatactggcatttataaacaggaattgaatgcgaaaacagttgtaataattaagcagtattaaacatccactatccaacgctacaccacgttgcaacaggcccaaccatccacctataccatccaaattcattagactaaactaatgtgagactaatcacggtgaatctggttgaccgcccataaccgcgggcacggctattcgaatagttttactctgatcagaggtgtacaactgtacccacaagacacagccccacgacacgtttccgtgcgccgacatgccaccacgacataccggaaagaggtcgtgacaggacccttcgcataaccccctctagccaagcacaccacacctcaggtttcacccccgttcccagcgggcaactggcagtcccctctcgtgcctaggtgaatccgaaagcgacagaggccgtcgcagggcccgccctgctccatcacgcccacccttgcctggatgcgtcagctagagaaaagctacactacaagcccagccgttgcccacgctggcttgtggtaagcacgataaattcttccaaggtttcccgcgaaccggtccttaattgctatgggcgcgactagcaaaaccttgcacccacagcccaccatgtgattcattttatttaaccaacaccagagcggtggtactaatccaacattatcatataaacctatagtctaggttttaaatgagatttccccattgtgtgctagttgaactaagcatggctaagcaattcctagtccaaagtctaatcatgttataacccaagctaacaaaggagcatggtatccaaaagcatggctgtaacaacatgtaaccatcccatagtatcctattataaaacaatgcaatatttgaaagaaaacaatagagcatttgcaatataggatcaacatgttcaagtgacaagcatgacttgccttgctctgctgttggaggaacctcggcgactatctcgaagtacaccggagcgtcggaggaatcggaatctagcgacatacaaagcaaacattgcaaacaggctataaggctactgaaacagggaacaaaaccatttttaatggattctacacatttttcttgatttactgagacttgaatgggcttaaacggagctcggatgaattagatatgaattttagaagattcactgtgtttattcctataaaagaaatccttaaatgatttattgcgcaatattttccagggctgacgtcatcaaggggggcgcggcgccggcaagcgggacccgcatgtcagcggcgcacgggtggccggtctaccgtggaccgggaccacgcgggtgatccaccgccggtccacggggatcgacggcccggatcggcccgggcccgatcggacggtgcggcggcggccaggctaggctcggctcggcacaaagccggccgaccggtcacggcgacggcgcgcgcacgcgcacgcgcgttgccagacgacggcaaccgccggcggagacggcggcgccgaagggcggtgatgctaaagcgacgactaacgggcggcggcgctaaagcggcggctaggagggagaggaaggggaaaagaggggagggggtgcctcaccgagggcggccggcgcggaggaagacgatggcgaacggcgacggcaagccacgggaggacgacgtcggcgggcggacgagcttcggggtgccctaaggaaggagaagagagggattagagagagggagatggaccacggcgatcggaaaccatggccgaaggcggcggtggaggtggtgctcacccgagtgcgagggaacgagggctccggcgacgaacatcgacggaggaagggtggacggggtggatctcggccacgcgaacccgacggcggcgacggcgcggcctggcggcgaccctaacggcggctagcggcggccggagtagcggaaaaggcggcggccaggggttgcacggcgcgggagcgatgggaggctcgagagagtgcggcgaaatggggaaaaagtgagaggggacgacggcgatgcttaaatagggggagaggggaccggacgtggccgggagaggcgggaatcgccgggcgacctgggggagtgggggaggagagaaaagctctttttnctnattcttttncacttttctatctatccacactgccttatcctcataatattatctagtatcttttcctcacacacaagcattctaaactcacttcttaagggtctatggtgcaaatttcctttttcaagtttttttcatattttttcatcaatatcatcttgatgtcccgaacccttattcccacctaagccttttttgacacttaatcttctagctcacatatctttttagtccttttgccataacatacgttgtatcttcaatac

SEQ ID NO: 48883 - DNA, 14204 bp, Oryza sativa
  unsure (1)..(14204): unsure at all n locations
ctggcaaggtcgaatcgnctgctcagnagcccaccacgattattatttgcattactttcttagggttttctcttgatttcacctgcattttcttagggtcgttttaaaaattaaaattttggcttgggaggaaaacttcggggtgtgacacaaggcctctaaacataacccataaatatttttgactgatgtaaaaaaaggtctaacaatgcccctgctagagaaccctttaaaaaataggaaggccacccaaatctcaactcatatcccttaatcccggagctctaaactataacccccatcgatagcttctacgtgaaagaggaatattctggtctcgtgcctgtgctgaattgatcccgcgtgactgcgacacctgctcccgctccgcctgaggcctgccctacactagcatcttgctacaccatcttagaaaagaagcccggctacattgttcattgctgtcatcagcgtcactggagactctaccctactccaagcctactttgcctgatgccctaggatccccaagttgggcagtccgcaaccctcccctccctgccccaccgtgctcccttcctgatctgttatgcaactatgcctggcatcttttctgacatgttcaaggcatttgtagatagggactagtgcaacacatggtttcaggtgtggttatctccatggcagtgtagaatggcatggaatgtttgttcatcaatatgtttcgtgatatggtgtgggttcgtgtatatcttgcttgcttgctctcggaagtctatggtataaggcttgccagatgcatggtatgataacaaagatatagttgttcttggtctacgttgtcaaggatactttgatttcaacatataaaaactttgggtctattgagttgttagagcaagttaggaaggtggcacattaagcaatagaagtatttggtcagccttcatattggggggttagtaaccaaaagtttagttgttaaggtggatgattcatgatggcctagggccaaatgacaaatgccaaccttccgttttcagctctataaattcaattgagttagacagacaacttcatgcatcgatcattaaggatgggttcattcatagtatttttgttcgtaacccactccccaccatgtactatagaagtgataatgtgaaggatagcgtcagtgctacgaataaggcatacctcctatacttgagttcgtggtgtattgagataccgcacacctaatgttattatacgagaaggtatacttagatgaggagataagacgaactcggaaggaaactatatttgtgggatagcaggtgtcagtccgatccaaagaagataagttttccaatgttcgtaccatgcccgtgatcttcgagatctacttgaagaagaaagcgattactgctataaatacaaggccccatacgaaggtagggcatcaaatcacaagccatagctagagccacactgaaaaataatccggagaaagccaaagccctagtcattgtattccactcgttgagatgtactcggtgggttctagtcggtagattagagtagtttacagattcccacattgtaacctgtgtggtactttttccagcaatacatataaactgaagtagggttttattcatctcgagggcttgaaccagtataaatccttgtcccatgtcttcttgatacaatctcgcatatatcctagtaccaatgacccctatgctttatggataccgttgtcggctatagcctgtcgacggctagctacaaggttttcgaagagattcaggaatctcatggatagtacaatggttgctagttttgctacacatatggccattcatttgagacattcctaacattcaggaatacgtgatgcttgatgcttgttttttggtcagtgatttattgtcatgcatagttctgaactactgatgttggatactcatcacacaacgagggagacatccatgttaataggattatttgacacatccatagttgaaaattttgaatttaaattatggtgcttgaaatttttaatttgaatatagtaaattctttgcaccataaatattcatgtttgaactattgtgtggtgttaaactatgcttatacataaagcgtatgtttatatagaagagaaaaagaaatggaggctgagcaatacatgtttgtgcttgacatggagccatttggcttttagggagtccaaaatatgggatattaattgctggagcctggaaatgcacttaactccatatacggggcttgctctcaatcaaagtttatataaagatagctttctttacagggtttctatttcttctctaccaatataccaatcacaattagctcttccacctgtcccatctcgacccatctgtctcctgattgcccatcccattgtggcttttcctgaaccctcctgtagttgtagattgttgctccttcctcaacatcatccccttcttgcaacagaaacaaccttccttcttccttggttttttgtccctttcaaacacagactccaccaatttccaccattcactcgagtctagtgtagtatgaagcctcaaaattgttatgaaaattggagtagaagaaatggattggggatttggtgttcgccacaagactgcaccatattacaagttaccggtaacaacaaatgaaatttagagttcaattttgtactttcccattcgctgatatgcaagtatctaaattggttcaactcaggttacaacacttaatatctaaaggagtttagattctgatttcacgcactaatcagaaatgataacaatctttcattaataggaattatgaaactggttgtaggtcatcgtatctcctgtggcccatctccttctcatcaagccatttgattcccttcaagtacaagtccgggagaccagtaccaaaatgccttcttgtaaatcttcatttctgaacatttttgctccattttttaataattatagctaaggttttgatagttaattaggccacctggcattgggtgctttgagccttggtaattgctaccctgccactcaatgccatggcagcagcctcatttctacatatcggtatgatccatataaagtggtctcatggaggaaccagagaccaggtttagctcctacaacctaactttgtcatgcccaacacctcgtaagtgtttctcttgtggtgctcttggtattttagttagatattccctccattccaaaatataaggcacaaccaccttaatccaaagaccaagaaatagttattattatcttgtagtttggattatcctaataaatgtaatgcatgcatccaatagagttagagaatgtgagagtgaaggattttaaaaaatagtagtttaatggagaatatgtcatagttaatgacatgcatgcatgtatgccttatattatggaacatctaaaaaaagtgtgtaacatcccagcccagggcttaataggattaatagaatactcatatcaactagttgcaacttcttttccggaagccgatttccaaagaactccagggttaagcgtgcttggcctggagcaatttagggatgggtgactgatcgagtgaggacaaagtatgcagaaaagacttgtgttggtctgtgagggcagtctataagactataacctatgaaagctatcagatgtaaacggctatcagatgtaagcgggcctggcctgggagaggcgggacgttacaaagtggtatcagagccgactctcgcggtttcacgagtgcgtgtgtcgcagttgcgcaggcatggtgcgcatggctggtgtggaccgggagtggtcacacagcatggcacatgtgctggcactggacgcacggacgtggccaggaggggacgttcctggaacaagttgcaacttctttttcggaagccgatttccaaagaactccaggggtaagcgtgtttggcccttgagcaatttagggatgggtgactgatcgggaaattcttcccgagtgcgcacgagtgaggacaaagtatgcagaaaagacttgtattggtctgtgagggcagtctataacctataaaagctatcagatgtaagcgggcccggcctgggagaggcgggacgttacaaagtgtttgtgctttatattatggaatggagggagtatatgcgttggttgacttatgttgctcatgatgttcatgatcaaatgtcaactgagataaaaatgacactataggaatctttactaaagtaaattttctaaaataatgcaaattgtattgtattcttacggatgaaaatagtacaattgttggagtgatactcatcacagtaggttgtgatattcatgctagtcagtaccacttaagattgtacttttgtcggttcaagcacgtgtaagcggcggccagttttaaaccatgtgacgatgtgactttttgcaatagtgcttgttaatacccttatgtaaatgaatttcacaacggccatttacacctatatggtcttgcccctagcttatatatataaagtgcatgactagttgctaaatttgttcacctatatatctaggccccatgctctgaaaatacatatctaggtcttagaagttgttaaagtatatcattttagtcccaaattgctacgacgcctccggtatcctaactggtgttggttgccacctcacggaaattcctttcaattttcccctcttatttttttcttttcctctgttttttgttctttttttttaatcttctcctcttcccatgcacggctcatatacatgaaggggctcaaggatggtggcaacccgggtgaccgcttgagggcccatgaccatggcagagcccatctgtggtgactgaatacgagctcaatagaggcgatagggtgaagagtttgggggggggggggggggcgagctcgagggcccgcagcaagggctaactcggtgatggcgactagggacaacctccaacttcggtatccattgttcgtgccatgcatggtgttttgggtctggatctcggcccggacctttgcccctacaccaaacaacagctcccaaggatgtagacgacaccgtgcatgatccccctctcgtggaggtgacaacaaagcagaggagccactcgttattgttcccttcatcccaatgacaacatggacaagtttatggcgatgaccttgacgacaacaattgtagtggaaaatgagaaaaaaaggggaaaaaaaggagataagatggacaaggaaaaatacaaaagaagaaaagaaggaaaaggaaattcctaagtgggacccatttcagtcagtgtagagttagtagtgatgctatatcagcgtccgtgtggcacattaacaccatgtagaatcctagagggatccgtgcaatttcagactgaaatgacacgttaaccagttaataactacatctatttttgattgtatgaaaacagataacataaacgaacaagtttaggctctgttcgtatgagcaagtttggaagctttccagggatttacgaacctgagtactgtagctgctactgtagtatattactgtagcagttgacggacgagatggcgtccaccgcgccgttggagcgccgacactttccgtcgtcgagagaaggatggctgtcacacccggaagttctcctcctaagcctaaaatcgaattaataagagaccctaagaaaataccggtgcaaagcaagagttaaccctattaaatcaatgcaaataataatcggaattggcatgtagaatttttcttgagttctacatgtcgaaattcactaacaagatttttagtggaattttcagagctctcgaaataattttaaccaattaaaatcgagcatgcaatattttaaatcccagggaaattcttttcctccttttcttttttccttttccctccttttcctcttcttgggccgtcggcacattccaccccgccgcgcgcgcgccctcctccttgtgggccggcccaaaccgcccctccctctctccaagggacgccgacaggtgggccccacctgtcgggcccgtctccttcctccagccggcgtcgccgcgcccgcaaccgccgccgcgtccacgcctccgccttctccgggccgcgttggccacacccgcgagtgcgccgcatctcccgcacccacttccccctctctcgcgctcgcacccgcgcccgagatggccgggattcgattttcgaatcccgcctctctctcctcccccactccccacgttggccggcaaaatctcgccctaccggccacgtccgggactcccctcccctatttaagcttccctgtcgccccctctcgctttttccccatctcgccgaactccctcgtgctccccatcgctcccgcgccgtgcaaccacccgccgccggagtttccgccactccggccgccgctagccgccactagggttgccgccgcaccgtgccgtcgccggcgtagggttcgcgaggctaagcttcaccccggccgccccttccacgtcgggattcatcaccggaattcgcatcccctcgcgctccggtgagttcaacctctaccgccgccttcggccatgaatgccggtcgccgtggttcatctccctccctctaatctctctcttctccttccttagggcaccccgaatcccgtccgtcggttgccgtcgtcctcccgtggctcgtcgtcgccgttcgccgtcgtcttcttccgcgccggccaccctcggtgaggcatccctcccctcttttccccttcctcccccctagtgtcgcgccgccgcttcaagtcgcgcgcggtcgctttcggccgccgccgccgcctcccgtgccgccggtcgccgccgccgtcggccgcgtgccgtcgccgctagccctggctggccggtcggctttgatgccgagccgagcccggcggccgcctctatcgccgcccgtccgatcggccccgagggcgatctgggccgtcggtcccgtggaccggcggtggaccacccgcgtggtcccggtccacggtgaaccgccccccttgagtcgctgaccagtggggcccgcctgtcggcgccgcgcctcccccgtgctgacgtcagccctggaaaatattgcgcaataaattatttaaggatttttgttatagtaataaacacattgaatcttctaaaattcataactaattcatccgagctccgtttaagcccattcaagtctcagtaaatcaagaaaaatgtgtagaatccattaaaaatggttttgttctctgtttcagtagtcttatagcctgtttgcattgtttgccttgtatgtcgctagattccggctcttccgacgctccggtgtacttcgaaatagtcgccgaggttcctccagcagcagagcaaggcaagtcatgcttgtcacttgatcatattgatcctatattgcaaatgtcctaatgttttctttcaaataccgcatttgttttgcaattatactatgggatggttacctattgttacagctatgctttttggataccatgctcctttgttagcttgggttataacatgattagactttggactaggaattgcttagccatgcttagttcaactagcacacaatggggaaaactcatttaaaacctagactataggtttatatgataatgttggattagtaccaccgctctggtgttggttaaataaaatgaatcacatggtgggctgtgggtgcaaggttttgctagtcgcgcccatagcaattaaggaccggttcgcgggaaaccctggaagaatttatcgtgcttaccacaagccagcgtgggcaacggctgggcttgtagtgtagcttttctctagctgacgcatccaggcaagggtgggcgtgatggagcagggcgggccctgcgacggcctctgtcgctttcggattcacctaggcacgagaggggactgccagttgcccgctgggaacgggggtgaaacctgaggtgtggtgtgcttggctagagggggttatgcgaagggtcctgtcacgacctcttttcggtatgtcgtggtggcatgtcggcgcacggaaacgtgtcgtggggctgtgtcttgtgggtacagttgtacacctctgatcagagtaaaactattcgaatagccgtgcccgcggttatgggcggtcaaccagactcaccgtgattagactcaccttagtttagtctaatgaaattggatggtataggtggatgattgggcctgttgcaacgtggtgtaacgttggatagtggacgattaattctgcttaattattacaacttttttcgcattcaattcctgtttataaatgccagtatttatgcaaatgaacctgtttagctatcccttgttgaatccctgcatcatacccccccattccggtatgacttgctgagtacagtggatagtactcagccttgctctattttcccccaatcccagagctcgagtatgtatccgatggcgggttctctgaggagtaggcttcgtccgtgccgtcgaggatacctgtggagtggtgttcccgctgtagttcaagtcaaggattagctccagttatcttttgtttttccgctgcatttatgtaagacttttataatgtttgtaagacatggatctgtatgtcaacattgtcgtttgtgtaccccggccagtcctcgacgggggttttaatgcacattctgcttggaattctattcgggaatttctgggcgtgacaatggctgccgttgccgccggatgcgctgcagggggtgtaaatgcgtgggaggaattggtagatgcacacaagaaaacacaccccgatttgaaaaaattgagaagaaatgggaattgcattacagtagtaatttcatatggattcaatttcatgtagtttcgtttgaaataatagattgtatgtagattgaatttcgcaattgtgctatgcagtagcagaaaaccatttcgtaatgacgcagtatttcttaccataataattttcataatatgtgaagattcggacataaattttgcaataacattgattaattttttgtctgaaataataacgcaagaattaagaaaaaaatgaattgtgaaacaaataacacaagattcggtgcatcaaatttgttgttaacgttataaaaataaatggtaaaccatacaatcttgaaaattgaagtactgaacatacgacaagcattatgggtaacatcacctacctaatggtagttattgtacgcatcatcagcaatacagtcacgcaacatgctcatagcggcctcgctatttgttgcgtaatacatatggtcgaatgaatcgttcagcagcggcactggattgccgttgtagagagcattagtgaaccgataggtcggatctttactatccaacctaaagttgtgtagagcgaaagctgcatgaatgatgcgtgcagggatgtcctcatctcggtaataagggatttctttcaatattttccacatcttttttgcgatgacaaattgtctttccacgatccctcgcaacgtggagtgtcgatggttgaaagtctcttcccgtcctacgggtggtggggctccctcgaccgcaagttgatccctgtggtaccgtacatgtgggtacggtgcaaggaatcccatcctggtaggaaatccggagtcgacaagtaggtacctgcctggttaacggcgcagaattaaatattagtgcacatgtgtagaattaaataaaatcaagacatttggcaataaaaaaaagtgtattgactgatacaactcacctaacggtacccgtgggaaatcgtaggggtaagcctgcactgcctcattgagaatcctttggtcgtgaactgatccaggccagccagcatcacagaaaataattctcccatcatgatcacatattactagaacatttctggttgttatgtggtgacggttcctgtgttgcatagcgctagctgcattaggcagaactggaatatgtgtgccatccacagctcccactgattggtagaaaggcttgaaaggattctcttgcagaatctgagggttgtaatctaagaagttgggatcaaccggtttcaatattttcccagcgagatcattcatagcctgcaaaacatggtggaagtgaaccgacactgtcgagttggagcggacccaccgattgttcccgtctctgattggacgatttccacccatcgtgtacaagaaaataccaagcttttccatggaacagacccctgctgttcctacaagaccaaaagaagtgaccaatagatcatgcaaattgtgtatctcctccgcagtaagcctgaacattgccctgcattggcttcgatttgccatcgtgtccatcatccaactgataccggtttgcaccggtattctccttggtgccctctcattgaaatcaagggtagcagccacgtactcaatgatggcatcttcttctttgctgcttgtgtgaccgcctccattccaactcgatccacccgcgccgtaactcatcgccgatttcctttaacatatgagaaccggagaatacgcaatgtttgtcataatcaaaaggatagaaattaataatggcagtgatctatgcaatcgaagaattatttggatataaaagcaatgcaatggaatacgtagttgctcgaattggatataaagccgcaaatgtttagggactcacagaatgtaaaaattgttagcacacagagttctaaacataaatactagtttatttggaaaacatcgcacatcacaactcaaagtaaagtacagtttggtgccaccagatgactgtccagtaccaccagtgcgtataaattccaagcgcctagaggcgtccttgagttgaacaaagcatttgcaggtcaatgggtcacggaatagcgcacaagcagcataccacacacttcctccaatttcatggccatcattttccaccaactccatgcacgcatcaaggcccatagacttctctgcttccatctaagcagcatgactctggtagctctgctctcggatgtccgcaatcctcnnnnnnnnnnnnnnnnnnnnnnnnnnncgggacttcttgaaagaactccctgaggcaggagtgtttgctgctggcctctttcctttgccccggtctgctgccgttgggggtggagttggaggtggtggtctataagcagcagcgagctgcgccatgtcgatggtctgccactgaactgctccttgcggtgcggctggggctgcccctgcgacggcggagtggtttccgacaactgtgcgcccactgaataccgcgtggtgaaggtcaatgtgcttcagaggatcattcctgaagcttaagacacctttattttgctgcaacataagtagacagtaaaaacaagttagtacaaggcaagtgcattaggcttgtgcaaacattgaacgtaatgaatatgtgcagtccaatgtgcattactactaaaatgctggcagtaaatgtgcacattggtaccaagttatcaaatataatcaggagtacatgttacaatgggccacacatctgacagaatgaaagaaagatagtttgaacattgtaaacataagataaactgcatatgttatattctttgtagatgagcacatttttgttcattctctctatatacatcagaaagaaggtgtgtacagctagttgaatatgtattaacatgttcctaaatgacttgtacaagatctttcctaatttactgatacactgcatatagattttgtttatgcagagaacaaaacctatgagcattaccatgttacattgactgctacattgcataagctaatagaatgctacattgtgtaagctatatccttcacaattaaacacatgtgaatctgttaaaatgcttttgaatgtcacatgtacaagatcatttacttctcgcaatcattgccaatcagttcatggtaaatagtgtaaacatcattttgttaacttaaatacaagggaatggcacacattactaaaaacgacatgacagtaacaactatgaaacatatgtgagcacaatccttccattttactgcagctagtcatttgttggcacacacaacttgaacaaaaaaattattacacctcacaaaactgtatttataactgcatgcatgtactaaatttcagataatacctcttgtaggaaaaattgttggttcaaaatatttattgtcaagtgtacgtaccgcatttttgctttcctaccactcatcatcggcaacaatggctgatgtatggggatcacgacccagcccgcttgcatgtgattctagccacacccacctgttgtaccgcttcttacactgcccccaaatgtactccaattgagccttgttcaccttcttcttacacttggtgtacatcttgtgtattaggttctgccatgcctgcggcttgggggagttggaggtgatggtgaacgctgccatctcctccaagcagctctcaagaaacacacgaacctccatatcggtccaccggctacggccatcgcccatctactacgtgcaagtcaaacaaaattgaatcggaaatgaacaaattaatacaaaccaataccttcgatgactcttcctcacggacgacgtcccaatcaatcgaacgcccgacggtggcagggctcactcttcgaacaaagtcgatgacggctctagaagacttggcgcaaaccttgtagagggcatgcgcgatatgaagcacgtcgtcgggagcagccttggcgctgccagcgtcggaggtgacagagtcggaggagtcctcgccggactctagatcggcgccgcggacagagatctcccctgtttgaggggattgaacaatcgtcccctcctcttggatcgacaatagatcccgctcttgcttccgcttcttcactctcgtctccatcggaccacgcacacgctcgtcctgaaatagagctggctcctcaactccgccagcttggatgccttgatgagactcttcaagccagcactgtctgacctgagaggccgagaggacgagcacacaggcagccagactgccaaagatgggcggcctgatgggcgccgatgcttgctgcttcacagcgagcacgccggccagctttttctcccctcgaggacgacgcagacagctcgacaggcgtggggctcttccacttccccccgattttgagcaccttgaaccgaccgctgccgcaagacgacgcgcggacgagaatcgattgggggggggcacgggcctgcaagccacagtcgaaaggggaggagggtggctggcgagaatcggggaggacgggagcctacagcggaggggaatcgattctcctccaggcctgcgtcgcatcgacgaccgcggaagcaagagagcaacagcgagaggaggaagaaagagggatcgagagcattggatgccctaactccgacggaaaagccgaggcgcaaaggcaacttctcacatccgttaacgccgttaacgtcgcctcacaagccgtcgttttggtactgtgtgcgggaccacgcttccagtgcacggaacatgaaccggatcaggactcgcacatacgaacgaagccttagaaactagtgatgtactctactcttttccaatggtctttatcagtactctgatctagaccacatatttgaaagtttctggatttccggtacctcaaatttttaaaaggtttggtgacttttctcctccatcgtacgataatctaatgattgtgatcatcctattgtttttttattacaatgacgttctttctttaggcaaaaggttgtacaataaattattctaacctacaaaattgaatgaaataaacttatagcttatacacaatacataattaaatgaaaaaaatcaaacatggagaaaaataaagtgaaaccatggatatatataacaacaaaaatcatagttaaaataagtaaagtttcacattgtatagctatgcaattttaaactttgcaaaatgtgtaattttaggagactgtaaatttacaaattnattgctgataagcgattggtaatcacacntcaagngtcactgnnnggngngggnnnnngggaatcnantagcacgctattagactaaacagggaatcatgatcaaaataccggaataattcatacactcatacatattcaatattaacgacatcangagggag

SEQ ID NO: 48884 - DNA, 6443 bp, Oryza sativa
  unsure (1)..(6443): unsure at all n locations
ataagttcgaattataatttcttttatgataaaataagtcaaaacaaaataaataatatttatattttttaaataagacgaatgatcaaatatcacgttaaaaaacaatgatgttatatattaaaaagtggaagagggagtatagtaggtttgctatacttttaaaatggaaggagtacatacgtaccatgtgcctctgggtaacgaatggactggagcaccgcggtgtatgtgtcgaagaaggagtaggtgaagtccggatgcgtctcgctcatgtcgcggaggagcacgaccgccgcatcgtttaaccgagttgccatgtagttggcctgagcatcacattccttggtggggttcagctcccgtatcaacgggcaacatcccagcggtgctatccccacgaagaacaaccgtcgcatcccaaggtcgtacaaggtctaaaatcatgatagatttgcactccttattcatattacatgtcgttttgatttcttttatcaaacttatttaagtctaaactaattttataaaaaaaatatagtagcatttccaatagaaaacaaacaaattaacaaaatatattgaattctatattacataaactaatttggcattttaggtattgtaaattttttctataaagtacgaaggtagcccgcatatatacgtgggcatcttatttaatgtgcgtgaagttttattatgaatgttcatgttagagtgactgttaatttaaatattcttttactatatcctaaactaaaattaaacttatttgatgtgttttgaacgttggttatgatttttttttctaattattaccattgcagcatataaattctatactaaaattatttgaaaccgtgcaattttcaatttatgagaaaatactgtgttaaaataatatatgtgattctaatgagaaaattttgggtatttcgtctccccagaaggatatcgtaccaaaaaaatttaccaaaaagtccaattttttgatagattctatataaaactttagatatttcaattttatttgtcctggtaaaatgtttgaatattaagattttatctaattttagagtacacgtatctatttagaaatgcttataggatgtttactggggatggaggtttgggatgctttttttaagaaaaatgatagatctaacgacctaaaataatgtgcctatcaaatcaattagaaaccgatggtcaaattttttttttaattccgtagttccacgtagtggtttagaaatatttgtatgttgtttaatagactataaatattaatggataaagggatagagggaaagctggctggacttattagctaggtcgaggtctacatgtgggtttttttccccgtgaaagtaattttaatttcaattattacgaggacagaaagaggagagcgatatagtaacggagggagcatacatacatgtgtacgccgcatttaggcagctgggacagtgggagtttttgtttttttaatatatatagatcaaggtagttttgtttttaaatagatttattgatctaaaataatggtacaccaaattaaataaaaatcgatgattatattactctattttattaaagtgccatgtgacgactcggaagcaatgacgcatggtggcttagaagcgttcataagaagtttaataaaattttagtatataataggtagaggcttggtcaactttagaaagtttgaaatgaaaaaaaaatatcaaaatgatttataaaatgaaatggagatagtagtaagcacatggagaattgtatggagagcaacgaaggtgatgtgatgttactaaatccataaacatttgagaaaattcgaaaattttggtccagccggtcggtgggggtgtctgaaattactgtttcgaaaccgaaactgcaaaaacccggcctgatgttacgttgaccttaattgcaagatcgttttgcaagcataagtatacgtacctgcagctggcgtttgagggtattttccagattgctgacgatctcatctcgggagcgtaggagctcgctgacgggactcagcaggaggtcgttgatgatgtcgttgccgccgatggcgacgacgaagagcgatttggcaaggtgggccttggccccaggaatgcccagctgcttccccagcgcctcgtggactctgtggtagtccccctctatctgctcgtcgaagctgatgcactgggcctgcatgcgccgtactagaattaaatactcatgtaataattaatatagaattaaatactcatgtaataattaattgatggattaataagtatgtaacctgtaattaaatttctgattcatacatattctgttcgtgttacactaaaaatatattcaaaattttcttgagcctcagtgtggtgctctctattattattggaagacagtatgaaccgttgatctcatttaatcgaagtgttaaaatttatttgtactactaccactattagcagtaatagaaatgtggaggggtatattgtaacaaaaaatgtataaaagggtataatcatcattagcagtaactaaactttttccctcttttttggctttttcgatgaaatatatttagccgggaaaaaacatatataaatgacaaagtaaatcataattattgtattagtaaattactattttacctataataatatactggtagtataatattataggtagagagcaccgaaacatcactcaattttctttatttcgaccctagtattaagttgtagtactaccaggtttgtgagattagacacccctgctcctcctgaagcaaaattgacacccttcagatatacggagctgttcattggtttgctgcttatagagaggtatggaggagggctgggcaccccgagactgatagctgcaatgtggaaaaaaggttaaaaaaaaagacaacaaaaagagatatatatatatatatataaacacacacacaccaacgaaatttttttttgagtagagataaagcaaaaataatgtcaagtttcaaaagatctatctatcttctattttattttatatactaaaagtccatgaaacttcctacaaacgctctcaagctgccacgtggtgcttctaaaaacgctccaaagtcgccacgtggcgtattgataaatcctaaaaattctaagtaaaaaacaaaacatctaaccgttgattttcttttaatcgggtagacccattattttcaaccattagatctattttacaaaattaccaaatcaaccaccgttagatctatcttgcgagtacaaaattaccaaatcaatttatctctcttaaattatccctcggtccgtgtacctgtacagcatgtacgtttgtacgtacgtatcatcccaccctacttctttttctatttttttcttttttatttagattagatgaaaaacgaaaataaataattcaagtccattcacaaccattgattttccataaaacatggtggactaattagatttttgttattaaacaattgaaaggcccacgtgtgccacgtcctcccttccatcatgtacatgcgtacttagtacatacatgtatatatcggtccctctacccattcggttccctctctctatgatgtattattagccatcaaatcgtattcacaatggttgtgtagagcctcacacattatatataaaacgttcccaaatgaattatctatcacataatgcaaatatattggagtatacaaacccatcaatttaccatagccttatgtcccatataatccatttattaataaataatgaaaatctataccaatcttacttgcttattgataatttttttttaaaaaaagttgacacatagggtgtaatgatgtcactatttgtcatatcatacatttgaacttaaaataatatttgtataaaataaaacaaaagtgtaaaatgaaccaattctagaaaaccttataatttcttagaaccattgtggttcataactttcccttaaattgagataaccatgcataaccacttcatcatttttaagtgactacatatcaatagacttctctctgttctatgccatagcagaagatagttggctttgaatattatatttcttactattaaatttgggttttaacactcgggttgactaaatgtatttaaacaaatatatagatcacacatattataggaagcgaggtctagaatatatctactctatatttttattgattcatacataagtacgtataaaaaattgcatcaattgtgaaccaattaaaagaaggaataaaacacatttattataaataacctttttgagaattttttttaaataagagcccaaaacatttaattaaaaataaaaacaacaccttactttaatttggattaagacctacgtcttcttaaatgataaagatgattaactttatagataggtgcttatatagatgaatcaaatttacatattgtaaactaacaaatatcttaaaagaaacatttaagcaatgattcatgaatgcccgcgcgaatgcgcgagctaccatcctagttgtgagaataacaatcagtcagtgctggatcggacctgccaacatgttcatattggcgtacaaattaaacggagggggctcagatctggttttcccaaacctcgagctctctactatttgattcaaacaattcgtccggaagattccattaattttagacttaagttccagtatatatgcaaccccatgtccggaagtttcattttaatttcataaactcgaactctctgtcattaaataattcctactaagctggattttctgatctaagcgttgcacaagcgctttcccttttgggttgcctctgcagcttaggagggtgcctgcgaaaatcccattttactgtttgtatatttcaatattatatactccctccgtattttaattttaatgtatgacgccattgactttttaactaacgtttgaccattcgtcttattcaaatttgttatgcaaatacaaaaatacttatgttaggcttaaagaacatttgatgataaatcaagtcacaataaaataaatgataattacataatttttttgaattagacgaaaggtcaaacgtttgttaaaaagttaacggtgtcatacattaaaatacagagggagtaacacttttaatacaatacataaatatcggtaaaacacatatgcatatgcacatgaatacatttggtgataactgaaaaactaaaaaaaaaaaaaccatactctcgtcaacataggggctgattgaaacgctagctactgcagtgctaggctgtggccgtttttagttgctgtcgcctgcacgctgctgtaatagcaagcactaccgaaaacacctattgtgttaggtgaccattgcttattcatggaataagccaaacggcatatttaaaaacgaaaagtaatttatgaataaaacttttatatacgtattcttatcgatttaaaagcaaagtctagcaaataaactttgatgaaaaacctcaaaatcaacttcaaatttaagattgaaaatttaaattttagctgataagtataagtataaacgaaaagatgaggcacttagatttgcaatcatgcttaaacattctaggacgacacatatcctccacgtagggtgcgagcgtccatagcacatgaaaacagtttgacataaaaatacgctgtggacaatggccgtacgtacgtgtacgcagcgatcgatcgatgatgatggatatatactcaccgattaaatcgacgaagttgtagccattgctgaacctgccggtgggctttccccccgggtagtcgatgccattgtgagggaagttggccttgagcagcgagtgcagcaggtagttgttgttccctacgtctgcctgcgagtctccgagcacgtagatcgccgggacagcgccgcgcgcgcacgttaggcagcaagcagccaaacacaggaggacgacgacgacgcagacgccgccggaggacaatgtgcaagaacccatcgtcgctcgctcgctccttcgttcacagcgggtgtgcatgcatgtgtatgctgaagctaagctactagctagcctgccctattgaagctatactacacatagntaaatttttnctctgatttccctttacttttggcatgttatttaatttagaactttcctattttgttggctctagccaagcaagcgctctgggccgtgggaaatttaatcattagcggtggcgaattttacggtgcctaaccatgcatggtttgtttaaaagcaaggtcttcgtagttttttaagagcaggttcatttattaagcgacactaagtgcagtaaatagcatggtgatatacggaaaagagcttaagagagaaacattcatgagcttgggcgagcggaccacaatttataatggggctgg

SEQ ID NO: 48885 - DNA, 763 bp, Oryza sativa
  unsure (1)..(763): unsure at all n locations
gcggcattgatgatcgcttgacagnagcncatcacactagaagtaaatgtacgagatatcgctacgattaactggttgagaaccagtgagtaggtgtctctcgatcatttggagtcgtggtacgaggaccgctacgctgtcggtcgaagatcagtcgtagctgttcctcaaccatctgaagttaagatgcgagagattgctacgttttactagttcgagaaatagcgagcgagtagaattatctcttgaacaccaatggaagttgcggtgtgagagattgctacgtactggttcgagaaccagcgagcgagtagaattatctctcgaacaccaatggaagttgcggtgtgagagattgctacgtactggttcgagagccagcgagcgagtagaattatctctcgaacaccaatggaagtttccggtgcgagagattgctacgtactggttcgagagccagtgagcgagtagaattatctctcgaacaccaatggaagtttcggtgctagagattgctacgtactggttcgagaactagtgagcgagtagaattatctctcgaacaccaatggaagtttcggtgcgagagattgctacgtactggttcgagaactagtgagcaagtagaattatctctcgaacaccaatggaaattgcggtgcgagagattgctacgtactggttcgagagccagcgagcgagtagaattatctctcgaacaccaattgaaagtttgctgtgccgagaggatgctacgtacttg

SEQ ID NO: 48886 - DNA, 6716 bp, Oryza sativa
  unsure (1)..(6716): unsure at all n locations
ctgtcaggtaagacaacatgatgtacagcagctcatcaatattaccatgtttgtgagattagacacccctgatcctcctgaagaaaagttgacacccctcaggtataccgaggtgttgcttatagagaggtatggaggagggctggccaccccgagactgtcagctgcaattaatggaacaacaagagaagtatttgccgtgaaaaaaatattttcccttaaggccatcttcggttaatcccaaagagaaagagatcagcggaaatttattacatatttattgtggtgtgaaattattccccctcaaacccctccaatccccttcaaccctctccaacccgaacgagccttaagacaatggtcacatgtatatacatagccaatacaatagcctctaattttaattcccaagagtgcgcagtgtacgcgttgatgaaatactcaccaaggtagtcgacgaagttgtagccgttgctgaacctgccggtgggcttgccccccgggtagtcgacgccgttgtgagggtagttggccttgtacatcggcagcgtcgctggcaggtagttgttgttcccgacgtccgcctgcgagtcgccaagtacgtacaccgccggggcagcgccgcgtgcgcgcgtcgggcagcaagccaaagccacaaggaggagggcgacgacacagacgcctgcacaggccgatgtcgacggtgtgcaccggcgccagaaacccattgttccttcacagcgtacagtgtgacgtgtgtattaaagcctcctagctactctctccgtcctaaaatataacaacttttagcccttagaatttatcttaaaatataactacttctccacaaatatttctcttcctaaccaatcacaactattcaccattcatttttcccacctgtctccactacccatccaatcacgacccttcaccacttatttctaccctacttttttaataatcgtgtcaaactctaaaacctcttatattctgagacggagtgagtagtgtatataggctgtgtttagttggatccaaagtttggattttgggtaaaattgaagataatgtgactgaaaagttgtgtatatatgacagggtgatgtgatggaaaaggactgaagtttggatgcaaactttagatctaaacacaaccataggatcggaggacgccaaagctagctacatttatagcctattgttgtgcacacaaagacggcagcggctgtccaaagctatgccaactttaggattggacgagagggactagtcaaccctagtcaccgtacagtactactctctctgtttcgaaatatttgacgccgttgacttttgaaaacatgtttgaccgttcgtcttattcaaaaaatttaagtaattattaattcttttcctatcatttgattcattgttaaatatatttttatgtaggcatataattttacatctttcacaaaagtttttgaataagacgaacggtcaaacatgtgctaaaaagtcaacagtgtcaaacatttcgaaacggagggagtatatatataattgagtaaatttcatgaaacaaaatatattttgagaaattccgtacagatttaacaccaaattacatattgaacatgttattggttggggctctagccccagctctctggttggcaggaatctaatcccatatatctgttgcgtagtgagttcatagtgccagcaaaatttgcacagcaaccagcatacggccaagcagtgatggctagttggctggagacgttcagggtgaaagaaatgatgtgcatgaaaaaacattaggctgtttattactagctggatcatttgtgaattgtgatcattaattatattgtagattatttttactcttgtgttctagctagtagctgttgcagtgtgcagctcatggcctttatacatggaaaagactataggtactaactttttcttactaaattctaacactgaagtgtcatgctacgagttcatctagatttttcataacttccatctacctaaatcaaacggttgagatgattattagtaaagatttagtaagaaaaaactagtatgtgtagcagtgctcttatacctattaatttcaatctttttcagttcacttcagtctttaatcctctttttttccctatccgcgtaggattttgaaaaagtatattataattattatgtattatgactttaatataaagccccaataatattttcatcacgttgtacattcgccactgcacattctgatggtacattgaactacgtttgtacctgaagaaggtgcaagtgcacatcatattatgtctgcacgactgcactagactatttgccgaactaatgtggaaatacctgcgccagcagtagctgtgaatctgtgatatgatcctttctttttattatcacgtttttgaaaataaataaataaaataaaataaggtcaatagcttaggacacttcgtcagtgcccggtttttaagggccactgactttccgactatgatgatcgttggtgccgattgcactgattttctagcactgagtggtttcaattattaatacgaactagaaatgcacggacaccttgtttaattttgctttaatttttattgtgaatgcttatgttagaataatattgttgaaatattccctgacttcattttaaacatgttttgcttaataactgatttggacattggttatgatttttttctaattaccttgaaacgtataaactctatactaaaagtaaaattacttgaaaccatataaccttaaattgatgagaaaaattgtgtcggttcatatctatttgtattatgtatgattattttttggaacatttagcacaggggcggacccagggggtgtgccgggtatgcnccggcacacccaaaaaaacgaaaaacttatagtatatagcatgtattagtttggggcaaaagttgatgagtatgaacgcatgagccagcccatcatagatgcctgtgtgatgtgttgtgcgctttgcatcgtgcaagttccccgcttcacctcgcattcgcgtatccacttggcatcgtgtgaaaggtagctagggtcagggcatcaggcgttgttccacattcagcgagcggcggcggtgacaccgaagagcacgacagtcaacaggccagagcaccgatattggctggacggcgagtgtggagcgtcgacggtggagacgagagccgcagccactagcatttagagacatggcgaagcaatgtcgatgcgagcccggtgagtctgtgagcaacgcaaggaatgcagctagcagcaaccacattgaccaaggcaagcaagcaggtccagcttcgcatcatctatctaaaacttcagatacagatatactctttgggacttttagtctctcactatttttagtttctttgtctccctgaattttcttttaaaggagagctagagattggttgaaaaattgaaaattctgaaatcagttaatacgaagaggaacaagggcattgtcttcttttagcaaggcatcagaaaattcagattatgctttgtctaggccatgtacagggctctacattttggtgtataaaatgctcggtttgcctatatttttgtgtatatgctctagaccaatgtgtagggcttgtatttgtgggcacacccagggtataaatcctgggtccgccactgatttagcatatcggtttccaaaattttactaacattttttcttgtgtgctataaatgactttatggatttacgaggaagcaccggcaccatcgtctttgctgaccgtgctgtggcctccacagattcaccctcctgaagttcgagatggtgttgctccattcttcgctcctccagatttttttttgtcttcctcacatatctttaattttgacatggaattttgctggtggagcagaggatatgccatacatctctgtttgtttgcatgcattcatatatggtagatagacatctaccagtaaaaaatcatttgtcggtaattaaaaacttttcctgactactggatcattggcaaacactggtggtagactaagtgtcgacaaattgtttgacgctaagagcaggtacaatagcaggctataagccagctgcaaatatattttaaggagataaatgagaagagagaaaagcagtgggctacagatttgtagccagctgtagcacactccaagacgcagtgtgtgtatgacaggtgggtctatgtattaatagtgtagtatataactattgtatgaatgagctattagattagctatagatgaattggagctagtagttggctatattattaaacttgctctaatggccatttataccgacagtctaagtgcttccatatgtaggtcatggtgtagcgtgctctcgtgttccattatcttctcgcgaatgctaggcgacacataccatcccccatcccctgcatgggacgctccaatccctcagacatgaatcgctggagccgatgaggatggacacacttctccaggagatgatgagattgtgtacggtggactgtgaaggtagtcccgccactcccgataggcccgcatccaagtgactgtatggggcgagagttgactagagatcatggagatcgaagctcctcaccacacgacctcaccaactacaagcggttcacgaagcatgcgatggaggcagatatgctcctcacgggcactgatgagctcttcgccatcactgacgtcctcttcatctcacagtcactcctcccctcgggccactgaagatctgctcaccatcctcaagctatacgcccatgtatggtacgaatcaattttttcttggtaccaataagacaatgagcattgggcgatatcagtggatatcaatatctagtaccgacgagtatcggctgatacccagggattaaaattttggttcgaaatttttgaaatttcagaacccttcccccttccccccgcaatgccaatatctcggctgaaatttttggtttttctccaatttttgtgaatttagtcaaattcagttaaattgtgtcaaaatttcagtaaatttcagtccaaaattaccaaaattcccagaatttcggttctaccaaaagggccgaaatcaaaattgaaaattgtgccgatacctatggggtatcatatgatacctagcaagtatcatgcatgactctggtaggtatcacctgatatatagctactagctagtatacctagcaagtatcatgcatgactctggtaggtatcacctgatatatagctactagttagtataccgggtctggatcccctggagttgagtataactctaccgagtggagttggccaaatctgtactatccattgtttcctacggctgagatcattcatcatcaatttcacctaataaattaactccttaaattaatggttaaggcttccgaggaaacttagttttttcatgtgtttgctctataatagcgatttgattaagttctcacccccaaaaaaaaaagtaacagaacaacgttttgttattccccaaacaacagatatagtcgatcaactctaaagcaactcgcagtgtataccaacatagtgctttcacatatatgcaaacagtgaaccatatcaatattaatgtgtatgatttttttagataattgatgaagcatgaaatttttgttctaattatacaataaaaatgatctcgtgataagttgttgatgcgagtttatttgttgcatggtcagttactggtttttaaagtataaattaatgtggcttaatcccagcccctgaagtatatggaatggcacatatttggccaactccacccggtagagttatacccaactctaggggatctggactagtgtggatgtggatgcagatgtggatcggattatttcggacggcggatttggtacagagtcagtgcaaactcggttcggaaatgaaataaaattgtcggatgttatgtttgtattcatggtgttgttgaaggcatgtttctttaacgatttctagcctagcgagagccctattcattacatacaacaagaaggcagcaatacaataagcagcaatgcgatagtaaaataacatctgaacatgatctctcaaggaaaaaccagccaaaacacatccataatagtataattttgcttaagtgcttaagtgcagcttgcataatatataacatcaagtgcttgaataatccaaaacccttccaggcattgcttgaaaatataagtccatccatggctccagcctccatgccaatgccataacatcaggtgtaaagtcccaagtcctaacaaattaacacatccaagatcaagataacagtatggtaacaataattccatgcagaagtacaacaattactcttgcaatttactaagttgcaaatatgaactagatctatacaacacacatcaacatgcaaggatccagacttcacttctcactcttcatcattactgtcggagggtgaactcctggagcgggggactaaggggcccccctttcagttcggcggggggcagcgggtgagaatcaaggtttggtgcaaggagtgatgtggagggggtcgggcccctcaagaacgatgagataaaatgggtttatacaggttcgggccactgagaagcataacaccctactgatgngctgctgtncatncagttggtcttaatggccgc

SEQ ID NO: 48887 - DNA, 753 bp, Oryza sativa
  unsure (1)..(753): unsure at all n locations
agaggtagactcctcgttgcaagnagcncatcacaaaataacaacaaaaaggaaatattacctcaaaacatcaagataatattacctctgccacttggaactatctgcttagcgacagagagcaatgtaatatctgttctcttgatcggacactagaaaacgacgtttcattgcaagaacaaatggatcagaagcatgcctgctaggaacaattattcttctaggaccatgagcaggtaattttccgcctgaagagctcatcccatgtgtataccgtgatagattattggttgcattgtatatctcttcggttttaacacaagattctttaacagtttgtggaaatttattttcacccaagaaaacaacatctggagagttctacagaaaacaacaaaataaaaacacaactaaatttaatttgaaaaataaaatggcaaaataaattaaaaaaacacatttctatacttacagtcacatcttgaaataccctgttggaaaaaattgaagaaatttgattaatcccagctgagttctcattacttcttatattgttgtgatcaatgacatcaatagaatcagggacagatcgaaaagatttgcacagctacaacagaaaaatgaatataaatatatagaaacatcttctaaaagaactataaaatacagtattaaaaaacaaaactagtaccaatgatgaggaggagtaaatatctccatgagcttgataaccctcttcatttaactgattat

SEQ ID NO: 48888 - DNA, 2220 bp, Oryza sativa
  unsure (1)..(2220): unsure at all n locations
ccgcgcttgatggcttctctgctgtagctcatcatactctatatggctgtgttcggcagcctatgttaggaacacattttctgcacacgaaaaacggagtggtccattagcgtgcacgtaattaattaagtattagctattttttttaaaaaaatagatcaatatgattttttaagcagctttcgtataggaactttttttaaaaaaaaacgcaccgtctttagcactgtgaaaagtctgcgagcaaaatacgtgggaggtgagttgggaaaattggaggaaagaacacagcttgtatatgtagttctctgcacgtgtttgtgtctattttacgaaatatcctatagatgcaagtcttcacatgttacatacacataacatgtacattaattaactaacaaatattcacaaaattctaaaaaatatgtatgtatactttcaataaaagaatttgtaatagtattatatccacatatgaaattccatcttcaaattcatcatacatggaaaaaaagacaacattttgacaaatttatagtcttaaaactatcagaattttttttgttgttacagccaaaatataatgaattaatttgtggttagatttatacataggtgtaatactatccatagtatatgcatatatttttttttataattttagataatatttattagttggtatgcacggagtgtgctgtgcacaggatatgttcccaccttactataacaatttacatctgacatagctccatacatattatagtatggtaatttttttggccttttcagtacgatgagtgtagctcaactgattatgttccttgtgatggaacctacccacccaaattcaagttccagacttgatatagatgagtttaagtcctatacttgacacgactgctcgcatctatggctaattagctttttaaggataggcaacttaccatcggtgattttatttgggtgctcgcatttacggctaattaggttttcagtgatagatgacttacccgtgggttcaagttttagacttagacacatgtgtttgtatgtatggctaattatattttcaatgatagacgacttacccattaattgatagtgaggccctattgatgacttcgtcgattttaaaatatgcgacatgatgactttatcaattttaagatataccggttcagtctttagatatgtttataaaaatatccgcgtatttataagcccttggatttgtagtatgttttaaaaaagaaatattttatcaccaacatataggaactggataaatctacgtgcatggtgcatctatgattggtgtagagaggaagactcgtttagcagtgttgcagtttgcataatgtatagtaaatactcggtgcatatatatgcacgcacaccgtttgatagctagtatcttgtagtttagcttctaggaaaaatatcaatatttatgggtggacgactgaaaaatgcttgagttgttctcgctatgggataaaggctgcaggtagcgcgcgtcgtctccagtccagtgaagaaagctcacgcacgcaacacgcacgcacccctagctcatgtgcaagacgagccggcgagctgtatacgtagcagctggactctggagaagcatcagctaagctgtacgtactactgtagttcgatcgatggatgctggtaataacgcaatcgctgcggcgtccttcgccatcgtcgtccttgtcgccgccgccgcctcgtctttagcggcggcggtgccggcggtgtacgtgctcggcgactcgctggcggacgtggggaacaacaaccacctgctgacgctgctcaaggcggacttcccgcacaacgggatcgactacccgggggggaaggccaccggccgcttcagcaacggcaagaacttccccgatttcctcggtgcgttatcgtcgcaagccccccaccccatcaaatttnanctcttccattacttcttaaccttcttattcattaaaataaccattantttaataccaacatcatcacttcttatccatatacttattaaaaccttaatttcacaaaatattttctttaataaatttccatctacataaaaaaacctaaaaaaaagaatttaacttatatcatcaaaacctcttcaaccccatacaaaatttctattcccttacaccaacttcaactctttaaacaataccctcattaactttgcttttatgn

SEQ ID NO: 48889 - DNA, 6442 bp, Oryza sativa
  unsure (1)..(6442): unsure at all n locations
atgtccaagtacgatcagcatgttcagtagttcatcaacaattttcaacttgtacatacgtacgttctacacagcttagcccttacatactaaccaccagggttcaaatttttattttggctattttctatcaggtactgaaataatttgaattttaataaaatttggtcacatttaaacaaaatttgccaaattcacaaaaaatggaaaaaagggtggaatagttttggttttgggggggggggggggggaagggggccatagacccaaaattttgaaaatttcagtccgtaattttgaacctgcttattacatatatagtacgttaatttaatcatgttattacaagcttcccgatccttgtgtatccgatcataaattaatttatcacttggtcatttttgatatgaatggtgcattgcagctgagaaccttgggttggcgacatctccaccgtacctcgccatatcgtcaagcagcagtgctaactacgtgaatggcgtcaactttgcttcaggtggcgccggagttttcaactctacaaacaaggtagttctaattagtttcaactcgtacacgtaattgcaataacaaacttttctcatagattaccaggacgtaggattatatgtatgcatgttagtcgtcaacgcactatatataaagttcattttttttaaaaaaataatacaaatggtttacatatttctgtcgacagtgatatagtcaatttgttttcaacttgttttagagttgaaaattggttttaattacttgtgttaaacattaatgcaggatcagtgcatcagcttcgacaagcagatcgagtactactccaaggtgcaggcgtcgctggtgcagagcctcggcgaggcccaggcggcgagccacctggcgaaatccctcttcgccatcaccatcggcagcaacgacatcatcggctacgtcaggtccagcgccgccgccaaggccaccaaccctatggagcagttcgtcgacgccctcatccagtcgctcaccggccagctacaggtgaggatcgaggtcaccgatcgacagataattaaatcgatcatcaaatgatcaatttcatggtgttacgttctaatggtgttcgatcgattgtgttcagaggctgtacgacctcggggcgcgcagggtgctgttcctggggacggggccggtgggctgctgcccgtcgctgcgggagctgagcgccgacaggggctgcagcggcgaggccaacgacgcgtcggcgcggtacaacgcggcggcggcgtcgctgctgcgcgggatggccgagcggcgcgcgggcctccgctacgcggtgttcgactccagcgcggcgctgctccggtacatcgagcggccggcggcgtacgggttcgcggaggcgcgggcggcgtgctgcggcctcggggacatgaacgccaagatcggctgcaccccggtcagcttctactgcgccaaccggacgggctacgtgttctgggacttctaccacccgaccgaggccaccgcgcggatgctcaccgccgtcgcgttcgacggctcgccgccgctcgtcttccccgtgaacattangcagctcgctgctatgtaggcttcatctcatcttcacggtgtactgatcgatcgagctgcttgtgagattccacttttttcaagcttcaagtacagccatagaaatatactactatataccatgtaaagtatactagtgtatttacttacgattggtacatatagcggtagaatcatataatatagcaaattcataataagtgattgttgaagttcatcagaaattcacctggaattggggtcggaatcataacaagtgattattgaagattgtcagacagctatagtacttaccaagacgagaagatttgtggtgcagcaatttttctttcagggatactagcgctcaaaacgtggcaggaaaaattcactttagattccgcatagagtaaattgcactagcggtacttaaacttgtaacgatgtttcacttaggtccacgaacttgcaaagcgcacatcgagatccctaaatttgatttattgtatcatcccggtccaaagccgcgtttgaccgtggtcttgcctacttggcacgccacgtagacgatgacatggcacaaattttaattttcctttttttctccccatcttttctctccttcctcacctcgtatggtcggaggggacgcggggcaggagcggcgcgggcgtgctcgggcgccggccgacgggaggagaggagcggcgcgcgtgcgcggccagcggccggcgagaaaggagcggcgcgcgggtgtcggctggcgggaggagagaagccgctgcagcggggcggcagggcgagctcgtgctcaacggtgtaagctcgacggcgacaacggccatgtgagggctactgccggagtggtggggcgaagaggccgaggcgcgcacggggggtggtgtcgccagccgctcccgggggaggggtcgccgaccgcggccgcgcgtgcggggggaggcgtcggcgggcccgagctcgacgacggcagcggggcggtggggcgagctcgagctgggcaacgcgagctcgacggcgacaatggccatgtgggggccaccgccggagtggtgggacgaagaggagggcggcacgtcattcatgcggaagcggctgaggtgcgcgaggggggaggtgtcgccggggcagccaaagcctcgttgacgggagggagggaggacgacggtgattgggggaggacacgccgcgcggcgcctcccagccgcgtgtcccttcctcctttcctcccctcggcgtcgcctcctagctgcgcgtggccaagccactgcgccgcaccaccttcctcctgagctgtgccgcctccctcccgtgcgcgcgcccggccgtgctgccgcgctcagccaccgccccgctgcctcatgccacgcccgccctgggcagcctcctctcccacaccgagctcccctcccttatcccaccgctgcccctctcccggcgctgtgccaagctgcgccgcgccgacacgccgctgtcgcctcagccgcgtcgtcgcgtgccggctgcctcgcacgcgacagcccgcgccgacgccgctgccccgagctcccccgtgccggcctctcccttccatcgccgccgcccgtttccgctcgagccaagacgacgccgccgccgagttttcctctcctctcgatagccgccagctcctctctcctgcaccgccgccaggtcgccgaccccggccacaacctcctcgcaccggtcgtcaaccgcctctccccgcctctctcctgcgccgccgccaggtcgccgaccccgcccacggcctcctcgcaccggtctcgctggctccctctctccctttgcctgccacagatgcatctagaggtggaggaaggagagaaaaaaaaggaaaattaaaatttgtgccatgtcatcgttcatgtggcgtgccacgtaggcaagaccacggtcaaacgcggctttagaccgggatgatacaataaactaagtttagggatttcgatatgcgctttgcaagttcgttgacctaagtgaaacctcgttacaagtttaaggaccgctagtgcaatttactcttccgcatataacggttgagtttggatagtgcccctcatcttctaaaaccactttaaatatatagtcccgccatatgcacactatatttcttctctatggattacatgtacgttgacccacttttttttgttgttgttgttttatcgtataagtttcacatagacgccacattagataaagaacaaatcaatatggcacgttgaaaccgtcttcgttgggactacatttcctctgttcggtaaagataaggattgcgttagtacattgtttcgcggttgagagactcgatcgaaactcaaccttagatgagagaccggcagtgaactttttccaaacgtggttcgtggcccatcaaaattccaggattccagcttatgttgggccttccagatctgcgtcgttgggccatatgggccagcgtgcttgttcgtccaagcacaccgccccacggcccaccgtccgattcacacgtctagtagttccccaggccaagctaccggtgctgccggcggcggcggcggcggcgggcgccgaaagcacgaacggcgaacggctaaggcacctgcctctcgggactcggggaccagcggcagaatcttctccgggcggcccttttctcttgccccagtggcctctgctgcaaactccgcacaaatgccgcgccccgctgagcctcccagttctcgccgccggcgatatgtgtaggtaaaattatttagaatgagttaattttttttggttatgcgcaaatccacaattaatctacatttgagctaactagttgctccatagtttctttgctgagctggagattggatgcagtattgttgccattcagatctcttggtcgagtttgaacctagaactgggcctataaggctataatttgttactgcagctattatacttctatacgttatatgcatttcaggtttgtgactagcctgattcaatccaaagccttgactttaactatctttttttttaaagaatacgtagaaggtttgcatgccatttcttatagcgataagagaaaaggaaccaggctgctatgagtgtccaaatagtaccaattacaccactcaggaaccactacacataatgcagctgttttctccgcaaaaggtaaataatagttggttgtttaattcacacaatcacaccacatgacccatgagagacggtaaaatatatatgtagctaatatggtatgagctcctcacctgtaaagcatgacgttgattaggtgattattacttataggttgcagtgttctttctaatttttataccaaattaagctatctattcatcctcttcgctactgtcatcactgccgtactgaatttcctcatcttctgactgctcatggtcttgctcatcgttgtcctctccattgtcatcttcgtacaaaagcccaaactcctctctgtgctcgtcctcacttgcatcattcaattcattcagagcttgttgctcttcataccaagcatctttagactcatgtaactgagagaagggacattaattattataaataaaaaattcagaaaaaggaactaagaaaataaacagtggtcctagtactgcaaatgcactaataaaacttaaagcataaagtatttgtacgtagatggtgatagagatctatacctggcattgctggtgcgaaatttggacttccaaccagtctgctagcaatgggcactttgtgatggtaagtcgctgaagctgtgttgacagtggtttatcagatggtagctgcagataaggacatctatgtatcttcaaaaatttgagtgacccaaggctgctaagacccattatagagtgaagacgtgggcaaacactgataaccaagacttcgagcaatgggtgattctgattgtcaagtaaaaggtgctcgatgctccgtgacagtaacactttcagtgatctgagatgcggaaagtgcaaatcattcagaatttgttcatttatcttgctcttcaagaccaaagtagtgaggtttggaatagctggtagactagcaagtttgctgcaatccttgataactaactttgtgagggaggaagatagctcctgtgggaggtacctcaactcgtggctatccttgatttttagcaggcggagtgaaggaaagtcatcctgaccaacttgagaccactcaacccatttcaacatttcttgaaactccagctcctcaacagctgggaatgcctttgtggtgatgtttccacggaactcctgtcgcacatgctccacatctgtcatgcactccatagagagtatgcggaggcgtggcaattccccaagtggaggaaggaacttgcagctttgctgacataggattatctttgccaagtgcatgaaggtagaagccccaaaccagctaggatatttgtatccactataattgactacctccaattcttcgatgttcttgtgcggccgtaggctctcaaagatctcttcctcatgctctgggtctggggtagccacatcattttggctgctaggatgactgcagttgttggggcaaacaccatcagaccagtctaatctcaggatttgcaattggttcttactgactaaattagctgtctgagcatcatcaacatttataaccctccgtagtcctgtaatacataactctccatgtatgttcaccagatggtgtagctcggcaacattggaatgccaacctccgcttccaatgctaaaccttggcaatgtctgtagcctttttagcccacctatcccacatggcatgctagcttgagtatgatgggctacagcgcacgagtctaatccgcagg

SEQ ID NO: 48890 - DNA, 20279 bp, Oryza sativa
  unsure (1)..(20279): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagtactgggcgtttgagctactggtactgatcgccggattgctcccgaatccgacagtgagcacctcgctgatcgccatgtggtaagttcgtcgttgcgctgtcccttccatgaatcgatcgcaaaggaagaaactgatctgattaatgcatgattgtgttcagctcgagcacggaggccatcgcctacatgatcacgtacgggttcagcgccgctgtgaggtacgttacttacatacgcacgctacctgttcgatcgccggccattgttcgtcgccgtcgtttctgaccgaacgttgcacgcgccacgcgcgacgcgacacgcgcagcacgcgggtgtcgaacgagatcggggccgggaacgtggagggggcgaagaacgcggtggcggtgacgctgaagctgtcggtgttcctggcggcggcgttcgtgctgctcctcggcttcggccacggcctctgggcggggctcttcagcggcagcgccatcatcgcggcggagttcgccgccgtggcgccgctgatgatggcctccatcctgctcgactccgcgcagggggtcctctccggcgtcgccaggggctgcggctggcagcacctcgccgccgtgaccaacctcgtcgccttctacgtcatcggcatgccgctctccatcttcttcgccttcaagctcaagtggtacaccaaggtagtacattacttatacttacaatctcacattaatccttttcatttctgcttcacaaagattacatgcatgtgacatttgatttgggttgcattgcttgtagggattatggatgggtttgatctgcgggctgacatgccagacctgcacgctgatggtgatcaccgcacgaaccaaatggtccaagatcgtggacgcgatgcaggagaagaaggccagctacgtcgcgtagtttaactagtctttggctatactgtagattatcgatcggattggatatgtgtatgtatacacgatgagcatttgaagcaacatctgcggttagcatgtctgcaacacgcgcgacgccggctgttgcgttcgtgcagtgcgtgcgcctgcgacgtttcgcggggttttggacgcgacgacaatgcgcgcgaactgcttgttcaaatacagtttcttcagccatctggaagctggaagcctggaatagacaaacaccttagagcaagtataatagtaggctataagccaactataagcttaaggagaatttgaaaaatggagagagttggctctcatgcaagagctagctattcacatattttaagatagatacataggtgagagatagagagaggaggagaaaaaaaagaggtaaccttatagcccatttactatatatgttaactctaagataagctataaactcattgttggctctattattaaacttgctcttacagtactattttcaaatggtgagcaccatatattaattgtgaaaacacacacacacaccgatgtacacgatgatggaaatttactcctctcaagtttgattgaatcttgtctgaagttttatataaaccaaactaactttagataaaagccctcccactaccataaaacctacttccttcgttctacaatgtaaaactttctaggatgaggacatatcatgtgaaaacaatgtaagtgttgaaaaattatgaaaatcatatataaaagttccgtaaattcatgaaaaatattaaagataggtgtagtgaaatacattctcaccaaatctcaactccaaactcaattttgtttaagaggaaaaaaaagagacaaattttgggtgaatagtgtcatattactattctcctaaaatttgtcttttgtcctaaataaaattaagtttggacttaagatttggtaataatgtatttcatgtttacacttatctctagtattttttttatgaatttataaaacttttaggtatgatttttacgagtttctaacacttagcttgttttcaccagatatgtccccttctaggattacccaaattaatatagatgttaatgaatctagacacatatagaaaacatatacattgatcaatggatgaatctaggtaagtctaaaaagtattacgatatgaaacgaagggagtatcaaatataccatcttactagtgctggttagggaaaaaactagcactggtagcggtttttggtccctcaaacccacacgacactcggaggataagaaaaaccacacatgagaccatatcgataccagttcattaaataaaccaataaaatgtgtgggacgttgatgttggaacatgtataaaaaagagctgatattgatgggtgattaagctgagctgatcgagcaagctctagattggtttcgatatatttaagtctagacactctctcttgtgtgcgctcagaatcgatcccttcgtctcccttcccctttctctcatggccacctcccttttcctctctcacttcctctccctctttgtcccgccaccgcgagattgattacagtggctgatcggtaggcagcggcaacttccgtcatctttcccaacgcggctgtcctatagagctcggaagccgctggatctgcccatcatgagctcgggtatggctggatccgatcagtgtggctcaatggaaacttccctccccctctcccagccaccttgagctttcgaatgcgacgacaaaatagaacaacagctatggtctattctcaaatataagcatttatatgatttattttttccatgatataaatatttctgagcactaattctaatatgtaggaatttaggcatttttcagccaattagatacttagaaaatgaatctagctatctaagaaactcaagattttttaatatgaccattgatgaggttatcgaaagggaattattaccttaacataatatttactaaataacctaaaaatgcttatatttaaaaataggtggagtggtacattttgcggttaagcttttctttttactagtaatcgtgcacgtgcatcaatgcacgtttttcataaaatatattataggagtacattggaagtttggaaactatatctaccaaaaataatttattcaaccaaaatttataaaatatatctcatgtgtaactgtaaaaaaaatataaccaacattatcggtacttgtaaacatgggcatgactgtttgttttgtacaaattttgataggagggaacaaaatagaaccgaagccaaaggctatacagtagccgcctttttctctacagctagctgctccactgcttgatctcgtaaaaaaaagaatttgtcgacaattcgctaaattgaccatccctctttcttgaagtttctattgtttcgttccgtccaaattccccaacagacaagcaagaagagggtcctgagccctttgctttgcatcttttctgataaagtcttgtgacaccaccattccaatactgaacaggctgaaggagggctagctgaagaaacttcagtcaagcacaggctaataaatatagatgtgtaagacatgcttcagacaaacttcagtcaaggaggtaatgcatcactgcaagttgaattaaattaaaaatcaaatatgatagtttcactcactagatgttacaactcacgagaatacaagatttcggaaaacaaaacaactaataaatatagatgtgtaagacatactcccttcgttccaaaaagaatcaacctagaaggggccacatacatcaacctaggaggagtcttaagttgaattttaggaagtaggaagtaaaatctagatatttttcccgagcgtgcaacaaaataacttaaatatggaggctctctattaccctcgatagaaaggcgaagttataaaactcgttggagatgctctcttggctggattttttttcttagaaagacagatttgtcaattttcccagtcagacaaatgtagcagcgtcaactaattaaggagctgatgaaccttcttccagagaatggagtgtcacgggctgttatgtttctcttgtcactgtaatctgagtaccagctactatgcgtctgtgcgttgttctcgaacgaactagtggtcttatcggtaaagttaaaatttatattttcaagttgattttaaaatatttttaacatagtagttttattttcagaattggcttttaagtcccttaaaacatgcatatacaagttttatctataaattaatttttattttctaataaactgttttggtttataagggaatatgagtaaccgacgaggacataaacagcttatcccgatctcaaaattttagcagaataatgatcaacaagcagaaataattcagatagatagcgacgtgtaaagatgcaccaaccacatagaaatctctgtttcgttgcgtttgcctcggcgtaggttagggagcagaattggctgtcagctggtgccttatcgttgattggaaaagatatggaagttggaacaagccaacaaactgtatatgtcatcattttagggcaagcccaaaagcattttctagccgcaccatcgagaaagcattctagccgctcgatttcgagctggcattttctcttctggtcgtacaaattttcttccctaaattttacttgttttcagtcttttttaacaaaaagaaaatattttaagcctactgtttgagagcgtactatgcagcaacaaatattacaaaaaaattataactagagatagtattctatgatgtaattttcagaaattcacaccgactttcaagtaagttcaacaaaacatacttgaaatatatgttgctccgtgatttggatccccgtggactacgggagagaaccagggaattggaatctaatttcttaaacaggttgtttgggtgccattggagttggaatcatctaaacaatatcggcttccaagacgaaaatagtacatatccacattttatattagagtaaatttcacaaaactatacgtctatacgttttgtggtctatgttacagaaaactacacacactttgatacttggcacttaagtacatatatttcgatatttcggtagtgtagttttacaaaaccacactatcaataaataaattcaccgtgagatgatgtggctgttccacctaaacgaggacgtggcatcctatgctattaattttgcatgacctcctatgcttgtcagcgccggcgcggacggccgttccatatttccgcccatcgacgaccaccgagcaatatcgtgtagttctcaccgccttcggcttgcatctcgtcgtcatgtcagccacaagccagcgcctttcctctcactgctatcccctcgccgccgcgccacgaggctcctcgctaggcctcatcatctctcccggcggcccctcaccatcctctggtcatctctctccaatacatgctatgctcgagatgtggagttagcaggcaactcgctggctacatgcctctttgagtactgcggctgtgcggccccttgtgtctcattccagtactatggtggctctgccattctgctactaacaggtatggtttggttctttttttttttgtccaaggaatcaatcaggtgcccattttatagtgagttttaatgagcaagttccaactgaaatttcacataggtatgtagttttttgcctcactgttgattgattttgttaaaaaaaacagttaattcatcaaatatggaggtttctaatgcctctgaaatgaaagtagtacaaaacatgggagctataaggggaggacagggaattagtattctcagtcagtccactattgtacttaatttcaagtagataaattacgcttcagtggaaaggatcactcagtctgaagtttgtggctataaccccttgagttaattgattgttccattcagcttgtagtactggaacttgacaagagaagcacaatagtttggcgtagtactggaacttgacaagagaagcacaatagtttggctgtagacagtagtaggtggcttctttcatgtctgtaggaaagtgctcctaaaccaagcacaaccttcagttgtggtaagcacaatacagaccttaactcatggaactttgaaatgaaataaaaatggtataatgctccattagacatgttcacacatctagtttgatcaacaagtattcttaataaccagctcaacaaatagtgcaagaacaatagactcaaaacaaccatatagaaaggtgatcactgaccagaaaacaagtcacataataaaatccttggtaacatatcgcgctgggattggaaggcacatatgtgcgtatatttagttgcagcagttttagtgggccatgcgcatagaagtccagcttgtcccacgatgccacgtcctcgttataggtggaacaaccacatcatctcacgtgtgaattcattcattgatagtgtagttttgtgaagctacactatcaaaatatatatatttaagtgccaaatgtcaaagtgtgtgtagttttctacaacttggaccacaaaacgtgtagttttgtgaaatttactctttatattaaaaaaggatgtctttttttttcacgtactcttgtgacttaggccctgtttagttaccacgcaaaaactttccaccccgtcacatcgaatgtttggacacatgcatggagtattaaatatagacaaacataactaattacacagattgcgtgtaaattgcgagacaaatctgttacgaccaaatttggtaagatatgaaccaggttcggcattagaatcaaagcggattcggcaaagagttaggctcgaaaaacatagtttgcatcggctgcgaagacatcggctgagatggatcggacagagtacagccgatacggtcgattctgatgaagacagttgtaaaactgcttctagaatcaatcaacatgctacacaaagattgccacgacggagataagctcttagataggcaattgtatctattagttagttaggatatttcgaatagtttccttagagatatgtttggacaaaagtctgtcgtaaagacctatgtgtatcttagagtttgttagagataagagtcgtgtccggcgaggacatattatgtatctcgggtataaatatgacccgaacccaatgtaaacaacaacacacaattcaataacactttcgcgcatcgccaccctttttacttttgttctatttcgacgagttattgttttcgggttgagctgcatcgtttcgattttcaactagaggtaaacttgtcatgacggtttgcgttctcgagattagtacttccatctttatggtattctaatcttgtttatgtaattcgtcgagttatcgtatatactttataatctctgttaattgtgcttgttggtgacatgggaccgggggtatcttgactagaggtttggggcagctgcagtcacccacgtggcctgaccccctcgggggggggggggggtcgggcccgagggtgatgtggccgcccctccctctgtcttcccgaggggtcgggccgctcccgtttcggccccgagggctggggcgccccgaccccctgtgggtttggcgccacgtgtgtgggttaggtgagcacagcggcgctcacctaaccgcgttaattgcgggttggacgagcgccccacgccgcatttaatgcagcgcagcacactcgttcggtccgtgacaggtcacagtgtgtgaccggtcacagaccggtcagatcgcgggttaggtggcaacaggcggcctgacacacgtctcgccctgtcccgtcggaatgatgagagcctccaggcactcgtccctagccggagccggcgtgggaactcctggagttggcacgtcagccccggccagatacattccaggcttcatcgcaaccattgcaaggaagtcattgtatgaagaagggcagacgtgtagcatgctgaactgacacgtggtggacaagaatgaccggtctgtgactggtctgacgccggtcgcgtcatcggcagacaaccgtgctcccacgatgcatctgcctccggtggagtggaggtaggtatgacccatctcgtcggatggtcatttggaaagcagccatggtaaatctccgcccattaatgagggagtaacagggagatccccggtgtcaggcgagagacggcgctgagcctcactcaaggacaagttgtgatttagcttccaggcgaaggtgcaagccaagttttggtcaagagagggtaggtccccacccagaagaaaagtaggtagaagtggtgcatgtagtatccccttgagatataaaaggaggaccttgcccaccaaagagaaagaaaaaaaaagaaaaaaaaggaggcgagaggggttctggagcctgaactctctggctctccggctctctgtaaatccttcacacacagatccaccagaacacaggagtagggtattacgcttctcagcggcccgaacctgtctacatcgcccgtgtctcgtgcacttgctctctcgcgaacattctccagatcgatcgagggcgaagaacctcacttagcgcccccggccgaaccggcaaaggggggcctgcgcggtctcccggtgaggagccccacgctccgtcatctggcgcgccaggtagggggcgcgtatgtttttctaagccctcgtcctctttcgtgtgcgccaagcttctcccgctcagcccattggccgaacgggcagtggcgcacaatctctctccgagcactagcggtgaagacggggagcagaacccgcgccgtcgagctcgtactccactgtccccctctcgccgaagtcttgggcgggaggaggcgctcgaggaggtcgaaagatccgcgacttcgccgcacgcgggcgatggagaaggacggcgagacggggagcgtcgtctcctcgtctacggagatggcagcacgccccagggcgcgctccaggctgcgggcgcactcctgcgtcacccgcccgtcatccctgatccagagactccaacccgacgttggctagatgacgtggccaatttggtcatgacggcgcagcagcgcttaggcgccggctggcggtcctccgccaccaaggccactggcgttgctactgctggctccgtgtcgtcgaggcggagggcgcggcgagcggcggccgctacccgccgttcgtccgccattccctcgtcaacgcctccaacccaagaagatgtgcgtagggggccagatgcccgcttcaatatcgagcgccggcgcaatgatcgccgtgctgcccatgcatcggagggcgcttcctcgtccggagcgccacttcggtccgggcacgggggccagccccccgtgtccccggttggcggtgccggctgtcgagcctttgtggcgagccttcggaacgtccgttggcccccaaggttccggcccaccatcaccgaaaaatacgacggaagcgtcaaccccgccgagtttctccagatctacacgactaggatcgaggccgccgggggtgacgacagggtcatggcgaatttcttccccatggccctgaaaggacaggcgcggggttggctaatgaacttgccacccgcgtcggtccactcttgggaggatttgtgccagcagttcaccatgaacttccaaggcacatatccgcgcccaggtgaagaagcggacttgcacgcggtacagcgaggggacgatgagtctcttcgctcgtacattcagcggttttgtcaagtccgcaacaccataccgtgcatcccagcacacgcggtgatctacgcgttcaggggggcgtgcgccacaaccgcatgctcgagaagatcgcctccaaggagccccagaccaccgcggagctttttcagctcgcggaccgtgtggctcgcaaggaggaggcctggacctggaactcctcctgttccggtgtggcagcttcggccgcccccggatccgccgctcggtcagggcgacgggacaggaggaggaagaagaggtcggcccattccgacgacgagggtcacgtcctcgccgtcgagggcgctttgcgggccacccgaaaggggaggcctgcgagcgacaaaaagaaggaggccggcgctcctagcagggagcgcccgaccggcaagtggtgcaccgtgcacaacacctccctccacgacctcgcggactgccgcgcggtcaaaagtttggctgagcggacgaggaagtgggaggaggagaggaggcaggagcgccgtgagggcaataccccggcggctcccgccggcaaccggcgaggtgaggccaagcagaaggcccccgccgaggacatcaacgatggcgacgatgacctagggttccaggagcctgaggccactgtcgccaccgttgatgggggagcgtgtgctcacgcttctcgccggagcctcaaggccatgaagcgagagcttctggccgtggcccctacccatgaggtgacgcggcgggcgcggtggtcggaggttgccctcaccttcgaccagaccgaccacccaccgtgcgttgcccggggaggacagatcgcgatggtggtttcccccaccgtttgcaatgtgaagttggggcgtgtcctcgttgacgggggtgcagccctcaacatcctttcccccgctgcctttgacgccatcaaggccccggggatggtgctccggccgtcccagccgatcatcggtgtgacgccggggcacacttggccgctaggccatatcaacctcccggtcaccttcggtggttccgccaacttccgcacggagcgggtgaacttcgatgtggcggacctcagtctgccctacaacgcggtcctggggaggcccgcgttggtgaagttcatggtggcggtccactacgcctatctccagatgaagatgccgggccccggtggccccatcaccgtccatggcgacctcaaagtcgcgcttgcttgcatggagcagcgcgcggaccacctcgccgcggcatccaagcccgcgggtggtgacgagaggctcagcacctccgtcccagccgccccgaggcagcggatgatcacgtgcgacgaggtcccgatcaagcaggttgccctgggcgatggcccgtccaagaccacacgaatcggtggtcttctggacgacaaataggaagacgcgctcgtctccttcctacgggcaaacgccgacgtcttcgcctggagaccggcggacatgcccggggtccccagggaggtgattgagcaccgtctcgccgtacggccgggcgcaaggccggtccggcagaaagtgcggcggcaggccccggaacgtcaagccttcatccgcgaggaggtggcgcgacttctggaggccggattcatccgagaagtcatccatccggagtggctggcgaacccggtcgtcgttcccaaggcgaacggcaagcttcggatgtgcatcgactacaccgaccttaacaaggcatgtcctaaggacccttaccccctgccacgcatagatcagattgtcgactccaccgcggggtgcgaccttttgtgttttctagatgcatactctagttatcatcagattcgcatggctagggaggatgaggaaaaaactgcattcattacccgcataggaacttattgttatacgacaatgcctttcgggttaaagaatgcaggtcctacttttcaacgtactactcgaatttctttgggtagccaaataggacgtaatgttgaggcctatgttgatgacttggttgtgaaaacacgcaaccaggagaccttactctcggatctagcggaaactttcgaaagtctccgcaccgcccgcataaagctgaaccccgacaagtgcgtgttcggcgtgcctgcgggcaagcttctcgggttcttgatctctgcccgaggcattgaggccaaccccgagaagatacgagctatagagcggatgcgcccccccagcaagcttagggatgtgcaatgcgtcactggctgtatggccgccctaagtcggttcatatcgaggctgggagagaaggcgctacccctatttaagctcctcaaacgctccgggccgtttatctagacggaggaggctgaacgggccctcactcagttgaaggcgtacctcagttctcccccagtcctggtcgccccggagccagatgagccgttgctactctacctggcggcaactccgcaggtggtcagcgcggcgttggtcgtggagcgcgacgaggacgaccctcgctccgcgcatccccaccctgtgtcgactcgacccgggagagagcagggaggagaggcccccgagccgaatggtggcccgaggcccccaacgaccggaactggccctctgcccgcttgtccgacggtgccaggcgcccctgatccccaggatggccccggggccactgcgggaaggccgcgcctgtcgccctctgaccccgaggtcgtcggcacagaagccgagtgcgccccgtgcggcctctcggacgaagagcaccctgtatcgactcgacccgggagagagcagggaggagaggcccccgagccgaacggcggcccgaggcccccgacgaccggagctggccctctgcccgcttgtccgacggtgccaggagcccccgacccccaggatggccccggggccactgcgggaaggccgcgcctgtcgccttccgaccccgaggtcgtcgacacagaagccgagtgcgccccgcgcggcctctcggacgaaaagcgccctggagatgcggcccctggcgaagaggatcggccccgacaaaaggtgcaacggcccgtctactttgttagtgaggccctccgggacgccaagacccgataccctcaggcccagaagatgctttacgctattctgatggcttcgaggaagttgcgccattatttccaggcgcatcgggtcacggtggttacgtcctaccccctcggccaaatcttgcataaccgagagggtactggacgggtggtgaaatgggcaatcgaactctctgagttcgatttgcactttgaaccacgccacgcgatcaagagccaggccctcgccgactttgtggcagagtggacaccggctcccgagcccgtctccatccccgaggccagctcgggcccttcgcagctgcctcacaccgcctattgggtgatgcagttcgacggctccctgtctcttcagggcgccggtgcgggggtcacgttgacctcgccgagcggagatgtccttaaatacctggtccgcctcgactttcgggcaaccaacaatatggcagagtacgagggactccttgcgggactcagagtggcggctggactggggatccgccgcctcctggtgttaggcgactctcagttggtcgttaaccaggtctccaaggagtaccagtgctctgacccgcagatggatgcttacgtgcgccaggtgcggcgtatggagcgccattttgacgggatagagcttcggcacgtgcccagacgggataacgcggtcgccgacgaactctcaaggctcgcttcctcgcgagcccagaccccaccgggcgcctttgaagaaaggcttgcccagccgtcggcgcgacccgaccccctaggggagacggacgcgcctgaacggcccccgaggcccgtcggagtccaggcctcgggacccgaggggggcgctcccagctcccttagattgattgcttagatcgctgagatccaggcgtacctcgcagataagactctacctgaggaccacgaagggagtgaacgcgtacagtgcatctccaagcgctacgtgctggtggaagggaccctctatcggcacgcggctaacggagtcctcctgaagtgcattcttcgggaacaaggcgtcgagcttcttgccgatatccatgaaggcgagtgcggagcccactctgcctcacgcaccttggttggcaaggcctttcgccagggtttctattggccgacgactctcaacgatgcggtcgacctggtccggcggtgcagggcgtgccagttccacgccaagcaaacccatcagccggcccaggccctgcagaccatacctctttcatggccgtttgctgtctgggggctcgatatcctgggtccgtttagacgggccccgggcgggttcgagtatctgtatgtcgctatcgacaagttcactaagtggcccgaggcttatccggtcatcaagatcgataagcactccgcacttaaattcatcaggggtatcactgctcggtttggggtgcctaaccgtatcattacggataacggcacccagttcactagtgagctcttcggtgactactgcgaagacatgggcattaagctctgcttcgcctctcccgcccaccccagaagcaatggccaagtggagcgcgccaacgcagaaatcctcaagggcctcaaaaccaagaccttcaacatcctcaagaagcacggcgactcgtggattgaggagctgccagcggtgctctgggcgaaccgaaccacgccaagccgagcaaccggggaaacgcctttcttcctcgtctacggcgcggaggcggttctcccatccgagctcaccctgaggtcccctcgggccaccatgtactgcgaggctgatcaagatcagcttcgcagagatgacctcgactacttggaagaacgaaggcggcgcgcggcccttcgagccgcgcactaccagcagagcctgcggcgctaccatcagcgtcacgtccgggcccgatcactctgcgtcgacgacctcgtcctacgccgtgtccaaacgcgtgctggactgagcaagctctcaccaatgtgggagggtccgtatcgagtgatcggcgtcccccggccgggctccgttcggctggccacgggcgacggcacagagctgtctaacccgtggaacatcgaacaccttcgtcacttctacccctagtgggggtcaggtgttaggtctcgggctcgggccaaccccgcaccccccctcgggcgtgcagggttggccgggggctaccacatatgcatatacttatcttttttctcttccgtatttcaataaaagctttttcgatttcctaaggactgtgtctgtgccattgtttccttttgaagagttttggcttgaattagcacgctcgtgctcgaccctgccctcggtggctcgggccagcggaaatcgccaaacggggcccagaaccgagccgtgccccggggcgtggtgaactccgggggggaatcggcaaaggcccacaatcgggtccccataaccctcggtcaccacgctcccagcctggccagtctcgacacgtgcatctccccaggcactagccccgacccgcgccgtttgaggctgggacctgggcacgagcccttgttcaagccaagacacagaaggaccgcggcacagaccatcctcgtctcatacacacaacaaataaaattgacacagaaatttcttctttatttgattgcagattaaattagtttatacaagaagggggcccgaaggcctcggaagaagaaaggaaaaactatttaagattggcgggggcctgggggctcatttcgaggctcccgggtcgccggcctcgtggtcgctgtcgtccacaccaccgtcgccgccctcctcgtcggagtcgagggcgaacgcgagccgaggggccgtaccctcgaagctgtggacgatgtggtcggcggcgtcccggacctgcgcgcgcgcgtcgtcctcggttccgggagggaactcgtccaacgctgcccacggggagaagtccgggtccctggcctggtagcttgccagtacaagctccactgcccccccgggcgaggtctctcgaggatgacttgatcgtctcctcgagctcctcggggagccgctggagagtcccggccatctctgagaggcgctgggcgaggcccccctggttggcggcgtacttcgcggtccgctcgccccagaggcccgcttgccgcccgacgcggtctagacgggagacggcgtcccgaagcatgccgggccctacctcgcccgccaagcggagggcctcgacctccccggcggacgagtccagtgcgccctgcagatcagcgatggtgtgttcggcagctgcgaggcgggcggctagatcgccgtcgcccgcggccgcctcgccgctgcgcgccctcgcgtccagctccttcgcccgcgcctcgagctcagcggcccgctgatccagtgcggccctcttggcgcgggcgccttccagattacggcgcgcctgctcctcccgcgctgcctcgcggagggacaggctgtccgccagccgctgcgccgcggcctcggcctcctcgagagatcgctcccgctcggtgagcgcatcctcgcggaggcggagtgcggactcctcttcggcgcaggcggcctcgtgcgccgccagcgttgcctcctggatagcgacggcggtctcgcggtccgccaggtccttctccctcgcgcgggcacgctcttccagcgccgtggcgcgagcctcaagggtcacttcgcgccgccgggacgccgcctcgttctccgtcgcccgccgttcccgagcagtggtggcgtcaaggactccccgggcggcgtcgagtttcttctctagctccgccacccggctcccgtattgaaggcggagatcgtcccgcgcctcgttgagcacggcggtggcgatgagggcaatctcccgctcctcctccacctccctggcgatctccgccagctccctccgacgggcctcgagctctgaggcgtgccggcggtatgccttgcggcccgcctccaccatggcctccaccgagcgccgcccctcttcgacgcgcgcccacgccgcgtcgagctccgcccgctctgcttgcaggacctccatctgggcacctaacccgtccagcaccatcgtgttcgcggcggccagggcctgcaggaggggctctgtgttcagtggagcggcgtaaggcagaggggagagccgcctcggtgtgggcgctatgcggctcggcccgccaatcgacgtgccggactcaggggcgtcccccgaggctggctcgtcctgaacgtcgcccgaagggtcgggtccgagcggtgcgcccgcggcctcgtcgtgggtggactcggaagtcgtcgtcgcctcgggcggagtcgggtcgggggcttggcaggccgcctggcgtgcgcgcgtcgcctctgcctcccgggctgacttcccggcccggtggagtctggcctcctcccgagtggcctcctcagcctggcgaacccggacggcttcctgggcagcctcctcagcttcccggaggcggtccgcggcttctcgccggacagcttcccgcctccgggcctccgcggtcgctgtctcctcggcctcagaccggccggacttggaatggcgaggggggcgcgacggaatctcgctgaaagcggaagaaaaaccagaagacaaaaagaaacgggtaagtgaaaactcgccttgggagaatgaatacggccgcagtgggcgcggggacgaacctgcgaggaggtcggctaaacgaccaccttgggggggagatgaggtttccccggcatggttcggtcacccccatcttgcggagccgcttcttttttcgctccccctcgggctgcgacgtcggcacagcaccctccgggcgcctgctgctggcacgcaccgccccgccccctcggggaggagatggggagggggtatcctcctgtttcctcttcccccgggcgtcggcagggcggctgccccccgggcccccgtcacggggcccagacgcacgaccccctcccggggtagattgttcccccctgcggctcccgcccgcgccatcgtggcctcgaggagcccgctcccctgacgccccgaccggctgcatgatggtcaggatgttggcgcgctctggatcgctgcagagggggaggacaccttgggggatgagggatgcctccacggagctgagattcagcacccgttggaccaccatctcgaaatcctcaggggcccagtcccatctgcccccctggtgggtcctcatgtagtcctcggacccggtgtactcccaggcgccccgggcgcgccgctggagtggcgcgatccggcgacgaaggtagtcgccgaacaccatggcccccgtgagcccctgggatcgcagacccgccaggcggtcaagaacggcgtcgtagccatctcccagatctaccggcgcccgccagctggaggcctgcgccgggggctggctcggaagtcggaggcgcgctttgtcggcgagaggggtgtagaaccagtcgctcttccagtcgtcccacttcttgcgaaggacgcaggaaatgtagcggttcagcaccggcccccgcggctggaagtagcaaccactgactaccgacggtggcgacaccggctgtacggtgaagaaccaccggaacagccggagagatgggcgcaccccgatgaacatctcgcataggtgcgcgaagatggccaacgtcattaccgcgttgggggtgaggtgcgccatctggagatcataaagctccagaacatccatgaagaaagaagagaatggcgggaccagccctgccattgcgaaagagaggaagaagacggaccgccccgggtaatgcggcgccgggcgtccctcgcccagcgcgaccacctcccggccggtggcagattccggcatgaatcggcgcggcagcccggcctgcctctcgctcacgatgcgggaaggcggcagcacgctaccctcgagcggtgcggagccccgtgccatgacgccggcggaggaggagcttgagagcgagcgagtatggcaagggtagggcgccggaaacggagagtcagagcacaagtggcaaaggcaaagggaagagtgacgagaggaaggaaacaagtcccttccttgatgtcttagtacccttgccaacgctatgcccggctcctcgatccccgcgcccactacctcgccccctcgtctctcgcgcccacgcctccactaatcccgctcgcccgtttgcggcgcacgaggcggatgtgcggccgtggcagtcgagatgggacatatcgtgcgcgcgttaactacgctcgccgaccgatgcaccgtcatcacatctccagacgaaacgaaccggctcgtcccggttcgcgcgctacttaagtaatgtagtggtcttgaaggaagccgctcattattgtcggtcggttttttccttgacgatgtgcgcgatttgcgaccgctgggtttctgccacctgtggagaccggccccacctgtcaccaggtctaaggagtggcgtcatgcccgagcgcttccctcgggggggggggcgatcgccctggcgtaacgccgggggctactgtcggtgacatgggaccgggggtatcttgactagaggtttggggcagctgcagtcacccacgtggcctgaccccctcgggaggggtcgggcccgagggtgatgtggccgcccctccctctgtcttcccgaggggtcgggccgctcccgtttcggccccgagggctggggcgccccgaccccctgtgggtttggcgccacgtgtgtgggttaggtgagcacagcggcgctcacctaaccgcgtttattgcgggttggacgagcgccccacgccacatttaatgcagcgcagcacactcgttcggtccgtgacaggtcacagtgtgtgaccggtcacagaccggtcagatcgcgggttaggtggcaacaggcggcctgacacacgcctcgccccgtcccgtcggaatgatgagagcctccaggcactcgtccctagccggagccggcgtgggaactcctggagttggcacgtcagccccggccagatacattccaggcttcatcgcaaccattgcaaggaagtcattgtatgaagaagggcagacgtgtagcatgctgaactgacacgtggtggacaagaatgaccggtctgtgactggtctgacgccggtcgcgtcatcggcagacaaccgtgctcccacgatgcattttgctccggtggagtggaagtaggtatgacccatctcgtgggatggtcatttggaaagcagccatggtaaatctcc

SEQ ID NO: 48891 - DNA, 26635 bp, Oryza sativa
cccctctccttctccccctcttccctataaatatcccccctcccccattctctccactccatctccctcttcggctcccctctcccctctccactgcgccgccgttcccgtgccgctgcgccgccgttcccgtgccgccgcgccgccgttcccgtgccgccgcgccgccgttcccgtgccgccgcgccgccgttcccgtgccgccgcgccgccgttcccgcgccgccgtgccgtcgctcctgtgccaccgtgccgccgcttctgtgccgccgtacgccaccgtcgccaccgccgtcgtcgccgctgctgccgtcgctgagccgccctccttccccctcgcgtccaccgccgccaccgctcgggtaggagggagagccgagagaaagagaggaagaagaaaagaaaccgagggagggagaagccaaggaagagagaaaggagccgggagggagagaagaaagggaaaaagaaagagaggagagaaagaaaagaaaaggaaaagagagaaaaagagaaaaagaaaagggaaaagagaagagaaaagaaaaaggaaagggagaaaaaggaaaaggaaataaataggaaattagagggagtttggggaagtttagaaaatttaaaataattagaatttaattatagattaattatagtcgtagaattgcaaaatttaatataaattatggattattcttggtaatttctataggaaatcaattcgcggtagtaatttagatgtaattaataactaaacaaatagttgaattcttatagattattatagattatttttgggtaatccctataagtaatcgattcacggtagaaattcggatttaatcgctaggaattttagacgtatattatatttaatcgtttagtcatagactaaattaaattgtataatatttctaggatttcgtccaatatttagctcgtaatagaaatttctaacctattatatacaatgctcggggagagtaaattattgacaacgaaataattatacccgcaaagtagtttaaatcgaaattgggtttgccgtagtttgcacatagtaaagttaataaaaaggaatcgactttcgcattcgactttcatttggatttatttggatttttatttgaattctaaccgaattcaaatcaatttttgcacgtaacaatagagcccgagggagttgcggatccaagcgaaggccaagacccgcaagactttgagcaaggcaagtcatcactattccttgaacatgttgatcctaattgcaaaattgttttgtttacaaataaaattgcatgcaatgatgaacatcctacttgtgattatgccatgccttgattattgctaacccttaaatctttgtaaccatgtttacgtatgagtccctagtcaactatgacaattgcttagaaatgctactctagaatcatgcatactcatatttatcaaatgctatatgcttggggcaattacctttgggaaggtaattgagatgcggcatgtggagacataagcgccacattgccattatgttgatgacatgatttgtgaaaggagaaataaaatttaacaattgttttcgactggggcggacggaggatttgggtggtatctggaaaaggctagtaccgtccccggtcaattaaggaccgagccatgaagttaagcatgaaacgacccccgtacaaccgtacttctcgaatgggtatagacctagcggattagatagccgagcggaggcagtatccctgcatagatggttcacctctgagtgaggcaggtgcgctacattgggacagccgttgaggtagggccgagaggcgtgccctccatcggtgtcgccattggtaggactgccatgagtgtgtaagagagagaacttaacttgaaccataatttaatatgtgtgtgagacttctctttcccgggagcgccagaactcctctcactgctagaaacatggacgcctagagtgcatgaggatttaagttcatggagcgggtactgccaatgcgaggttatcaaaaagctttgccgtgacgcgtctcatgtgttgggacgaggctcatgtgttgggcagtcgcggagtgcgggtaaagtgtacatccactgcagtgtgagtaaaccaaatctattcgaatagccgtgctcgcggttattgagcaccgggacatgtattatacttagctagactctaaattctttaacttgtgtgggatgggatattgcatgatgatttttatgctgatggagccacttcctgagaggcgggaatgtggacgtcctcagaaaaccataacgattcaatggcgggaagctatccttgggatcacaatggatggtggacagaaccgtcattgtttaatatgaacactggtattaaaacgtgatcaatctatgctaggtcttaggcttgtgaaaagaattacaaaatttgctttgcgcaaaagaaccatagccatcctttgaattcctctgtcatgtgcatcattgctgtggtggcttgctgagtacggttggtactcatccttgcaaatataaaatttatcagaagcggaagatgaagcctcggaggatccctatgcctactatcaggagggagatgaagacgaaggcgtccagtaggtcttagtacggtcgttgcctgtggcaatggcatgccgctgcctgaattccgctgccttatctatttctgcttttggatgtattccggaccgctcggtccgatgatttaagactatgcctgcgggcctataatgtaataattcgtattagacactcgtgtatgtgcacttggtattccagctatgaatccgtgtgtaccaaactacttgatccagggaaatggtactgtttacacgattgattcctgttataaaaacgggggtctacacgccggtcgcgtcatcggcagacaaccgtgctcccacgatgcatctgcctccggtggagtggaggtaggtatgacccatctcgtcggatggtcatttggaaagcagccatggcaaatctccgcccattaatgagggagtaacaggagatccccggtgtcaggcgagagacggcgctgagcctcactcaaggacaagttgtgatttagtttccaggcgaaggtgcaagccaagttttggtcaaaaaagggtaggtccccacccaacaagaaaagtaggtagaattggtgaatgtagtatccccttgagatataaaaggaggaccttgcccaccaaagagaaagaaaaaaaaaaagaaaaaaaaggaggcgagaggggttctggagcctgaactctctggctctcggctctctgtaaatccttcacacacagatccaccagaacacaggagtagggtattacgcttctcagcggcccgaacctgtctacatcgcccgtgtctcgtgcacttgctctctcgcgaacattctccagatcgatcgagggcgaagaacctcacttagcgcccccggccgaaccggcaaaggggggcctgcgcggtctcccggtgaggagccccacgctccgtcagtgctatataacttgcaattggctgatttttactgttggaaagtagccgatagagttaaatctcgttattaatttagattatattgtatatctactatctcttagagattttcatcatcttgcctagatcttatacttatctttatgcttaatgctgcatcggttgggttcgatctattaagtaatatccataattataaatatctagtttgttttatgattgtcaatagagatagtgtcggagttccagccgatcttacctgatttagctatttatatctcatatgcttgattgttatgctaaatctgccttttatattaaaatcttattgcattaaagtatattaggcttcttgtttgatatttttttgcttgttttgatatcttagtataaagtggtatcagagtattagccgatacacgctagatctatttggtcagctatgctataaacatctatataatctttgcttcaatgtatgtttcgacttaagtgatttatactgtctctgcatgacgaccgatctatcccaatcacttagtttaaacatatatcgaaggaaagattacatgtcattaatatctacagacgatcgagtagatttagttttatcttattcatttattactgccgatcgattccaacatgacatcggctcgaagataaatgatatgtcatcggcaactagccgatcggctatcatttatggatttaatcgtggttttttttgtctttctttcttgttgattgcaggatcaaatcaactggcacgctcacgaacctaaaagcaagattttggacctacatatgagttaagcagatctccaggccagtgtgtgtttttcacatcaacagaatcttttaagcctaattactccatgatttgacaatgtggcgctacagtaaatatttgctaatgacggattaattaggcttaataaattcatctcgcagtttacaagcagaatatgtaatttgttttgttattaaatctacgtttaatacttcaaatttatgtccgtatattcaatatgacacgccaaaactttttaccctgaacagggccttaccctactcatcactgcactgttctccgtattgggaagcctcagctatggtgacaccatcctcaatgagaggaggaggaggatgaacctaggccagcacaccatgtttcaaccttaaattaccaaatctggttgcacgaaaatataagcgtaaagataacatcaataaacatgatattaaggtttgtgccaaacatttgatgacatcaagtgcaagtgcaacggagacagcaaggcaatgagaaattgagaagtctagtattttgctagttgcttactagtataccttactctctttctgaacttttctttaaaatgttctataaaagtttattttaaaaatcatattaattcaatttaaaatattttaagctaatacttaattaatcatgtgctaatctgccactccgttttgcatgtcgagaggaagaattttcaacactcaaaagaacacaacctaattctctccacgctttcctgtgctctttctcggttattaatattttctcaatcctataatttttttaaaaaaaaacaggcatttaaaactatccgctaaggatttaactcaatactaaaatggaaatataatccattctaaacatagaattcgagcagaggcctttcaataatcttgagcatagcctggctagcgagtccataaacagtcactgacaagtgggccccaagtagagcgtggccacgaccaaagctctgctccccccttccagcccgtctccaaccagccgcctcccccccaacgccaaccacccgcacacgcaaaatcccccaactccagcaacaaccaaaaagtcgccgtcgccgtcgcctctcctcgccgtcgccgcccatccccccccccctctcgctttcccctcccctcccctccaccgaccagccgccatcccgacctgctccctgccgcggcggtctctcgacgaccgtttccgtccctacttgctcatggtggtggccgcgccgtgctcgtcgtgagggggatgatgcgccgccgcgcgacgatcggggccatggggccctccgcagccgcgctgagggccgccgccgtggtggggctggttgtggcggtcgggctcgcgctcccgccgctggccgcggcgctgcggccgctcagggagcgcgtcgcgtccgcaggggccgcctcctcctccggatcgtggggcgatgaggtgaggacaccgaggcgcgattgggaggtttcctccccacaccatttctgtcgcgggggtttaggcgaattcggtcccgacggggtagtgcaattgaagagaagaggccggggggagttggggagagatatatgctttgctctgcgctaaatttggtactccatgggtttaatttcgtagagggcttattttggtgccttgtttccttgcagtacaaacaattcgatggaaacagataactagtgttgaatttggaaaggtactgcaaaaccaaaatcggcgtctaggtttacaagtcaaattaggctattctgttcttggtaggcaccttgaattggatatgctggcatcccaactgactgtacgtttgtacctacatagacaccaggtgtagttggagtaagagtctactaggcgtctataagcccttgggaatatgaagaaggggcactcgaacagctcgcacttcaagtggtttctttcatttctaacttggttgttatctgatcatgcccttgagcttgtctgtttatcacttttatctacaactacgaattctacttgtatgtctgcagttgagcttattactcattatctctatctttatgtgcttctgcagcatgcattcttcaagagggatgagaatgagataagtccgtactcatggaatatcacagggacatataaaggtaacttctgggtcatagttacacttacacactcgatgttctacctgcttctttagctgaacatttgtatcactacagcatgtgctatagtgatatgttgtctttcgcttgccatacattttattgccgctgcatgtgtttggatgatctactgttgtaggtattccaggaattaagtatgtgctatttgctcttggaatattatttgaaacatgggaactgccctctattccctggagttcagtactgtacctgcattttaggtgctggaatgatttaattttagtgctaccaatttttctttcgaagattataagttaatgatatgctattcaaaccatatgatataatttgatcatgccttatcttctttgcacttacttcttttgtttcatgatattccttgtgcctaatattaattcactgctgttgcttgcttgtcataatgcttagagctttcttggatcttaggttaggacgttcagccccaaattgaaatgtttgatactttgattttcctgctgtgtatctagttagtaacaggagtcttttaacaatttgtggtagattttctattatgggtccatatctatgctttaagatagttactgtggccaaaaagtggaataacatatgtgcttttgaaaatccacctcgtcactgcttgccaatcctagcaactgtggtctttccttcctgtccaaacagttgtatcatacaccatgtctatacttgtgtgcgtttgagtgttacacacattgttctcttaaatataattgtaaatataaataaagtgcacatatgacgcctttttttaaaaaaaaaaatagttaccttatgttgtgctagtgctatgcataggataccgttgcttcattacagtgttaatgtgcttcatgaaataacatcaccaatttgttgttcaggaagttggaactttgctggttccacaaatggttcttctaggtttcttgagtttacaaaattgaagggcgatgcggttttggaactattaagtacaccgacaaagataagcggggtgcactatgttcaggtaatgcagttccccaccccaccaggtacatgaggccattctagtttactttcatttataagtccagttgagctgatgtcacatcctggcctcccacacccttcaaatagtccctgttgagccattcctacattggtgtaactcctttatccctgtagcctaaacttaattctttcccccgcccccttcatctcaatcaacttgaagcttgtaatcccacctttttgggactttttgaagagatttaatttcaggtgggctgatcacagtttttcgtggagtcataaaataataataaaaaagaagttacacagtcctttgcatgtccgatacaatttttgtggtcatcatgatcattttcttcttcattcgtggctcctctgttcactcttttaccttgggatggcagggatctgttacattccatgatgttctagacaatgctcatgatcgtggagttgctcagataaggttagaaggcgtgtacatatggccttttcggcaacttcggatggttgcaaacaggtgcatatttaattttattttctttgtactaaggagctttattatacggttttatgttatgccttcctgcttctggattatattatgttctgttaattttgtacaagagaactatattattaatatgttctattgccaagcactccaataaacctgcattatgttacttaatgcaagcttagctactattacaaattcattcaaattccttggttatcctgacagatacttttttttttctgttagctagtgctaatgtttaattgtggtgtcacattgatttatattaattacaacgagggcgacattacatcacctttttgtagggtggcatatttatttgtttttggtgtcagttctgttttggagtattctgtagtggcacatgtaaatcttgtccttctaccatatgatctaatgcatatgtactatactgtccagtggtgcagatggcgagccacttcaagaagaggattacttcttatcaaatccatatcatttggtaagaagcatagttcttttttctttattgacttttcacagaatgtcttccagtagtttcctcttaccaaatgccaccatccagttttccttgtgtactttctctttagatatgcatgtagtcccatgacatttacattcattatgatagtaaaagaaccccactctttaagctaatgtacacgcctatgacaatgcacttgctaaatttgtatcagctgcggattttctcctctcaagtgttccaagaaacctctgaagagaagaaccggaggaagaattgtaagattttgacttgtacattgaatactacctacaacctcatgtggttttgatatgcgtgacctcttccttatcagctcttacttacgacatggagaagcattgtagcgtcgaaatagctgctaaggtggtccgtgtgtcctctaacctaaatggtattgaatttctttgtgaaattcttaaactcatttctcattggttagtttgttgtgcatcaccaaaagctgcatgctcatatttcaagttttcagtttgtgattgcctttcctttcattcttcaatgacatctaaacagcgtctgtaaatgcttcttttcaactagagggagagcatgagaaataccgtttggagggattgatggagagtacagcagtggatgatgatggagagtgtttctcaccgatcttattaaatgcaacatcattgaatgttgaagtttattacaacaaagcagtcaattatacactgatggtcacttttgtatcctttgtgactcttcaactttctttgttctgattttttattggtatgtactgtactctatgtgaattccttaattgagtataccagatctccttcctccaagttttgttactgattagacaaatggaacatagcaacacccaatctgtatgtattcattttccttttcagaatatgtcagtacaatttggacctcttgcttttcataacctcaaagattccagttttgaggtagtttatatcattttgcagggagctgccaaggtttcaattctaatgatagggcaacaagctatcatggatgcatatctttgtctactgcatctgactgctgggatattggttggtgagtcttttgaatcctaaaatatcagatgtcttttttgtctattattttctgataagtgccaactgctagtatcacccactctttctttgctggtaaaagttgggtccttgtgccacttgttctgacatatgctgttgctatgttccaacttgcatgaagttcaagtgtttctgagcaattagctgtaaaataaaatgtcttccagtagtaatgcgaaaataattatgttcattgattttttttctctattaaatttaaattccactttgattaatggttattccatttacaatggtattttctgttgaagtcttgaagggttgaatagcaatgcaatataatggcaatctgagccaaacacaaaatgaacatgttatggttacatatgctacttatcaaatagagatcgtggataaaaatgatccaccgttgaacctgctactgatcaccagttaaataccatcaacataccccaagattgggcccagcatgcatgcatggtctgaatttgccaacccactcaaacaagtcctgtaatttcactaatttgtaaacccctaggccattaatctgaaatgctgttagtcacaatattaactaagtggaaacctttaagcttttcgtgcggcctgatgcttataatgttttaaattctgcatatcttcaaaatttattggtggtattaacattttaattgcttgtttgaattatctacagagtctctctttaacgcattcgcaacggctgctttcttcaagtttgtcgtattttctatatttgagatgcgatatctccttgccatatggaaagccagtagaccattgaacagtggagaaggctgggaagtaatgaggagagaattgtctgttctttacagccgcttttgtaagttctccattttcatctggtttctccattgtcttaaaaaccagtcagtaggtcatctcttccagccaacatttattatgcacaagagcatgaatctgcgtaaactttagaactttacatgggcatgtaatctggatcacaagaagattgagttcctagcagtctagcacccatgccgatcattgttcaattagtaagatgtcatgtgctcaccatagttgacttggcaagatagctcctgtgctgaccccatttctcagtcattcttatttatggttctacacatttacctttcatttgaatttatttatgataagtgatacctaatgtgtaagtgagtgggcaaagcacccttatgtgctatttgcctatttgttgaagcctttgagtatgttgttctgttggaaccattaggatgaatatttttgttgcttgttgaaacagcctatttttccattgtagtatcagtatgttggtaagatgtcaaattagttgacactttccacctttacatcagtgtttagcacttttagcttttattttacaaaatataatgttcaatttgcgttgtgttattcagatggcattcttttgggagggatccttctcatgtatgagttgcacaattttctgcgcccacttcttttcctgatgtactccttttgggttcctcaaattgtcacaaatgtcatccgggatacaagaaaacccctgcaccctcagtatattttaggcatgacgatcactcgccttgctattccactgtatatatttggttgccctagcaatttcatgcgcattgagcctgacaagacatggtgcatagctgtgacaatattcatgggtatccaagcggcagtgctcctgctccagcactattttggttcacgctgctttattcctcaccaggtaattactacatggtctttcctaaatcctcatacacagttgatctgttgatctttcctacacgcactctagttgccattcatggcattaaattccatgcctcccaagttttttttttccttctatgcttgctgtattatgcactgtagtacttccattcctcagattggaacaatttgttctacctgtatcacactatcattaataaattgtcatgggtacaattttcagattctccctgagaaatactgctaccacaggaaggtagaggataacacaaatcagcccattgattgtgttatttgcatgactacaatcgaccttacccaaagaacaagtgaatacatggtaattatgaaatcttgttgcctgtgactaactgtgatgtcatagataactttggctgaacgtgtgctgccttctccttcaggtggcaccttgtgagcatatattccactcaggctgtttgcaacgttggatggatatcaagatggagtgcccaacttgcaggcgctccttgccgccagcttagatgagcactactttgtaccatatagttaacaagtaggtagctcagcatattcaaggtattacaaactcaactccttttcccttttatccgtaaaagtggctttatacatctgcagcttgacggtttgtctgtttcgatgcatttttaggtgggaattgaggtgcaataagacgagttgcaaccatgggtggtttctcgaagatagctgtagaaaatctgttacgcttttaatctcaagtgatctctgtgttgtacacaaatcattgtaccaattctcccacggaggaaaaaaaaattttacttatgcagtattctcgctcggcatgctgcgttcttatgtcttcttcagatctgtccttgttttgattatgtaagcattgcacaaaaggtattctcacactgcaaaacgaactacggtgttccaacttctgcgatctgcggtaatgcgccgccacccatgccgttgaggtgtgtgcccctgctgttccggcgtttgttgtcgggtgtgctgtaccccgttgaggtgtgcccatgtttaaacgcaggcagtcgagaccaacacgacgagacaggaatgctgcaattggagaaagaatatgaggcccctttcaaatggaggaaaaataaaggaattgaaatcctacactattcatatctttgattcgtaggaacgagaaaagaaaaaacgtaggaaaccttcctattcctacgattttagaggaaaaacgtaggaaatttaacatctattctaacctcttggaaaattttctctgagtctatctcttggaaaatttcctctgagtctaactctcttatctaattcttgtgttttttctgcggtctaattaaacggttattcctatgtgtgtttccggtattttgtaatcctctgttttatactttatgttaaaatcatgtgtttttcctattcttccgttttttcaaccttgcgattcaatggggccctggaagggaaaaggagagcaaaatgcaagatactgcagtggacgagaggtcacaatgcattgaaatcgaacttattcacaatgcacttcaatcatgtttttctttttctttcgtacactagctaaagacctgtgcgttataaaagaatattataaaagataaaacaaaagcaaaaactttatagcataactagtcgatttaacatataatgcaaagacatccatactaaaatgtgttgctagatcacctctttttatcctctttgtcaatttccctaagccataaagtcggataatacaagattggatgcttataattcatctgtggtagtagatgaatttaaaggttttgtatgtgattcctttaaaatttctagaattagcatttttatggctattcatatgttacggagatctcatgcttatgttctgacatgtaagtttgtggtgttgaagacaaactcggacaccacaaaaatcattctaagtagtaaagataagagcacttcaatttcctatagagattgagaaaatttaatttcaaactggacataaaggatagtccaccttaccagttgcaacagtgccaccgccaattcttttaccccttgccagtagtactatgtgccattggtctcttgtgattaacaatcggaagagaaaaaaaaactctaggtttgcttctctgtgctcatgttgacaagttttactttgaaactagtactatctccgtttctccgttacaaaatataaatatttttaagattgtcacatgtattaagaaaatatgtgtaaatgattggttgaaaaggaaacgtaggtaaaggataatggttacgattcgttgagaagtaagtaggtggagaagtaattttattttaatataaaataccgtgctagaaatagctacttcatttgttccaaaatataacaacttttaaccctctggatttgtcacaaaatgtaacaacttctccaccaacattctcttcctaaccaatcacaaccctctagcattcactttttctacctacctccactactcatccaatcacaaccctccaccattcacttttacctactttcttaataatcgtgttcaactttaaaacgtcttatattttgggacggatggagtatattttggaacgaagatatcaatggagtaacggaacagaagaattactgcaattggccgagtttagtttcaaattttttcttcaaacttttaactttttcatcacattaaaacttttttacacacatgaacttccaacttttccgttacaccgttttaattttaaccaaacttctaattttggtttgaactaaacatgcccttggactctctacgggaaatttcactcacctcaacgaggccactggatctcaatcgatagctggagcatccaataccgctactccagcgtagtggtagggacaaatcgccgcaacaaccgggcgcactttcccactttcggtccccccccccccccccccacccgtcgtcgataccgcccgccgggacggtgcaataaacgttacagtgagctggaaggacatgctgcattgcattgctgcccggctgcccgtgatcttagtttcgcaccgattggctaaggttgatttgctcccgatgatttctccacgaggccgtagtactacgagcagtagctgtgtaccccgacaagatgcaacccttttttttctttttcttttttttcgcgcgcctattcatttgttgggtgaccagattttttctatccttacatttacaactaacggattacaaaagaaaataataaatacatatttacttacacaatatttatattaaaattatagtgcacttacctgtcatatcaactaaatttacaaatgtaattttagttatataggactgtaattctatattttaaagaaaataactaatacatatttacttacacaataatttttatcaaaattacattgcacttacatgtcatatcaactgaatttgcaaatataattgtgttatataaaactgtagttttatattttatttcatcaaaccaaactaacacgcatggttgcatccgttcatattccttatctggttatagtgttggttgtgtgtccaataaaaatgctactaggtggttcgtgcaggcgtgcacggtagggacgcatcacagccgttaaattaagtcatgcccaagcgatccaacggaagcaaattctagtgatttccacaaaaaaaaaaaatctgtcgcgtgatgtttaacaaaatcgttcagaaaaagagaaaaacggccgcgcaatttctggcgacttcgagtttgaggctttgagccaaagctcgcaatattctgggcttctgtcgagtacgagctcgaatcgaatagctcgccaggggcagggcagctggttgcctggttcttgtccagggcgcggtgtcgcctccaccaacggctgcaccgcggttctatcggcaccgtcgtcgtagcccgcatcgacgttggtagtccaacacctcctcctcccaagttgcctcgatctatctacaacaccgaccaccaaacattatctgttctgaaacaccgaccaccaaacaccgacctccctagttgacagcggaagttcggcggcgacccccactcctttcttcctccaaccggcggccttcctccctaggccggacactgacaagctcctctccctctccgtcaagttgctgcgtggtttggaacagggataacgatgggctcaacagcgctgaatggggacgaaaacgaggttagccgcctcctcatcttcttcctctaccaccttgttgtcgaggtcgctagatccactttaggggtggcaacgcatctcgtggtggtggcctcgccgacgaccgccaccacccttgcatgaggtgtgggggtgttgcacggggccacgcctcttccaacacgccactcgcctcatgcctcagctccgccctgacatatgcctgcgtaatttctgatgaaaaacccgtgtctttattttagctccgtggtctttagattgggagcgcggatgtgtgcgtggcgtgaaatctccgacgtgaacggtcgggggtgaacgccatgtaagtatactgtgaatggccttagcccttggtccggacattcattcctgcgcgctgataaccaattcccagatgattattgttatcctctcctcgggtggctcgtgcgtgggtcgggagcacgaacgtgcacggtgcactcctctcactatccctcccgtaccccaactaaaaaatgataaaaggaggttaacctgtgaccacatcatctgcacagctcaagtctccattactaatcataaaagcaccccgtatttgtctgtcgctaatcacgaatattctaatactacactcggttttagctctcgaaatcagagttttcaggcagcttgttgtttctctgcctcgagagaaaagaaaaaaaaagagaaatcttgggagtgccaaagcggaggagaaaggctcgtactttgaaggggagggaggagcgcaatgcagcgcggatctctcggcgtgctgcggctgcggctgtggctgtggctgctcgcggtctccgcatcaaccgctgttcttgcggcggatcctagcaaaggtgagctttcttgcttgattcttgtttgccttttttagctttgaaaagctcagtttcctgggtcttcctgctgaaatgtttgctaaatgcagcccaaaccagcgaccgtttttagtctgtggaatgaaacaatttcgtctacagaatgagaaattcctggctattttaccccttctttccttccctttttggatcttgaaatgcgaatcgtgtcttgggaggatgtaagcggcgaggtgggttcccccagtttgagtttttgggtccaatgctgcatttcttgagtcttggccaaaattaggcgctgttgtttggtttcaatcaagcaaatttgtgggaatatccttctatttttaagcatttcttgtattttgggggcactgcattgttcacggaaaaaaaagattgattttgaccccttctgagatactactacttatgatatttctgttcccttatcgagttcatccattttggagttcatccattttgggagtactactcccaaggagtccagttttctttgcgagttcgcatgtgctatttgatagtttccattttgctaggacaaatcttgctcaagctatgactgaataggaagtaggaactactcccatttctgtatatttgtactttcacggtttaatgaactcagataatatttgctgtagttgcttgattgattgttcttgtctagcatgacatagctgtgtgccgtaattcaagtatcttgttttcagagccattcaccatccgcataagctgtgggagttttgatgatatccggacagctcctaccaacacattgtggtacagagactttggttatactggtggcagatttgcaaatgctacacggccgagcttcataattcctccgctgaaaacgctccggcatttccctctgtctgatggtcctgaaaattgctactacatcaacaatgttcccaatgggcactatcaagttaggcttttctttgctcttgtggctgatcctaatcttgacagcgagccgattttcgatgtttccgtcgagggtactctatttagttctttgctgttgggttggagcagtgaggatgagaagacatttgcagaagctttggtttttgtccaggactcaagcctgtcaatttgcttccacagcactggtcatggtgatccatcgatactttctatcgaagttctccaaatagatgacaatgcctataaatttggtccttcatgggggaaaggtacaatacttagaactgccaaaaggttgacatgtggttctggcaaaccagcattcgacgaagatctaaatggtattcactggggtggggacagattctggttaggggtgaaaactttgtcttccagttctgacgaccagccgatatcaactgagaacgttatagcagaaacattacttgcaccaaatttttatcctcaaagcatctaccagtctgctattgtgggtactgacaggcaaccaagcctatcctttgaaatggatgttactccaaacaggaattattctgtgtggcttcactttgcagagattgagaatggaataactgcggaagaggaaagggtgtttgatgtacttatcaatggggatactgcattcaaggatattgatataattcgcatggcaggagaacgttttactgcccttgttctgaataaaactattgttgtcactgggacaacactaacaattgtcttgcagcctcttaaaggaacacgtgccactattagtgctattgaggtctttgagatcattctggccgaaaagaaaactttaactcaagaaggttggtgcttgataccctacaaattactttccttttgtttcaagcaaatagcaaactatggtagtggcttttttgaacattgtactgactttattttgactactgagcctttttgtgtcaaattgcgtatgaaacttttagtcccatttccatcttgtagatgattgaggccaccttagcttttcatgatgtatattgatcgatgaaaaatgtactgccaaataaagtagcttttactgaatgcaaaaaatgtattgatgtcttttttcaaagaacagaaaatgacacgcgaatcaccagagtttgctgcttatgtaatgattttcctgttttaatgctttatagtgagcgcattgcgtactgtgaagggttcgcttggtcttcctcttcgattgggctggaacggtgacccctgtgttcctcaacaacatccatggagtggagttgaatgccagtttgatgatatcaaaggccattgggtcattgatgggctgtatgttctctatatcacaaaaatcaatatttatctttattattagcttgctagaaatgccacactgattttttattcgttcaaataacataaatagaaggattccgcacggtctattttctcatttattaaatttcagtaacatgaaactaatacataataataaggtatgttctagtaagcaatattgcatacaattgcccaaccaaaaaaaaggaaggtctgaaggactaataataggacaaaatatgagaccgtgaacatatagtagttaactaaaagatagtgccaaatgacatcacttgtgaaattccacatgtattcaattatcaggtgaagattgttgcaagcatactattgctagtagttctacaacagctatcacctaatcttattgtacaataaatttaaaatgctctagaatttgattttacaatgccatgctgtcatatattcttttcagacaattattgattgtcatgtgattttcccatggatttcctaatgaactgctggtaaaccattgattcgaacaccaatcttttcatagtttggttttagtgttgtaaaagttgtgttttgatgaactaggggcttatccacaatttttggtttctgacatgcatttcaatttcaatagttatccatcaacaggaaatctttttctatcgcaagcatttaaacttaattcctgaacatgcagaggtcttgacaaccaaggtttgagaggatttataccttctgacatatctaagctacaacatctacaaagcatgtaagttggtatctaatagagacgatctgatttcatttttttgaggagcactagtatgctttgctagatcttatgataagtgcagtatctgaaaccttcacattataacagcattaattaaggactgctggaaagtattcaaaacctataaagctgtaacattgcaatggatgcattgacctacacacctgtgcaacatatatgactgttggaaagtggtcatgtccagtatcatctgaaaatctaatatgaatatgggatttttgtgaaatctaaatgacatgttctaactgccattgccataagaaagttttgcccctcttctagtctgacacaagtacaatcccattttgtcaaacagaaacttgagtggtaatagcataaagggcaacattcctgtcaccttgggtactatatcagggctgcaagtgctgtaagtgcacctcaactatattttactattatgtttcccttgattatttcaagaacattcataatatgttctcttgattaaagaaagagtatgtaaaatgtatttgtattctttgtgtttgagcttcttaaggcttgatgccaaatgttcttggaggtaacaataagggaaatttatttgtttggtcaaagcgtacctttttggtgataacacatgacctcagaatgggatattgcaatggttagatcttggcaccttgcatcatgtgcctaaaattaccgatatccctgctcctttatttttattgtgaatattcatccagcttattgcctgttctctgctgacatggaactcaaaagtgaattgtatttcatttccttatactcctgagattgaaactgcagttggaagctaatgattcagttaaatatcatttcttgattaatcctatctctgtcaaatccgcactactcttagaccaaatttaagttatatcgggaaagagcagcagttttttgtataatactaacttgataattatgtttgcagagatctgtcgtacaacgaacttaatggttctattccagatagccttggtcagctggcatcgttacagatactgtgaggacatttattatgcattttgttttgtttgggacatgctttatgcttctccctgttatcttaaaagaatagctctcatgcaggaatctgaatggcaattatctttctggaagggtaccagccagccttggaggaagacctctacacagagctagatttaagtaagcactctcttttcattttgtcactatatgtaacctggtttcaatttgccacatcctccatatacgtaatcacacataccaatctagatacatctggctggtaattgctgttaatagaagattgaatgataacaagttaagtagcttatgattgctgaatgctgatatggcagcttcacggacaatgctggactttgtggaattcccggtttacatgaatgcggcccgcatttatctgtggctgcaaagattggtatggcttttggggtactggtagctatcctatttctagttgtatttgcggcatgctggtggaagagaagacagaacattcgccgtgcgcagaaattagctgcaggtaagaagcaatcataagttgttaaaatctgaatgcagggtgtacgccttttctgaatataaaggactgattgcccatttcccccttatattactgcagcaagggaagctccttatgcaaagtctcgaacacaatttacacgggacatgcaaatggcgaagcatcaccgcccacatgaaagctctcggagcggcaacgatgaaagcactccacatttgcttccttcctagttaattgttagctatggtgatttgttgtttgctcagttgattctgctatcaggttgagttgcaaaacaaattgtacatactaggtcatgtatggtgtatagacactcgtttttggctccaacgtttatggtacaggagcattatcagttgagagaaaggaatgatccagatcaggttgtcctattgcttctgaattctgatggaccaggtggtgtactgactgaattgcaacatcttatgcttgtgcaaattagcagccagattatctcctgtactacttttaagtttgccaaatgtaaattcaggggagcacctatttactgttatataaacctgaaatctcacctggtctgtcaatctgtaaatgttgtttttttttagtttcaattgacagtaatttatttcgagtggcatactgaaaatgtgttccagaacttatacatccctgcggaacagaaaagcaacagaaggtatgcagaaccaaacactgaaaaacaagcatattactcccagtagcacaggcctgctgcatatcagcatcacatatttttatcccatcctactgatctcatgatctcatcaggatgttttttttttttacttatctttcatacctcatagaccgtgtccacaccagccatgtgtgtgtgtgtgtgtatattacacacacacacatacatacatacatatatgtgtgtgttgtgtgtgtatatatatatataagctcgccgccggcgaatcaccgggagacacctgggatgttaacccattggaggtgcaggatgatctcgccggtatcggtgttcctgagcttgaggacgatgtcctgggacaccttgccgtccttccatgtgatgtggctctccgccgcgaagcagttctcctccttgtccgggtggatcgtcttcatcaccgcgccgtcgccgagatggctgtggtcctgcttggcgatctcgacgaagtccaggatgccgaactccgcgtcgcccatgctgtcgtccttggtgaaggtgtccttgtcaaacacttcctgcgtgcaggttgatgtttcagaagggaccagaggtggcaaccaaatgcttagaagtaggcttatacaagaatcagtgcaaatttcatatattatttaacatgaaaactaccgttaaatcaaaataaacgtttgagatttgtccgcgttactctaagtaaaacttttactcccggatttaacaacgagggaatgttttaccgggagtaaaagttttacttaagatgacgtgaacaaatctcatatgccaattttttttatccaacgatagttttcaggtttacgttacattttgcactacatattttcccaacttgtaatgaaacacttgatatcttgaaggaagaagcactgaagtagtgacgaaccgagaacggaaattatcaagggtctaatcatactccctcagttctaaatataaggcataaccacacacttaacccaacgagcaagaaataattattatcaacttctagttcacgtaatgtaaataaatataatgtatgcacccaataaatcaagagatcttgagggtgaaggagagtaggtgctagctagttacatgcatatacgtatgttttatcttataaaacaattttaaaaaatagttttacgttatattatgaaatagagagagtaattaagtatctaacttatgaattgatatacttaattaatataatatacattattaaaattggataattatttatctgggtcctatgacctcgagaaggataacgtaggaacaccactggctggctgaaggtactaaaatgtgagtggaaatgctgatgaacttacaattttaacaggcagcatcatgtttgtgattgataacgtgagttcctcgttccattctgggttgatggaatgatatcttatacttgacttgactttctgcacatcgcacgaatagattagcagaaatgtcaacaaagaagcatcattgaggataaggaagacaagaataagtagcctgaatttacaccatttcactatataaaacgaattgtcgtaaccagtaacatcatacaaaacgaactatttgaaaaaaaaatttctacttggttttcctatcaataataagtactacatctatctacgacctctctatctctttactaatactccctccgtcctaaaaaaactcaagctcatactacgacgtgacacatcctagtataatgaatctagacgtactctatgtccaaattcgttgtgtcacatcctagtactaggttgtctttttttgggacggagggagtatgagatattgtagagttttgcctgtctcatcaaccgcttttcatttaaattttttaacatcttactcccaacaagtctctcacgtccaaccatccaaactccttttcttctcaatctggcttagttcttttcagcaattccaaacgacaacttcattgttttcacgaacacactactgaacttatatagaaacttatttaaaaaattaaataaatatattttctaagtttatcatacactaaagagctttctcattttgcgcgtggttggatatctcatcctagaatcacaaaggaacgggacctttatctctacaaaataacctagaatccatttacacgtaacgtagaataaaaacaggggtggagccaccgcccggctaccctggacggttgcccaggctcatcagtgaaaatgctattaaatttgtatgttgttgttgaataagttgatgaaatatttatagcaaatactagttacagtgaaatttgtttgggctcaaaaatatttctggctctgcaacactgaataaagaaaggaacttggaaattaaatgatgctcttctatattcgagggtccctgatttcttaatctgttttagcttcgccattactccgaattagctgcttcaattccgcgttggccggaaatggtgtgactgatacaacgatcagtaagtacgtactactacacgtacatatatacaggtcgattgattaccggccttaatggagagcttgtgaatcaatcccatcagggctacgtataccgctcgctcgatccaaattaatcgaaacaaaagcatgcatgtgcgatcaggatcgattaaaaaccgagacgatcgacgacattacgacaaccaatcaaaaggtaattaaggtggcactcgcctagaagagcatatgcatgaacaaggaggatccaaggaaggaaaggagaagatcgatcgatcgatcgatcagcaaacctgggagccgtggcggaggacgacgtaggggtcgctgctgtgggtgagcgggtcgcagatggccaggttgaggccccgcatgacgcgcaccttgagcaagccaagcaggcactccatcgatcgatcgaacgagatcgtctctccgggctgatcagcctcctctcgcggccgcgcgcgtcgaccttattaccggagttaaagctgaaggaagaggaggaggaggagacgacgggcgacagaaagaaacggcaggaaggcaggcttaggcaacgcaaaacttgggcgccgtggaggaagatggagaagctggacgccaacgccgggcagccagccaaaggctttttatattttcattaactacacggatgcatcatgcatatgcatgatatttctgaaaccgctccaatccacctccacgcgccggtaacgctaccaaatttaggtaatactacttgtaggaacgatctgagtgctcagattataagggtatattaggcctggttcatttggcaaaaatttttgcttctgtgtgtcatatcggatatacggacacatatttgaagtattaaacgtagtctaataacaaaacaataaattatagattccatcagtaaaccgcgagacgagtttattaagcctaattaatccgtcattagtaaatgtttactgtaccacaacattatcaaatcatagcgtaattaggcttaaaagattcgtctcgcaatttacacgcaatatgtgtaattgactttttttttgtctacatttaatactccatgcatgtgtccaaacattcgatgtgaaatttgttttaggaactaaacagggccttagcactctctccgtcccaaaaatgaacatttttggacttcgacacagtattcaggatgctattttgaccaataataactataaaataagatgttttaaataaaaagagttatacattatgatagtttgtttaatgataaatttagtaacatcaattttacatgattgatcctttttttctattaatagttaaagttaaaaatatctgactggacaccatacttaaaaatgcttatattatactccctccgttttttaatagatgacgccgttgactttttctcacatgtttgatcattcgtcttattcaaaattttatgcaaatgtataagatataaatcacacttaaagtactatgagtgataaaacaactcataacaaaataaattataattacgtaaattttttaaataagacgaatggtcaaacatgtgagaaaaaataaatgacgtcatctattaaaaaacggaggtagtaggatggagggagtacttagttactaactctatagttaggggtaattttgagaatcaccgtcgctacccgttcacccggccatggcggccgctgttccacccagtgatcactgccctcgctctcgtagttccgtcgccgttcttcccagccatccttgcccaggttcgatgccgtcatattcgtcctgcggcacaagctctagtaaaccacgatggcctagctagattatgctaacagtaaagaggatcgtgaaagacgtttttgatggattttgttcggcttttcatgatttaccgtggtaagcgaaacctaattcccgatatccgtccgactgttagctttctgccatgctaaggaggacattgacgaagcgttcatttgtcctcctccctgacggcgatatcggcggccggccggccgtgcagtgcagggcagggaagggcagggcgtctcgtgcgagcctgcgttgcggcgactcgtcaaaacatgtcttccctccgtttcaaaatgtttgacaccgttgactttttagcacgtgtttgaccgttcgtcttatttaaaaaaattttgtgaaatatgtaaaactatatgtgtacatg

SEQ ID NO: 48892 - DNA, 9987 bp, Oryza sativa
tcaaacattttgaaacggagggagtataatataaggagttttaaatcaaacatgggtatttattaaatatgttgacaagactaaatggagaaatattgtggttgattaagaagaaaatgtataaaggaaatttcaatagtgaaaagttatgcctggttaataagagaatgtaggtggatgaattgttattttttaaaaaataatttttaaagatttaaagttgttatattttagaagggatgaagtaaacaactgcatgcattttgttccacagacgacaggatcacaggaacatttccgtcggatcagtgaaatgaagaatgcgtcaaaaacaatttagcgaaaacggatggtgggcctcgctgagccaaaatcttagcccggcctacagaggccagcaatgttgggccgagacgcagaaccgatgattttgttctcttctactctttttttatcactactatagaaatggacattcaaatcgatactataaataccaaaaatgatataacatttatagtgttttttccacccacgcgctcaccagcgagagagccatcacaaaaaaccggcatctttctctccaaatagatgccggtttttaaattgaacttgcacctatttttcctgtcaaagaaagatgccggttttaaaatttagacttacaattttttttgacttttggcttagtaactttgactgagaagagaccgagagcttgttcgggtggcaagcgtcgccggtgggcacgctgcccacgagcattcgaaccccaggttcgacgctcgtgctcgcccgagggatttttcccctctttcccaggactgactttggttggtcctggctaggtaatagggtacacacgcgtgcgtgttcagtgggactgcacgttttccgtgcactgaggcctagtgcctctaatctcattcctagcgtgtgttagggacgtgcacacgtgtgtgtgcgtgtgtcgtggtgagtgtggtgtgtgtaagtgtgcgttatgagttgtacccttctaaaaaaactttcactgatgatatacatgcaaatttcagatttaggaatggctttggacttagttattttacactaaggaaggtttagacttataatttttgactgaggcatttactctttttttttttacatttctatgtgttgatatatatgtgaacgtggatgtggatggggttgtggatttgatgaaaaattcagatgtggctacgaatgtgaatgaatttgtgtgaatgtgaatgaatgtggctgtatactaatgaatggatgtgatttgagacaaattatgttacatgtgatttgtatatgaaattggaaggtcctgctatttttatttttttattgtcaacataagggtgccggtctacttgccacatgtccagttcagtcaaaaactggcacctatatgctatttataggtgctggttttcgtaagaactggcacctacactacaccagttgcggttttggtcaacagctaaaatgatctacactcacgtctaaagaactgcagatatgcaatagtcttgtcgtgggtgattacatatggataccggttcttggatgaaaactggcacctatatatttttagtcatcagtgtcggctattagatgctggtttgataaatctggcatataagaattttctcaactgccaccaatgagggttcttttagtaatgtatactcattttagttgagtttagtcccacgttggtaattgatgatgggggagcacgacttaaaaaagtggatgccgtccttacctatcagactattcttttggtttgtgtaggcccggaatctaaagttgtgggtccggttgggcctgtggtggagcaggcccaatgtgacctgggtgacccacagttggtgggctgggctgcgtactctaacaagtggtatcagttcccaaggtttggaacccgaaacaatttttatgggtcacatggtgggaaggccgggtaacaagtcttcggggtcacatgggttgatgtgacgggggagattattgggtttagtcccacatcggtaattgatgatggatgagcacgacttaaaaggtgggggtagtcctcacccatcagactgttttttgggttatgtaggcttaggaccttaagttgtggctctggtttggcctatgggggagaatgcccaatgtgacctggatggcccacggttcgtgggccgggctgcacactttaacaagtttcctcttaatcatgtagcaatgtaaattatcatttttcataaatgagatggaaggtagagttggctctaccttcttatgtgtgaaaaaaaaatatttcaggtcttttctcattgtttgcttgttagtttatcaaccacagtaaaaacttaaattttggagttctttcatcgtaatctattttacagcattaacttcccataactttttttttcaatagttttctacagcttttcaaccataaaccattagagttggccattctcaactctcataaaattttggtatcagagttgtgtgcaattaaaggtggatgaattcaatttagctgatcgatcgaccgcgccttcatactctcagacacggctctgctttgagaaagcggagctaacactttcacgtggctagctagctagcttacagtacaccatgcagcctggaaaatattagcacatcaagttaccccatatatcttggacgatatgcaagtgtcggacggaaagcaccatcacgcaaacaagctggagtaagaaacgaaccggtgctattccccttcagtcttgacgttcaattagcagacatgctgtgttcgattacagaggttgggaacacatgctctgtacacgaaaaacggagtggtctattagtacgtgattaattaagtattagctaatttttttttcaaaaatagattaatatgattttcttcaagcaactttcgtatataaactttttttaaaaaaaaacaccgtttagcaatttaaaaaacgtgcgcgcggaatacgagggagaggggttgggaacccagtgatctaaacacagcacacaagcatcaatccttgcctgaactaggactcaaagcaaacatttatgtagctatagctagctactagctactatggatcaaacgttaacgtgtgttgtctctctctatatatacacatatgtttatatgcatgcttgtgatatccggccattgctgcaagaagactacgagcaagcagtatagctagctaggaagctagcgtcgttgttgcccggccggcgccggagaagaaggagaaggagaaggcggaggtaggtcgagatcaatggcggaggcgatcgtggggccgctggtggggaggctgcaggagctggcgctggggcaggcgcgggcgctggtgggggtgaacgccgacatccagaagctcaaggacaagctcatgtggctgcaggccttcctccgggaggccgacgccaagcgccgcgccgtctccgacgaggtcaccaaggtgtgggtgctgcagacgcgggacgccgtcttcgacgccgaggacgcgctcgaccattactatctccagttggacaagtccaggtatgtcacattattagtactactgtatactacctctatttttttaagtaacatttgattatttgttttactaaaatcttttagtatgaatatgtaaaagtataagttattaaggttatagtttttcaatgataaaataagtcacaagacaacaaagtaaataacatttatattctttttaaaaaagacgaatagtcgtacgttacatgaatacattaaaaaccagagagcgtttcaaaatactaataacgttctagttttatcataagtcaaacattttcatctttataattgttaatttttaaaatttcatatagtttaacaatgtttgagttatatattatggaagtatttcctatagtgaattaaaaatataaatcttatgatgttaaactatatgaatttatcaaaattgatggctaaaaaaatgaaatgatggacttagcactacttaaaaaactattttcctgtaagagatcttatgatttttacaaacggaccgcgtaagttgccgtgtctggaaaaatcgagcggtattttcgcatatggctccttaagacggccgtatggaaaaatcgatttttttccatgcgggctcttaagagatctgcatgcaaaaaataaactcattttgtgaaaataaaatttgaaactagtttatctcactcatttgaattccgaattggatgattcattttcctaaatgttactaaaatcatgctctatcatattatcgtgttcttactgctattattttggccttttttttattgtgactttgttttatcaattaaaaatttgaattttaaaacttcaaaaaatattttgaagtagtaaataatttcaggtgaaaaaaatcatgaacataaaattgtagaactcatcaagacgtacaacttttattttgatcatttcttcatccaacaatgtgattataacattgttcacaaaatttacatatcttatctcttatagtttataaaaccaaatgagagatatgtaaattttgtgaacaatgttactatcactttgtcggatgaagaaatgactgaaataaaaggtatagatcttgatgagttatacaactttgttgttgatgactttttcagttgaaatcatttagtatttaaaaattttgtttgaagttatcatattttcaaattcaaattcaaactattcgaacaaagtcatacagaaaaatgaccaaaacaaaagttgtagatcttgataagttatacaactttgttgttgacaatttttctatttgaaatcatttactacccgaaaaattatttgaatttcttatgttttaaaattcaaattttatatagttcaatcaaacttggatgaagaaataaccaaaagcaaattggtagatctcaatgagttctacaactttgtttttgataacttttttcacatgagttcatttattattataaaattcgattcaaactttaaaaagccacatgatttttgcatgcggatggataagtgatctgcactgcatgcaaaaatatcacccatatttttttcatgagagaatccactcaataccactgagtttatcgcacttctacaatctaccactcactttgtcaagttcaataatataccatcgtgttttctttacctctattgtgtgccctcgccgtccatgagctgttagctgacatccttttgctgtattgaattttatcttaatgactaaaataccctttgactaaaaccaccagtacccaccagcttcaatgtgcactagtagtttgaacggatcatggtgaggacaacgatgctgccgaggaaaccccccgcaatggagaatgtgggcgtcgacttcccgacggatgttctggtggtcatcctatcgcagctcccgacgagctccttgtgacggtgccggctcgtgtgccggcggtggcgcgacaccgtcgacaagcgcacgctggagcgtgacgtccggaccaagatgctcaccttcgtcaagggcctcgacaatgaggcgtccgcctacatcgtcgacgaggcacgaggccgtcacaggtgcgtgtggaccagctcctgctccgtcgacatgatcggcacccgcaacggcctcatctgcgtcctggacggcgacacgggcgccgtcacggtggccaacccagcgacgcgcgtcgcagtccatgccgccgccgccgtgacaggcgtggctcttgccgtgctccccagacgcgtgcacgtcccgtgctacttcaacaagtctggcacgttcgatgccatgtaggtgtacgccctcggcggcagcgcaccgctgtcatggcagagtgtgcctaccgtaggtgccagcggccgtttccagccgggaggggtcgcctgcgtcgatggcgtggcgtactggatcaccgccggaatgcagctggttgtggccaggtcgtcactgggtactgagtggagacgggtggccggcgcatcaatggggattccggcgaccggtggcgcgtcgattgggattctagagaccggcgggcggcggcacgtcgatttggagttgggcggtcgacagcgcgtcgttggggagtcgggctgccggtggcgcgattgggagtcggcgccgcctcgctgggaagagaggaagagaatgatttaggggagagattgatttgctagggttttcacttttcagtcaacaaggatgaataaattagccaaagggtattttagtcattaagagaaaattcaatacagcaaacggatgccaactaacggcgcatggacggcgagggcacacaagagaggttaaagaaaacacgatggtatattattgaacttgacaaagtgagtggtagattgtagaagtacgataaacttagtggtactgagtggattctctcttttttcatctccctccactgtcttaatagtacgacattcctaaactcaaatgtaaataggaggagaattataccaataggaatgtcttctttccatctttctttcattgtcttaagggatgccaatgccgaaaccgtttcaccatatattctttagatgattgatgcggttacttgtagcttcaaatggcctcgcacggtccatcatgacaaagccttcactcgcccttgatcaccggatttggttcttcggtgccaagccccttgcttgcccttgaccgccgcatggtccatcgtaaccaagcatcgcttgcccttcaccgtcttgccatagtagccacttcgtatcccatatcttcaatatcttcactttgtcatcattggcatctttaggtgtaatgagatcacttgagcaacaatacctttgcaatccttgggacctatttctctcattcaactcaataaaattattatatgaataaataatgagtactaatcaacaccacaagtgtcatatactcgaatgtatactcaaatgtaaagatcccaattaaataaaagtgaatcacttggatcaagtacatgcataactaaggtatagtatttactccccctaaatgtatgcatacgaaatatttgtgtgaagcaagagtatgtataacaagatatgaaacattgagagcttatcctatacaagaatagaagacatttatcaaatatagacattaaaataaaaacataccttcatcatctccatgttctcaatgtaaagagactaaacaagatatggctcaaacaaaacattagtctcacatgcttatgtaatcacatgaaaatatcaatatgtgaacagagagaaagagtgatacatggcttgatctctattcatttcatctttgtgatttaggtccaccatcaatgaacgtttctatctcaacttatatgatgtctgggaatcacttctcacatattccgttttcatatccatatgagactagtagacaaagaaatgcttataattaacaatattagtctcatgtaattggatttatcattaatcaccaaaaccaaattaatggcacataaactttcacaaactccaattgtactaaatttggactccctccaaatttaaacttctcatcctatacgcatacaatatctccatcgtatgccatatggaatctccaacaaccacatgcattgatctttagcctaagcatcctgcaagatactccgattgtcaggacatcatcttctcccaagttaactcctgatccatctccggtaactctctctctcgaggcgtcaagactcacctacacatgaatctaacacaaaaccatatccgaatacaagttctctccaacttgactcaacattagcatacaacagtattacatatgcatagaaatcatctagaagtcataaacatgaattatccacgagtatccaaataaataacccgaaaccgaaaccgatacagagttggtcagtcaaaccgcgggctgaccagtctgaccgcgcacataacatcggtctgaccggtcccgtcagacaaaaatccctgtttaccacttgaaaacattgttcacaatcatcccagtctgaccggtgccaaaaccacttcctcaataatctccatatatcaaaacaaataatctcagatgtcaattgttcatcaggaaataagaatcaaacacactttgattttacacttgcaaccacaaagtttagccaataagtagatgtgagtctcaaaagtttaatgaaacattcatatcttaattagggtaaactttggcaacaaaatcagccatctttgttttaccaataagttccatagaatatttttccttaagttttagtacaactatagtttagtttagctttgtatgtatttatatgatacttatacatatgcttttggtctatctagattataaatttttttattttagcaactattacttagtggggatttgcgtcgaaagtagagatcaattgtcagtactggtctaatggtctaaaaaaaggatcaaccacttgattaatagatgatctaataatgaataatgcttctatgcttcaacaaagttgaatatatggtcttgttttgagatatctgctcttgatggtctagttttaaaaaaaaattgctctaatagttttatgtacatgtattcaggtacccattgtggattcgtcccaccgcaaaacttgtcacgacctttacaacacaggcacacattcgacacaagctgtctaggaaaataaaagcaatcaattcaaggcttgaggacatcattgaaaacaaacataaatacaagatcgaggaggcaaacacgaagacaactaggacatggaaagcttctacatcaatatcttacacccataaaaaattgtaagtagacagaagtaccttttgcaatatttatctacatgtattagatctctagtattatttggatttggttctttgattattcttctgtagaaataaaggcttagctattccaacttcaagtttcaaaattgtggaactttatcttttagttacattaaaatcagaaacatggagttcaatagaaaacacttgaattccaagattaagtttgagaataaaaaaaaatcaaattattggacttcaaatataaatattttaaatctcatttagcaaatggtattcctgtgttggtgctttttctgaccaacatgggttcacctaaaaatttacggtgttaacagggtcgccagccacctcggagtagaaaagctcttaacaaagatgggtttagaaaagaataaaactaactagcggaactgattcagagatcaaaccaacgtctaggctgatttagatcgatttgaaaataacaaccagtctcatgggtgaaacggaaggtttacgaggcaaaccttcaaagggtattgcactctcgcagcgaaggcggatgatatatggcgcaaatcgacaaagatggatgaaactataggataaagtaaaaatacatggctgagaagtaaatgtaaaagaacgattcgatggatggtggtcaggggtttagaatcgaaccatccattgcccttatgaagaggttggtcttgtctccgtagggccttctccacatcctattaggcttagagaataatttggactatagaaaccttggaacaaaataaggaaactaataacccacaaattgggctcgaagtcgaatctgctggtatgaccggccacataccgtcggtcaaattgggcccacaccatcggtctaatcaaccctatggcagggctcaaaccagcttcatatggcaaaccgggtcttttctatatatggctgtgttttcttattttcaatgtttggtgtctaatttaggtgttaacacttttatagggagtttttcgtaatgtaggaattaatctaaaccccactatcaagtttatctagaagcactactcaacttatatagtggacataattaacacttcatcttttgaaaccattcatttctacagttacatct

SEQ ID NO: 48893 - DNA, 7642 bp, Oryza sativa
tattttaaactaaaataagacttgtataaaataaaatagaaaagtataaaaaatatcaatagggattgaattaaattaattagagagactctaataaatttgtaaaaaatagttattacttttcaaaaattggaacaaccattgtatgttccattgccataaccatgtttaagtgcttagatattaatggtcttccatctatcctataccctggaattatgagtttctccaattattgcatatataagatatactaaggtagcaagatgtagaagtacgtagttggttaaaaagttatatatatgctactattaacattatatttagaactcatgttgactaggtatattttaaaaaaataaattataaatcacatatataacagtgaaacgaggtgtacaatatatatctcctatgtatttattgaaacactctttctagaaaataaagaagattattgataattgcttatagtaatgaattaaatattatatagttcaaaacttacaaatatcttgtaaaaaaattatctaagcaatgtccacgaagaaaattttcaaagaaatagtacttttcaaacatagcaggtgtcatctcattgatattccaccttacaagttactcaagcgtaacttacattacattctcgtgcgaatgcgtgggctaccttcctagttgtttacatggccaacaggttagcccaattttccaagccaaccaacaatacccttatgtgtttgttttcaagctaacttcttaaaaaaaagattggctgaattcgttattaggccaattccgtcctagtttgcatgacctggtaaaatcacactaggttgttagctagtctagttttcattccttttttaggggtgggagagggggggggttgattggggtagaaattaaacccattttcatacttaggctatgttcgtaacttggggttgggaacccatctcctccacatggaaaaggaagcagtccattagcacatgattaattaagtattagctaattttttttacaaatgaattaatttgattttttaagcaactttcgtattgaaactttttgcaaaaaacaaaccgtttagtagtttgaaaagcgtacgcgcgaaaaacgagggagaggggttgggaacccagagcaccgaacacagccttaggggtaaacaaaacacctactataatacatcaagtggttgtagactttttcctttaaggaacccacgaggctctacacctaatagtttcatgttttcagatctctttgaaatatttgaaaggtacaaagagatactgctacttacaagtcagaaggcaaagaaaaaaattaactcttttagtgaactacatttgtggcacaactaggatatagttatcacttattaaaattatacgtactattactgataataacggtatacttatgatttgaccacagggaatatttgcatgagtcagacgtgccgattcatgtggaagagcgaaaaaaactagagaaagtccttcttactacacctgaagatctacatggcaaagaacacaatccagtcataatctctgtgtttggaaaaagtggtgttggcaagacaactcttgtgagaaaaatatttaaagaaataggtaagcagaagcagttcgacattccagccatggagtgttttgcaccttacctatccgctaccaatatcttacaacaaattgttcaacaactaacaacagacaaccaggattgccctagaaataaggtcctcgaaattttagaaaagaaattaaaagaaaaaaagtatttgttggtgatagatggtgaagttagtggtactgaactgaacaacattttgagtacactcccgattggtcatgcgggtagtagaatagttcatatcacagaaagtaagccagaggagccacctagcaactatcatcatgtcaccattgagttgaaaacaattgacaaaagtatatccaagaagatgttcctacaccatatggaagtacaaaatctagaccttgaaaaccatgaggatgatattatttttcagattactggagggttaccacttgcaattgctcttttatcaggtcttatgaaaaccaaggagtccactggtgagtggcagaaggtattcgaatatcttaagtccaagcaatcaaaacaaattgatgatatgctctcaatttgctttgatgatcttccacatgagctgaaatgttgcttcctgtatcttgctgcatttccagccaatgttaccattgaggcacgcaacctagtgtctatgtgggtagctgagggatttctaaggtcaaaagttggcaagtcaatggaggacattggctacttctacttgaaagagttgtcggctaggaatctagtcagtctggttcaaatggacgatgattccaatgttagcaatatgactgttaccatccaaaacaaagtccatgaatttttgcagtttgaagcacatgaggcaagcttcctagaggtacatagtggtgatgatatccccacattgacaagtgctcgtcgtctctccttgcagaattacactgataaatatgctgttctagcaaatccattgccgaagctacgatccatcttctcccagtttgagcaagagcctaaagaggaattggagaccatgacaaaaagcatccaagcatatgtatgttgttcccctcaacaaggtactatagcttctatgcagaagaagaatatcaaatctcacataaaagaactattgcatggatctgagttcctccgtgttatcaatatacaaggcattgagataggtaacaggttgacacgtgcaataggcaaagccgttcacctccaataccttggaatcacttcttgctcacttgaaaacatcccatcatccataggaaatcttacaagccttcaaacattggatgtaagggaaactaaagtccggaagctcccaaaggcattttggatgatcaagacactaaggcatgtgtttggttttatcctcaaattacccaagcaaactgtcaatttgaagcagctacatacacttgattccatagaacttgaagattttgagcaaggcttggataatacacttggagagatgatccatcttgagggcttagttatttggaaaatctcaaatggtaatgtcaaagctctgttaagtgctctaagaaagcttgagagccttaagactctaaacttacaaggtaacaatattacatcaagtgtattcaccaccttgttcttgcgtcgcctcaagtttatggttctagacggggagttggacttttcatctgatcaactgaataatgggttagccctccctaatctgactatgcttacattgaaggaaacaaaagtaactcaggagtttattaacaagctagcaaagcttccctctcttgtcacacttgcgttgtgtctaggatcctacaaggatcaggaacttgtcttcttttctaataaatttcgatgtctacagaagctcaaggttgacgtggagaaattgaagaaagtagaaataaagttgagtatgcttcccaaactcaaaaaattagaaatccagacacatgacagtcatcactatcaagagcatgaagtaactcatcaggaacacgaacagaagacagtgatctcttggaaaaaggaaaatgctattcaagttgaatgatgaagcccctctgatgagatgtcacttctcccactatgcatggctagactccgttatctgttatgacatgcttgttctttcttgtgtttccgcctatacctctctaattaatatatccatagtgttgtctatgtatggattgattataatatttgtctaacccaggtgcggtcagtgttgtcgtgtgtatatatagtaagcttgtgtaataatgtggtaaaaactgtgatgattactctgcctcaagttcatgcataattatacttagctaatgtgggttactaaaacaacaattgaaagttgtacggctagtcccttaagcataccaagaatgtaaaaatgccatgtgtgttcttttagctgagcgagcgtgaacaacggcgtcgtcaagcattggctttgcttctctttactatgcgctacccaaaatttggtcatgtagagacataaaaattaaaaacaaaatactccttttctcctcaaaacagagagaaaagatgtatagtatttctaatgcttctaacatcaaatttatagtattggcccaaatgcccatgctgcaagcgcaacgacaaacacacccatcaatgcttagtctgatgagttaagtctagcggcaccgcctcacaccctagcccgcaccatatctacatgacgacaatcagcaaaacgcctcaacaatggagggcagatctcatccaattgatctcgttcatttgtgctgcactgcaggatggatgcacgaatgcacgtgatcgattggtcaaggtgccatcaaggagatgggggcaagcatacgtgacatgacccgacgacgtacgacagtcggctggttcactaagagaggctatctgcaatgatgccaagcgtaagcggacaaaatggaaccagatttaaaactattttatcacaaaactacagattttataactttaaatagataatagtactatgatctaactctagaatatatagttctttgataacttcatcattaaatctgtattgttgtgatacatatttttaaatctgtagttttatgatcatttgagccaagtatctatattttgtgaaatttactcttttatctacgtacaatcatcattggtatacaatagatttacatttagattgatatataaagccttatcatttaacaaaatagtcctgtaataaataaatgtattatcagtctcttcagcacctgcatggaggacaagttgattctgccttcagcacagcacccgtagagcagctgacgaaacggaatatttgttggtcccacttggcattgggccacccatgcccacaaatccatgacgctgggccttccccattcctcgtgggcccaagcacagagcagtttgggccttacaagcaggcccgccacaaactttcgtttttggcctgcctaacttagcagtagtaggtccccctgacacgacgagctgacgtctcggtgcacctgatcgtgttgccgccgcagccgtcgcgttgccatgacacagcgtgcggtggcggccatggagatggagctcctccgcctgcaggcagctgctcgccggcgagatgaactgcgcgacgcggtccatgagctccacggcgctggggcgcgccggccggtacaggtggaagcagtggtcctcgccctccgactccaccagcgtcacctcgcgcccgccgccgcgaagctgggcggcgtaccggcggccgcgctcactcaggacgtccttctcggcgacggcgaccagcgcgcggcggcatggaagcgacgacacgtcctcggcgggggggtcgatccgcgggtcgtcgttgccggcggcgccgcccgtcacgtacggccagagcgcgtccagcctgcccggcgcgagcatcggcggctcatcgtcgcgccagccggccgccgccgcctcctccgacggcagccaccgcgcgccccagaagcatggctgcagcagcgccacgccctcgatgtcgacgtcgtcgccgtcggggccggcggcccgcgcggccacgttgtgcgcgatggtggcgccggcgctctcgccggcgaggaacagccgcgtggggtccgcgtagcgcgccacccaggggtcggcgagcgacgccgcccaccggagcgcggcccacccgtcggcgaacgccgcgggcaaggggtgctccggcgcgaggcggtactccacggagacgacgagcgccccggcgcgcgccgccagcgacgccgcgtaccggtggaacagccgcccgaacgcgctccccgtgacgaaggcgccgccgtggaagtatagaaccaacggaagcctcctcccttcgccgccgccgccgggaaggaacagacgcgccgacgcgccggtatcctcgtcgacgaccacgtccctcgtcgcgacgccgtccctagtagccggccgcaccgccgccgacgtcgccgtgccgtcgtcgtgggacgccgccacggcggcggtgctgcgcacgagccgctcaatgtggccgccctcgtacacgcgcaggaacgggtagaggtcgacggcgacacggccgccgccgccgccgccaatggccggagatgatctaggcgccatgcatgcacgttacgtcgcacgaatatgcttgcgaaagctgcatgcaaagtgtgctacttatactgtgctgcggtggtgggcttaccgggtcgtctaaatgttcaacgagtcatgcgtgccaatgtgcgcgtcagccgtggcgcacacagtcgggggctcaaatcacatactttcttgcctacaaaatttcgagaagttttttgaggggaaaatctcgagaagttcaaagcagccatcggttgcaaacaagatagcagcagagagtttggaatttgatgagtatcaacacttcacgagcgtagaattctaaacgcatgcatgcataccgtcaattttacgaacaaaaaaggttaaaaagaatgtcgcagcttgggcctaaaagttattttctatccaaaccatcgagcgatatgcatgcatccttttctgcaggaacatgcgtgtacaagttacaagcaaaggaatttacaagttaattttagcctgtgaaagaagggccgactgatttcaaaaagaggggtaaaaacaaaagcgattgaacaagctttcaaagtgtcaatttccatcaaatgtggatatattatgagagatagagttattgcccgaatccatggggatatgagtatatgacctaatcttgacatgtcttctaatttaagttatctataagctcactacatattatcatgaggtaaaataatatacttttcccccatcttgttatatacctttctcttcttcatttactctcttctctgttccataaaagcatagtattcttctctgttttcccctgttctctcctcctatgtatatatgcatagacacaaatatggcatgacataaacaaaagctataagcgatttacacggcatcatgaaatgataagaatatacaatgcactactgcaccagaaacgcccttgttgatgattctttattgcgacagcatatagggctcctagaataatgcgatatatatctcgcaccaggtaaatccttaacccttcctcctcttactaatactacgtaatgttcttgtaaactatcgacaataccaggtatataagcagtgattttaaacctagaagttaatcgtactctagcaactttacgtaagagcatgtacaaatataaagttcaatattggtttgttagttaatatatatcacttagaaaccatcctcatacaatagtgagacaataagatctcttaactattattacaccaaaatattttttttacccttatttccttttcttcttcccctgcaacaatttttttttaataaatgttaagagtcgactctgaaccgttgcatagaaacgacggttcccttttcaccccccccccaactactagaaaaagtattttcgcaggcggacaaaagtga

SEQ ID NO: 48894 - DNA, 38648 bp, Oryza sativa
  unsure (1)..(38648): unsure at all n locations
aacaaaaaaaaatcacggcggcggcttcactgacaccgccatgcgcctcaccgccgctgccctccgccggccggatctgggaggggaggggaggggaccgccgccccgtatccgtgccgccggcctccccctccctcctccggccggatctgggaggagggaggggagcccccgccgccgccccgcgcgtcgtcgtcgccgccgccccgacccgtcgtcgtcgtcgccgcctccgccggcctccccgctccctcctccggccagatctgggagggagggggaggggagccgccgccgcagctccgcgtgtcgtcgtcgccgctgccgccggcctcccccctccctcctccggccagatctgggagggagggggaggggagccgccgccgccaccccgacccgtcgtcgtcgacaccgtcgccgccctcgcctgcctcctccctccctcctccggtcagccgtacgccacgccgccagccggacaccgcgccgccccgccgccttccacgccaccccgcgccgtggccgccgtcgctccccctccgacggccggggagaggaggaagggtgaggggaggggagaggaggcggcgtgaggggagaggaggaggcgtgaggtgtgggaagagaggccggccgtgggtggagactggagacttagaaaaaatcaacacttccccaagtctatttatagtgaagtctattttcgcaagcggaccactgcgaaaatagattttcgcagacggaccgaccatttcaccccgatttatatttttgtagacggtcatttggctttaagagtcatgtccgcctgcgaaaatgagacccctacgttaatatgccttttctagtagtgccccccccccctccctcatttctatcttccacgtcatcaaatttgcatgcatgtcaaccgagagagcccgttaataaacgtggttgtacaagccctaagctagccagctattttcatctactgccttcgtccataaaagatatatttcttgtccaagtatatggctaaaaacaagatcggcaaggagaaagtgcgtattgaaaaaataaaatctattgaataagtccctacatgggcggaatcttgccttcttccatatagcaggctttcctaacttggggaaattttcaagagagacttaaatataattaagtttaaattaaacacaagaatatattgttcctaagagcatgctggtagttaacagtaagccgccgggcacagtgacagtactgcaggcatcttgacgacgttgatgcgccaacgttttacttttctcccaataatttggtcaagatcgatattattcggcgttcactttgctcctaataattggtcaatagataattcatgcccgttgaacaaatcaggtccatgccaagtgcttcagccgcctactcttaattagtaccgtatacgaactcatataaaacctagcaaaagctgttgtaagcaaatgtctcaacaaaatccactagtacatatccttatatatgtgacggcctctaacatgcctggaaatagcgggccgtcacaagaaagtcatctcaattaggccgaaaaagtgcccgattgagatatggtcgcacagacatattacaagggcataaaacttaagtccgtcacggatgacacctatcagtgacgggccgtagtttaggcccgatagagataacgttccatatctcaaacgggcctaaagttagggcccgtcatagatgaccatcatccgtgacgggcaccaactttaggcccgattgagataacattccatatctcaaacgggccttaaattgaggtccgtcacagatgaccatcatccgtgacgtgcaccaacttgaggcccgtcacagatgactcatcagtgacgggctatatactaatccccggttgacacgacttaatctctatcgggcattaactaaagcccgtcaccgatgagtatttttccatttttcatatgaaatgtttatatttgtaagttgaactatagcaaaataattagcttgtagtacaataattcaatttatgagtcaaaataattttacgtgtagtaaatgatatcaaatggaaaagtcatcaacaacaaagttgtatagctcaactcatcaagatctataacttttattttagtcatttttctatataacaatttttgaacagtttgaatttgaatttaaaaatatgacaacttcaaacaatattttcaaatactaaatgatttcaactaaataagttatcaacaacaaagttgaataactcatcaaaatttataacttttattttggtcatttttctatataacattttttgaaccgtttgaatttgaatttaaaaatatgacaacttcaaacaacattttcaaacattaaatgattttaaactgaaaaaagttatcaacaacaaagttgaataactcatcaagatttaaaacttttattttggttatttcttcatctgataaaatgttagtaacattgttcacaaatttacatatatgtgttatagtttataaaaccagataagagatatgtcaattttgtgaacaatgttactatcactttatcagatgaagaaatgaccaaaataaaagtttatatcttgatgagttattcaactttgttgttgataactttttcagttgaaatcatttagtatttgaaaatgttgtttgaagttatcatattttcaaattcaaattcaaacggttcaaaaaatattatatagaaaaatgaccaaaataaaagttatagatcttgatgagttatacaactttgttgttgatgactttttcagttgaagtcgttcactaacaaaaaattatgtttgaatttctcaaactttgaatttcaaatttcaaattgtttaaatagagtcggatggagaaatgaccaaaataaaaattttgcacctcgatgagctctacaactttggttttggtgacttttccatttgaaatcatttattaaccctaatttttgttcaaagttgttaaattttgaaaattcaaaatttgaattgttcaaatgaaacttacttgtacaaaggaccgatacaatagttgtagatctcggtgagttatacaattttgttgtttaggatttttgatggttgtgtatgtgaatgaatgtatatgaatgagggatgttggggtgtgacatcttggcctagggcttaataggattaatagaatactcatagcaacaagttacaactactcttccggaagccaactttgatgttaagcgtgtttggcctgtagcaatttcgggatgggtgactgatcgggaagttcttctcaggtgcacacgagtaaggacaaaaaagattggcctgagagagaggctagacggcatgcctaaaaataaaatttatttttttggagattatactcatctgtgacgggcattaacttagacccgattgagaggactcatctatgatgggcattaacttaggcccgattgagataggtcatccgtgacgggctatagtttaactgatcgtctgggtcaaaagctattggtgacgggctttaattatggcccgattgagataggttcatctgtgacggccgtttgcctgattgagataacttttcacatcagtgacttctagcctgtgacggacgccatgcccgattgagatgggggttgccgcccgattgagatgatggtatccgttctagtgatcccaaattatccatgtcgtcctaactattggcaatgtacaaacttgtgggatggatacagtctagtcgaatagcttacgaaattctcatgtcgatgcgaaaatttgtttcactgcatcctaaattaaacttctataaattggacaagttcataaaaaaagcattatttaattaaaaaagtattatattcaatgatgggtttaacaaaaactaatttggtgtagtactatatttttctataactagtgtgaccatcaactatatttatacaattaagcatgagaaatataaaacattaccaaacaatacctcggatgaatggaagatctataagatattcaagctcatttttggaatccagttcggtcttaagaaacatcactggcttcaaataaacctagcgtcttcatgccaacttcaatttaggtgatcttggatttgttgaaatgcttacattgtcacctttcatatgcatatggcctcatatcaaaatctatcctgagtcaacagaaatcatcaaaacaagacaatatagttgcctaacccgaacttaaacttataccttgcgatagactgtacgtcggtccatccttacaagagtgattttttagtttttggatttttctcataaagaacttttgaattaatggaggatatagtagatttttttagcccattgctagcttgatatatgtctttgattttctaaaatatttttctttttttaagaaaaaacggaggcagtatactagcctatagctactacaactcacaaatctgaacacacaactgtatcggcagccaaattaatagtgaactcggccggcgagccagtcgatcgagcggcacacgtatggtcgtgagttgctagcctcatgagcgtccacccaccgcgccgctattggcttggtcattcatgcatgcaagcatgctgcatgagaaacaaaacgcatattcacctgcacctaacattgactgctagctagctgctgccggcgccttgacgccacaaaacagatattatcatcataatcgttactcccttcgtttcataatgttagtcattataacatttttcacatttatattaatgttaatgaatctagatagatatatatatgtatagattcattaacatcaatatgaatatggaaaatactaaaataacttacattgtgtaacggaggaagtatgacattatcatcagcaatatatctccgcagatatatacatcaaatcattatcatccggctacgctagctgtatatataaacgtttgaatttgaccggtgcaaagtcagacatgttcacgtgccaaatagtactccttttgttcgatattataacaagtcattttaattttttttcctattcaaacatatttagatgatcaaactcataaaaaaaattagcaaaaaacatctacttccgcgccgccaacaccaaccacctcaccgccctcatgggcaggttcaagcgtacgtacatgcctataagcatgcacgccacccggctttacataaacgtttttttctgtacgatagccactataggtactataggtgttgtaggtggatcttaactgatcgcgtctgcaaaaatcgatcttcattttcatatacggctacataaaagacctacatcaaaaatctattttcacaggtgtgcatataaaagtgagcatattttctcatgtggtgttttaagaggccacatggaaaaaaaaagattttcgcatgcgggcttcttcaatgatccgcatgcgaaataacccctcttctccacagatattttctatgctctctcttttccctttcaccacttcaaattttgtcacgatctctcctctcctctcctctccctctccagctctcctctcctctctctctctccttgtctcctttcctccccctctcttcctctcctgaccgcgctggagtgggcagcgctgacgaggcgggctgggagcgggcgccgccactgccgccgatgaggaggcggctgggagtggcaccccttgcatggatccagtggcagcggtcccttcctgcatagatccggcgctgggggccctcactcgcgtggatcggaaccgacgacgacaacggtggacacggatctggcatggaatatggtgggctcgggcggcagcagcgtcactgccgcatacggatcaagcgccgtcaacgactacggcgggcagtgggggcgagtggatccaacgccggtgacgacggtgggtggtgggggcagaagatccgatggcgatgatgatggtgggtccgacgcggatccagcaggcgacgacggcgggctagggttcagtcgatttgggttatttttattttttcgctgaaattattttcgcatgtggccggtattggtgacataccgtacgtaaaaatatgattttcgcagatcttttggcgcatactattgcactggccgtatgcaaaagtcacttttgggcacctataaaaacgatttctatactagtgtccatcgatcccctctcaaagttccacaatcgtctatgtgttcccgtgaatttcttgcatgtagtggcaatgtgagcgccttcatgcgtggccgtatatatggtccgaaccatatggtcgctagctgcaggtcagaagcaagcacaccacggctgcaccactcgtggatcgaggaaggttctggggttcatcagcgagacgtcgagcagtgcctcctgtactcgttctggccccggcaaaggcaacaagtacgtctgaattccgaaaagtgaaaaattcacggcaaagcccaaagagaaacccccacagatcggtaagcgtctttgggcgcgtggagtatgggccgcagcctgcaaaatcagcgcactccgggtccaactcgttcaccttaattcggccggacgcctgactctaaccggcaggtcgtacgtcgtcctagagcctagcaaaagtaaccaagtccaagttcagacacctcctccggcctccgttgcacggcctactacgagctcgtttatccacgcatagtccagtcgcatgcatggctggtgggctgcctaccgcgcggcgtcactctcaacgggaagatcggcaagtctaatttcaaaggattctttttttgcggggaaagggagatatattactcaacaaagctatccacaccaacaaggtgtgagatacaatcacagctattgtctggccagaaggccgtcaaggactcacttccgcccttgtttgctaggaaatcactaacacaattattctccctgtgaatcttcctaatgataatctccctattcccggacaaggggtctctaacctccttgaccaaaaacgctagctctgatctgtcactgctaccagcgccgacaagcttcaaaagctccaggctgtcagtttccacgataaatggaagcaacgtccactgaagagccataataattccttccctgcacgccagaagttcagcttccagagcgccgccgcatctgctcatgttcccgcagaagatcaaactgcctgcactattacggaggacagcacctattccccctgaaccatatcgagcgtcaaacgacccgtcgacgttcagcttcatccagcccgggtttggtttctcccaatgattaagcaccttcggatcaggcacctgggatgtccccttcatgcagcccaaattcgaaaccacaaattttcctttggcgaaatccgcccgagggaactgcttgatttctcgcaaagatgacacataactgacgataaacctgtgcgagacagacactggtggagcagatttcccatggtatatctcattcctgttgtaccagatgcgccaaagcagcatcaaaaacattgccccttcctcttttgcaatcagccctagctggtcaagaatccacccagagcctgaccaagaagcccccgcttcaaatgagatgtcctttgaactgcgcagagaaagccaaaggttagtcgcgtgagggcagcggcataatgcgtgagctacatcttcctcttccctgccacatatgctacagatggccatcggttctaatctccttgtcttcttattttgcagagtagccagactattagtagctgctttccacgcaaagatcttaaccttttgaggtatgttacagttccaaactaacttccaagccttgctaagatcatgcccagacgagctagagctggagttaacattagccagggaaacagccaaatgataggcactcctaacagagaaaatcccatgtttatcaggatgccatgccacaaaatcagcttcttgagatcgtgagggacgaatcttcagtataatatcagtgtcaatctggttaaaatgttgctggattctttcaagatcccactcaccattatcgttcagaagatcgggaacccatttaatgcggcagttacccttcctggtgatgggtctcctggagaaatccctaggaagccaaggatcacgccaaatgcggatggaatgaccattacccactctccagattatacctttcttcaaaagttcgagaccatattctatccctttccatcctggggaagagttccccccaaaacttgtatctataatcgaaccgttggggaaatacttagcttttaaaactctagcacataagctgttcaggttgtccaagatcctccaagcctgcctggccaacaacgcctgattaaaaagcttgaaatctcgaaaacccatacctccacactgtttcggtttaatcagggtgtcccaagccctccaatgagttttcctttttcctctgtcggcgccccaccaaaagttacggacggcttttgttagttcatcacaaaccgagtccgggatcttgaagatgcccatgacataaactggaatagcctgaaggacagacttaataagaatttctttaccaccaacagaaaggtggttttcaccccatagcagaattctcttccaaactttctcttgtaaactttggaatttgcctttattcattctaccttcgggcgttggaaatcccaaatatttgtcctcaaagccagcgctgcttatattaggtggtatttgggtcaaaggattctttaagcacatacactaaatcataaatcatgtgagaatcctatacatatataaagtttatctccactaagtacagttaatgttatttctctcttctttcgttaagtcacatcatctcaattgtttttgcacctggatgattgatctatagtctaaattgtctccctcatttcttctcctttgtttaatctgtggatgattaatctgtgttaccttgcttcttttctctcgataattgagacgtatcaccttagctttccttttgaatgatcaacctatatatgatttaaattgttataaaccacatcatcttaattatttataacttatttcatggtcgattaaagatgaaagttatataaagcatataaagttatgtcatctagctatcttatatgttatatgttatgtacattactattttacggaactcccatagcaacgctcggagtttcatctagttctataaaattcatataatttcaatttgggataaaaggattttggaggattcttacggtagttaagcattcatgtgaaagttctctaaacaaagcatgcttgaagagttggtagcggcttgtggcttcaaccccataaacccatgtatgactacaacatcaacatgtgaggagaaaaaaaatatagctagcctacacaaatttaaccatattaagcatttgatatgaaaattatattttcaatgcttacaataatatcattatatattgagcattaactaataggggacagtgtgccgcctagggttgtagttgcggggctttgccactgcaccatttttttttcttgattattcgattatgtgctcatcgagcatttgtttgtatgtaaaaatttgcaataggacacttaaaaacttgtggatttcgtcgcaggatatcctaaaattgtaacaccactattgggcaccctaaaaactgatagttagatgtgggataccgcggctgctattttagacaaaatttgttctaaggcatcgtgattttatgattttagctcctgacatataaaaagtcaatatttctcacttaagatatggttatttgttgatggacactagctcactaaaatatacatttatatactattataaaaattgaagatgtttttgctagtactttggtacgtcatccatgtatgagtcggtttttaagttcgttcgattttggaaatacaaatccgtatttaagtcgggttttaagttcgttcgcttttgaaaatacagaagaagtcgtataagatatctctttaaaaaactcgcatactaacttgagatgattggactcctaattgcagctcattattgtctagaaaaatatatatccaagtgaattcccacagtgaattttaccttaactaaaccgtataacaataataatactaaaataaccttcaccagttgcaacgcacggacattttttctagtgtaatgagatatgagaaagaaaccatgtaacatgtcaaaaatgtccttagccccgtttgttagattcttccttctcttcgtggctagcgaaaggggcatcaatggtggcggtacatatgcatgacgaaccactgaatgggtgctgcgggacgtcgattaattccactcagagtgatactaacactactacgaaaaccatctttcatggcggttattttgggttttcactggtggaatttggagctgctacaaagcaaaggctagtgaagatcaagatcttcactagcggttatcaaccgccagcgataattcattttcgctggcggtcgtcttaaccagccaccagcaaaaatccattttcgctggcaattggcttaagacggccgccagcaaaaatgaattatcgctagcggctatgttaaataggccgctagtgaaaatctattttgggccaaaaaatatacccatgcagctacccagccgccagcgaagatgatttggagaaaagctcgttgattcattttcaaaattcaaatccacatctagagatctagattagatgctcacttccaaattcaaacacgaaatacaaaatcatcattagcacatatcaaacatcatttacacagaccaaaacatgtgcatcatctggaacaacaacatgcacaaaaaaaatttcaaatcggagaagaggaagctgggagcacgatgaggacagcgtcacggtcggagaggagggagccgggagcacggggcagcacggtcggagaggagggagacaggagcacggtcgacggcgtcgaggtcggtgccaccctccccgtgatccggtggcggcggatccggcctccccgcccgcgcccgagctccacttcccgttcccgagagccaccgcccgcacccgagctcgccgtcgccttcgtcgcgcagtcctccgttgccggcgctggaggattggagggagagagggagtggagggaggtggaggagagataggataaggacgaggctggtgtgggggcggtgattttatagcgttaaattttatttcgctgacggtgctgtaacttgctgccagcgaaaacccgattttttatgacaggcctcttagcatcgccgctagcaaaaatagaactatttttttggtaggcctcttagcttggctgccagcgaaattttcgctggcggtctgtaactcctcacccctcattatatttttagtgacggtttttgcctattaccaccagcgaaaaattatagggtacacgtcgtagaccttgtagcggttcagcacgcccacctggtgatagaccttgtggagcaggcaaaatattagtggttaaacatcacacagtacgctggaatgaatgatgcagatcgatgctaattgtggtgtggtgtgcaattgagatcatcagtaatggtggtgaatggtgactgacttgtaccggttgacgacgttctacctggggcatcatccgagctcgtttgcggaggctcatggcgacatcgttggggacggcgccgaacatggtgaccaccttggtgagaccggccggagtcaccgaagaggccgggcaatgagtacttttgacctttgatctttggcattgtttccctctgacctgaaaatttatattttgatgttcagcagcaaatagttatattttgagagtttcctaaagatcgatttttatatgtccaaagaggattattctttaatttcatttgttgcagaggtaatgacgttgattcaattcctttccgttgcaaaatataatgagagagagagcagccaagccctggcctgcctagctcagcgtgtgcagggcaatctgatcaccacctcaaccggtcaacatgtattctttaatagctaccaatttaagttgtgatcctttcacataaatttttaaggtggtattaatctattaacattaattgtggaccaatgaaatttattagaaagaaaacgggtctagtctatttattgtaacagaaactaagtagaaattaactttccaaatataacattttttgacgtgaacattccaaatataacatgcatcatgcccacttcacatgtgcagattgcatcgaggaaagctaacgcgcgcgtgcgtatcgtcagcgcgcgattccagagaacgtatctaacccgcgtaaaatctattttcgtttttccttaaccagcgacgcctgaatatggagaagacgtggagtctactacatcggactcgtactacatgcatgcatgccctttttcctctttaaacaaagttttctctcaaattacttatccgatctataatccgattacaccattgtgttcgttacaattaaatcttcacaacaagatcttacatgattatattatgatgaaaaaatatttatatttataaattacttttattatatacataagttacttttatcatatatataagttacttttagatttaactaaattacttcttagacatataaaagtaaattcaataaagtttaaaagtaatttacatatattataatataaaagtaacttaaacggacgtaactttgtcacgatattagaagtaaattcgttgtagggataaaaatatgacttcgtgtcatatgaaaaaaaggcattcattaaagttattttctttttgttataagttacttctataatatatgtaaattacttttaggttttattgaatttacttttatatgtctatgaagtaatttagtgaaatctaaaagtaatttagatatatgataaaagtaatttataatttttcatcaaaatataatcatgtaagatcttgttgtaaagatttaattgcaacgaacacaacggtataatcggattataaatcggataagtaatttaagagaaacttctctaagaagaaaaaatacatagatattgagtgcactagtagctttttttttttggaaagaagagtgtctctctttagcactatccagctagcactctcggtgtagttgtgtccatctaacccgattagtttaggagaacataactaacttgattagtttaggataatgatggtaattaaggaaatattttcctttttcggaatttttttattgtaatagattgaaaataaatctatacatgaaaaaaattttcacgtaaaatttaaaactttcaacttaaaatttgaaactttaaactcattttaaaattttattaactcgaaatttgaactttcgagttagacataaaatattttgacttaagatttaaactttgaagttaaattttgaaattttttaacttgaaatttaaatttataaaacaaaatttgaaaactttcaactcagatttgaaaacttttaaatcaggtttgaaaactttcaactcgagattgaaaactttcaaatccatatttgaaaactttcaactcagatttgaaaactttcaactcaagattgaaaactttcaagtccatatatgaaaactttcaactctgatttgaaaactttcaaattaaaaaaataaaaaagaatgcaaaaaaaatggaaaatgcgctgaggaaaaaacatcgtggaaaaaagagaaaaaatcgcacgaaaagaatagctaaacaaaaaaatccacgtgtagcggtgttgggcgcgcgcgcgccatttccgtatatggcgcgcgcctcttcaatcaatatcgaacttgataaaattagtctcttgtgtcgttttggctttggttcgtatgcaccagatcagataagtttgtgtagtaaaatgagtatttttacaagtctatacactaaggtgcatccacctaacaaattatataccatcaatacaatttaatctatttaatttatcctataatcaaatcaacaatccgtaacaataatcggctcagcaataaatcaaacaaggcctaaaaataggggaaaatattcgtcctgtatttggcccctatcatagacaagaacgtttttgtcacgtcgctaaacagaagagagcatacaaaaaaaaatctattgatagtggcgtttgacagttgagagtaagaacaagtatgcatcgaggacattgtactagactagaggcagctagccgacgcaacgtcttggactggatttcttgatatactacctcgccgttgacttttttaaaaatatttgaccgttcttcttattcaaaaaatttaagtaattgttaattcttattttatcatttgatttattgttaaatatatttttatgtatacatatagttttacacatatcacaaaagtttttaataaaacgaacggtcaaacatgtttaaaaaagtcaacggtgtcaaacatttaagaaaggagggagtatattagccgtcaacttttcttatgtttttaccttttaggacgcgtgcatatatgtatatgcaattcaattagtcacttaagtacatactgacgttacatacatatataattccttgaagtctcgaagcaacttcttgaaatttaatcttattggcacatccagtacagtgtagaaatgtaagctaagtctgcgtttatcatttgaattctttagtactttatatagatgtctacatcacaaggcaaatttagatcaattgtcaagaaatatgaccaattgggttctcgaatttcgactctgacaggagcagcgagtatgtggttttggaaatcctcgctgcattcgtctatgggcacaagccattggttttagaaattccccacagtaacactgcacatataaagctaaccccctttttaaatgctaatatatactgtattaagcttatgatttacattccagttgatcatttccacgcccacgtgcacagaaagctacagcggaacacctgaccagcaggccatgaccagcaccatatgtgtgtgactgagactccagagagaatgttcaaattctcaattctaaatgccaggtggtgtaaaaagttaccgcctttatccacgaacatgtactccctctatcccataaaaaaccaacctagaaccggatgtgtgtcacatccggttctaaattcgtttttttaagggatggaggaagtaggaattttgggattttagtattatctccgtcccaaaatattgtaatctaagatagatcaaatttacgaaagttatctatctagactcgttattttaggataaaacccatcctaagttacaacatttttttgacggatgaagtattttcgtagagattaaaaataaaatggacaaaaagacacacgtaccctcatcaaaattacatgaaggtaagtgggtaaaaggttcaatattttaagatccctaagaaatataggtcaaatttgaacctagatctctatatttgtggacgaaacaggaaattacgagctgaggaacgaaaaacaaactctctctctctctctctctctctatctatctgatcgttaatccttgtcaacagtccttccaaattaaggtcattcagacgtccggtcataaaaaagaggaactaaaactacttttctatcctaattcacgcttcaagctggttaattaataattaaaataacaatttacaaacgaccggattaactgagtcgtgtcccatcccacctgcgcacccagcccggtaatctccaattattctccattctcccccacggtttaagatcattccgttcgccatgttcaacgagcacgtaagaacacacatgtacaccccagctacgtacgtacgctcgctcgctagctgcgagcgatggatcggcacagtataaatagagccccagtttcatcagctttctcaaaccacgcagccacgacacatcgatctcccatctccttgtgcagccgctgatctctatagctagcatcctctgatccattgatcatacaagcacttacctagctaagctagctcgcttgcatttgctatatagtttgaatttgtcacccacagcgtcgacgttcatggcacctgttccggccaccgccgccgccgccgcccctgcggccgtcgtcagcacccacgagatccggcgtgcgcagcgcgccgatggcccggccaccgtgctcgccatcggcacggcgaacccggagacgtgcgtgccgcaggatgagtacgccgacttctacttccgcgtcaccaagagcgagcacctgcctgagctcaagaacaagctcaggagaatctgtaagcattatgcatccatgcatgcacattgtgtatatatgttgttaatttcaaaccatttttcttctctttttcaccttagaaatatatgtagtagtaagaacaagattgaaaaagtatatggatgcacattgcattgggcaaagtgttaattaagcttcaatttccacacaaaaaaaacttccattttactatacaatcaattccaacaaattttagatcgattgactcattgtatatctttgggatggtgcgaactgaaacttatttttttttcaccttgatgcaaaatttaacttgcaatacttcatccggtacaaagtgtaatttagcgcattataattgaataagcaaataacaataattagtgcatttcatgtgtgctaatgtgtggatgtacgtatgtttcaggtaacaagtcaggcatcgagaagcggttcatgttcgtgaacgacgacgtcatggaggcacacccggagttcgccgaccgacacctgacgtcactcgacgccagggtggagatcgtctccaaggtcgtgccggagctcgccgcggccgcctcggcgaaggcgatcgccgagtggggccggccggccaccgacatcacccacctcatcttcagcacctactccggcgtcaaggcgcccggcggcgaccgcctgctggcgtcgctcctcggcctccgccccaccgtgtcgcgcaccgtgctcagcctccacggctgctacggcggcggccgggcgctgcagctcgccaaggagctcgccgagaacaaccgcggcgcgcgcgtcctcgtcgcctgcgccgagtccacgctcatcgcgttctacgggcccgaggtggggtgcaacgacaccatcatcgggcaggcgctgttcggcgacggctcgggcgccgtcatcgtcggcgccgacccggtcggcgccgtcgagcgcccgctgttcgagatggcgttcgcgtcgcaggccaccgtcccggacagcgagggcgccatcaccatgcagcacaagaagggcggcatggactaccacatcggcggcggcgtgccggagatgctcgccggcagcatcgagcggtgcctggccgacgcgttcggcgccatcggcgtcgccgccaggtggagggacctcttctgggccgtccacccgggtggccgaaggatcctggacctcatcgaggaggcgctcgggctggacaacggcgccatggcggcgagccggcaggtgctgcgcgagtacggcaacatgagcggcaccacggtgatcttcgtgctcaacgagctgcgccgccggttcgtcgccgacggcgccgagggagccgactggggcgcgctgatggcgttcgggccgggcgtcaccgttgagaccattttgctccgcgtcggaagcggcctcaagggaaattaaataaacttaagtaaatttaattattttacttatacatgaattgcattctattggaaggtaagtcctataataaaatgtgttgagtcctaccactttgtttgtccgtttgggtcatggacatttttaattagggcatcaagttgagggagtagctctgctaaaaggagagatgtttggaccttaactgggtgttttggaagtgaccttgaacccaaaagtgtggagtagctataatcatggtcatgcatgccatttgttaattactgcttaatgacgatctttgtaatatcaaaagttaaataaataaagatctttgtgcgcagttacagttcgtttacacagcaaaatttcgtgtacttcaacgcaattcatattttgcgaattttgtgcatttctgaatttaaataaaatgcgctaattggatgtttctgattatcaaagttcatactatatatgtccaatttaaaataacactttcctaacttaaactaaatgatcaagctagaatttcttagttttagaatttcgtgcgacacatcagtgtctaaccccacgtggcacatatcagattcaaactaataaaaatagaaactactatgttcgttcaaagaaaaacgaatttactataaatgtgtcgccatatttactataaaaacgaatttaacatatatttacattgtaaatccctaaattacatatgtaattttagtgtatttataatgtaagaccataaattacatatgtaagttctaaaattacatttgatagatttttatctaaaaatctgtcaccatatatttagatagacctaagaaaaaatagaattaatcattttaactagaatgtgaatttatagaggattgtgggtgtatgattttgattgttgcgcatccatagcaattaaaaaccggttcaagagaaacttcaagacatctggtacttaccatgagaaagagtgagtaacagtgttggacttgtataactagctcctcttctaagcacccaaacgagggaaggtgtgatggagtttggttggccctgctttagtggctaagtggtttccgaattcattatgtcacaagagggggtgggtgtgaacggtcaggagtgagttatgcgaagggtcttatcataatcatttgcatggagacgtgtcagatttgtaacatgatggtagattgtgtcttgtggatacagttgtatatctttggccaaagtaaaactattcgaatagctaatccataattatgaggcgatcgacctgcttcagtgcaattagtcccacactttttaattcgcttgacttaataaattagtgtagatcaggtgattcgttgagcttgtccaacatagtgttgtgttgttcaatggagattaatcttactttaatcaattaaccaatttaatgttttaaactataaatgttcataactgtatttatgcaaagagccataaacctccatttactagtgtggcctgctaagtacggtggttgatactcagcctttttataatatcttctttttaaaagtttagtgactaaatgctgaaaatgaagttactggaccaaggcttatatcctacttaaacatgccagtcgagtggagatgtagcttcgtataacgtccgtgtatttcttaaaatatcaatttaaattttatttaagcgtcgctcttttctcccctgttcaaaatctccaaaaatttcaaagttacttttaatcttgcttttattttttcccggccaaaataattttttttctttccatccgaatattttatatattctcggaattttccttctccggagtaatttttccggagccgggagttcgtcctttttttttcctctcaccagcacacgtgcaagcatgcgcgccttctctcttttcctcaccgagagacaagcagactcatcaacctttttcatgcatgcacaagctcttctctcttcctcctctgccaccctttttcgtaaactctctgcaaacccagcggttaggcacagctctgcctcctccttgacagagcttcctgcaatcccagatggtcgttaggcaccgttctgccgtttcacagtgaaaggttggtatcaaaacatgaattcggcaataataaaagaggtagcgtatgagacataaaagtgaatgaatgcggagacaatggatttagaaaggttcatgccctctcaatgacaggtaataccctactcctgtttagagatttgaatccgccgagtatagtatagatatgacgatcatatgtgctcatacctcctagagggcctcctacctaccttatataggatggggggcaggattacaaaataaccttaaccaaatacggtatcggttttctaaatctactttacaatattaacaaaccaggattttatgccgttccataatatagaagaaaacataatacccaaatcatgatctgttatatattccatagatataagttatcctctataataagtcggaataactagtcagataaccatgtcgtgcggctacggcgtattcatagtctccacagttggcacttggcaccgctccgcctcttcggccgagcaaggtaggcggcgtcggcagcagcagagagagctgtggatgaagaagcaagaacagtcacaacaatggcggacgttctcgttgccagactcgcctgcggaatcacaacagagagtataaataccccactgcgccgccttgccgtcaccatgacgccaccaccacgccgcctccctgcccgtgagcctgtgcgccgccacccaccaccgcgcgcgccgcccggccgccgcaccttgccgtgccggcagccgctccgctcggtcgagagagagaagaacgagagagaagagataagaaaggaagagaagaagcatgagaaagaataagagaaaaggaggtgggacacatgggccccacatctccccctctccctttgacccgttgacctgatgccggacccactcagaatattccctgaaatattcctttctgttctttcagtaaaagaaatcctcgtaacttcaaaaatccatatctcttcatccctaactccgtttaactccattcaagtgccaaaatcttctaaaatcctcctctatttaatggcactgtatttttttttgtgttttgttttgtttagcagtagttttatgtattgtttattttctcgcatatagaacccgaggtggatggaggattcgcgcaggagttcgatgctccgtttgttctcgcaggtcaaggcaagcccccttgaccacttcttgcacctatatttttaactaagtattttgtttgccaaattgcatctttaggtcgcattgtttggccacgattcgaatatggattgttgggccttcctagtagtcacacttttattttgtagttgatgacccctttcttcgtagctccactgtatattttcctcggtattcacactgccgaagtagactacctatataggttacgattgtgcgtactagcgtgtgggaaaacttggatactcattattactcatttatttcgaagacctgacgagatgtcagtgtggttacgaagtggagaagtgttttataaaaacttgatgatgcgggagtcagtacctggtcgtttggctacgtattatccataagtatcgtttcctttgagaaattcattcaaacataaaacaatacgaccaaaacatgctggacacctacgttttagctacctgcgatagtgaccgacatgacgctataccggatgtgccccttcgggggtcagaaggtatatttcgagcattctttttttccaaataaaactaatagttttattagtttgtcgcatttcatgctttttcaaatcatgaaatttgactaagttcggggcaaaaggtttcccccgaaccccccttccaaaaggtaaatgaaaggttgagaaacttccatttgatttgggaaggtgtttctcaaccactacttttaggaacaaacaactctaacgactaaaacgggtcttggcaagacccttaacggagaggacttcttcttttaacacgaactccgcgaacggtccccccaaaccccccgcaggggctccagctcgcccttcggggtagaagaacttgttagttgtagttgttccgaagggacaagttgctcccctctgctaaccagaggaagcactttggaaaataaaaacttgatgtatacctccgggcagcagagcagagggaacggagccctcgtcccgaggggatactaattctctttcttaactacttattaatatatgatatagaggaatacctattcctatcagtagatagacaagcatactataagatgctatctgggtagatagcatcatatagtatcaatggatagcagagcctacaatcgggttggagccctccttttggggtcttacccaccctcgagtccaatctcgggtgggcgcttatggcaagtcccattccctagaacttatccgtggatcacctcccctttacccgaatccacaatcggatactaagatttactttttaaagtagcaatctttctagtgttgattttaccaattcaatgtttcagataattgcatctttttttaatcaagtatttttattttataactttcttttttaaaaagtgctttgttaaaaaaacacatgtccctaacaatgacaagtggtgttatagcgctcgctagaaggcatctcgaccctttttgaattgaaggtagaatcatacaaggaccacctcaaactagctaaatagtgaaggcccacaaggggtagttctctctagagaaatgagctagaaccacggcttcctttttttttaaagaaaactgacgcaaggttactttcgtgatagctgaatgcttcaagaaaggccatacaaccaggttaatattgccaaattaggtaaaatggtgccatatttatgacttaaaatgaccagtgaaccttttgttgcaacagcagttgtttcctgagaaaccaatcatccagtacagccacgccggtagggttcgattcccccaagcctagaatctggaatgagggaaggtctcatcttgtcgatagcctagcttagaagtgccataggaacctatctggaaaatcagcccccggggataatgcaaaactctgacttcgaactcgatgttagggacattccctggcaagaaaaggttaaagagttgagcaacaaaagatgagaaggcactggttgtggaccacttttcttgtcgctagcgggaagagcccactggatggattccaaggggatcctatcctgcgatagtgaccaacgcgacactatactggaggtgccccttcgggggttagaaggtatatttcgagtattctttttttccaaataaaactaatagttttattagtttgttgcatttcatgccttttcaaatcatgaaatttgactcagttcagggcaaaaggtttcccccgaacccccttccaaaaggtaaatgaaaggttgagaaacttcgtgggatgccattggccgagcaagtagctaaaacgtaggtgtccagcatgttagcggttgaggagcactggtatggtggtgtatatgccaatctcctgtagtgggaatgtgttggagtccatatggtggggcctgggtagatgagggcctgagcctggcctgatgcttggtggagagattccacccaactgtgggacatgtggtatttatgggttggttatggaaaagccttgtagtgaactcccctttgtcatccatgtctgatccacaagtgatcgtaatgtgaagcgttcactacgtgtgggtaaagcgtgcaacctctgcaaagtttagtcaaactgtttaaacagccgtcccacggtcatgggcatatgtgaggtgtttctcatagtgtagtgtttgttttaaacttattaaattgattcttgggatgggaatcgttaccagagtttgcctttgtggcagacgaccatccttcgtggttgggaacgagcctatgtggttcgggatgccgattggcaccaaggtgtggtttagggctaagaccaccgtggtagagtggctgagatggccgagttgtgttgagatggcacggtgtttgtattttactcattactacagtgacaggtgcaaagcaacctgtggaatggagtgtggtgtgagccttactctgaaactaaaacttgacactctagaggtttgcaactaaattatttaaaaaccttgggttttccaaatgaaactgttccactccttgttttaaccttgcatgtcatatttttccctgacttgctgagtacactgagtacttgcccttgttgatatttatatttatagagttagaagaaggatacctcaacccttctgccgaggcctactttcaggagcaggccaagtacgatttctcatggtttcaagcctagttcccaaacatagcttttggatttatggttgtcatcctgcttttatgctttcgcccacgtgtaccttatctttctagtgtttctacccgtctagggtttgtccatgacggtagtagtttgagacctccaccaatgttgtaataaaactttgttatttctggattccactattattctgtgaatactagcttgtgtatactgggactggtactgtaatcacaggtaatgttgtgacccccagcctatgccggtttatattcttgactggcatagtttggggcgccacaccccgttaggatttagtgcctaattggtaagtatttgtgttttatttatgtttgtatctgcatattaatttttcattttgcatatcttgacttggttcctgcatagagatttaatatacacaaaatgatctaaaattgacttttttttaatatgtcaccggggggtgaaatgcccacctgaaaataatatatatatatatatatatatatatatatatatatatatatatatatatatatatatatatatatatatacacgtcaaacagacttagacagggcaaagcaataactgcgcaagggcaggcaacagagagaatacacggggaaatacaaggaaagagaaacacaagggcaacagaaccaccctaaacacacattgatgttttccatcaacaagatcacatagccaaacacccaaacctaatgctagctccctagcttgacaccatctactccacaagcaacctagaaacaccaagagttgagaaataccgggaggcattctaccacgcacaccggctcggcttttggagatcaaaggttgtggttgtcgaagaccacccgcgtaagccatcaagagtcagatttcatcgtattgcagatttagatcaatgaccaccaacgtccttcgggagaaggaaaccccaaaggagggagagccattgaaggttgcggaaaaggctgcccgcatcaaataatcttcaatccagcattatcaagttgctagccaatttaacgcccaccaacgtctcccgggggaaggaagccccaaaagagggcgagacactgaacgtatgctgtcaaggacaaccaagtaaaggagatgaagactagacatgaagccagacaaaagagatgtggtgaaaggtagcaatcctattagtggaggggaacatcaacgacaatggtggagtcaaaaatcgccaaggaagcccgggaaacaaaccaacttgtagacccaaactatcaatcacacgagcatgccagagagagtagattgaagaaagagggccaaggaaccgcatactcatgatatatggtggatcaagggaaggttatttaggccggacaaggaacaacgaccgaaattaacaccaaccatgagatgaacagggagagacacaggggaacaaaggaggggatgaggcaaaccgaagctggagtaggcaaagggaggagaagaacaggaggagacgaacaccggagtaggcaaagtgtcgaggagtgatactggcggatcggatgtgtagagtattggggtacgttggaacgaggatctacatagtacgacatcgagcagacaaaagacaaggattatactggttcaagccccttatcaggtaatagccctagtccagtttatatcagattgatgatgatgagaacagattacaaagagagtagtcgaaatagatgttactgatgagatcgtaatcgaaggattcgacgagatctcccagcgacttggctccatgtactccggctttgtgaaatttggtggatgtgttcgctctagaattggataccctgaacccctcccagggggtcccttttataccgtggatcatcttgccccccaagaaaggtttgaggataccggacctggtacggtatagcagaaactctatcttttccgagtaggactttggaaatcacctgactcgaaaacatattttctataatttgtaatggtttccatgcgacatttacgggaacaatccgtatatgcgaaggtataccttattggtatattccataagtagcagaataggaggtatgccttatctgtaaccctgacacaaaggtaggagaagagtaagaggagacgcatgtcgaaggacaaatagggagacatcaacggatttccaaatgtgcggccttcaacaaaggaaggacatcgagaacgacatcgccgtcacacaccaaggaaatccagagagggttttcaccccaagacgaagtggtgtagggataagccacgcacaccaccccgtatccagcagagccgacaaaggagcagcggatctgggcgccgccagcctgtcacgccctgaagttcccctccttgctttaaaattcataaaataaatcgtccgaagaaatgatttaatttaacctagagatgaatccctaattaataaatgcaaataataatcggaatcggtatgtggaatttttcttggattctacatgtcaaaatatgctaacaggatttttagtggaattttcagagcccaaaaaataattttaaccaattaaaaatgagcacgtgcaatatttaatcccaggaaaatcccttttcctttcttctttttattttccctctttttcctttgttgggccgtcagcccattcttcccgcgctggccttccctcggctgggccggcccaagctggctcctcccttccccctccgggtcacatacaggtggggcccatctatcggccccttcttccaactcccgccgccgctccccaagccggcggcaaccaccaccaaagccgcccgggccgccgcttcctccgctccacctcatgcccccactccgctcatgtcccgcgcccacgtcacccgcccacttccccactcctcccactcgcgcgcgcaccccgcaacggcgggattcaaattcgaatccccctctctctcccccacctgcccacgtcgtcggcgagaaatccggccgcccccagccacgtccgcctcccctctccgcctataaaactctccccgtgtccccctctctcgcttttcgctctcgctgctctctctcgtgccctcaatcacgcccgcgccgctcgccgctagcgccgccgccgccaccgatccccggccgcgtgccgccgccactacagccgccgccacaccatgcaatcgccgctgctagctacgccggtgccacccgcacctcgtccgccgcacggttgccgccgcttgccaccggaaccccttcttcctcgcgcgccggtgagcattcccattttccccgccttcggccggcattgccgctcgccatggacatcctctctccctctaaatcctcccatttgctcccctaggtcactccggacatcgtccacccgctcgtctcgccgttcgccgcttgccgccgtcatccaccgtcgcctcttctcgcgtcggtcaaccccatggtgagaactccctctcctccctctttctcccctcccttcctctctctctgccgcgccgcccgccgcttttgccgtgccgacgcgcctcggtgccgccgccgctcaccatgaccggccagccggcttgaagccaagccaagccagcccgccttcctcctcccctttgagccaccgcctggtggggcccacccgccaggccacctcctcctcttgtgccgctgacccattggtcccgcttgccggcgccgtcccctccttgatgacgccagccctggggatttattgcgcaataaacaaatatggacttttctttattagtaaaaacacagataatcttccaaaaatcataactaattcatccgatctccgattaagtccattcaagtctcagtaaatacataaaaatgtatagaatccaataaaaatggttttgtttcctgtttcagtagacttatagcatgtttttcttatgtgctttgtttgtcgcgtagatttcgaccgttttgtcgatccgcggtttcccgaagacgttgctgtggtctcatcagtgcgctagcaacgcaagtcatgcattacaattgatcatattgtacccaatttacaaatgtcccgcatttttattaaatgttacattgttttacaatatcatgtggaatgggtcctactactcagccatagattgtttaccttatgccattgataacttgggttttaaaatgactagatgttggttaaggaaatgcttagccatgcttagttcaactagtactcaaagggcaatcacattaatgcatagactttgattattggcatagctttggatttagttaattaaaatacactatatggtgggctgtgggtgcatggttttgctagtcgtgcccatggcgattaaggaccggttcgcgggatgccctggaagaacttatcgtacttaccacaagccagcgtgggcaacggctgggcttgtagtgtagctttcctctagccgacgtacccaggcaagggtgggcgtgatggagttgggtcggccggggtgtccggttgatcggctgccggattcaccgtggcacgagaggggactgcccgctgccttgcgaggagtgggggtgaaacctgaggtgtggtgcgattggttagagggggttatgcgaagggtcctgtcacgtcctctttccggtatgtcgtggtggcatgtcggcgcacggaaacgtgtcgtagggctgtgtcttgtgggtacagttgtacacctctgatcagagtaaaactattcgaatagccgtgctcgcggttatgggcagtcgactagattcaccgtgattagtcccacccctagttagcttttgaactggtgtagttcaggtggttggttgggcctgttgtaacgtagtgtagcgttggacagtgattggtttatattgattaattactacaacagtttttactgctttcaactactgcttttaaatgctagctttatgctaaagaacctttagcctcccttggatatatcctgcatcataccttttcttccggtatgacttgctgagtacagtgggtagtactcagtcttgctctcttttcccccacaccagagttgaagttcttctcagttggagctgtctcgttgaggttggtttcatcgctgccgtcaaggattgcctgtggagtggagtcgccccgctgcagaagtcaagctttcaagtctaccttgttttactttttccgctgcatttgtaatcttttatatttttgtaagacgtggatctgtatgtcaacaattgtcgtttgtgtaccctggctggtcctggacaggggtttaatacacattcagcttagaaattctggttcgtgaatttctgggcgtgacacagccctgcggcatggccagtgccgaccaaaggtacggtggcagaagtcgaggcaaacaccaccgctgcagctctccttccgtcatgccccgccgcttgcgctccgcgtcgccgctcaccgccgcgcacgcgctgccctgcgccgcctagactcgctgtcgttgcccgccgccgccccgccgcagtgcactacgccgtcacccgtcgcgtctcgcggccagatctagccgtgggagcatgagatccggcctcagcgaagccggagtcactgccttccgccggcgagtgccccgcggcgaccggctcgtcgcgcgtgaccccgcctccctcgcgccaaaggcggtgtgcgcggcgccacgttttggccccatcgccgccatcctggcaccccacacggttgtctggcggcggcgaggcagagagaggatggagtgtgggcggcggcggcggctagggtttgcccctgagctgcccgcgcgaggggcgacgcgagggatagttgcccttgtgtgcgcttgtgttttcgagttgccaaattgactaaatttttagctgtgacattggtccatttatatttctagagctatcttaaaggtacaaaccaaaattgtgaatagggtccatgcataaactatctatatatcctaaacattccgatcatatcctaaatgctatctaggatgtttgtataacgcatcgctgggtccgtcaacaaatttttgaactgtaaacttcagtgaacaaaacttccgatcatgcagcctcttcaatatatctaacgtggctgacacgtacgctataactaatgggctcacacgtcaaccacccatatgagaaggcggtatgtcatcctgtccactcggattgtcccattccaacctcgagggcagattgggaggatatagctagcttgactcacaacaaaaaatcatttctaggtttaaatatggatatgtatatttaaatctagaagtgagtaatttttttttgaacggaggaagtgctaccctgcaacaagcagtccattttgtgatcgccgtggctttgtgaacctgtggtagtgtggcggcaggcatgagtctgtagcttgtgtagcaaccttgagactgcgacggaggctgttgggtttcgttgaatcggcggggaagcacgactggtggtgaaattatgggtgtataatactatccattaaacttaaatttgatgtatacaaatattacgcacatacaatttttaataaaattttagtgagattaaagaattgtggtattgtatgtgtagtggtatatgcgcgtgtgtctctggtatgtaataaattaaaataaaaaaacataatgactttatgcatcagtgggtgaccgccctacgtgcgaggccacgacgtcactcgttcgtacctcatgaggcagcagcggtgacactaacggtagtttgttttttttccctagttttttttttagaactgttctttctctaggttatcactgccacttgcctaaactggtagcgaagccattttattatctactggtgatatagacctttttgtttttaaaaataaggtccataaacatgaatgaaagaaattattttaaatatattacttttatgtttgatgatgttgatttttggacatgtgtgataatggctttgtgcatccttggacgaccggtccgtgtgcgaggccacgacatctcttcgtgctatacggcagacgcggtgacagtaacggttttgtttttacctagtatcttattatcactgccaaatgcataaacaggtaacaaagccattttattatttagtggacctatttcttctttaaaatggagccataaacgtgaattaaagaaaccaatatttttttaatttttgatgacgttatcttctatacgtaagtttgactattcatcttattacacaaaatatataattatcatttattttgtttgtggtttattttttcattatgccagttgaaaaacccacatatataggtaccggtttcccaaccgacatccccaaagcggcaccaatgaggagaaatgattggtgccagtgtctaggaactggcacctataaggtccaacaaatcaaaaaaatatcccgctcgatgtatcggttcgattttatcccacagtatctcatcaaagaacaattcatcgatatcttcattcatcaacatcccatccaataagaacaaacaaccatactccgagatcgagattgaaagatacccaagaacatcaatgaacaaaattaagcacatgagaatttcaagcacacgagactccggatctggaagacttggaaagctctgaggccatcgggagggagggagggcgccaccggcagcgacaatgtgtggggaggtcgctagccgccccgctgcacgccgccatggggaggccgccagccgctcgccacgcgccaccctggaggggtctaccggccacccgcacccccacgtgccaccatgggaaggcagcattaaccctaccactgccagcgtctgccgcgacaggccgatcgcccatacgccgactcccctccccctccccgttgctgcccaccgcgagtagtcgctcgccaagataccgaccccgccacctccgccgtccaccgcgaccggccactcgccctggctagatgcagaaggagaatgggggaagagagaaggagagagagggacaggtgagtggagggggccgggcgagtggataaggacgcatttatccatccactcgtgcgactttatccacttgatcggtcgcgcccccggttttctctctcgatcaactcggctcgtttgataggtgccgattttcttaaaaaacctgcatctataatatattatatgtgtcggtttttatttaaccggcagctataatatattaaaggtgtcgtttttttttaaaccgacaactatagtataatataggtgtcgatttttctgttaaaccggcacctataattacttaaaggttccccttttttgtattttcagcctgtggaggtggggaaaacacctataattaccaatgaactagaaaaaatgcccgtgcgttgcaacgggtgaggtctattttaatcttattattgttatatggtttagttaagatgaaattcactgtgggagtttgcttggatatactgtatatatttttagaaaatcatgagctgcagttaggaatttgattgtctcaagttagcatgcgagtttttttaaacatatttcttatatgattccttctgtattaaaaagccgactcaaatacggatttgtatttctaaaagcaaacgaacttaaaaaccaactcatacacggatgacgtaccaaaataccggcaaaaacatcttcaattttttgcagtgcatatttacacataattttataaaatcaccaaatatatgtcaaaaagttaacgaaataaataaaaacagtgggagtgtactttattcattggttggctggtgtaatttttgttactcgaaccatttgtattgtacaagtactccctctgtcccataatataagggattttgtctttttacttgtactgtttgaccgttcgtcttatttaaaaaaatttaaaattattatttattttatttgtgacttattttattatccaaaatattttaagtacaacttttcgttttttatatttacacaaatttttttgaatagaacgagtggtcaaacagtacaagcaaaaaagttaaaatcccttataatatgggatgaagggagtagaatgtaataaggtggtcggtgacacacacaagtttatttatacttagtaaaatgcccatacgttacaacgggacgtctcatatgaaaattggaataaaaaatgaagcgtggtctggcataattaagtgtcccatgttatgttgtgtcgcatggtacgtttgtttcagttggcaggtttgaactaattaattaaactgcataaaataaacaaggcattggattagactgagcaatttcataagtgaaactgatttgtatgaattatcaatcaagaaactattgccttcaagatctaattttgaccattaattaatttctgctccctccattttgggttataagaaagtcaaactattttaagtttgactaagtttgtaaacaaatatagtaatatttataatattaaattagtttcatcaaatcaataattgaatatattttcataacaaatttatattgggttaaaaatgttactactttttttacaaatttagtcaaatttaaagcattttgattttgaccaaagtcaaaacatcttgcaacctaaaacggagagagtaccatggtacatatacatatgtaaaaccaaaaaacagtgaaatccagtaaaattataatcatctcccgtgcatacatgctcctgatgaccgacgtggtcaacgcggtgatctaacgcccagcgcctccaacacgaattgctcgtacacgagagcaaatagttagaacacttcttaaacaactatagccggagatttaaaatcttgcttaatttacctgcctgtcctcgttcccatcttcagggtctatcgctaggttcctcgctcgcccgatgcctcctgcggtttagccatggccttgctcaacgttggacaactgttataaaaccgacccgatatatatctcggaaactgaacatggaagaaacatcataaaagattcaaacatgaagacgacaccgagatacgatatttgataatagagttcagccgatgtctacatctcccggttaccgattacgggcgctcctccctgatccagcatattacagtgtatccggatatccacgaccctccaccggctaggccgccggcctatcgtacccacacctatgctactgtcgtctttcggttacaattggtgtgcccctctatttaagagaaaggctaggatagagtccgactcttactctagttctaacacctattataactccaagttctaaactgtaacagactatatacacatattcaacacaaactctaacaacagcaataagaggaacacaacgggatagggcgtcgttgggggtgagcatcaatttaatttgcattggcggcgagcttgtcaagaggaaggtggaggagaatgcggtgggggaagacgatgttggggagcgacatcgggatatggcgacgttgggggacaacatcggtggcagtggtggcagaagtcgagagaggcggcgaacccggcagataaggaatgcggagatgcgtagagccgagtgctgcacttggagccggggccatctagcgtttacgtcctagcgctgcgcttggagccaagccgacagagcattctgtcggatcattgcgttgtccacgtgttggccaccaggagtgggtttgcacctggttactacctttttttttcccctgcggtttctctgcttcatcttggagacggcgggtgaaacggaattaatacaaaatcgcacttggattcagacgacgacataccaaaattttgattaaaaacatcttcaatttttataataatagagatagagaagagatatgaaagcattcgcaacttgcattaatttcactttctttttgaaatcaccgagtgtcgtatatactacttttggtccttgcaaagatcgataagatggtcgtaaaaggaggtagtatttgaatcacttcccttcaaaactcgcggtttatggtggttaatcaaagcgattgcgtacgtacgaccaacgtactcgaccaatttagtcgtgcctaagcttcaccaatcaccagagatctccacggtataaaattaatattgagatggcaccgtacaatataaatagagcctagtttcagctttgcccaaatcatgaaatcaagtagctctccccgatcgattgagtactgcacaatactcgacctaagctaagctagctagctcgcttgcattgccaggcgatactcatggcacctgctcatcatcaggcagcggcggccaccaccgtcaccactcaagatatccggcgagcacagcgcgccgatggcccggccaccgtgctcgccatcgccacggctaacccggagactcgcagatcgcaggatgaatatgccgacttctacttccgcgtcaccaagagcgagcatctccctcagctcaaggagaagctcgagaggatctgtaagcacgcatgcacatcgaccgtatacgttaatttgttcctgccgtttccaaccattttttcgcccatcttattatttgaaacgtaacaacactataaaaaaaaagatttttgtggacctcggcattcttctgcaagcggaccaaatgtaaaaagaacgtaggccatctcagggccacagaccgtctagctgtgaaagcctaattctacaggctattacttaagaaaaccataaaaaaaagttctattaatattttcactggcgattttcctaaggtaccacctataaattctttcaaaaaaaaggtatgacctataaaaatagaatgatttataggtgattattttaagaaaataaggtatgtaaaaatcaatttatttggacggttaccacccataaaaataggagcgaacctatttcaagagaaaatactacctttgtcctagaatattaaaagttttaaggttgaacacggtcattaagaaagtggatagaatttaatggagggaggttgttattggttgagaaatagaggtaggtgaaaaaattaaatggtggaaagttgtgattggttcgaaagagaatgttggtgaagaagttgttatacttgggacagattctgaatgttagaagttgttatatttttagacggatggtgtatcttttttacatgaagtcagatgatgaaaaattttatatgaaattatagctctcgatgaaactttacagttgaaagttttttttatttgcgatcattgaggggccaaaatatgtgttaaagctcttaaatctattttttaaaatgttttcttatttttttaaacaaccttagatgtagacaagttctatattaacactgtagagctctacgcaatgtacaactttatactagaaaggtttgatatttagatcattttggtgtcttaaaaagtatagtcattacaagctcttgtatctattttgggattctttacaaagttcaaactttgaaaatttcttgcaaattcgcaagccccatcaaggtaaaatattcatatatgtgtgtgtgagagagagagatcattgtagtatttcctttaatatgacataattagaattttcttagaatatttcttatatatagtgattcactaatatcaggttgtataacatatcgaatcatagtctacgtaagtaaataatcatattgaaagaaatattttaagaagatgggccttgccatattaaataaaatattgtaagtctcatataaaactttgattcaccttaattaaagctaaaattagttctctataattttttaaatttagtcattatcaaagaataaagaaaaagtttttgcaggacaaaatcttaaagaaccaccaataaaatgatttttataggtgtactttttaaatagtcataggcagttctcaccaaaaaaaattcctataaatatcaactattgcagacggtttcttataaaattggaccttaaatatgggactatcactggaatatgaaaaaaaaatcataatactttttatatgaagtcggatgatgacaaactttacggatattgtagctctcagtgagatctataacttgtagtggaacctgttttcatttgagattgtttattaagggtccaaatattcatttgaaagaaaaaaaatgacattttgagtttttcaaataaactcggatagagagatatgctctatatcaaagttgtatagcttatcacgatctacatatttaatttagttgatgagttctccaattgatgtcatttaattaatgtataaaatatgtgttaaaagttttagagcggtacagagttaaagaatagcatccaacccatagtcaacccattatagtgtatatcttaggggcaagattgttgtatctgcacaagaaaatgccattattaacagattcctttgctaacttctggagcaagtcctcaattaatacacaacaatgtttttttggtatcaataattgtggggaatctaaaaattgtgacagaccctcgaagaattctatgccaattcatactctctgatcttcctttgatgacatgaatagatatttctatgatagacttgatctagtaggtgaggacagtgataagagtggttatcttgccattttataactgacgcaactataatttaatcaattaaaatgatttagaaaattatattcccatagatcataaatatttgatatttaggatataattcgatcaaatcgttgaaacttagcccataaaattctagtatattataataaggtgataaaatttaatacctttatttttaaaatatatggtgctcttaacttttggatatgtcatttgatcatttgtattatttataaactatgtaaatattatttattttaattctatttgtttcatcataaaatgttttttaaccatgacttatctttttacgtatttgtagtatttctttaaaaaaagatgaagaatcaaatacctgtgttcgaaagtcaataatatcatacaagagtacttaaaatcagagagagtaataagctcaaggtattataattgtatttttcaagaaatatcaatgtgtgtgcatgactatgtattttataatggtattgagatattattgatggctaaaagtttcaattgaatttataaacgttaaatatttatgatttgagccagtgttggaggaatttgcgtgcttatattatataattaatatggttgatatatgttacaggtaagaaatccggcatcgaaaatcggtacacgtacgtgaacgacgaggtcatgaaggcccatccagagttctccgatcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 48895 - DNA, 1308 bp, Oryza sativa
accccttgtgggtttggcgccacgtgtgtgggttaggtgagcacagcggcgctcacctaaccgcgtttattgcgggttggacgagcgccccacgccacatttaatgcagcgcagcacactcgttcggtccgtgacaggtcacagtgtgtgaccggtcacagaccggtcagatcgcgggttaggtggcaacaggcggcctgacacacgcctcgccccgtcccgtcggaatgatgagagcctccaggcactcgtccctagccggagccggcgtgggaactcctggagttggcacgtcagccccggccagatacattccaggcttcatcgcaaccattgcaaggaagtcattgtatgaagaagggcagacgtgtagcatgctgaactgacacgtggtggacaagaatgaccggtctgtgactggtctgacgccgtgtaacaccctgaaaattcgaccgacaaaaccaaaactctaaaaatacggattttcaaaaacttttttaaactaattgcatcatgccgatcttattggtctattttatctggagttgatctcgaagattattaatcgtgagtaaagaatagttaattagaaataaaccttaaaaacaaattggtaaaataaatataaattaaaaataaagattaggtgtggatagtaataaataaaatattatcgcgaccatatttggatcaattaaatttcattgcgatggaataagaattaaccctaattaaaactcaaataaattatataaaaataaaatatgagtaatattaatctagggtgaattcattagttaagataacacgaatattgagtaaaatgcatatatgtaaaattaggaattgtggaatcaaatttagatggaaaatacactaaaatcgggataaataggaaaagtcactgttcattgcgcctaaggtgttcgatgtggtccctaaccttccccctcctctcccacctctgcccctagccgccccgagcccgtccatcgcgtagccgctgccgcgccgcgtcgccgtcgcgtcgccgtcatcacgcgccgcgcgccatcgccgtcgccatcgtcaccgtcggcctcgcgccccgtgccgccgcctcgagccccgtgccgccgccttgcgccccgcgccgccgctgccacgctgtcgccgcgccgcacgcccgcctaccgccgtgcaaccgtcccgtcgccgcgccgcgcgcccgtcccgtcgcgccgctgtcccgccgccccgcgcgccctcgcgcccgtcaccgaccgttccgtcaccgcgccgcgcgcccgtcgtgtcgccgctgccgcc

SEQ ID NO: 48896 - DNA, 1300 bp, Oryza sativa
cggctgaaatttcctagctgatatggcctgtgctatcgaacaatccataatagtagaaccactgtgctgtccataaccacagcgatgcttctgctgtccaccttgctgaaacctgaactgcatagctttcctcttgcgatctatcttgttacgttgatcttcctaacgaatggtcctgtccacaagtctctcaaaatcagcatagtctttagaaatctcctggttagtcaatgttgacggtccttaaatcataatatttgaccatcaatacttacatataatgaaataaaatatggtatccaacttagtggtagggtttataactaatcatttctaccagtattgatgaaatatgtgtgtgcagatattttgaggagaaaacacatccgtcatgcgacataatgcacctctgaacattcaggacgcgtttacacgaattggaggcaaaataagtcaataaaaaccatctaggattgggccaaaacatagtgaaggatgttgggggcccattaagcaacctaccggccgaaggaggggccgggaggacgtttttctagttcttgaaccaatcctggcacctcccgccatctggcttcacgtggacggctcggatttctcccctatggcggttgcagggtgttttggtcatttcccatgcccctaaccgtcatttggaacctatataaggaggtctccttctcacttcaagaacacacaactttgagctgaattacaagaggctctattgtatcttttgtacattagaataaggtagagagtgagagaagctctggaggagtgcccggaagtttggcactcatccgacttctacctcgacgagtgcagcttcctaggagaaattatggaggagtaccggagctatcggtacactctgctccaggttcggagaacttcttctattaagtaagcatttgtgttcctttcttatgttatttaattacttagtctgagtaagatatatttacagctttgcgggttcattgtttagtattcgtactaagtgctctagtactaggactccggatagagaaggaagtttctgcacaaatattagagtagtaattaataacataggcgtggtgtctaggttagagattacctttgtttgttgtgtatcccacggatttgttagaggtaggcagcaggtggtgacagccctgaatcccatcctagtaatcctccacgttcggatacatcatagagctatagccggaaccacgctagtagaccagcaggggtcgctgctcgaagcaatagatagaaaattacctttatttag

SEQ ID NO: 48897 - DNA, 2422 bp, Oryza sativa
  unsure (1)..(2422): unsure at all n locations
nnnnnnnnnnnnnnnnnnnnnnnnnnnnnnnnnnnnnnnnnnnnnnnnnnnnnnnnnnnnnnnnnnctccgtccggtgtattaatggttctctggagggtaattcaaaaggctcgccagaatcttctttttcaatgaaacaaagatcatcctgttctataatagattcaggggactaaaatttaatatgtagtatataatccctatcccttatcctctcctacacttcacaaatcccttccccttcctcttcacagatctaacacctccccctcctcgccttcctcctcacctctcctccccctcacttaccatccggtggccggcggcggcggccatggcgggcggcggcagttggcggggccgcgcccggcggcggccatggcgggcggccaaaggtgtcacgcgcggcagcggtcgtgccctctcgtctgccggccggcctcttttcttttttttttctgataattcgggattgattgagatgtataattttgtgattcattgcatggatatgagatgtataatctgtcacacccagaaattctcgaaccagaatttctaagnnnnnnnnnnnnnnnnnnnnnnnnnnnnnnnnnnnnnnnnnnnnnnnnnnnnnttataaaaccgtttctggaatcgatcaacgtgctacacaaggattgccacgatggagataagctctcagatatgcaattgtatctattaattatgatattttaaatagttccttagagatatgtttgggtaagagtctgccgtaaagacttatgtgtatcttagagtttgctagagataagagtcgtgtccggcaaggacctatcatgtatctcgggtataaatataaccctaacccatgtaattaacaacaacagttcaataacatttttggtgcatcgccaccctttttacttgctttcaataacagttcaataacaacaacagttcttgctttcgggttgagctgcatcgatttcaatcttcaacaagaggtaaacttgtcatggcggcttgcattctcgtgattagtgcttccatctttatgacattctaatcttgtatatgtaaatcgtcgagttatcatatatgctctataatctttattagttgcgccatctaacctgcaatcggctggtttctactgctagagagtagccgatagatttagattttgttattaatctagattatatagcatattgttgatgtaaaaaggaataagttcaccggaggtccctcaaattgacaccgagattttttaaggtccttaaactagaataccagaaatgtgtacccctaaaattactaaatccgtccgtagaaggtccctcggcagtattgactcagtttttgcccggttttgctgacatgtcgcgctgtgggacccactagtcagtccgccgttggggagttaatagacggggttaacggaggggagcgcagctagccagacctccattctctctcctttgctcgaactctagctgagctgcgaccaggaggcgacttgaaggcgacggcgggtttgtcggcggcggcgagctggccatggcgctggcgacgagcatcgttttcgtccaaacgcgtggcggattccaccccggttagtaccttgttggctcggcattgcgtgctattgtagctggtactgtgttgattttgggggaagatttaaaatgtggtagattcgttttttgtttgggattcggtgtagaggtcaagtagtatattgtcccatatgctttaggtgtagtaatgcttttgtatacccatgtgaatctgggtgggttagtgttggggtggtccttttttaatcggtgttaggtgttaactaggtattagggatctggatgtagtgtagttttaatagtagagtagtaaagtgcttctttttttaatttttcagagctggcagcatggatcccttcggcactctagcagttaggttccatttcaatggggaatttgttaatagagggagacagaagttgtattgtggggggagagaagcaatgtcatacatagacagggataaagtgtcattacctgaactttttggacacctaaaagatcactgcaaatttgtggatgataaggtgtgtgggttcatgtctgactgtataagtgagggtagtgtggttgaggtgtatgctgacgaacccattgtaattgatgttgatgaagaggaacacagtgattatgaggctgaaatgcagcaaaatcactagcatcacacatgatttcaaacagcagcgaccaatcagagggttggatgattggtgctgagatgagtgattccttaaggattttaaaggatttcatacactcatcatcaaagtcaaccggaacatcattagnnnnnnnnnnnnnnnnnnnnnnnnnnnnnnnnnnnnnnnnnnnnnnnnnnnnnnnnnnnnnnnnnn

SEQ ID NO: 48898 - DNA, 1386 bp, Oryza sativa
gagtcgttctgctcgtggtcatcgctatctggacctcgccaagtttctttggacgctcggtaagcatcctaggatcccatagaggcacatgcatgtagataaacatttagatcaatgccctagctccacatgcaccgtcacccgagaaccaccgccgctcgcaccgccgtcgccattaatttcgatgaccaatgcttgcaagaataccacctatagcctcaccttgaacccctttacattttctccttaggttgcacaccgagatctgccgccgtttgccgccagcgagctcgagaatgagctcggccatggctagctctgtgtcagctcaatctaaggacctcgattgagaagaatcaaaactctaggtactactttgtaaaacctacctcacacacagaacagtcacaggactgcgggttgatttcctgaaacactaagggcctttctgcatattggcttgagactgacctgtggacccaatctatttaaattctggaaaaatctaaatgaaatgcctaaagctttatattttcatcagaaaaacatgtaaacttgtaaaatcgttaacaaattgaaaacaactcgttttagagtaatacaaattactgttaactcatcgaatcatgaaattagtgttatttcataaaaacttgcactcacagtacaaatgtagcctctaaatttggtctaagataaatcatacataaagcatatacaaacttataaaatgcaaacaaaattcatttcaactcattttagagaaaacttagtttctacatatccaccaacatgttccctaaaaacaaagtaaaataaaacatatacatactttacatcaaatgcctctaaaactattatctttaaaataactagttttgcataagctgaaatttagaagtttatataaaattcatcttagatcctttttgagtaaactcaagttctatagaattacagagttgtgcacttcaatgttataaaataaaaagacatacttacagtataataagaacccctaagcatttatgtaaggaataagcaacatggagcataccttaaattgtaaaatttgtagaaaattcatctttagtctaaatgaagtgaaccaaatttctgtagaaccagcaagtaatatacttcaacctagtagagtgaattatggcaccctctgtacagaccataactctaaaccttaatttggttgtacagaccataactctaaaccttaatttggaagaataggtactaaacgcataatagtggttaaacaatacatatgaataagtatatatatgcatggtagctccaaataaatcaaaataaaacttgttaggaccagtggagccatagttccatccccatctaccaaaacttagatgaact

SEQ ID NO: 48899 - DNA, 4636 bp, Oryza sativa
  unsure (1)..(4636): unsure at all n locations
atatttcggtgtttaattgcataatgtgtactttgtatagatgattgcttaaacggtgaagaagtgaattaggtgctgacatttttcagttgcaaggcaagtcccagctccctctctttgatcactttgaacctatgttttagaggttattgaaaatgtttgcaaatctttcatgtcgattgtacactaataaattaaaattttgttaaactcgttagacaaactcctattatttgcattatcaccttaaccccacatatatctatatccctcattcataaccttaggagcaatatgactataccactttatatatgagttttggtgacactaggttactataatgcttagccatgcttagaatggtcttccttgtcattatgggctcattacaaacatgaaaattgatttttaaataatctggacagaactttaatacttattatttcgataaataaaatggtggaaaacatggattttaggtttgggcctcaagcggtgcatatatggtgattagatgtgtaccgatagggggagagtgtgcgcccaaaccgacctaaggacttcactcaatgtcagttcatttcgtatacagtacaaccacatgtgctagtatgggatagcccaagcttagtaaattatttatggtttagccttacattctggtaggccggtgtgtatgagtttgaataatttagaggagcttcatatttaccccgaagtggtagtttaggtgactaagcgtgtccaatacaacggtattgtgccacgtggagggttcccgttgtgtccgccaccatggcattaagtttaaggcgtgggcccgccacttaacggttctaggtcatatttccagtatgactaggatggaggaacacgtatcgtgctggtgtaaggctaaatcatgaattttggaaaagctttgatgcgggtaataaatcgggtatttatttatcgcgtgccatgctcttgcatgattattatttcgcatcatgtgggtaaagtgtagaactctgcagagttaaaactaatcgattagccgtgctcgcggtcatgagcggcgtgtggatatgtattgagtatagacttgtgtttattcttctaaattctgaaatttaacttcaaaatgtgatgagatttgtgaatgatctccttgctaccatggatggcaatgaggtgtatatttatacatgattaatgactactttgatgcccaatatgtcaagtacttgcttgctgaaatttatttgaaagcaaaactgatttggaaatgttttatacaaataaaacttgctttatgctaaaaagaaccatatcatgccttctttgattatatgccttgcaagtagagtgttaggcaagtcctagaaataatgtactgactcttgctgttgaattaaccttttgtttgcaggtttagacttagtctttgagtgatgcaggtaatcgactgcttcttctagggtaaaccgctagtcggtgcacttgtggattgggtagacaagcttccgttgttctattatttatttggccggtcggccaatgtaactaaagtagatgtatttataatcactttcatcttaattgtgtttgctatgtatatctatgattgagatgaaagtgtgagtctagtgcacatcctgggagctagattcacatgagtatgagttaagaatatttgagatgttgtagatctttagccatttttgtcaagtctcctgaatgtgtaacacatctggtcgctgccttcgagtggtttgacgagcacatctcaggcaaaagttgactggcaggctaaaggcccagcaatgtctccaatattcctctcttgaggcgtcggatatttcattgtacttgtttgatgattttagttattcatttcatctctcaattataatggaaggtccggagagcctacgacagtgatggagtacagatggacctggattttggtctatgctccttccggatttaccttggcacgagcagggactgcacattgcctgtatagggatgggggtgaaaccggaggtgggtgtgttggttaggggaggctatatggagggtttgtcatgatttccccctttgtagtatctcggtggtacttcggggcatggtaacatgtgtggaatcgtgtcttgtgagtaaagttgtacactctaatcagagtaaaactatttgaatagccgtgcctgcggttattgggcggtcaaccagctcaccgtgactagtctcaccttaataatttgacctaatgaactggtgtagttcaggtggtttgggttggacctatcataacatggttttagcgttggatagtgatgatgttaatactacttaattatctactattttactgctttcaacttatgatttataaatgctgcttcttacttcaaatatcctatcagccattcctttgaatatccttgcatgataccttccccttggtatgagttgttgagtacggtggtggtactcagccttgctttatttttcccaatcccagaggcagagaatttgtcggatggtgagttctatgaagattaggcttgtgccagacgtcgaggttttgcctgtggattatggtggaagcttccctttgctgagaagaataagtttagatggtctttagtttttttgctgcttttctgagctcttggatattttcgtaagacttggaactgtatcaaattatgatccgcgtactctgcttgatgcctggatagaggttaaatgcacagatagccggtgattcgggttgctaatctctaggcgtgacacatacactccattccaccatataccacatttgtcatccacggaataaatactctagaagaagaacaagactaaatttgctgcaaattttcttttgattaaacttggtctgccctcaggggtcgtgtacaaaggcatatatagccattacatgtgttagaaactaactacgaatcaaatacaacacaatatagaaacctctctgcagcaccgtcaatttgatttggctcttgaggtgaaaccagaaggaatttgtgtcctaggccctatccaccaagtgtgtcatgaagttagcttttcaacaagtgctcacacgtccaaaacggactccggacgagacagaaacgggcgttttagtcctggtatatccaggctggcccaaaccgagtccgaactgaatcttttcttccttgtctagaaactccttgctttggaaggcttcaatccatggagaaattatagatggactccttcccaacccaagatgggccataggatagtataactccatccaaacatgccgttcaaagccgacgttcatcaccattgttgttacttgcgcgttgcccgttctacccgcacatgatgtcttcaacttgagattgccgttggtagaaagctcggaatgacatgccgtttgatccgatggaaagtggacttgataacctttcctagtatataagccattcatgttgaaagccttctcatcaatgcagaattctccatgaacttcatgaacagaatagcaattgatcttcctcatgtacgccgctacaacggtcacctccgactggacccacatgttgtttatgccagccaagggttccaatctctcaagtgcgaaatattatgtagcatcaaattctcatatatttcacacatagacttagagagaaatgagctcaccttttgttctgatctgtaagtaaagaacaatgtactattgataggtagatctggatcaattcttcttcatatgctctcgatactttagttcatctaagtattgtctttactttatgtttgtattggtacagtcatatagttagcctaccagagaggtgcaatggtgtgggtttaatgtccgattactcggttgctctatgtcatctcgagggatgtagagtagtatttaataatgtagacagggtgtctagattactaagtatcattatctgggtttatatgctacgagtcagtaaaggtgggctgctaattgtgacagctcaatacgggtattcctccacgatagtatctaatcctaagaaactttcctagggagggtactcctccgtatttagcctaggttggacggccatggtaggttgtcgtaagaaactcggcaacccggggtagtctctcgaagcaccaggagggcactgttagggggtattggctatatggttgtatactagtagatgtagactaaagttaangntgggtnaatnaattntaagaattaataggaattgattgttttttctatttcttcttccacttagttcagaaatgattaaagaagaaatatgagtgctttgcttcgtgtcactctacccatataaatattttaacccatgcttagactttgattatgtaagtggcatgtatatatattattagcatagttctctcttacaatcttcccttgcgattaaataaatacgataccttagaatactcccgggtgaaatgctacaatggtaaatccgtgcgcttgcggattctttctgtaaaccatatatataccaggaccatttctagcgccattgctgggaattcatatttctagtaatatcgttaagaaataccaacaacaggctggccggactagagggacaggatgcaacattccttg

SEQ ID NO: 48900 - DNA, 2053 bp, Oryza sativa
  unsure (1)..(2053): unsure at all n locations
nnnnnnnnnnnnnnnnnnnnnnnnnnnnnnnnnnnnnnnnnnnnnnnnnnnnnnnnnnnnnnaggaaataatatagcgcacgatagatattcaatcactatagtagtcatattagtcccttcgttccaatatagtaagttatgtagttttgtccaaagtcaaacttcttgaacttcgatatagtttatataaaagtacatcaacatctacaacatcaaattagttccattaattccaccatgaaatagctcttaatagtgcatttatttgttattttagatgctggtgcattttcctataaactcggtcgtcgttagagaagtttgattcaggttagagctaaaactaatatggtactgaaggagtattagcaaggaacaaagacatttaatgaccttgcccttttgtccaactattgtgcatcaataaaggcaaaaaagaaatagcagggtgcttaccatcatatcaggtagtggcattttgatcttagttaacatgatctctgtgttattggctcgtcttaaatcaatctgtagatttcaaagacaccaaggtaactcttagaaaacacaagtgataccagtaattaatgaagggcagattttattgtcagagagaagctaatgaataccgtgaaatataaatatatgaactaaagatacaatctcggtacaaaaagccatcaacacattttcaaaagtgaatatgataatgaggtttttccgcaactatatagaaaacttgtcttctaaaatgaaagtaattattaattttgtgcgcattacacttgcatggaatcaagtaattcattatcatagcagtagattaaacaaaagtactgggaatattttctgtttagcatagtaatgtgttagagtaagttaccagatgaactttgtcaggttttgatccaagagatttgctagctccatctgattttgaaccaccttttgtctttggagcaatagcaaaaagagactccaattctttcacatcaaattcagaatggctacatacatgatactaccagttagtaaaattttattaaaaaaatgatacgagaaataaattgaaatagcagcgggtttacactacagtattttttgttgtaactatggtgaaagaggtagagaagttatattttctagtaatcaaaaagctaaaaaacaagagggtacctattagcatctgcttgcttttgtatttctgcccataaactcccttgcattgctcttgttactttaacccaatgtagtggttttagagttgaccttcttgctgtggcagctgagttcagccccaaggaacgagtaagtccatgtcctactacacctctgccaccaggtggagcaggcaaaccccttccaccagggggtggaggaggaccaccaggcacaccaggaggcattggaggagcaggtgcacccggaggggtaggggggccacctaccccaccatgtcctctagggggtggaggtggtggtgcaacccctccatgtgcattgggaggtggagttccacctcgaaatccagctggaggtggtggagctggaggccctcctagccctccaacaggaggtggaggaggaactcctccgattggggatcaggtagagtcgaggtgctggcggagcttgatgcccacctagccctccaataggaggtggaggaggaactcctgtgattcctccaggtggaggaggaggtggtggagcccctgcaccaatgctaggaggaggtggagccactccataatctcccagagttggtggcagaggtggtggcagaggtggaatgccaccttgaattcctactgatgtattttctctctgaggaggaggtggtgatggtggcgatggagctcctccaacttctcctggaagataatgtggcctttctggaggatgatgtggacaccgtttccattcaagatgagataatggtggcaattgaggaccagcatcaatcaattcagtagaagttgtagctaaaattccgtggctaccttctggggtggtggtggtagaggaattctagtatatttttttgcatg

SEQ ID NO: 48901 - DNA, 1497 bp, Oryza sativa
tgcaggaaggtaataggacttgatagttgcttttccaagggatctacaaatggagagctattgtgtgctatagggagggatgccaataatcagatgtacctaatagcttgggaagtggcctataaagagaacaatgaagaatgtgaatggttttgtgacttgctgtgtagtgatctgagggttggtgatggaagtggatgggtcttcatctctgaccaatagaaggtaatgctcctgatccactgtttgcttttatgttctgtcaattctgtcattacacaatgcatacctaatgtcttgtgcatgttactatcaaatgcagggaataattaatgctgtctctaagtgggctccagaagctgaacacaggaactgtgccaggcatatctatgccaattggaagaggcacttcaatgataaagtgtttcaaaaaaaattctggaagtgtgccaaagcatcatgcagaatgcttttcaacttgccaagagcaaagctggcccaactgacccctgctagagctcaagcaatattgaacacacacccagagcattggagtaggcttggttcaggttaggatttaattgtgactctgttgataacaacatttgtgaatctttcaacaaatggattcttgaggctagattctttcctatcataacaatgcttgaaaccattagaaggaaagtaatggttaggatccatgaccaaaaaaaatgttctaatagatggagtactgtcatttgccctggtatacttaagaaacttaatgtgtacattgctgaatctgcattctgccatgctatatgcaatggggctgacagttttgaagtcaagcataatgagcataggttcatagttaacctagatatgaaggagtgctcatgcagatattggcaattgtcaggtttgccatgtcctcatgcaattgcttgcatctactatagcaccaacacactagatgggtgggttgctccatgctattaagtggaatctttcaaaaaaaacctatgcccattgcctgcagccagtagagggcatgactagttggccagatgatcctagagagcctctcaatgccccaggatacatacagatgccagggaggcctaagactgaaaggagaagggagcctaatgagccagctaaacctaccaaagcttccaaatttggcacaattatgaggtgcagatcatgcaagcaacctggtcacaatagcaagggctgtcacatgcacagtggggcaggtggtagcacatctgcagctgcaacatctgctccaggaaatacagtcactgcaaataacaacttagtgttgtcaagcacacctagcagcattgcacaaagcaggaaaaggaaggcagctgagctcagtactagcacatctgcttgccacactaggaagagaacatctcctacaaaaaaggtatgtcagccagtcctcattcaattaaacttttgaaattaacattcatttgctaacaacacttgtttcttttc

SEQ ID NO: 48902 - DNA, 1360 bp, Oryza sativa
agcagcattgcacaaagcaggaaaaggaaggcagctgagctcagtactagcacatctgcttgccacactaggaagagaacatctcctacaaaaaaggtatgtcagccagtcctcattcaattaaacttttgaaattaacattcatttgctaacaacacttgtttcttttccttccagtcagcaaacacaaacagttcacttgtgaaggttgcagccagtgctaggctggcaactgaaagaggtggttcaaccagtgtgaaacttcaggccatagtgccacactctcaatgttcttcttctgcttcaatgaggatcacttctgagaaagcaagtgtttatgtgcaagctcaagaaccagccactaccaagcccaagaaaacacctacaggtccactgatgctgattcccccatgggaaactgacaagctgtgatgccatattgtgctaactatgcaatgttatgtgctttttgtgtattttggcagactctaagccaactatgcctactgtgaactttatgtaatttggcagactcttagccaactttgcctatctgtttagtttctgtaatttggcaaactgcttgccaactatgctgtgatatgtgcttgttctggcagactgtaagccagctaagctatgtggattgttatcatctaaattgagtgactttgctcaaatgatgtgtcatagcctaatctgatatgagatggtatttactgagctgatctgatgtgatgaattgactcttatcaatttgttatgctaaaatttatgtgcaaagttacgaatactcagccactgcaaaagatgatattcagtcacaattcaaccaaccactgcaaagtcagctcaaatatatgcaatgtcagtgtcattactgaatatcaatcacaattcagccaaccacaaatccattcacttaacttagatagtcaaagagcacagctcagtttcttggcaaaatgcagcaaaatgctttcagctaccagcattttgacacatagattaacacattgcacctcacagctgaactaaaatcatagcaaacaacacaagcatgcatcccaacgacatcagtacaagccaaactctctgtttctctagcctactgttacttgctctcatagcagccatgttagcttcattctcagctgccacaatcctcaattgtgccacttcattcattgctacccctaattctaggcactgctcttctacctttggcctcagttcttcaacacaatgttgcagctcattcttctcccttcttagcgataacacggcttcatgaagatcgttcaacagctccctcaaaaaactacttgttgcaggctcataccagtcaaaaaaatcgcag

SEQ ID NO: 48903 - DNA, 1299 bp, Oryza sativa
attacattcttttctagtcctacgagcataatatatctttactcctttgaatattccttgtggtgatggtggtggccaccaccactgatatttgggccccacataattagtatagacaaatttattattttgggatcaacattatctttcatactcatgcttgattttatatgaacaactagtgtacgacagctatatatctccataccttacaaagaaagtgcattagtgtcattctactgttgtttgcacgagtgtctgtaagttttaataggctgtccaagcgaaaaccaagagcctggcctgcaacaagataaggaaaattaaatattttttcttcctcaatgaatacgaggtatagggaagctaaaattagtgacccacagatcttgaacatacagtacttaaattgacattcaaacaacttcaatctatagcctgaattgttttacattgttgcacctagagaaacaacttatttttgttgataatagtggaaaggataaatgtaattatatatacagtgaagttgtcacagggcatttctccctcctagtcctaatgaagagggagcttagaaattatccaggaaatttcaactgcaaaatgattttaagctaaacatatttgcatgaaagtttatttgaaagattttatagctcgtcaatagacgcagtaaattacctcttggtgttccctgatttaatttatttcctagaaacagaattttctccatgatcacctttaacttctcagagcctctgagctgattgacatattgaaatgagctctcacgtgataaacattaatacttattaatccaaaggaggtgtattaaaacatatttacctcctcacaagcggatgacacagtcagcaaattctttctaacatccctaatctaagagggaaatgaaaagggggatagtgaaaatctatggacatttcaaatacggagataataactcaaaatttcaacagtgtatgacctgtgattgaaattgaatcttgaaagcaaatatcctaaacttagattcaaccctcggcaccttcataagctctagaaaaaactgcagacggaggagatgaataggaatgtacaaaatataatttgtcagttataacctcaatagttctgatcaaatataagtgaaaaaaacaaatcaatatataacaaaagaagatccaaacatgcatgaaggtttacctgctcacactttccaagagtttccttgtctccagtgtagttctgataggaaaaagtgcaaatactttacttttgcaagatattcagagaaga

SEQ ID NO: 48904 - DNA, 1305 bp, Oryza sativa
  unsure (1)..(1305): unsure at all n locations
nnnnnnnnnnnnnnnnnnnnnnnnnnnnnnnnnnnnnnnnnnnnnnnnnnnnnnnnntgggccacaagtgcctctactacaggaccagggtgttacactaacttataaaaaggggtttagcgttaatgattccactcactctggtctcaaatacttcttattttgaataagcatctagtcaaacatttaaaagtagtgtcaacatcttttaaagattatttggatacatgagaatcataaatataaccaaaagaaagaaaatatagcagcacacagacaccaaagttaaaagttccaaggaattaccatgttttgaaatataatcaaaagattccaaggcctctgaagttgtccgatatatatttggcgacaagacatgcacaaggtgctcatcaacccacctaaaccaataattcaagacaaattatgttaccgtagataaactccagtttgtaagaatgttaagagagtaaaatgttggtcactcgtgcaaccagggttcgccatgctacttctagaggaatccagctcactccatcaagggtaaagcctaaatgcagccaatttagtggtagtcggcttttttgtttttcatctttcagtttgtgaatcctaccagaaaatgcataactacccctaatacaagataataatggacttactggttgtctctagccttggaaacactactatgaccagatccagagaaaaagtctataaagtaatcatcagatcataacggataagctcttagtttcatcaattaattttagtggtaaaaacacaatgaaataaagcaaagaggatagttgatggccatactgattctgcctggccttgaaacattatcaccagatccttgggaaacatgtaactataaactatcagatcgcagaaaaaatgtagtaatagtgatggctatgctgatcctgcctggtgttggaacattacaatgaccagatccagggaaagaagtctatcatgtaactatcaatgcataaacagaaaaaactgatggacaaggtttttgttcaccgattgatttacattgtaaaacaatgaaacaaaagtaaagaaatactataaaagtagaacatattgcacatactaatgccatataaatgattaaaaatttcaagaggaaagtagactttaaacaatatttgtttctagaaataggagtactataacattaatgatttgagaagctagaaccaagacctgaaaaaaaaataacaaatactaatgccacataaacagatgcaagtaatggagaaatacctgcgccatttgggtaccgagctc

SEQ ID NO: 48905 - DNA, 1321 bp, Oryza sativa
  unsure (1)..(1321): unsure at all n locations
nnnnnnnnnnnnnnnnnnnnnnnnnnnnnnnnnnnnnnnnnnnnnnnnnnnnnnnnnnnnnnnnnnatttttcttcctcttcattagtggctttatcatcagggcggaccctttgctgtaatatattgattatatctaccaacaacagatgtaacaatacgttaactctggagtttaacacataaaaagttattttacttaaaagttgaaaccacaacaatgtaaaggaaccagaccggaataaaccaatatgaaatgaatgtaacctgatgaatcaaccagctgttcaccatctaccatcagtattgggaccttcttgtactcagaccacttgatttccttcttgctcaatggattaacttccacaaccttgtagggtatatcatgatagtctaggaaagctgaaatgaagcaaatgaagaatctttcaactaaaagaaattatgccagaacagagagatcatcaatgatttcagaataacaagtgaatgatctttagcaagcaactttcaagcttcagaaatctagaatacctctatgctctaagctactgatatacagatcacacttacaatcaggattgatcatagactcacagtacgatcacacttagttatcgaagtgtatatactcatacagcagataatttgtgaacccattgacagatgacaaccccagtcccaatagcattatgaagtttcacgtacagtaaattattacatcatgctgccaatgaatcagattgctgtgcaagtttgtaggtgagggtgacacctgtcaaaaaagggatggctgatgtactaacaagtaatgacagttggacaaaaggaaaacaatttttacaacaaattctggaaggggtctgattcaatgaataaacttgaccaattcttagctgggaggctcctctcttttgaagttatgcaaaatgtaccgacagtccttaaacatgtcatagatgggcacagatgcacagttggacccgtgatgatacattaaattaagggcttaaatatgcaatttgaaagttcaagaaccataatgatagaagaattgtactctactgactatgttaaattacatactgctacctaaaaacgcttagcttgtaagtttttcattaccaacaaatcaataattatcccctcaacagaaaatcaggacatagaacaacacatcatggtaccccatgaactatttccatgaagctaaacacaatactaccaaaactcagaccttgagctatttcaggagnnnnnnnnnnnnnnnnnnnnnnnnnnnnnnnnnnnnnnnnnnnnnnnnnnnnnnnnnnnnnnnnnnn

SEQ ID NO: 48906 - DNA, 4373 bp, Oryza sativa
atgggagaaggcagtttcttgagtaaaaaatgatgacgagtacaccaaaaggctcccatcggatggcctattcagctaaagaaaaagccaaaatttgaattttcaaacttaattttgatattgattttgagatattttcaacgtagtttctttttcagcattagcttttaagtcacaaaaacacatgtataaaagctttacctacaaattcatttttattctctaataagccgttttggcttatttagaaaaaagccaaacgatgaggccccaaatttttcggtttgatttttaagttttcacgctcttctttggttggcattttagaaaaaccaaataaagaaaaacggatcaaaccaaaccgaggaaaccaaatgcacacccttatcaactaaaactaagtagctcctaaacaagaaagcgtggatttttttaagcaatgtgtgtttgaaagttcgtacgtgctgatgtgcttatctacccaatacctaggacttgttaggcagagtttcaactctaacttagagctagagtccatccaaatagtttcagctctacctaacaagggagcgaagcggagtgaagtgcatcacaaaataaactagcgaggtaaagctgggtttaaaccgcgcttcataactctagtccagacctaactcttgaaattaaatttaatagttgaagccctacccaacaggatcctaatatcatcatgtttctttcatattcacatgtccaaaaccgagaaccttatgcttttgcttttggtaaaggtgtatttctttcgtctcataaaaaacaaacataataaaaaaatatgatataggccttgtttagataaaaaaaatttggccaaaaacgtcacatcaaatgtttggacacatgcatggtgcattaaatgtgaggaaaaaaccaattgtacatttaggggtgaaaacggagcggattcggacggataatagctataccatatcctaaaccattttctttaagcggatgcggagcgagtgcagatgacgtgcggatgcggatgcggagcggattatttcggacgtcggattcggtgcggagtcggtgcggactctgttcggaaacagacaaaaagttgtcggatgtcaagtttgtattcaatccatacaacaagagggcggcaatacaattgccgcaatacgatggccaaacaacatatgaacatgatctcagctctctaggaaaaaccaaccaaaacacatcaataatataattttgcttaatataacacatccatcaaaaacataatataagtgttcagttcagcagttcactgcgttgcttaaaatttaaaaatatagtgttcagttcagtagttcactcatcagtatgacaggcatgaggcaatgaggcatacagcaatataggcatacagcacacagccacacaatacagtagcacactgcatacagcacacaacacactagttccatacagcacactgcttacagcaaacagcacacaacacactgtcggcggactaaaaggaggagcggcggcggtggcgccagcaggctgtagcgatggcacggcgcacctatggtgccatgcggcggcgcatgtgggagcaggagaagggaccgagagaagagtcgcagagagagagagagatttaggggaggattggattaggttacactatataggctagatgggttgcccgatgtaaaatgggctaaatagagttgttgtgtggtctgaaaggtgcggattatccgccaaacattacatcggataatccgattaaaatatcggataatccgcatccgtcggatatcgttgataccatatccgcatccgcatccgcatctggccggatatctaaaaatttttaccatatcctcacatcggacggattcggatcggatcggatcggataatatccgctccgttttcacccctatgtatagtttatatgtaaattgcgagacgaattttttgagcctaattacgtgatgatttgacaatgtgatgctacagtaaatatttgctaatgacgggcttaataaattcgtctcacagtttacaggcggaatctgtaatttgtttgtgttattagtctatgtttaatactttaaatgtgtgtccgtatactttaaaaactttacataaaaaaaaactaaacatacctatattactatgattttgaataggttattagatttaggtttaatttttttatagtacagagggaagtagatgttgagccgtggacaacaatcccgtcatccgtcgttaacctgcgaacccaactgttccgcgtatttttttcttcttctccaagaagaacgagcgcaaaggtatcctccgaaaacaaaagtctatttagaaaaccgatccgtcattgggcccttagccgcgataataacacaatttaatagtagttgaagtactaatacgtaaagtatcaagggttttaggcgttccatccagcaccatccaggatctcccttgtaattcctaaatccgtctcttcttccgccggcgccggcgaggcaaaccagtccaaaaccctaacagccccgctctattcgtttgccaagatgaggtcaatccgagcggcgcaagctctggcctcccgctcgctgctcctctcctcgcgcgctctccatggggacgccgcctccacggcggcggccgcggcgggcggcgggagattgggcgtccagccgtcgcccccatcccaggcatcatcatcatcatcctcgcgggccatgccagctggaatcgctggggcggtctccttctccctgaccttcgcgacgatggcggcggcggaggccaaggaaaggccgcccatggatctgctgccgcagaacgtggtgctgtaccagtaccaggcctgccccttctgcaacaaagtcagaggtgatgtgctcctgcttccgtgcactcctccaatctagcgttttcgatgtgcattagacctgataaaaagtacttttcgtggtgatctggttacgataaaatagttcactagctgtaatttgcctttttatcttaatgattactatcgagaatatagattataatttgtattttggttgggaggctgctgtagaagctgtttctgaggttgggaggattcaagtaaccatagaagttaaaggacagtcaattgtcatgagtttggcggaccaacaatgtttctggacaatgcataaatctacagaacataagtttcaccgccttttgatagtgttctctactttcattgctttgaaaatagctaaatgtagaatacatcccactgaatccatacgtgtccatagactacccaggatttaatgccaagagcactgctgagaatgcaccaaggctgattgcacaacgactggatgaccagtgctaagcctagcaaaccaagcaatacctgcttgtaaaacctttttcattctttttcatctatccaacctttttagataaaaaagtgaatgaaaatattttgaacaatatgagttagcgaggtccctatgcacaggtaggactattcacattgtgagcccaatatagtttctttagctcgtaagctgatagggctgtttggaacagataaatagaattacaagaatggggaaaacacagaaaatcaagtatcgctaatttaggtgtcatctgaaataggtttgttgatgctttacagaaggtgaaggatatttgaagggaactatctttcgacacagagaattgattctaaggtagtagattacagaaaataagctcccatcagttagcatcaagatttctggatgaggtgaagaaaaccacttctatctgtttaaccaaagtacagctaatagaagggaaaaaaactaacacaatacattgggtccatttcaaaaatatggaacatattccatcactccttaagaaaattgggtgcctgctttgtaaccattgctatcattctcactaacaccgtcttgctggtgtcaccaaagttgcctttactgttcttccttgaggccacagcagagctcaccagatactgctacctgagtttgtcccctttgtgaagcttctgttgggcctgttatcttgtccatgcactcataagtcatatcagtgtggggaacattccaatggagggtaatttagttaccatggttgcattgtttgcattatgctattatccgccagatcactctaatgaggccatctgtggatcactcccatgaggccatctctgccactcactgagtggctttacttgtgcttcttgtcaccttacagttcacatgcactcattgaactgaccacctcagggtccttgtgttcgttgttccgttttatgtaacagacttcatgacatcactgtagtgtagtcctgctacccatgccat

SEQ ID NO: 48907 - DNA, 855 bp, Oryza sativa
  unsure (1)..(855): unsure at all n locations
nnnnnnnnnnnnnnnnnnnnnnnnnnnnnnnnnnnnnnnnnnnnnnnnnnnnnnnnnctttttcttcgttttgcgtgttagcttgtcgtttccatcgttgcgaaggttcgtgagtgcgccggaagtattcaagaagattaattgaagaccgattattgcaaggcaagtcacacagatcccaaataaccctttgagcatgttgaacccgtttaaagctattattttatttcaactatgcattattttcgaatgtcattgggtggtgaacctttccccgttaattaatggcctaagatgactttattttcctatgggttataatttgagtagcatgaaccttatatattggattggttcagctaaatgctatatgtatgtgtgcttagctatgcttagaaacattagctaactaaaggggataattataaactatattatattattttaattatgggtatatttaatggtcgatcacgatggttaatcgtgtgatgttaattaattgataaataaaatctggttaaggtgggttgtgagcatatggttttgatggttgtgctcatgacaattaaggactggttcgcgagctactgttgtgaaacatttatcgtgccaaccacaagccagcgtgggcaacggctttatcttttgtatagcatgattcatcatagtgtgccagactgtgaagcggcaagaagtccgtgggggtcgctggggagtccattgcctctggttttgagggggagattatgatccaggaacggtgcactgttttgagttgtgttgtgcaaagggtactgtcacgatttcccccattgcaatgccgtggtggtatttcggggcatgacaacatgt

SEQ ID NO: 48908 - DNA, 2965 bp, Oryza sativa
  unsure (1)..(2965): unsure at all n locations
cagcatacagtagattcttatcccaagatccaccaaaatcaagggcgcaaactctcaacatatcctccaaaatctgatttacttgctctgtctgaccatcggtctgcagatgatatgctgtgctaaagttcaaacgggttccaagttcctcttgcagcttatgccaaaactttgacgtaaactgacttcctctatcagacacgatcttcttcggcacaccatgcaaacagacaatcctcgaaagatacaactctgctaacctctttcctatataagttgtatgaaccggaagaaaatgtgccactttcatgagacgatccactattacccaaatagaatcatgacctgatgatgtccttggcaatccggttataaatccataccaatttcttcccacttccattctggaatctgaatagactgcaaacctgctggtctctagtgttctgcttttactcgctgacatacgtcacggagtgctacgaattctgctatctctcttttcatactgaccgaccaaaacttctccttgaaatattggtacatctttgtgcttcccggatgaattgaatattggatctggtgagcttcactaagagtcaactccttcaactctttgttgtcaggcacacacaatctttcacccatccatatcgttccatgttcatcctcagtaaaatctcgggctttatccactcgcatatttttcttaagctctgctatctctggatattttgcatgcgcaacgagtgtcggctgtgcttccaaagcggcaacaaaaccatgttctacaattcccaaattcagacgttctaggtcttgtatcagttgagtacttacttcttctaagcatgttgcattgcaataatttttccggcttaacgcatcggcaacgacattagctttaccaggatgataatctatacacacatcataatctttgatcaactctaacaatcggcactgacggagattcaaatcgggctgggtgaagatatacttcatgctcttatgatcagtatatatatctcagaacgattaccaatcaagtagtgtcgccagatcttcaaagcatgaaccactactgctaactccaaatcatgagtcggataattgtcttcatgtgtacgcaactgacgcgaggcgtaagcaacaactctaccttcttgaataagcacccatcccaaaccttgacgagatgcatcacaatacacttcaaaatcctttctctgattgggcagaatcaaaattagagcggacactaatctcctcttgagttcctcaaaactctcctgacactgcgaagtacgaacaaacttttcctctttcttcaacaactgtgtcattggcttggcaattctcgagaaattctcaatgaaccgacagtaataccctggtagttcaaaaaaactcctcacttgcatcactgtcttcggtggaatccacttagtgactgcttccacatttcacgaatcgactgctactcttttagtggtaataacatgccgaacttacttctttcnananccannananaangaattcacacttgctgaacttgggatacaactaatgctccttcatcttctccaacactacgtgaagatgattcccatgttcttccttagactttgaataaaccaagatatcatcaatgaaaaccacaacaaactatccaggtattccatgaacacattattcatcaaattcatgaagaatgtgggtgcattggtaagtccaaacgacattactatgcactcgaacaattcatagcgagtcgtaaaagttgtcttaggaatatcctcctcgcgaattctgaactgatggtaacctgatcacagatatatcttcgaaagcacagttgctcccttcagctgatgaaacatatcatctatccttagcaaagggtacttattcttgatcgtaacatcattaagcgctctataatcagtagacatcctctttgtcttgtctttcttctcaacaaaaatcactagagcaccccaaggcgatgtgctgggtcgaatgtatcctttctgcaactgctcatccacttgcttcttaacttctgccatttcttcggctgccatcctgtacggtctcttgtagatgggagctgtacctaggaccaaattgatacggaactcaatgtctttctttggcagcatagctgtcgactcctccaaaaaaacttcagaatactcacaaaccacaggaatgtcttctaactttgggacatctttcatgacttcatcctgttgttcactttccacttaattcaagcttacttctttcttctgaataaatggagattgaattactaccacttctccatttcaattaaccaacgtaattgtgcggcttgcacaatcaataactcctttatgtcttgtcaaccaatccattcctagtatgacatctaggtctttgcactccagaaggataagattggctagaaaaggtgacccttggatttctatcatcaaagaggaacaaaaactaactaatgttaagctattacttggtgtattaactttcatgggagtactaagttacacttttcttaacccgtgtacccaaacaaatctcttggatataaatgaatgcgtagcaccagaatcgaataaaactgtagaaggaattgagttcacagggaacgtacccaaaaccacttctgacgctgcttgagcttcctttgtagacacatgataaacacgagcttgaacgaccttgggtccattgcgcattgttttagggcacttatttgcaaaatgtccggtatctccgtagttgaaacacataaggggcttttgttctgacttcttctttggctggtggggctgcaaagcttgagactgggcgggcgcggaactggattatggttgttctgatttccactgttgcctcgnnnnnnnnnnnnnnnnnnnnnnnnnnnnnnnnnnnnnnnnnnnnnnnnnnnnnnnnn

SEQ ID NO: 48909 - DNA, 1522 bp, Oryza sativa
  unsure (1)..(1522): unsure at all n locations
tcaaattgttccatggtttctgtagagaagcaacagtcgaatactgcaagcataaatatttcaatcaatttctcttcaagtcaaattggattctaaaaggcatcttagctaacattttagtaacactgcagaatgttagcaagctacttttcccctgtgaaagaaacattagcaagctactccctccttaccaaaatataatagcttctagcattaaaaaatatctcaaaatatagcaacttgtacacctgcttcctcttctcaaccaatcagagacatttctcaattaatttcagcacctactttcccttgtgaaccaatcataatttttttgctatttatttctacatactttcttaatacttgtgccgaactccagacgttcttgtatttaagaaaatttggnggnatngntnaaaaatctgtgaagctatcacataaggaagtagttgttttatttacataattaattcagagaaaaaaccgatatgcatttcgtagacttttcaacaacatattaaaaacctatataatccatgaaattgtattatctaggttgataagtaatattaccgtatctattaattgagtgaatgtacaaagcagccccatttccaaagctagaatcaatgacacattacacaatttcaccaattccacgcaacctaacccttccatgttgctgcagcgtttccccagatcctcctcagcatttgaaaagcaacaacattgcaggaggaagaagaagcatgggtttaccatagacgcggtcggcgatctcgaggagtcgatccggtggcttcctatagaatagcctccgcaacagcgccatgccctccctgccgttgccaccgccgtctctggcggccaagcctatgaccggcacccttccttccttcttctaggaacaacctccatgcgcagcacaatgccaccaaccaacacactttcgtagcaaatctgtcttgcaagagatcaaactccaccccaatgcgccgatgaaatttggccggaaagaatttcgcttccgcttctgactcgaattttttgctggattattatttttttacgataatgcttccatctggacgttggatgcaagcaaaaaaatcggaccccgcgtctaccatgcaaaaccaacaccacccatctgcaagtttgcatgcaagctcatttggtcgcccgcgcctcccatgcaaaaccaacgttttcgtccactgcaagtctgcatgcaagcatgcacgcatttaacaaggagaaggctccagaccaaacacacgagcctcaaatgatgttttccctaaactatgtatctttatttaagatctgatttcaccattgtatttattgaagataaatcattaaaaaatgatctcctatgattatcttttgaggaatataaatgtttcaaccgttaaaattcgatgtttcatgcgtgagagcgatgtgtttcacgtgttttattttttatgtctattccagttcttaggatatttcactggtgctcaacagaaatatttgg

SEQ ID NO: 48910 - DNA, 1145 bp, Oryza sativa
ttgtaattacatacaaggcactcttcatgattaatatacctcaatagtgctatgtacattaactcaatagtgctatgtatattaactctaaaacatgtagttctttgataacttcatcactaaatcagtagttttgtgatacaatgctataaatctgtagttctatgaaaaatttggcactaaatctgtaatttcgtcatatacatttttgaatctgtagttttgcgatagtttagttaaaggcagccttagttaaaatatcgctagttttgtgatatttactcaatttgaaaggccaactaactagctaatttctttgtcatgtttaacttgtcatcatactgcttattttgctcctctcataaaattctaagtttgcttctataataagctttaattcttattaactcgatggttggtttaagtgtttatcagggccttgcggacaaatcaccacatttactggatttttatgaggaatttgtcaacctagaagctgcttctaaggtgtgtatgtcgatctgacgagagcatccaaaggacttgtgttgataaaaaaaattatacattgtttagaaaatggaagtttgtattgaacccaatcaattacatcacggtgcctctgcataactaagatacacacgaccacactcaacaaacaaaaaatggagaatatcatggatttgtaaggaccatcaatcgaaagaataaatcgtcacccatgaacaactccttaaatatatcctctaaatgcacaaagtattaagagccaccaatcctaatactagatctccacccatatacctgggtaaagaactccttgaccaccttctccaaatgtagacatgccgcaaccaccatatcccgcggatcaggcttctgtaggatagcccatgtacgaagccaatggataagacaatatataacctgtaatagtgaagttatgattttttttaatcaaaatatacattattcctgcatagccaaagcaaccaacaagtagcaaatgctcttaacaggacatgtgcttttaaattattatgaattccagcaaggcagctcccaaacatatgggctacactatgcagtggaggaagtccaaatgctacttggaccaaacagaatgggcaaaatcaaaaaaaaaa

SEQ ID NO: 48911 - DNA, 3766 bp, Oryza sativa
agactgcaccgagaactccccatttgaggttaagttctaacgaaactcgtcttgctcctgagttaattgaaaatcagtgatacatgataataaatacaagtttaaggaccacccgtgcattttactcataataaattattccaagccacctattttgatcctataaggtcccttctccatgaaagggaatgattggtttctaagacttgtgcaacagtagccggcttatgcttaactatattttgaaggcaaggatactgttcttttaaggttgaattgcccaaccatttgtctctcataacctgatttgggagctatataaaggatccaaaccagagaaaatcccatttctccttcatgggggtggaccaaaagtataagtccctggccttccactaagcttgagaaagaggtttatcacctacatacttattacatatcaactgttgtcaaaccccttccgtggagagcaacttgaataagcacttactaagtagagccacattcttaatgtccaaaacatgaattcccaaccccccccccccttgttccttggggaggcactttttttctctgaccaccacatttccagtaaacctggagcgaaaatacttaagctttgtaagtatcccctttggtatggcaaagaaagacatcatatatctcgggaggctacttagcactgaattaatcaatgttagccatcctccggtggacaggagttttcctttccaactactttgatgtttttcaaagcattttatcacatctttacaatcggcatttcttaatctcctatagtgaatagggatacctagataccggaatagaaatttaccagtggaacaaccaaagagctccatgtattcattgttaaactcgttcgcttcaccaaagcaatataattagtttttatggaaatttatcttaagactgttaattgctcaaggcaaattttgctacatgacactgcttatgtgtggttttagctctaggacactgcccaaactcacttttgagggaaaacactccataaacatggtaatttgctagtggataccacgccgattaaaataataatttccggttgaagaggagagagaaaacgcgtgaaatgtcaaaaatgcccttaggcccacatgtcagctctatctcctatctctcttctcctcttccagcccacatgtcgctccccgccggccgccggccatgcccgcgcagatggcggtggaggcagtcgttgaactcgtcaccatcgacgtgacatcgagcggctcatcgagatgttcatctggaataactcgttggagaagggcgcccgccgatcggccgcggtggttgtctccatgctcaccgaggggaagttgaatgctctctgcgtcaccggcacccccggcgccatcgagtcagtcgcgtcgctgcattacgcttacctcgacgagctcaacctacttggcctccatgcccatccaccactctctgctaccgagcttgccgctagcaaaatcagtcgttccaccgccgggtatatttcgccggcgtcgtgtgcagtcgcctcccccaatctgcccttgcctctgaccatcacacgcgtgtttgtggggggaggggggattgcggcatcgtgattcggcgattgggatgagagaagggcggcagcggcggctgcggcggtggccatgagtggctcagcgtcgacggggatggggtgcgggagctacggctggcttgcgtcggccggcggtgggaggaagggcgggggtagggggtgggggtggcgaggcggcggggagaaggagcggctgcagctgctccaccgcgcgctacggctgatgggctgccggagggccagggtgcttctgctgctcgccactgcctcccaagcagtgtctacgcgggcatggccggcagccagcgaggagcgacatgtgggcaggaagagaagagagataggagatagagctgacagtgtgcccaagggcatttgcgacatttcacgcaatgtctctctcctcttcaaccagaaattattgttttaatcggcgcggtgtctactggcaaattaccatgtttaaggagtgttttcctctaaaagtgagtttggtagtgtactagggctaaaaccacacataagcagtgtcctgtagcaaaattttcctttgctcaatgacataaagcaataacgtcaggttacgagctttttctaatttatgatccataaaaaaaactatatcattggtatattgcaagatagagagaccatcattcattagatgatgtcgtactacttctgcaatttgccgatcaactttggctctattaatcagtatagccaatacgtcagctataatattaaataatatgggtgataagggatcaacttgatgtacccattctggagttgctttgaacagttgcaactgaaagcattggctgaggagcagcaagcagttgtgaaagggctgcagaaggttgaacaagaactagctgcttcagaaagtgatgggcccgtttctgaggttttccgcaaggtataatttaattccctacctttttggatgctatgtgtttagtttagatggctactgctccatccgttttttaatatatgatgcagttgactcttagatacatttgaccattcgttttattcaaaaatttatataattatcatttattttgatgtgatttaatttatcattaaatattttttaagcatgatttaattttttttatattcgcacaaaatttttgaataagatgaatggtcaaacgttcgttaaaaagtcaacggcgtcacacacacacacaaagaaacagaaagaaatttacttgacgttcctttctgtttctttaagtatggaatcttaataaacagatatatttactgatggttttgcaatctagactttgaaggagttcactgatgcttctggagctgatgtaaggtccttgtcagcactatatgctgaagtagtaagccatcgtgatccaacaagctagctttcaaaactgttccatttggattcgaaccccttttaacatactgagcggtgacagggtaaaagtgcggatgcactagcctattattttggagaggatcctgcaaaatgtccttttgaacaaggtaatattcgatctggaaattctggatgattcccaattctccatcaagttgtggtagaacaagttaatttttacagttttgtgaacactgcttgagagcatcattttttccaaacatgtgacattcactagctcaaagacagaatcaataattaaacgtctgacagaaattattagatctaataaatacttgaattttacgaattgtcggatttaggaagttggtgctctttcgttctagaattttcaagaccaggtaaatctcctgttgtgttcacgatcatctaaattaataaaagcttatatgctggaacagagggaaggtctaaagtactgaacaaagctaaggcttagggtgtgttacagtgttagttcacgttaaaattgaaagtttggttgaaattgaaacgatgtgatggaaaaattgaaagtttatgtgtgtagaaaaattttgatacgatggaaaagttgaaagtttgaagaaaaagttaaaaactaaacgagggcttagtaaatggacctgggctcatgggctggtgccatctgcagcacgttaggtcccatacagaaaatggaccactgaatttaccgtacctaatccctgatcggcaaaaagatctaggctgtgtttagttcatgg

SEQ ID NO: 48912 - DNA, 1195 bp, Oryza sativa
aattaacaagagttcctgttaactgattgattatgtgtgctaaattcattttcttttacctttttaaattaaaaagctatcaatgttcgtatgttctgattaattttctgatcatgtacatatgtaactgtaaatcttatactatatatttatatgtacactgtaggaggttctcctacagtatttttcctctaaaacaaatgttaatggagactttaagtagtaacagcatccttctttcctcttgctcacattaattttgaattcgacaaaaatacagtcacgtctactcttctgaactttgtggggttatttcggaaagcacatgaggagaacataaagcagattgaggctgacaagaagaaagcacagaaggaggctgagaaggaggcaaaccaggaccgtactcctgtaaagtctaaagatggactagtagatagatcaccaagatcacccttcaagtgacatgcatcactaccaattttttattgtccagccgggtcagtttcttctcgacaaatgccacctccattaccattagccattcagaccatcgtggctcaagcaatgcatggctccatgtgcttgagaaacaaggtaacgcatcattatgtacattgcacacttttgttcttactgtattgatgaaattatagtcgtcattaattatcattctaacctataatatatatttttttattttgtataggtactcaacccatgcatgctttctagcttgcaatactgtacagagctaactccgcaactatatatttaggtccgtttgtacatatttcactagacatttcttctattgtacatgtatactagaagaaataggtcagtagttgtaaactaggaaaaggaaagaacgtaagagaggatcagtaggtcagaaaccataggaaattaaggattagtgttacctcgaggcagttacagcaactggtgaatgtatagcaatgttcctgactcgtgctatcaaatgacgcatccaagtgtacaccttttatctagaagcatgtgttgtcaattaattaaaaccaagctagcttacttatatggttatggtgttactgtagctgttaatgtatagaaagaaaaggaacgaatcaaacttcgaattaaatttgaaaatatatcgctcattcaattttatttcaggaatattcgggatgtaaattttttaaaaaaa

SEQ ID NO: 48913 - DNA, 2101 bp, Oryza sativa
gtctgcattctaccttgacataactgttggagggtcattcatgcacaaaactcccgcgaaggcaaggaaattctcgatcgcatatcggaaaatacctcctttgccgggtagtgtgttgagccccgtccagaggcatttgtgtcaggaaggaaggaaccttcttttgccgaacctgaatctaagcccgcaatatcataaagtctgactaaagagtcctccttggagccatctccggattccaaagaaatcaagctccaggttgcactcctaaattcagggatgatcctcatagcgattatgacaaaaccttgataggcatccccctgatagattcatgtgtcccctgaatctattctagaacaggatgatctttgtttcattgaaaaagaagattctggcgagacttttgaattacactccatagaaccaccatcacaacctccaatcgagcgaaagccttgtccctttggccctcaagatgttgttctcgacagttgtcaagaaacaaccccgttctttcaatggagaactttcaggccaaggacaagtttgagacatcaactctagaggatgcgaactccacaaatgagcatgaaagcctctcttttcaaagttcccaagatacatgctctcataaggaatccccagagtactgtccaattagtaccacttcattgtacaaggaccacaaccaccttacgaccctcatttctaacatgttttgaagtgtggttgtggatgcttttaactatcataaatactgcaaattggtatttgtattcacactaatcttgcagcatgatgtctcaatggttgagcttgtgaccacaaacaaaacactaccgggagacaccccggattatcttagtaagttttctttccaataaaagcaagaaccatttcaggtgaagattaagaacgagagacgtacgatgcctaagaacatgggagctacatcaactgttcatgtgttggaacacactttatgaagatcccagtctcacatacttggtttttgacgtctcatgacacaaaagtccaagtgtgaggcagggaggtcgacaagctcttcctggcgggtttcgtcaacctaggccatcttggtttaaagctggtgttagtcttaccttgctgaaaaaagtgtggaagaaaaaaaaaagaaagaaaaagagacaaaagaaaagaagaaaaaaaagaatgggagaagaggaagagagcaagagggctgacgatctagatcaaagaccgcattatgtgcgagtcttttctggctatacacctcgccagtagctattattcttcttggctgcacccagcccctctcttgagctcatgtgccgccttggttagccttcatccactcctagttgtgcacaagttctcgctcccgcagcacctactcgcacacaagcaagaggagacgccctcttcttttctaggtgtttgctactccactccagttggaacttgcatatttgcccaaaaagagatgcaccctacgtctctacagcattctaccaatggaacacgccttcaaggcataaggttcatgcacccgagttgtgtgcataaccgaaccactcgcctgagttggtgtggtcaaagtgccaactgatgagggagttaggtcctaatcttccgataggtattgataaacaatcgatttgggcggagtcgcgacacaactcgatctggcttctgaacgaatacgctactaagccccgcaatcgcagcaccacgtctcctctggttatcaaccgtgcctaaacctggttgacctcgccgagaaggctaatccctgcatgcgaatagaagaacaaaagcaagaacaagatagattgcaacacaattgcatatgaattattaagcactcgaatttggggttccacaaaccgatctagcagcgaaactgttcttaacaaaataatctaagcaaaacccaactctaaacgacgacggctactgattaattatgattagggacgtcctagggttgccctagggcgcacacccccttgggagcccacgacacaattacaaggcccaaaaccgaaatcagatacagattggatgaggtacatggcttgttttgcagattccc

SEQ ID NO: 48914 - DNA, 5291 bp, Oryza sativa
gcccaaaaccgaaatcagatacagattggatgaggtacatggcttgttttgcagattcccggcagcccggtaggaattttgacgtgggaccaaaaccatctgaaattagactccataagctttccaacaagtactcatgggccccaaaattccttcttgatcagtggctaggtccatttgaagttggtgctatcaggaggcctgaatccgaacccaaaacgtgtggaactttatttcttgtcttctatggaccaaaagtgacgtggtgagatgaaagaagactaggagaaggtcttggtttggtccccaatcaacttcttcaatcatccatgcattccttatgctcggtctcttttctttcgcccaagcaactacctctgcaaacgaaaacacacaaaactcattgtgtagcaacgtttgttcaaatatataacaagtaaatctaatgtagaacatatgcacctttggttgactaatacataaggtagtcatggttatatgcgagctagttgtgtcctcatcagccttcccttgccacaatccgcacaagactgatgggagatcgacaattacatgcgaccatagcaccgctccagagaattcaacatacacatcgtgctggcggtaagtacacttaagtatacaaaaggtagcgaaagattcaccacatcttttactcatacttatctttatttgaatgaggcttgagcatacatgggttatgtttcttgtgtctatttgcatatgctctggtttgggtgtttgcgcaagacatctataggtttagatagtctgctttaatcaaattagacatggagtcaaatttgcttaatgaactttcagatgcatatcttttgtggactaaccccctgcaggaaagttttcaaattcatgggtgagtcctcaagttcaattcacactagaggtaagtcagggttcgggaaacaaatcaataaattgcaaacatgcaaagagagtaacacatcacctttcaaggtgcaaagtaagtatactgtcaattgctcctttgttatgatcgtgcaattttatctgtaagtcctgtatgagtttttgcttaatgaaaatttggtgaacaataaaacattaaaaaaaatgttttaaagaataaaagaaatgtctctcgaagaaaaaaaatgaagacaaaataaaattatggcaaatttgtgggatccatgcttcctaagttttgaatccaattcctttttagcgtagatgttaacaattaatcttgaggctatgaaaaaatctttccaattctttgtagtccctctagtatttgttgtccactaaccttttgcagggaataaagtgacaaccaaggagcggtgtacaataacttcaacaccaatcccacgctccttggtatcatagaaagctgtgaagcttgttgcacagggaaccaagttgaacaaatgcaaaacttcgttgcattcaattcagttctaagtttggtaagatccgtctggtaagtatctgaaacactttgtgcatccgcgcctcatatctccaccctgctaagttacccataacctccattgttgccatgaaaaaatatgaaaataaataaaaaaaaaatttaggcacttcatgtgccttgagttacttgaataaaatttggctcaccggtatttcaccccggggacaacatgatgaacattgtcccacggacacgcacaaaactcagcagccagaaccatgtcctagctgggttggccgaaccaagtgttctctcgccccttgcctagcccggtgctgtcatccttcaccgtgtagtcaggtttgtaggtgtccttccttatcctcctgtcgaaacaagaattcggcaacaataaaatggggtagcgcacgagacctaaaagtggatggatgtggagacaaagatttaaacaggttcaggccctctcgatgagaggtaataccctactcctatttgggaatttgaatccgccaggtgtagtattgatctgatgatcatatgtgaatatgcccccctagaggacctcctgtccaccttatatagcatggggggcaagattacaagatagaaaccttaaccaatgcagtatcggtttgctaaatctactttacaaaattagcaaaccaggactttaggccattccataatatacaaggaaacgtaataccgtaatacccatgtcatgatccgttacatattccatagatacaagttatcccctataattagtcggataaccatatcgtgtgggtatggggtacccataatctccacacctcccatgattgtgagttaaactttggtagaaaattgaacacaatttagtttggctccaaatgaaaattgaagcattaacactcaacagatagaattttccaatgatttatcatgtatactttttattctttgctaacacttgttagttgtgaacaaccatctatcatagggaaccttgctaatataagtaattgatatatgtgatatggttatgacaatagaaattcatgtccaactgtcatgatacttgggatttattttgtgaaaatcaaaaattcttttcgagcaatactcctcagtgactatattattacctaccaaggccatatatgattctcattacaaaatcctgatatatgtttaggctacatggcattacattgagctttgtcaaattcttgtgacccgtgtgagatgcttttcatactttcatgatcaagatcacgtacactccacatacacacacttatgctaaacttctacactgcaagctagcatctctcttccattatttattttatctattatccacaaaataaaaactccatgtcatttatgccttttcctccaaaattctttcaaaagaaaaaaagatagagagaggcatggctatgcaaaagaaaaagaaataaagccttgctcatacaagtatggagcagtgaaaacaaaaagaaagagaaaaaaaacttgctcatacaaagtatgtggcatgatgaaaaaaaaaagaagaaaaaagatagccatgcactctctcaaatttccaaagagagaaaattggaggaggatgtatacgaaaggagttgttgtcttttattttcctttttccatccacagaatttgccatacacgtacacatatcacacacatgcacattcttgatcagagagtatgacttgctatctccttgggtccggtcttttggctttgcaatatgtgatgcaggtatgccccaattgatccctaccaagctccacctatctagccttttagaatagagacattttgacaaacatgccttggtgaagatccacaaatcaaaccacatgagtgatttgagagaaagtccattgaggagtatagctactttgtgaaaatatatgaaaaccccaagagattgacaggaggaacatgaaggacttgagtcatgaccgttccatttatcaattacccaagatggtaagttagatactcaaagttcacaggtgcagatatggctaagaataatttgtgtacttgtattatattttgggaaattttattccatattaatccttaacctttactcgggacgagtaaagagctaagtgtgtgggtttgttgacggctgttaaatacaaaatttaagccatcaatatctgcataaaaccataaatataaacatccaacatagttgtagggtttatttctaacaatttccacgagtgttcgtgtatattcgtatgcaagtgacaaactacctaagttgagaagaaatatacctgaaggaggaggagaatcaaaagcgtatatgaacatatggagttttggacccagaaacccaattaaacacctccaaatgggccttccatccataccaatagaatgaggggcccaaaatgaatgtccacgccgaaaatcggcgttaatggagtcggctagggttcggccgaaccctgacagaggctgctggcctaggcccaagttcagttcggtagtgctccacttccatttgacggttatggcgttaataccggtagaaaccgtcatcagaatgggacacttggcaacacatgagagaagatgctctttgaatgcttggagcatctccacactcccaaggcacttctctacctataaatacccctctcatcctcacttgtaaacacacacttgaagcatgagctgaattataagaggatctattgtactttattttatacaagattagggagagagttgagtagaagatttcggaggagctccggagttgtcggtaatcctcctcttattctttctgctctgtttattactctgattataattgaaatatcttttgaataatttagttttgctctttaagaattatttattggttagttcctattcagagtgtgggatcatcgttcactataatcaactaaactatagtgattgctttagtgagttataaacactagagtagttattaactgcgtagatgcggtgtctaggtagttgatttccgatgtttgctccccatcccacagtaggtgtgaggtgggtgtagaggtggtgatagccctcaatatcactaagtcctccctgtccgggtgtgcagtacagcgatatctgggagcagtgagctggccagtgcccgaagtacctcattaggattgaagttaagctttccgtagacattgttcttcaccggtgaaacctctctatcctttgcctatccatagcttcgtgtctttggatgaacctgaaccggagttagcacacacgttccctgtggaaatcgatacctaagaatactcccgggtgaagtgctatattggtatattccgtgcgcttgcgggtttatttatgatcgtcagaaataccaacacctaagtgcaaccacaaattcctaccggcctatcgtttgccgtaccgaggctttaccctaaatcgtgtctagcctaccgatttagccgcagccattgttgagtcactcgctcattagtttgaacaaggtgtcgccccgtgtttcgttcgttcatccatgttgagtcgttccttagtttagagccattcagagccgccggtttcgttcgccggtttcggttgatcatttggatggtcccgtgtcacgtagatttgactcgttgagtcggtatctcgtaaggttcgctcaccaatgttaatctatcctttgatcatatttccttttgggcaataatctatgtcaaatgattaaggtttttcggttattagtaataaaagagttcaccttgtaaaattcatatctaattcatccgagctccattttaacccattcaaattgcagtaaattcgt

SEQ ID NO: 48915 - DNA, 17726 bp, Oryza sativa
aggttgaggttttttgggacggaggagtagcttagaaagaattgttacaaaattcttggcaaataggctgctcccaaaactgacagacttggcatccccaaaccaaacagtgcttttatttgaaaaagagctattcatgataatttcatatatgtacaaaatctggttcaacgttgcataaaaccaataagccaaccatactcttcaaattagatatcccaaaagcattcgacttaggcaggggcagatccaacatgggtgcaagggggactcgagtcccccctacacccacaagacccatcgatacccccggagcatccccttcgattttttcaccataaatgataaattaaaggtctctagatgactagaggtgaagaaactgtgtaattgagcccccccacaattttttctttctggatccgcccctggactcaggccctctttatttaggcttaattataagccaacttataagtcgaaaagtctaagtctaaacaaataagcagcttttctgtttggcttttatgaagctataagccactctaacactattaagccaaaagctaggtttgagaagctttttttttttttgcttatgtgaggtagatgtatgacaccatcactaaacttaggacattaaatccactagcttataaatcatataagtcaataaactgatttaaaagtctagaccaataaacctaaccttcaataaagagggcctcagtgagttggacttatttattgacagatctcacaacttttggctttggcccatagatggagaaactggatctcatctctcttgctcacctgatcgtccaaaattactgatgaatggttctacaggacaggaatcttccatgcaagaggttcaagactgctatagggtgatccactttcacctatggttttaatcctcgcaatggaggccttgcgtaagatattacccgcaactgaaacagtgggcctcctgtcccaactcaattgcaactactgcaggtttaggtcttcgctttatgcggatgataacatgtgatcatgaagtatatacatacaaccaagcatgagaaatataaaacattgtcaaacaatgcatcggatgaacgggggatccataaaatattaaagtctaatgagttttgaaatttagttcggcctctagagacaacactgaattcaaacagacctagcacctccatgccatctccgatttgggtgatcttggacttgatggaaagcttatctctctacctttcaaacgcattcggtctcgtatccaaattcattccgagttaacatgaatcgtcaaaacaaggcagtgctgttactgaaacctaacttgggtcttgggccttctaatcactggtggagaaagcctttttactcccggttggtaacccccctatagtcccggttttccaaccgggagtacgaatccgggactaaagatcgctatctttagtcccggttcaaatacccgggactaaagatcggttggtgttacgaaccgggaaaaaaaagaggaatctttagtcccggttgataacaccaaccgggactaaagagagagtagcgtcagttcagatggtgccctttttttccagatttaatctctatattttctcccgaatctagtgccatgtatatccctaaatcaatccccaaatccccaattcaaagtaacatcccaaatcttaagttattataaacataaatcaaatacatcacaaatccttaaaaaagtgcactcaaatcaaatacatcacaaatcctaaaaaatacacacaaatcaaatacatcacagattatgtcacgcccagaagtttcccccttttcttgttttaaaaattggttaaataaattgcccgaagaaattatcttaattaacctagagctaaatccctagttaataaatgcaattaataatcggaaatagcgtggtggaatttttcttgagttccccatgctccaatgcattaacaagatttttagtggaattttcacagccctggaaataattttaaccaattaaaaatcaccaaagtgcaattttttaatcccaggaaaatccttttcctcgttttcttttcttttccttcctttttctctagatgggccgtcggcccatctctctccccgcgctcggcgccacttcctgggccggcccgctcctcctttcccctccccgaagtcctccctccctccctttctctttctggcgccgacaggtggggcccacctgtcggtcgtcccctacctccggtcgttggagccggagctccaaccgcccgcgccgccgccttctccgctccacgtcgcgcctccactccgcgcccgcacctcgcgcccacgtcgccgccctttccccgcatctcccgcacgcgcgcgcccgcaagtggtgggggatttgaaatcccccaacaccctctctctctcctccacctctccacgtcgccggccaaataggggccatccccggccgtttccgcccctccctcgcccataaaaaccctcactcgagctctctctctcatttcccccattcaccgtcctctcccacgccctctaccgccgtcgcgccgcgctcgccgagctccgccgccgccgcccatctccggccgcgtgccgtcgccactagggccgccgccgcgccaagccgccgccgccgctagctccgccgccgtgtgggccatctcggccaccgcctcgcgtcaccggaaccccaccgggaccccatctccctcgcgagccggtgagctatccattcccctccgtctccagccagccactttggttgtcgcggtcgccttctccatccctaactcctctcctccccttctctaggtgtcgccgccgctcgtccgcccctcctctcgtcgggtcgtcgtcgccgccttcgtcttccgctccggccaccgtgtcgtcggtgagtcctccctctccctcctttcctcaccttcccgcgagcgccggccacgccgctgctccggccatgcgccgccgcctttcggccgtcgccgccgcttcccgcaccgccggtcaccgccgtcggtggccgtgcctcgccgtcgcctcgccttggtcggccggtcggccttgaggccgagccgagcccggccgacgccaccctcgcctcccctttgagccaccgcctggtggggcccacctgccaggcgccacctccttcccttttgagccgctgacctgtggggcccacgtgccggcgcccccttcctctcctctttgagaagctgacccatgggccccgcctgtcggcagccgccccccccccttggatgacgtcagccctgggtattattgcgcaataattaattaaggactttttctttattagtaaaaacacagtttatcttctaaaattcataagtaattcatccgagctccgttttaagtccattcaagtctcagtaaatcaagaaaaatgcaaataatccattaaaaatggttttgtttcctgtttcagtagtcttataccatgttttgcttgtgtgctttgtttgtcgcgtaggtttcggccgtttcgtcgatccgcggtttctcgaaggcgttgctgacgtctcgtcaatgtgagagcaaggcaagtcatgctttacatttgatcatattgtacccaatttacaaacacccctcctttcctcaccttcccgcgagcgccggccacgccgctgctccggccatgcgccgccgcctttcggccgtcgtcgacgcttcccgcaccgccggtcaccgccgtcggtggccgtgcctcgccgtcgcctcgccttggtcggccggtcggccttgaggccgagccgagcccggccgacgccaccctcgcctcgcctttgagccaccgcctggtggggcccacctgccaggcgccacctccttcccttttgagccgctgacctgtggggcccacgtgccggcgcccccttcctctcctctttgagaagctgacccatgggccccgcctgtcggcagccgccccccccccttggatgacgtcagccctgggtattattgcgcaataattaattaaggactttttctttattagtaaaaacacagtttatcttctaaaattcataagtaattcatccgagctccgttttaagtccattcaagtctcagtaaatcaagaaaaatgcaaataatccattaaaaatggttttgtttcctgtttcagtagtcttataccatgttttgcttgtgtgctttgtttgtcgcgtaggtttcggccgtttcgtcgatccgcggtttctcgaaggcgttgctgacgtctcgtcaatgtgagagcaaggcaagtcatgctttacatttgatcatattgtacccaatttacaaacaccctgcatttctattaaatgttgcattcttttacaatgtcatgtgggatgggtcctattacttagccatttattgtttaccatatgccattgataacctgtgtatcaaaatgattagatgttggtttaggaaatgcttagccatgcttagctcaactagtacacaaaaagggatcacattattacatagactttgtctattagcatagttttggattggtgccaccgcaatggtgttagttaattaaaatacactgaatggtgggctgtgggtgcatggttttgctggtcgcacccatggcagttaaggaccggttcacgggaaaccctgggagacttaccgtgcttaccgcaagcgggagtgggtaactgcttgatctgaagtatagctcgaccctttcctaggcaccggtagcgagggtgggcgtgatggagttgggtcggccgaggtgttcggttgtccagctgccggattcaccgcggcgcaagaggggaccgcccactgccttttgaggggtgggggtgaaaccttagcgtggtgtggatggttaggggagggttacgtggagggtcttgtcacgatttccccctttgcagtatcatggtgatacttcggggcatggcgacatgtgtggaatcgtgtcttgtgggtacagttgtacacctctggctagagtaaaactattcgaatagccgtgcccgcggttatgggcgatcaaccagattcaccgtgattagtctcacccctagtttagcttaatgaactggtgtagttcaggtggttggttgggcctgttgcaacgtggtgtagcgttggatagtgattggttaatattgattaattactacagctgttttactgctttcaactactgttttgaaatgcctgctttatgcaaaagaacccctagcttcctttggttatatcctgcatcatacctcctcttccggtatgacttgatgagtacagtgggtagtactcagtcttgctctcttttcccccacaccagagttgaagttcttctcagttggagccgtctcagagaggttggtttcgtcgctgcagtcaaggtttgcctgtggagtggagtcgcccgctgctgaagtcaagcttcccggtttagctcgcttttatctttcccgctgcatttgtaatcttttatatttttgtaagacgtgggtctgtatgtcaacaattatcgtttgtgtaccctggctggtcctggacaggggtttaatgcacattcagcttagaaattctggttcgagaatttctgggtgtgacagattatacatctcatatccatgcaatgaatcacaaaattatacatctcaatcaatcacaaattatcagaaaaaaaaaagaaaagaggccggccggcagacgagagggcacgaccgctgccgcgcgtgacacctttggccgcccgccatggccgccgccgggcgcggccccgccagctgccgccgcccgccatggccgccgccgccggccaccggatgggaagtgagggggaggagaggtgaggaggaaggcgaggagggggaggagttagatctgtgaagaggaaggggaagggatttgtgaagtgtaggagaggataagggatagggattatatactacatattaaattttagtcccagttggtaaaactaaccgggactaaagatcaatataatttttagtcccggttagtattatcaaccgggactataaagatgatctttagtcccactaaagatcctcggccccctgacagactactgacacgggatgaaccgggagtaaagatgatctttaatcccggttggtgatcataaaatagctgtggtgtttttaaccgggactaaagatcatttttagttccagtttttattgcaaccgggactattaatagactaggcccatctcggaagtgtctccctccacctccacgaattaacactaaaccctagatctattttctctataagtgtctatgtgcaccctctagaacatttgggttttgtttagttgaattttgccaagtgccattcaccttttctctaatcctcgctcgattagtcggcgactatagattcagagctcctaatagttggtgtgttgatttgtcgggtcgattagatctaccacttcaatcagaactatttcttcgtgcttcatcacctattcgtaatttagattgcatcttatcttgttcctgcagtgttctctcatttgcattgctgagatcatcaaccacgtgtcatggttggtatgacatcgtttgtggtgtagcgattgcacgacgttctagacttgttctggttggtagccacattgcaaatgttgtactcgatcaaagcaagaattatcctctgaccagaagatcaggccacgagagagagcttcatcaaactacctccgtccctaagtaagtgttgttatgggttttcgtatcatgtttcactgttcatcttattttaaaaaataatatgattagtatttttattgttattacataatagaacataaatatattattttatgtatgactaaatattagaagaaatttataaattttttaaataaaacggacggttaaacattaggaaaatattttttttctatttcttttgttcgatccccgctcccaatgaaccccatcccttggcaggcagtcaggtcggccggcaggttaggtgcatcgcatcgtcccaagacctgaatagcggtggcggtggagagatatcgctcacatcaatcaccaccacctggccatgctgccggcaggcagtcctcccacgtggcacttgtatcgacgtgtgggccccaacccaacacccaacggagcctctcggaccatatcatcttcctaccggcttcctctcatgtgctccgctccgttcacaccagcagaaaagtctctctgcccacgtgtcaaagcaccggtggatgccaccgtttgcggcgaggccttatatcagaaggcgagcgatacctacacaccgcaggatccaatccacttgcatttcagctcaggaagcctctgctactttgcttggcctgtacagtaatacagataaagacctgcagttctttggtctctttagtgaggactgaggagtttggttggagattgttgaggagatgggcatcgtcgacgttgtctccgagttctgctccgtgccgaggactcgccgacacctcaagaagaggaaacaattccaggtaatactgaacatgttaatccattaatcgcatctccctcttctgtcgatctctgtatatctgtcttccagtcgaatttgtaccatgatagtactagttgacagttgtgttgttggagtggaaaaaacttatgcctatatcctcttcttgtttcagacagtggagatgaaggtgcggatagactgcgaaggctgtgaaaggaagatcaagaaggcccttgaggacatgaaaggtgcttaatcatatttttgctgctgcttcttctttcacacgctctgaaaagcaaaacaagggctcctttagcttttgttctttgttgtggaaatgattgacgaatctgtgcatgtgcgcaggggtgagctcggtggaggtgacggcgaagcagaacaaggtgacggtgacggggtacgtggacgccgggaaggtgatgcggcgcgtggcgtacaagaccgggaagcgggtggagccatggccatacgtgccgtacgacacggtggcgcacccctacgcaccgggcgcctacgacaagaaggcccccgcggggtacgtgcgcaacgtggtgtccgacccctccgccgcaccgctcgcccgcgcctcctccaccgaggtccgctacaccgctgccttcagcgacgagaaccccaacgcctgctccgtcatgtagctagctgtgtgtccccgggacgacgacgaagcagcctagcagggtgtttttgttgccacttgcagctgtaataatattctgtgtgtccagattcgccatccctcaaaaatctttcgtccagattcgccatccctcaaaaatctttcatagtattatagaagggaggaagtagtaatttttccagctgtagtaatgttctttgctttagatagggtgttgtgttactattggactctcttttgcttgtgcttttggtttcagatgtaaaatactccatcatgttcttgtttggtgagatgaatcttcaaatctgcaaagttgcagatcggttgtttgagcttagcatgattgattggggtgggtgggggagacgtgtgaatatcgtactgtatattcgagttttgggtgggctcacaaggtcggcagcgccgaaaggtttttttttttatccgaggcgctgattgcgacgttctgaactgtagcccgatgctggtgtggcattattttggtggttggatggtcagccgataattctaaactttgaatcaaagtttagtttagttatttttcattacatcaatatgtcatatacacatattagttatatcatctttaattttaaccaaaatctaaactttgcgctgaactaaacacagccaaggtgtactatacgccaagtacgcgctatatattgctattaatattttaaatatttaaattttaaacatatattaaatacataggtttttcaattttattaaattaatataagtaaactttgttttaacgaaagttatatgtaaactttattttgaattcataaggacacaacaattttatttatctatagttttaaaaatcaggattagtatctatattgttgtcgaaatgacaataacttctctcaatgaaatgattggatggtaaaagcaatgtattaatgatgaaatttttttggatcccctattacatagccctaaagttttgtgtgagccttcttgggccgcaacacctcctagcccttttgttgaagacgagccccattgggcgaaccccttctgcttcgcgccatggcttcacccaacagagagacttgatgacgaaccttatggcttccattcttcgacttcgccttacagcttcatcctatggcttcacctccaagcgaccccttgtgattttagtcggcgctttgctaatctggtggtttcggcagatttggtcgaaggccctcgtgatatgcctccagcaagcccctcatgggcaagagcgagtagggagctttgggcgagaccgtgcaaatatgtggtatggcatgaggtgccccctttcggccgatgttcctgccaaaacctatgtacacctgcagaagctaacccttgttatttcatgagttctctcaaacgtttccatgttgtttttcgaccttctatccttttcggacgtgagttaggtcacttcttcttttctttaaactcgggttttgggtcgcgtttttcctgttcatgtggccttttactgttcggcccatcctaacaagagttaccattgtgtccatccctgggtgccacgtggtgggctgctattggccggaaggcaaaccgtcgcatgactagggctatatagtccccccgtgggtcgctttcacttttaccccatctatttttacttcccccggctgcgttcttgctctcgctttcaccttttctttttcggccttgtagtcttcgctagctctgactttcatttttcgccattccatcatggctccgcgcaagcctgctccagccgcagcgaccggaccggacccctgcaagattggcgaagactgcaccggcttcctcggcacttcgctgttcaacaaggcggatctggcgaagctcgtcgcgtcaagtacagtggttgaaaagcaagccttcttcgctggcgatgcagtggttcatcgccccgttgatggctggaccgttgtcttcgccgccttctttgatgcaggtcttcgcttcccatgcgacgtcctgctccccaaggtccttcaacttttccaagtggagcttcctcaactgagtccctcagtcctagttcggatcgcgatcttcgactggatttgccaaaccgcggggttcgtgccataaactgatctgttcggcgctatcttcttcgccaccgttcactcaaagatggtggtcactccggttgggacaaagaaaaccgtctttgggagtgtgaacttcaatgttcgcgctgtatgctccgatttgtggccagtgaatgcctccatgccaaagtgggagcggcattggatggagaggtggttctaccacacgaatccctatggagctaagacagacgcgacgaaggcaatccgatagggccggctagtgatctcccctaaccggaagctgaaggtggcgattgatgggacgatcgagtcccgtttcacccttttgcggagaaccgcccatcggttgagctgctgtgatttcgtggaggagttttgcatgttggcagatcaccgtaaatgaggatgaacgggttctcgacttgcctcgccttgttttgccaggaggcgttaatcgtaagtttttgggccaattccctatatgcccatgtaatttcacctaatcccttctacgcccctgaaatttgtttgatctcttatatacccctgagttttttatttggatcccttacatacccactccgttagttgaccattagtttgaccgttagttattgtagaaattattttattgtccttggtatattgttaaaagctagaaatgttttatgtgtaaattatttgagttgtgaaaaccaataaggaataaattactaaatatttgttatgaatttttaaaaataaaacattatttcattaaaataaaaaagatttatcgtaaaaaaaggttctgcataaaatttgaaaattacttttctacaaatatttagtgaaaaaagattcgttgtgaaaaaacaaaggggatgtaattagtttatcacaaattagaaaacaaatttaaaatttttaaataaatttcagatcaaatttgacaaatttcgtatatcttcccaaaaatttaaacctaaataacatttagtttttgctcttaattttctagcgaaactaatgtatggatttaatcataatttttaaaaaataaaaaataataacttttattttttaagttgggcattaaatgattatattgcttttattttgtataagttaatttttttcatatgaaaatttattgggtaggtaccacatatgtataggatggataatatagtcattttaaaatatttagcggtcaactaatggtcaactaatggagatgggtatagaggagatcaaaatgaaaactcaggggtatataagggatgatgtcaaattcaggggtattgaagggattgagtaaattttcaggggtatttagggaattttctataagtttttctaatttgctaactctttatttatctcatacccttttgttctttttttttttttttgcctctcttgtttttttgcctttttgcgcagttctcaccctaacccaggccgaaaatgaggcccgaactctgatcggggacctcaccattcatgagtatagctgtcacgccctaaaaatcctaaatatataaattgttgtttaattggaattattagaatttattttaaaagcctacaagttaaactctaataatctaggaaaattttcaacataaaaatgagctagataaaattttattaaatactttgcttgttcctctattttctagatttttctgggaattatttgagcaagggaagtatttttaataattgaaacaacatttcacaaattattttaattaaaaagttcaaaaacccctccctaagccgttgggccgaattcggcccaacattcctctctcttccgcacgccggagccggcccaaggccgcccgagtcggctcaagccgagccgcccgcccctcctctcatgggacaccgacatgtggggcccacatgtcgggcccttctcctacctccggccggccggccttgctagctcgagccgccccttttcccctccaaatccgcacccaatccggccctttttcttccgattgtttgaggagtttttatcctctcatcctcctctatctttacccccaaaatcggagcaaatcgttgagtatcttgcccgaatcgaactcgtttccgagtttatctccaaaaccgagtttttgatttcccgagtcgattttcttgcgggaggagtccgatctcttcaatccaaggctataaataggaccccctagtccttctttttcgtttgccccctctcccgtcctctcccgtgacccgtagagccgtcgccgcgtgaaaccatccgccgccgccgctggccgaactccggttgcgccgccacgccgcctccgtcgtcgccgtcgcttgccgtcgccgccgttggtttcgccaagaggtggagaagctcggccgccacctctccttcgccgccggccgccgtagcccgtccccaccggccaacccgagccgccgccgtcgcctcctcgtcgccggccgtcgtcggtcgtcgtttggcacgagggtgagtatcgttgggttcgtctcgtcgtcctctacgtgtacatgtcctccaaaatcccggccaatcaccctagctccggcgaggtcgccatccgagccggccgccattgatgacgtcatcatgacatcatcatcttccccttttccagttttttttaatagattaaatcttcggaaaatcataactaaataaccgtagatccgtttcaggtggttcaagttgctaaatttttctaaaatcaagatctacatgttaaaaatatccacatgtactgtttatgcttgtttttgtattgtttatttggtttttattagtctttttcttcgttttgcgtgttagcttgtcgtttccatcgttgcgaaggttcgtgagtgcgccggaagtattcaagaagattaattgaagaccgattattgcaaggcaagtcacacagatcccaaataaccctttgagcatgttgaacccgtttaaagctattattttatttcaactatgcattattttcgaatgtcattgggtggtgaacctttccccgttaattaatggcctaagatgactttattttcctatgggttataatttgagtagcatgaaccttatatattggattggttcagctaaatgctatatgtatgtgtgcttagctatgcttagaaacattagctaactaaaggggataattataaactatattatattattttaattatggttatatttaatggtcgatcacgatggttaatcgtgtgatgttaattaattgataaataaaatctggttaaggtgggttgtgagcatatggttttgatggttgtgctcatgacaattaaggactggttcgcgagctactgttgtgaaacatttatcgtgccaaccacaagccagcgtgggcaacggctttatcttttgtatagcatgattcatcatagtgtgccagactgtgaagcggcaagaagtccgtgggggtcgctggggagtccattgcctctggttttgagggggagattatgatccaggaacggtgcactgttttgagttgtgttgtgcaaagggtactgtcacgatttcccccattgcaatgccgtggtggtatttcggggcatggcaacatgtgtggaatcgtgtcttgtgggtacagtggtacacctctggccagagtaaaactattcgaatagccgtgcccgcggttatgggcgagttgagcaatgtttttcgtgattagtctcacacccctcacaataattatggatgttataactggtaataatttgcttagctcctggtttggagttagaactgtacagccgggtatggttgttcaggatggttgggcctgtgcagcatgggtgtgttgctcagtgttgattaaaatttctgattaattactccactgttttacttctcttaaatgttttgctaaatgctgcttttgcaaatgagcctatattatgccatcatttggtatccttgtgcacttgcatatttgctgtgtggtttgttgagtatgtcatatgctcattcttgcaataatcatcaaacctcagttgaagataaaggatccagaaggagaagacgtttggcttataccccagttgagctgcctgtgggagtggagctgaagtcatcgctagatcgttattccgctgctgttttcttttcttttgtaagtatgtaacgttattattaagatggatttgtatattaaattgtcagtttgtgtacctcggctgattcctggacgaggattttatgcacaaattagttcggaaattactacagaatttccgggcgtgacaatagccagctcctgacgcgtcaagtcaccggtcgggcaaatcgggtttacaatggctgcccctagcgcgccctggcgacgcgctccaacatgccggggctgaggacgacggcgaggtcctcgaaccactaggtgcggctggtgcaccgcacgctgaggcagctgctcttggtgtcgcacgagaaccggaacaccgagctctccggcgaggaagctcgtcagggtggcgtcccctggggtgatggccacgtgggacaccagcgcgccgatgacctggtcgaacatccctgtagcgtccaccatcgggtgcagctagccgctggcactacctgactatgtccaccacgctctgccacgaccactgcggcatctcatcgagagccttctccgtcatcttaaccaggctcggcggtgtcgacacctccgccatcgccgctattgctgccaccatgtccatgaactcaaccgtgcaccgcccataaaatcccccaagatgcggcgctggaggagaggatagagagagaagagagataggagagttgaaatgtgggtccaagagcatttttgatatttaatgtgatttctctctcctcttcaaccgaaaattattattttaactaatgatgtgttcatcagcaaatatccacgatccattttttaagagtgtcttccgctaaaagtcacttcggacagtgtcctacagctaaaaccataaagtcatgatctcctgtaacaaaatttgtcaaaaaattagcacaaatgaaaaaaaactaacacagaggttaactaactgtaatagcaaaaaggaaagaaaaacacgttacaatttttttttaactagggctggaaagcccccatttccattactaaaaatgaaacgacaagtacaacagggttcagaagtaaaaaaacaaaggaaaaggctaaacacaacccccttactggagcagcaccctgacaagagagactaacagtttctgcagggcaagctttacagagatcaccagatcacagacaacaagatgtaaagggcagacctaaccgagtagtaccatagcaaagcaaagaactcagcaacactaaactcctgaacttctttattccaaacgtcttgcatagattctccacccaaatcgggaactgaagacttcacttgccacttgtcttgccagcttggctcccaacattaagcttctttgtcttgcctccgatttctgcaagttagcccaattttcaataaaatgacatgtaagatatatcagctcaattggatcattgggccattttttatcaaaacacactttgtttctggacttccaaatggcccataatacagctgccaccccccaccatcacaagttgcttagagtgtttgtcaaaattagataaccattatccaaacatatggtttttatctctagcaggtgttatattcaaggcacacaacatcacattccagatcaatttagcaacagagcattcaaaaaataaatgctgtatggactcctccttatcacagaattggcacaatttatcacattttctccaacctctcttaaaaaggttatctttagtaaggattctgttttttaacaccagccataggaaaatcttgattttcggaggtattttaaacttccagattttttttatatgggaatgccacttgctcccttttaagagctttaataaaaggatttgacagtgaagcaaccatgcttttctagattccaccacattttatcttttattccttcttgcaaattcagaagcatccatctctgtttaatccagtctctaagtttatctccatgcaaagtccttctgaatttgataatctcccatcctttctccttcagttttgcaagggtgatatgtctagtatgggtaatgttgtataaagcaaggagctgcaaattcagaggtctgccaccataccaattatcctcccaaaacagattgtttttgccatctccaacctaagttgaacaaaatttcaggaattcttcctgacttccatcaaaccatgctagaaatgaaaattacccgctttataagtcacccatgacaaagttttttgactcaaatatttttccctgagaatggaaattatagaaacgagcgctcgtcaattcgtcattgataaatcatagaatgtcacatatgtatgttggtatgaataatctagagttgagctcctaattggcacagtccgtaaaaagacattcggccttcatggtaactatagtcctcttaatttttatatgtgtacaccgatctcaagtgaggccaaaagatggacagcgcttgaaatgaagaacgaaattaccggtgggcggtggtacaatcaaggaatgatctgcggaaaaataaaaacggccaccactttactgttctcgattaccggcatatgtagtacaccgatcttaagcgaggccaaaaggtggacagcgcttgaaatgaagaacgaaattaccggtggtacaatcaaggaatgatctgcggaaaaataaaaacggccaccacctactgttcaagatttaatttatatgtatatcatgatttgggatagatgcaattggatggtcagaaaacaatcttcactaaaacatggctacccaataagcgtttaacaactgtccatagctgctcttaggcacgaaacaatctacctgcccaaggtttgcccagcaaaaagatttcaatagttgaaatgggtaaacgaccgcctaaagctctctttcagtgaaataaacacaggtgttcgaaaataagtgttgagatcactgaagatgaagtgccttttcactggaacataatgaccatgagcatattccaccgagggaattgaaccacactagcacacctttcgttttgcatctaattgttaagtttgcaactgttcccacatttgctatccagctcgcctaatggggtcttggaagtattggagagagatgagaagtgcttcctgaaaacgtttgcttctgtcaaaataggaacaaatccctgaaaaataatgaactttccaagctttcaagtgtcaagtacctccgttcttattgttctgctcccttgactgggacatgtattcaaatagg

SEQ ID NO: 48916 - DNA, 10496 bp, Oryza sativa
  unsure (1)..(10496): unsure at all n locations
nnnnnnnnnnnnnnnnnnnnnnnnnnnnnnnnnnnnnnnnnnnnnnnnnnnnnnnnnnnnnnnnnnntgatttgggatagatgcaattggatggtcagaaaacaatcttcactaaaacatggctacccaataagcgtttaacaactgtccatagctgctcttaggcacgaaacaatctacctgcccaaggtttgcccagcaaaaagatttcaatagttgaaatgggtaaacgaccgcctaaagctctctttcagtgaaataaacacaggtgttcgaaaataagtgttgagatcactgaagatgaagtgccttttcactggaacataatgaccatgagcatattccaccgagggaattgaaccacactagcacacctttcgttttgcatctaattgttaagtttgcaactgttcccacatttgctatccagctcgcctaatggggtcttggaagtattggagagagatgagaagtgcttcctgaaaacgtttgcttctgtcaaaataggaacaaatccctgaaaaataatgaactttccaagctttcaagtgtcaagtacctccgttcttattgttctgctcccttgactgggacatgtattcaaataggtattaaatacatcatctacacctttaccctgcagaaggaaatgtgtcttcaataacaatactaacagtaaaacaaccatcatttactaaagtatgagcagttagccacactaacacagtaatcaagttatgtatatcataaactaggaagtttatagaacaaatctcagctgacccattaccgagagttaaaaaacacaagacattgcaagtgagaatggactagatgatgtaggttgggcagttggtctatggtggattggtggtctagtaggtgcaatttggcgtggctttcctagttggtatgaagccagcagcctatattctcattctcataaaggcacacaggaaaatactagcaactaaaccactactatgcagagctgatctccctggcttcttttcatatttttgttgtactccaatctgaagttacaaaattttccattagttcctttcaccccttgtttcatcagttctcaagttcgtgttttagttagagaacttggactctgccacatctcttaacttcgcttcagaatctgaacagccagtattgttggtctgtgaccattcagttttattcgtttattcagcttttcattagtacttaacaaagaataccaaatattcaaagacaataccggtccaactgagttgactgctgtattttgataatttcagcctggtttgtctagtgtcagaaataacaacataggtaccagttttttgttagtactaacaaaatacgtattagaaactatcatatgcaatgataccttcaaatttctatcttcttcaatgcattcttctagaccagccaatccaccaaatgcaattaaaaggtgcctgtacaatgaagcgctcataaatgacaagatagccatacacccacaatggtggtcctgtgtatttttcagtttatgatgaagaatagagtggattctactttgcctctcatacactatcatctgagtctagaaatcaaccctgaataataaaaacggacatcttccacccctcaaccaccaaaaccagtttaaaatatccccttaagagcaatacaatgtggttataaccaaggttctaaatagaagtgatagttacaacaatggtggtagtgggttactaccattaccaagactaggtagtgctacgaaatagcgcattggaacaaagcagctgcaatagcagctggatagcaacctcataagcaaaatagcagctgctattgcattgcacactgaagtctgaattatggagcttaaatttgtgttgtgttaactcttgttgattacttgctttgtttttttaaatagagtaaagacctaattaaccatatctctattttctttttcataccaaggctccaaaagcagctaccctaatgagggttaaaaaaaaaaagcagctacccaaataactcgacactggtaaattcaggccagaggcaaattatgtaaactatataaaatgatgaaccagctgttcaacaatcaaatcactggaaccatcaaaataagttaaccagtaacatcaccaagtcaatagctggtctgggttcaagaactatctgactggatcacatatattgttgtatggcctattttatagtaagagtctgcaaaacactccctataacaaaaaagaaatggacatgtttaatgcaaaaaaaaaaaaaatcacattcagtttgtatatgttcattttttattcatagaaaaaaatcctgagacactggcaaaaaataaataaatagtcatcataaattatgtcatagcatctagaaacaaaattttgcattcagcagaccaaacaactatggaaaaaactgaattgaattctgaaggtagtccaagggaagtgaaaacaatatacctaaaggaaggtaagatcagctcagatgaactaatgatctttccatgctctgaagtaccaatgatataatcatatccttcctaaaaatatgaaaataattagtaataagtactctttaccctgtactacatgtgattgagctaaagaaaattgtaccttgtatggtgaatcactgaaaactccacccaaatttgaagcataccggaccttatagccccaatacaattccatttcatccctgggagaggaaggggaaacaattttccttttgcaagctagatgaaaagtaaatgacaatatgtcattaatcaatatcaaaataacagacaaaattcaagttgtagaaggcaagagctaaaataactgaatggggatataagtatgcctagtgaacaggaatgataaaatgaagcgacgcattacgaagtgaatccaaagagcacacatgtgaactgaaaatagtcactctgtttttatgttacataattaaaaaatccatccattttgctctgcagaacaagcagaatggtttacttgaaatctgtagtaacgcatgggcactatattattcatatgagaaataaaatcctgatagttgttgcagattttaaccagtcattgcaaatggttaggaaggatacttcagggtatatggattaaagaacatataccgagtaattcagatactaaaaagttctagacgaagaaaaatcaatagagccacatctgaagcctgggtcaagtgaataaatcatttacctgttgtaatgtcacgattggtacccatggcaatagttactctcttccctggttctagcatttgctcaaccagaacattctgtgatgaaagacaattatagtaagtttattggatgagaacgtacattatctaatacatgatccacaaaggtgtatatgatacaatatacattacagaatctgagaatcaagtttatcatgttgagtacaaaaagatttgctcagaggcagacatgcaactatcaatataaagttgctagacttgccaaagcactctggccaggcagctatcagcattgaagctatcccatgctgattttcatgtttcaccattctcttacccttgccccatatgcagttatgggtaatggccatggcatgcctctttggtgcaaagatatctagctgacattttgacagcttacagttatgctatgctatccttgccaaaaaaaaaaaaaaaaaaaaaaaaaaaaaaaaaaaaagcagtatgccctttgtttggcccagcttcagcgtatattgaaagcagccttactgggagtatagaaaattcaccaagcaaacctatattacagaaaaaaaaaaagaagtattttgttggaataacaaactatgaactcgtttgttatgtgtttggtatgacaccacccactagcttaactttttttcattcaattaggctaagtttacaggggttaattcctcggagtaaaggaaagataaagatagttgggtttatgaaaaggaaagggtttggttttttggaaaggaaggaaagtgtttgctctttccggaagtaagagaaggactaccttgggtaaggtaggacttctcggagtaagggaaagcaaggtgatacgtgttcctagcagtagttaagcgctattgttgctagggagcccatgtatgggggtatgcgcgtggaggaaaacgcccagaagggcaatttttgaagccctacggcactttagggtaggtttaggtactctgatacctaaaccagaatttaaatgcatttaaacgcatttctattagtgaattaattattcgattcatgcactgggttagtttgtttggacaataaccatattataacccctttgtttataactgaacagatattttatagtctaagccgtcaggttacaactgaacggatatttaattacacaagccacttgagctaaaaaatagtatgtgaaaaaaatttggataccttactcaatccgacatcaacaaatgtccccattgaacgatccccatccaatgttacgcctgtctaaattcattctactgtaagcattctgttgaatcacacatgaaaaatgtggtaacaaaaacttttccgataccagcattaaaataggaatgaaaaaacagtcgaaacaaatccaattatgctattagtactcatgttcctttttttagttgagaagcacaaaagggtgccattctaaattgaagccttaacaaagttgagcatgtgggataggcagtcctcccccaagaagtaattctacattaacacaaccaacagctcagccattcagtaacacagcaggatcaaagagcgtataaagtttatttttccttttagcatgaactacgagaattgataaagtccaaagcaaatgaattgcatattgtgcatgtaatgaatttctgaaagctacgaagaacagataaaacaactgcacaattcatgggcatactatataatatttataaaaggtgcagacatggccacgcatgacagaattattaaacatgatgaatcattcgaaataccaaacactgcatgtgcttatgcatagttcaattgatgtgctcatatacatatagtttcattcaaagatgtccctaactagttaaatatgaaatttacaacttctcctagttttctttttgaccgaaaaacagtagcagatctctagaacttgtcctaaattaacaagagaccgagaggtaagtcgcatagctcctataaatctaggaagacaaacttcatatttttctagttaggtaaaaaagttaaattacattggccatgtgatatttactttgatttctctctcctatttcaatccgatatactaaaataatggtaggagtgtattatagcaaagagaaaattcgctctatgcacagaaaaaatggcagtaccaaaaatagcacaaaacattcccccattcgaccagaggcacacgccactagtttttcttcaatttgtagcgcttccgtcacattttccgtccaagtgattggttagccaaacatgaacttgggctcctcggctaattgaacttgtccacggtggtggctgtggtggggtggccagcagcggaggagggggtgcggccgatggagaaggtgtttgcatcgctgatgaggtcttcacataggtgtggcttatggagatggagaacacagagaggtgcagcttgtcgtcgacgcgtagcagttccctgtttctctctagaaaaaaaatcagagaggaaggggccagtggtcatcacgcacagcaggaattgagtaagaagatgagacagagatgtgaagaattcagtgctcggcaatgcaaatcaatggtgtcctatggaatttaatttttgcaaatcaatgattgaacaggacacaacaaactagttcatcatggggttcggggatgggaaggagtcgttagccgccactgtcatcaacgaccttgatcccatgtgccgtcgcacggcgcaaactgccagccgccgcatgcttgcctgctctcccagccaaacgagcatgaactgatgaagaacaggaatggtccaacccaaccaatcacgtgtgaatacagagaggactaagggtaaatttgtcattttctgtccctattcacatggaaacactcgtcttgcactgcagttttggtggaagtgctatggatggaagaaaaacgagtggcctgtgctaccagtcgaaagcggaaattttagttccttgtttctgtgctacagatcgaattctctatagcaaatagccagaaaactagagtacccatggccgtgacatgattttagttccccacacaacaaatgccgacttcgccaaccatatacgataaaagcaattcaacgtggataccaatagcactgcaagaagagagagatcaccttcacgaaattcagaccactcatgcttgcgcaaatggtgtggtgcatcgagtgggggcagcaacccctgcatacaagaagcgacacggatcaatcagcacctccaggaaacccaacatgccgatgatgcaatcatgttcttcagcggtctcaccacaaacttcaagttgttgtgcatcgggaaaaggcgtcggcgcaggtattgtggagtctccagatactgtaggatgcgaacaaggaagcgcgcgccactctctacgtcatcgccgctgttctccactgaggaattgctgtcgaagaccacaacctcgtcgatgcggaagacggtcgccgcgcgggcgatttgtcctgccagctgaaacagggtaggagctagagccgcaagaactagcaagggaaggtgagaaaggatggatactgacgagggtggcgagctcgagggactgggcgttgtcgatgatggatccggcgacggcgatgctcaccgtggtcttccgattcggaaccgccacgtcatctccgttcttcttctgttgcagctgcttcttcctcttcttgtcgtggacgatttcttcgtcagccgctgaagcctctgcggctccgcagtcgtcctttcgcttctttttcttctccttcttgcaccgggccttcttggaggccgctgctgcctcggcgtctccggagttcattgcggcggcggcggcggcggcggaggcgtaggggggactaacacgagaacacctccaggttccaggagtcgagaggccgacgaaagtagggtagtgcgtaagggcccctcatgtgccggccttcggccagcgaaggggtttgcgtggagtcggactgttttcggcccagcgataagtctactttatgtccctcagtaccgtttgagtttcattgtatctctcaaccgtaaaaggtggagaagtagaaatagaggctcattcagattggtcgcccgatcgaatttgagaaatattgggcgctgacgtcagcgtccgatttacgtgcagaaactactttaaattgatttttctcttaaattacttatccaaatcataatccgattgcaccattaaattcgttgcaattaaattttcaaaacaagaccacacatggatatattccgacgaaaaaaaattagcttattattgaattatttttaaatattgcacaatgttccactaggtatatcggaattgtttcactaagtagatcgaaaatgtttcactcgtttaaatcgggtgttgtttcaccttatgtaaaaacaatgtttcaacaaatagcgaaagaatgtttcagttcgctgcaacattagatctatacatagtgaaacattgtgagtatactaggtgaaacatttttcggtggaaaaaaaatataccaaattcccttaatagggggtttccaaaatatatggatttttttgttgcaatggaatgtttcgttcactgcaacattagatctatacatagtgaaacattgtaagtacactaggtgaaacatttttgatggaacaaaaaataaactaaattcccttaatagagagtttctaaaatatgtgggttttttttgttgcaaaagaatattttaattcactgcaacattagatctatacatagtgaaacattgtgagtacattaggtgaaacatcttttgtgaaaaaatgggagggagaagtgggtgggcccaccaggtgatcacgtgggggagcgcccgatccggctcaccctgcgcgggtcacccggggtgaatcattatcgagtataaattgtccctcattttttattaaaaccagtacaaatcgataatatggaataagttcacactgcatcccttatgtttgcgcattgagtttaaatcacatccttaaaccacaatactggaaatcttaaacctccatattacaaaaccgggttaaataagatcctaagacggtacggatgattgttttggctgacatggcatcctagctagaaaaagaaaataaaaaataatatgtggggctcatatgtcggaggctttcttcttcctccaattctcccctctcttcccaatctcactccacaacggcaaccgctggggaaggaggggcggctgaagaaaagagacaaggcgatggtggcgttcgagccaaccaaaggtcgctctcgtggcgcaaacagctcgggctcaccttggttgctgagctccacctcgttggggaggccacaccgcccgctgggtacgacgcaacgacatggcggaccaacgccaaagatttcacggcaacagaggggatgaggtggtggatgacgatggtgacctcaaggctatgggagggggggggggagagaaagcctgagcaggcagtggggatgaggaggtgaaggatgatagcgagctcgaggttgcagcagtgacacggggagaaggggggtgaggggtggaggagggagctcgagtgagccggagggaacaaggtggtgggacgatgtgggcgagctcgagacgtgggtgagcttgaggccacaacagtggctaggggagcctgagcaagcggcatggcctccccatgcgaggcggagcttggtgaccagtctggccgccgccattgccttatctcctctctcctgccactatgaccgcctctcccctcgctgccatcagccattgccgcgaagagagatcgggaagagaagggaggtgtggaaagagatgggaatagaggagagaatgattggaggaagaagaaaacccgtgacatgtcaacccccacatgttttcaattttttttttggataccacgtcaaccaaaacaaccatccataagcttctttcatatcgtgactgaaaacctacaatttttcgagcgcatgaaatctagcaaacaacacaggaatttaacaaagggagagatttgcacgtgtttgtgtacgatagtatgttttattgtgccacttccgtgtaatcggaaaaaaaaaagaaactgattaagcttcacctcacctctcatcctcacaaacagtacatgagaatatttcacctgtcataatcccaccacgtaagatgcttccacaaactgtacatgagcacgatgaaacaatcaagctgtattgcacaccctccatcctaaaaaaaaattaaagcacaatcaagctgtattagaacatcacaaaatatcgatggagaatgtaaatcttgcagtttatccatcaacacgatcacaagttaatacttcacgactgacccccccaaaaatttctcatatactcctaaaccaggaacgaaataatgacgtcgcgacttggaaaagttagatacaaacagccgtacaatgatttaaaaccaaaacaggaagttcgagttccttctttttcatgttcaattctctgtgtactaaatatatgatgtcacattattacattgtcacacattctgcaaaacttcaataatttcaatgtctaaagcatatacttccttccgtttgaaatggtcaaagacttgaagaggcaaaaagaaattctactaatttcgttctactcctggattcttgatggttctccaattgcatcttccatacgttggtaccagtcaccaatttgtgtatgctcaaccatatcttttccagctgtcaagtatcggataggtctcaaaacaccaaatactgcaagatctgccaagttaggcttggagccacctggataaatgcaagttaatatcagtgcggagtaacaaacttgatgcatgtggattttcacccttccaggctgttttttcccttttcccttcctttatggaaaaatatcatacctagaaaatcccttccatcaagggcttccatccatgtgttggcagcatcgtataatgaagcacgcgcatcagttatattgtacttcttctttagcttcttagacaccatgtacattgctgcagcaccagcatacttcacagcaaaccgctcagtaaaactgaagttgcctgcattacagagttcgggtgcacatcgtcaaatgttgcactaacaaaatcatgtgtcatttctgctcaaatgattaaaacagttagcgaacagagcaccacctctgcacccaattttacgtttttgcctagagat

SEQ ID NO: 48917 - DNA, 941 bp, Oryza sativa
aattgcatatgaattattaagcactcgaatttggggttccacaaaccgatctagcagcgaaactgttcttaacaaaataatctaagcaaaagacaccatgtacattgctgcagcaccagcatacttcacagcaaaccgctcagtaaaactgaagttgcctgcattacagagttcgggtgcacatcgtcaaatgttgcactaacaaaatcatgtgtcatttcagctcggaatgattaaaacagttagcgaacagagcaccacctctgcacccaattttacgtttttgcctagagatgaagaaatctagtgttcctggataagtggatagcatggcatcttgaacttttattttttagttttctagtttgaatataattggagatgaatcatatcttactataaagttatcccccactaactccttaagcttaacatgcaaaggtgccacatcatcatccactaacaagatgctacacatcatccactaacaatcatcacatttaaacaacatgcaaacatgctatatctttatagtttttataatttaagagcttttcaaataaaaatatgttaaattatcatccaacataattcatataatgtttcaatatatatctttattatgttttatgatatcctatatacttatatagttcatcctcacttagttagtacttaaatgattaatctatggtccaaattatctttctccttttttcctctaattaagtcatatcacatcaattgtttttagcctttttttactggaattgtttttagcctttagatgattaatctacagaccaaactatctccctatttttcttcttccataaagtcataccaccttactttttacatttgaatcaccattctacatactatttaaatttaaattatcataaaccatattaatttacttaatctgatgttatctagct

SEQ ID NO: 48918 - DNA, 1175 bp, Oryza sativa
tgcccttcgaagatataacttcatgtatgatgaagacagccaattcttctctgatacggcgaaattgtgctctggaatgttgaaataacattctgaaagaggcatcaagttagtacatatcatacgcaaacctaattttatgtaatatactaatggccgattttataaacccatgaacctcaggatccaaggaggtcacctttctagcgagaatcttcatctgatgacatacatgaaatacacaggtttcgccggtttgtttcttgcatttgtagttatcatggtgatagaggtcgggtatatcttctcggtgccgaccccctttgttgacatatttctcccaagccgcattaaagtcctccttcatagatgtaaagttgtatttttttttcttattttggagttaaggaagtataccctactccatttttcacttatccaatggaatctgcaacgttaatatactggaagttgaagaccacacatgtgtagtaaaatttaaaattcctaacgtagtgtactattcactgttgattgtgtgctaataagatgaagtcttcatcctagtgggcccttaagctttcatagaagtaattaatcacatcatccaagtgagattgaagttctgcctcattatctcattatctgttcacctggtttttgttcctccgtgcctctttcgaacgtatccttcaaggttcacatgtgtggtcaattagaagcattctacaagtattaatagtatgtaagtttggtgttatttgtacttacaatgtgtagcactttaacaagccggtgtccactgctcgtagcttatagaggtaaaaaagatccgagaaggccactgcaaaataattttgttgccccaaggatggttcttggtcgtggtaacctactatggacgtgtccctcatcttgctcttggagtttgttttctccatgtagtatctatgcagcacttggcaagcagaacccattttggctaactcatggtctgcaaccaatggcacctgttgctgaaatgtacctggagcttgttttttggagtaacgttgacctccttattcagatctagttgtttgggaggtaactacggctcttgtgcctttcttttttcttttgatctatctcttgcatgatgcgcccttctttgcaccataggtggagatgaaatg

SEQ ID NO: 48919 - DNA, 1000 bp, Oryza sativa
  unsure (1)..(1000): unsure at all n locations
ggtacccaaactgcaccgcgaactcttgtttatggagtaggtttgtatggttagccctcggcattattattacagaatgtttgtgtaaccctaacttgtaggatgcattgggctacgccctgcatacaatccagaaaaaaatattagtttaagttgtacgaatcacatcagctacaacgagaactactattcgactgagacaggtggatgtcattctggaatcccagttgacaaacaactacttcgccgctgcaggggctcacttgcacttcttctggatgtccgttgtcctcgttcctttttggctagcatctcttcccttatcctagcctcaattccgtgtaatttttcattgaattcatggctaagttcactattgacggtccttaaatcataatatcaaaccgtcaatacctgcatataatgaaataaacacatggtatccaacttagtggtaggtgttattactaatcatttccactagtgttggtgaaatatatgtatgcaggtaattttaggagaaaacacatccgtcatgtgacaaaatgcacctccgcgcattcaggacgcgtttagacggattagaggccaaataagtcaataaaaaccatttagaattgggccaaaacatagcccaggttgtttggggcccattaaccaacctcccgaccgaaggagaggccgggaggagagtttttgggttcggccgaacctaccagttcgggcggaccaatcctggtgcttcctgtcatctgctttcacctggacggctcgaatttctctcctaaggcggttgcagcgtgttttggtcatttcccatacccctaaccgtcatttggagcctatataaggagctcttcatctcacttcaagcacacacaactttgagctgaattacaagaggctctattgtatcttttgtacattagaaataggtagaaagcgaggggaagctctgaannnnnnnnnnnnnnnnnnnnnnnnnnnnnnnnnnnnnnnn

SEQ ID NO: 48920 - DNA, 3508 bp, Oryza sativa
agatagccatgcactcttgaaattttcaaagagaaataaatggaagaggatgtatacaaaaggagttattgattcattttttttccacccacaaatttaccatacacatacacatacacatgcacattcttgaccagaaagtatgttttgtatttccgtggatccattatttgactttgcaatatatgtgatgcaagtaatgctctactcttttccataccctgagctccacaaaagccttattagatggtaggaaaagaaaaggcacaatcatatgccttgtgaggaatcatacactttgagcgatcgaaagaatcaatggaggagcaaagcatagttataattttgtgttacctcaaaaaccacaagttgttcttcatgaaaaattagggtgacttaatgtcaagattgttccatttctcaattgctcaagatcgcatggtagacactataaagatcgacaagtacaggtatggctttgaataatttgtttgcatgatgattagttaggaagtcataactctgttgtagagtccatagccttcactcgggatgagcaaaggttaagtgtgggggtgttgttgacggtccttaaatcataatatctgaccatcaatacctgcaaataatgaaataaaacacggtatccaacttagtggtaggtgttattactaatcatttccactagtgttggtgaaatatgtgtatgcaggtaatttgaggagaaaacacatccgtcatgtgacaaaatgcacctccgcacattcaggatgcgtttacacggattagaggcccaataagtcaataaaaactatttagaattggaccaaaacatcgcccaggttgttgggggcccattaaccaacctcccgaccaaaggagaggccaggaggagagtttttgggttcggccgaaccaatcctggtgcttcccgccaactactttcacctggacgtctcggatttctccccttaggcagttgcagggtgttttggtcatttcccatacccctaactgtcatttggagcctatataaggaggtcttcatctcacttcaagcacacacaactttgagctgaattacaagaggctctattgtatcttttgtacattagaaataggtagaaagcgaggggaagctctgaaggagtgcccggaagtttggcgctcatccgacttctgcctcgacgagtgtagcttcctaggaggaattctgaaggagtactggagtatcggtgagtactggagtactggccgagtagcttcctagatggctacgaaatcagtcttggctttatagccatggttcgagagaaaaccttctctggtagtatcggtgaaaatccatacctccatcttcaggactttgagctagtgtgttcgtgcctatctatcgtcggcatgacacatgatactcttaagtggaaattgtttcctttttctcgtagagatgaagctaagcaatggtacactctatctgtcaagaaattccactgtgaatgggaggagcttaagtgcaatttctgccttactttctttccattaacccgtgtaatcaatctttgagtagacatcctttcttttcgacagaatgagaaggaatatctcggtgcagcctaggccagtttctcactgttaactcaatctggcccagacttgtcgttacccgaccacgtgttgttgcaacattttcggtacgggttagacaaggagtttgccgaaaatctcaatatttctgcccgaggatcgttcgcacacaagacaaccgccgaaggaagagaactcttagatttgatcttagagaacgattctttcggccgaagcgaatccgtcccgaaggtcgagattattcatgaggaacctctgcacgtggagttggaacccgactcaactgtcgaatcctcatcccggtcgcaggagccggaggaagaagaaattcatcctccggaaatttcattccaattcgaggaggatcttttcgaagattattagaacaccttgaattattcctgagagaagagaccaccgaccaaggtcaattctaatgaacctcttgataaatctatgcttaaagagacggtgaagaggttgaccatcatcatgagtaacaaatggttaagagaaggagagctcttatctgaatcgattcagatccgatgcccctcctcaaccattatgtgtcacattggaggtaattcggtccgtgctctgtataatccctctgttggtgccaatattatgtccgcaacctttgcattcgattgcttaggggacagatcgttggaaccaaccgtcagaaccttccgaatttccacaaactctactaccgaaggtttagggattatctctggagtgcccacacggcacaacagtgttgaggtcatattagattttcatgtgtttgaaatatatgatttcgacatactcatagggcatcccatagaaaaactcttagatgtgcccgaaaccggtgtccttaacctgaaaataggaagaattgccacctccgtccctatgttgcaatcaaccaattctttgatggagtctcttcctgttcctgagccaattgagggagtgatggctatttctccattcgagaccctagagtctattttcgatgaatccatcgaagaattcaatgaaggggaggatgaaactggagaaacgatggatctgccaaaaacggatctgccgtcacgagccccaattgagctaaagcccttaccgtcaagcctaagttatgcctttctgaacagcgatgcggagtctctagtcattataagtgacaaactcctgagagggagatggcccgacttatcgccattttagaaaagcatagtgctgcttttggctattccctccaagacttaaaaggcatcagtccgaccctttgcactcatcgcattctcttagaaccgtctagcacaccatctagggaacctcagaggaggctaaataatgcgatgagagaggtcataaaaaaggaagtcttgaaactcctacataccgggattatctatcccgtaccatatagcgagtgggtcagccctgtccaagtagtgcctaagaagggaggcatgacggtcgttgaaaactcgaacaacgagttgatcccgcaacgaaccgtcacgggatggagaatgtgcattgactataggaaactcaacaaggctacgaagaaggatcacttttcgctgcctttcattgatgaaatgcttgagcggttggctaaccattccttcttttgtttccttgatgggtattctagttatcaccaaatccccatctatcccgatgatcaaagtaaaaccacattcacgtgcccatacggaacgtatgcatatcgaagaatgtcgttcgggtagtgcaatgcacccgcgtcatttcaaagatgcatgatgtctattttctctgacatgatcgaggatatcatggaagtcttcatggacgatttttcagtctatggtaaaacattcaatcattgtttggagaatttagataaggtctt

SEQ ID NO: 48921 - DNA, 1410 bp, Oryza sativa
ctgacacacaaccttcaagtcaagctatttgatgtatggggcatcgacttcatgggaactttcccaaagtcctatgactgcgtgtacatcctggtggccgttgactaggtgtcgaagtgggtagaggcagggccgcagacgccaagcacgccccccggatgtttcatgagattatcttccatcgttttggaactccgcggatggtgataagtgacggagggtctcattttatcgataagaccttccaaaactgtttgcaagaacttggggctcagcaaaaaattgccactccgtatcatccccaaacaagtggacaagcagaaatgagcaacaaacaaatcaagaatattctgcaaaagactgtaaatgagatggggtaggcatggaagaacaagctacctgatgcacttttggcatataggactgcttataagatgcccatcggcatgtcaccatactaacttgtctatgggaagacttgtcaccttccggtagagttggaacacagggcgcactgggctatccggacttggaacatcgacttgaagggagccggatagcacaggaagatgcagttctctgagctagaggaatggagggacaaggcctaccacaatgccaagatctacaaggaaagaaccaaaagatggcatgattagtggatcaagcacaaggaattcaaggtaggggacaacgtgctgctgctcaactcacgggtgaagcttttcggacatagaaaacttcgaagtaaatggatgggtccatataacatcgtcgatgcttcatcacatggagccgtcacgctgcgtgacaacgaaggtaacatctttaaggtaaatggccattgtttaaaagttttccttgatccgttagaagttgatcatgacttggatgttgtgaatcttgtctcttttagcttctacccggagtctttaggtccccccttgatccgttagttttcaatgccatgagtccttaggcctccctctagttatcttaggtctagctttcatgataaaaataaaaaaataaaaaaaaataaagttggctccttggtcttccaaccatgtgagccctttttgcttcactcttgtctttctttttcttttttgtgtccaataaagcctctcatatacgaagacaagtgtgggggtgatcttgcacatcaacgccgtaacaaaagcaagatcaccccagacgagctatgacaaaccacacacgggaaattgatgcagttagacctagtgaggggtcagccaaatctccagttcggctaaactatctctaccaaggatcattttctattttatacagagcgcatgtttgcacaatttttcctttggacatccattctatcttgagtttaatttgactatcaattctaaaatatcgaagataattaaactcaaa

SEQ ID NO: 48922 - DNA, 893 bp, Oryza sativa
  unsure (1)..(893): unsure at all n locations
tcggcagtattgactcagtttttgcccggttttgttgacgtgtcgcgctgtgggacccactggttagtccaccattggggagttaatagacggggttaaaggctctgtcctcgctgtttccaggcgttgccgcgacattttcctcttctcgagctgaaaccctagcttaggtcggcggcggcggcggaagcggcggcggcggcggcgggggcgacaagaggaggtgaggctaggcgatggcgagttattgcagtgaccggtcgtcggggtcgtcgcatcccagcagtcgtgctcccatcccggcgcgagttgggccctatgattatcagccggcggtgatgtgccgatgtggtgcgaannnnnnnnnnnnnnnnnnnnnnnnngtggacaaccctggtcgatggtactaccgatgccgcaatcgggtgagtgatgaagatttcgtttgcttgcttggtttttgtttgagctggcagtatggttgggtgatttgggatgtaatgttttcagggcgccggctgcgatttttttgactggtatgagcctgcaacaagtagttttttgagggagctgttgaacgatcttcatgaagccgtgttatcgctaagaagggagaagaatgagctgcaacattgtgttgaagaactgaggccaaaggtagaagagcagtgcctagaattaggggtagcaatgaatgaagtggcacaattgaggattgtggcagctgagaatgaagctaacatggctgctatgagagcaagtaacagtaggctagagaaacagagagtttggcttgtactgatgtcgttgggatgcatgcttgtgttgtttgctatgattttagttcagctgtgaggtgcaatgtgttaatctatgtgtcaaaatgctggtag

SEQ ID NO: 48923 - DNA, 926 bp, Oryza sativa
gtctaccatgcgtcgcgatactggaaagtacccgaatagaggctgtgacaataccctctgcataacacaactcaccacagtgcaccattcctggatcataatcacccccttataaaacaaggcatggactccccagtgacccccgtgggcttatctccgccacttctcagtctggtgctccgcaatgaatcatgttatacaaaaggtaaagccgttgcccacgctggcttgtggttggcacggttaatgtttcacaatagtagctcgcgaaccggtccttaattgtcatgagcacgactctcaaaaccatgtgctcacaacccaccattatcaagttttagttggcaagtaattaattaaccgatcacgattaaccatcgtgaaccatcattaaaccatcattaaataataatgaatcatatgttatcccaatagtgtgctaatgtttctaagcatggctaagcaatcacatctaatatctagctgaaccaatatataaagctcaactagtcaaattataataacccaaggtatcaaggattaaagtaatcaatgcaaacaggccataacaaaggaatagattcacaccacccagtgacatttgaaaataaatgcacagttgaaataaatagagaatttaaatataggatcaacatgctcaaaggattgtgtttaggatctgtgtgacttgccttgcaataatcggtcttcaattaatcttcttgaatacttccgacgcactcgcgaaccttcgcaacgacggaaacgacaagctaacacgcaaaacgaagaaaaagactaataaaaatcaaataaacaatacataaaaagtaaacaaacatgtagatcataattttagatgaattatgagacttgaacggcctcattctgacttcaaatgaatttattatgaattttacaagatt

SEQ ID NO: 48924 - DNA, 709 bp, Oryza sativa
tcaatttggtacgtagttcgtacatatatgtacaaaatttatatatataataaaatgattttatatatcagaagaagtaggagtatattttttagataatgagaatttataaaacccggcttctacaccaacgggggtgtatacagccacagaaaatccgagcaaacaagctcagttcatacacacaagttcacaaacaaaaggagcacaaaggttcaagcaccttacataaaaccaaaagagcacaaagactcccaacgcctttcaaagtgaaaagaccttccaaacaaactaacgaccacattcctcctttaaccgctttctcatgttccatccatctttaccaaagaagtgcatgacagatgtctctaacagtttgcatccttccttcatcacatcacactcatcttctttaagcagcaaggaccattgtcgagcccaatacgtccccctgaaaataacctgcaagtaagagttaaaattggagtcattgaagaccacatcatttctacaaatccacattgcccacaacaacgccgcaatccctataaagatttggtgctttagcctagattgtaaaccctttagccaaatcccaaacatattagcaacattgttaggcggatttatcccaaatgttataaaaaggatactccaaacaaatctagccacatgacaatcaaagaagagatgttgtatcgtttcattg

SEQ ID NO: 48925 - DNA, 9944 bp, Oryza sativa
attgtccttcgtgagaatcactcccttctttaaataccagaggaagattttgtttttcaaaggaattctaagcttccaaattaaatccttcattggcactacattctcatacataatcattttatacatagaactaaccgaaaatatttcggttttgttaactttccaaataagcttgtctctatggtttgagagcctaacaagaaccactttagccactaggttaaaccatgcaaccaaattctcccccaccaaagcccttctgaactcaacatttaacggcactttatctataacatccgcaacaatagcattcttattccttacaagattgtataaattagggtacaacttttcaaaaggtaaatcaccaatccagcaatcctcccagaatcttatctgataaccatcccccaccttaaaggcaccgcctttaaaaaagacatccctcacccccattagcccagcctagaaatgtgaatctccagggtgtttctcgatttgtgtgatggttttcttagtcaagtatctattcctaagaatgtcctgccaaaccccttcttcattgatgagttgtacaaccatttgctaagcaagcatttgttttgtatctctaagttttgtatacccaagccactacattcctttggtttgcacaatacactccatcttgctaacctatacttcttatgttcatcacattgctagaaaaatctagatctataatagtctagctttttgaaaatacccttagggatctcaaagaaggacaacatgaacatcgctaaactacttaacactgaattgataaggaccaaccttcctcctaccgagagaaattttcctttccaactactcagtttcttttgaatcctctcctccacaccctgccaatccttattgttgattctcttgtgatgcattggaatccctaattaagtatttaaaagggtaagccccggtatcacacccaaataatttgacgtactcatgctccacatcttttgcctgccatagcaaaataactcactcttatggaaattaatctttaagctagataatttctcaaatgcacttagtacaagcttgagatctctggttttatcaagatcatgatccataaaaagaatagtatcatcagtgtattgtaaaatagagagaccattatcaactaaatgaggtaccactcctttgaatctgccttgatctttcgttctttgtattaaaatggctaacatatctgcaacaaggttgaacagaataggtgacaaaggatcaccttgtctcaaacctttccttgtttgaaaataactcccaatctcatcatttactttgactgccacactcccacccctaacaatcgagtcaatccaatcgcaccacttagaagagaaacctttcattcgcaacgactgttgtagaaacttccaatcaactttgtcatatgctttctcaaagtctagctttagaatcaccccattcttctttttcttgtgcaattcatgaagtgtttcatgcaaaattaccactccttccataatgttccttcctggtaggaaagctgtctgcaaaggtttaatgaccttctgagccactagggctattcgattgtctattcaattggccattacagaagtaggagtatatacatataaaattatatatatatatatatatatatatatatatatatatatacatataaattcatatatgcatatatttgtataaagtttatacgcacatatacgaactatatacatacatatatatgtgcatacttcctccgtttcatatattataagttattttgactttggtcaaaatcaatttgtttcaaatttgatcaagtttatagaaaaaagttgtaatatttttaatcaagataattatattatgaaaatatatttaattatagatttagcgagactaatttaatgttgtaaatattactatatttatctacaagtttaatcaaattagtttgactttacccaaagtcaaaacgacttatagtccgaaatggagaccggaggggcaaactgatcgagtggctgcaccaacatgtggtcagcagcatcagcgcccgctaattgcgatggcatgaaggagatcagcgattgttgcatgcaaaatttaaactgtttgattctgagttttttcgttcatgatagtcttatagttgccatagcgtgaaggcgaacaacgattgttgcatgcaaattttaaaccagagtttgattctgagttttttctttcatgatatcgtttgaactacgaataacatagtgtcatcttggtttaaagtaattttggttgtttcaaatcttgagtaagtttccatactaccaaaatttttaattggattccccatgtgatttggcacactttggctctaatgagaaaaactaccaaaagatttattcaaattatcaaaataaattaaattggtaggacaagaataagcacaaaaccaaaaaaataccaatagatacaaaactttgagcaaattgtgttaacgataccagaacttggcgagtgggttcaattaagtgcgataacttaaaaaatgacataccaatgcaacaacttggctaggtgggtgtgtttgtggttcaaaaggctaccacataaattttgccatgtcaactgtccatgttggacaaagtctacatggaacacccttcacacatcatgataaatttgtacaaatcctcttatgttattctcatttgaggacttttttctgtacagatgaatcaatcaccaagcccatagatgacgagggatggggcttcaaatctgtagcgttgggcttcttgaagcttgtagttgatgtcttgaactagccgccatcgatgtcctcgaagcagccggtggtggtaggtaggacttgaagccaaaccatgttgacgtgtcaaattgcaagccaaacctatattgtaagacaaaccatgttgatgtgttaaattgtaaagtaaaatcatatgtatctgatgtgttatcagagccgtctctagatatttggggcccctgaacgaaatgctaattgggccctaaattttgaaaattttatataactaatataaacaaagcatactttcaatcaactatataactttaatatgtgttattttatacaaatattaatgctaaaagagaaaaggtagtactactgacctcatgttgtactgaaaagtgaaaagcatcatccttctagtgtttcttgaaatgaaatctttaattatatcttcataattaatatcgagattgagctgctgcatctagcctgtctcttcttacgtttttcagcacctgaatcatgctttctgtttctagaagtgacgaggaactgaagcaattgaggaaataaaagccttcctgagttcctgttttataaacaaaataaagaaaaggcgtgtttgattcaatcaatcattcaaaaaaaaaatcaaaatactgtatacatacatacatacagtatacacactaatagagaatcagagatgactagatgagatgatcagatgaaagtctagttcgttcgtcaaattacttgatgatcaaactctcagtctggttgcccggcgcgccctcgccggctcgcccttgctggttgccggcttgccgcgcgcgactgccggagttcgccacgccgccgctgccgctcggcgctcgcccgctcgattggccggcgattgttgtgctgtcagctgccatgcgcgtgcgctgcctcgcgttctccctgcctcggctgctcagtccattgtccacgcctccatggccatccaacagaccaacacagcaacactaaatactcgcgagttggagtcggtgaatcgcgacgcctcgactgacgcatgctgcgcgcgatcaccaatcaccgcttgagatgaaaacaacgcaactacgctcgcgagtcgcgacgcctcggactgcaaacttccgccgttctgcgctcttggtagcgggcaagcggctgccaggtatgtcaagaactattcttgaagggtacaattatatcacactcagccgtagaaaacaccaacacttacagtacaatcgatctcagttaagaaatctagtgtgccagtaattagactacattgccatgtaataataaacatcacaagattcaagcagaaaaaaagacaaacaggcaacaaccggtccaaatcaatgaaaccctaagtatataaacaataaccaattgaacaaaaataaaaatatgaaaccaccaggaagtgatttaccataaggaggggataccccaagaattcgccgagtcggcgccatccctgcgcatgcggttattacaccaccagggacagttcccaggtctgaatgagtaagggcaccagtttgggataatcagatctgaatcagtaagggcaccggtttaggataatcagatcagtgtggctcacgatgccctcacaactagcgcagaagcaatgtcgttttcccttgcactcgctgctaaccgtcgttgcctctcggtctattgaggtcttgaggaaatcacgaagagaaaccgagaagaaaggcacatatatttgttcattgtgatataacaaaagaaacaattggaatataagaattattaggagactttttttgtaaaattagatgggacctcattcctatgatgctgatgttgacatgggactttgtccaaggtggacagctgacgtggcaaattttctttcgtggcagccttttgaaccacacaaacgcacccacctagccaagttgttgcattggtacgtccaattttcaagttcttgcacttaatcacaccccacccgccaagttcttgtattgtcaacgcaatttactccaaaactttacttataaattattttagttacttcattcatatttatacattgagaccttttatggtgctcaacctcttattcacatccatcgttcattctttaaggggtaatttagggaaaaatataaacaaaggcgtggtaattgtttaagccaaaccatctttaattaacttctcaacctttgtttaccgctaccctctatctaacttccctctgctagccatgagccatttcttgtagttctcgcctacagcttattgcttgggtcactgtattttatcaatttgtacgtatggacagctaccactaattagggttgtcaaaaaagtttgaggctcacgagctactcgagctcggctcgttacaaacttgatttgagctcctctcgtttaagattaaaatcgagctcgagcttcactttaagcttgcgagccttccgagttgagctcaaataacttgccgagcctcagcttttactgtttcgtttcccctctctctctactagtactagtactataggccactctagtatagtaggtacaatagcggactataaaccagttataagcacatttcgagaagataaaagaggagagagaagagtagcaggctatagatttatagtcagctgcagcacagactccaagatgcaatgtgtgaatgataagtgggaccaggtattaatagtgtatagtagatgttgatagataattattatataaattggctattaaattgactataaatgatttggagctagtagatggttatactattaaacttgctcgtagaggacagccacacaactactatttgctgtcccatttcccaacaagagagcatggctgagtatgtgcattgatgtaggagcaataatactgctttttcccgtctaatcattacaatgtcacattttctcatgaatggagatgaatctgttccacttttgcatgtagtccaagcaggttcacgaaaaagctcgaagcaacgcgagccgagtctgagctcaacttcaagctcgaggaaaatctaggctcggctcgagctcgacttgagtttatactaagctcaagcatacgtagggaagtttgttcgagctcggatcattgatagccctacactaatctaaaactattattctcatctaatttaaactttgattctttataatgattcctctgttgtaatccatacgtgtgcgagaggtagagtttttttttatccatcttccttcactatcatcagtaactatggtggaaattaattaatcctaacccaacccaatagcttgcttcttttcttccacctccaaataaatgattttaaagacccaagtaaaacaacgtgctaatgtaaagtgatcataacaacgcagaaataattaataaaccctagaatatactgatcggcccttaaccatatgatgatacgaagtgataataagagaatatataattgccagtataacctttcaccttttatacctggcccataatttttaagtacccttccaccggtaccttctatctatcttagttctaagagcgctctaagatatgccaagcaccataggaagtctattatatacaatcaacatacctcatctaatcaaaacttacgtagtcccgtgcaaaaggcatcgtagtatcgtaccatactcttctaacctactcaatcaaacgtttgattgactagaaaggtcaaatgatggttcatttttatttatgtgaactattgccattgaacgtccaacaatttaaatttatgtataatgatgggaaaattacaatatttatgggcaaatagttacaacagtcgtaaccaataagtagtgttctgcataacaatagcgcctcgtggtaggttagattagttagcatgctcccatttttacttcttttgtactaggtgtaatacaccgaggagttgactattacccaactgctatataaaaatctttgtccgctgcttggtattaatcataccctccctacgtccctaaatgccgtagtcaggtataacccatcggtagatgtaaatacatggtcttcttggaggggagggcatcgaattataaaccattacaccacgtaacattgagtctacactaggagaaagccttttctgctagccgtcgactacaacccaccgctttgctcgccgagaatagattggtatgctagattagctagcttactcccctttatattcaatgtgatatatttcatatcaatacatataaacattgtcacaccctgattttcgttttaggatttataaattatttaataaattattaatagaatttatattaaatgttcattaatttacaagtgaagttaaatgtgggaaataaaatttcctaaatttaaagcatggatggatttaatttttattaaattctccatgattaattatactctcttaaattttctcggatttttcagagctcaattcctaaatgatacaaagaacaattcagtaattagttaatcaattaatgatctaattataattatgctaagtgcttttcttgtttaaaaatccttaaattataaatttttgtttaaaaggaattattagaaatgatcttaaaagcctaaaagagaagatctaattttaatttgttaaatctcaatataaaagtgggctagataaaattttgttaaatacttctcttgtttctatagttcctagatttttttgggatttatttgagtcaaggaagtatttttaatcaatggaatatcatttcatgaataatttaaatagaaaaggttttaaaatccccctttttggctttgggccgaaagtcggcccaagtctctctctctctctctcctcggcctgcttgcgcccggcccaagccggcccagtccgccgcgccctccctcctctttctcagccgctgacaggtggggtcgtcttcctcctccagccgccctagccaagctgcgcaaaccgccgatccccttccaaaatccggccgccccttttcttctccggccaaatcaattgagggggaaataatctcctcgatctcctcttccttttctctttaggaaacccgagctaattcgtttggaaatcgtcggattcaatgccgatttggttagcttctctttccaaaccctaaaaccttccatctcgctgccggtcgccgtgggcctccgtcgccgcctttgccctagcctgccgccttctctagcgtcgcctccgcgtggttctttgtgtcgccgcagccagtgggtgtccagtcgggcgccgccgtcccttcggtcatcgccgtcggtcgccgtctcctttaccagcaatgtgaggtcgtcgccgtccttgtctcgtcctccgtttccgccgcaggtcaccggagcgccgccgacaccgtcgacccgaagctctccaccgccgccatcagtccagccacgccgtgccgccgttgcagccaccaccttcggtcgttgtcgccaccgtcgggatcacgaggaggagcagcacctcgtcgaccccttcgttgctgccgtttcccgccggagcatcgccgtcattgccgacacgaagaccgccgccgcctcaacctcgccgctgtcgtcatccgtcatcgtttgccgccgttcgagtgctcggtgagttcgccgcgtcgagctctacccgttggtgccctccgtttgcaccgccgtaccgtcgttcgccggcgagcgcgaggtgccgagccgccgccagcgatgacgtcatcgtcgacgtcagcgccttgtcagcgctagacccgtggtggaccagatcgatctcggccgtccgtttggcttagattagatctcggcagttggtttcgtagaccgcctctgtgcacccggtctaccgtggaccgtctttgatgacgcaataaatccctttttcctttcaaaaataattctttattgcgtcataattcaattaaaatccatataaatgctttaatccggtttaatctttaaaaattcataactaattcatcgtaactcggtttaatgtggttccggttgcaaaagttgtataaagatctacatattaaaattacccataaattgaattaaatttatttaattctttttaaatgggttttaattagattaaatcttgtaaaattcataattaattcatatgaagttagaatgaggccgttcaagtctcataattcatctaaaatcatgatctacatgtttttttactttttatgtattttttatttggtttttattagtctttttcctcgttttgcgtgttagcttgtcgtttccgtcacttcgaaggttcgcaagtgcgtcggaagtattaagaagattaattgaagaccgattattgcaaggcaagtcacacagatcccaaacacaattcctttgagcatgtttatcctatatttaaattctctatttatttcaactgcgcatttattttcgaatgtcaccgggtggtgtgaacctgttcatttgttatggccaatttgcattgattaccctatgtcttgatcaccttgggttattataatttgactagttgagctttatatattggttcagctagatgttagacataattgcttagccatacttagaaacattagcacacaattgggataactaatgttccactattacttaatgatggatatttaatgatatttcacgatggtcaatcgtggttggtttattgtcacatcctgatttttgtttcagggtttataaattatttaataaattattaatagaatttatattaaatgatctttaattttcaagtgaagtaaaatgtgggaaataaaattttcttaaatctaaagcatggatggatttaattttttattaaattctccatggttaagtcaactctctgaaattttctcggatttttcagagctcaattcttaaataatacaaagaacagttcagtaattatttgatcattaatgatctaagtataattgttaagagcttttcttgtttaaaaatccttaacttataaattgttgtttaaaaggaattattagaaatgattttaaaagcctaaaagagaagatctaattttaatttgctaaatctcaatataaaaaggggccagataaaatttcat

SEQ ID NO: 48926 - DNA, 9430 bp, Oryza sativa
gctgcttttgcaaatgagcctaatattatgccatcctttggtatccttgtgcacttgcatatttgctgtgtggcttgctgagtatgtcatatgctcaccttgcaataatcaatcaacctcagttgaagaaaaaggatccagaaggagaagacgtttggcttataccccagttgagctgcctgtgggagtggagccggagcttcgctagattttattttccgctgcagttttcttcttggtgaggacttagtgcctcttaagtaagtatttatcgttttagttaatttgatgaatctgtatattaaattgtcaatttgtgtacctcggctgattcctggacgaggatttcatgcacaaataagttcggaaattactagtgaatttcgggcgtgacaagttggtatcagagccatctcgactgtaggataagccaaatggtcaaaccttaaggactaattttccgaaaacatgatttgtgaaaattttcctttcttccttctctagaattctctataaatcattttatcatcctctcccctcctgctttcaacttgagtagttctaagacattgaaacttgaagacgccaatgtggtcaacttatggaggttaagtcaagtggatcgatgaataagaaggtgatggtcgatctgaagtgccaagtggtcaagaaggaatgaagtttggatcctaccttagaacctatgccgccaaagtgtctttgaagaatagttagtaggatagaacgtttgttgtttgctttgtgtgtaggtatggttgcattcccatcattggagtagttcattgatgagtgtgtaactatactaggttgcttgcttaatcaacttgaacaatataatggtctacacacatcagatcagtggtaacctggttaaggtcttatctttagtgtaacacctctccttctatcttctctaatctgcaacggatggtgaacactcacgccaataaaagtggaaataataacaatgaagggaacccaactcttgctcaagttctggctcaacagactcagttaatgaacatgatggtacagcagatgcagaaccagctcaaccaagggaacaataatgctccaccgccgcagaacaagttaactgattttcttcgtgtgaagccacctaccttttctagcactaccaacccagtggaagcaggtgattggttgcacactattgagaaaaagttggaactgctccagtgcactgatcaggagaaagttgttttcgcttcacatcagttgcaaggatctgcatcagaatggtgggatcatttccggatgaacagagcagaaagacaaccaatcacttgggcggagttcacggaagcattcaagaagacacacatacctgtaggagttgttgctttgaagaagcgtgagtttagggcattgaagcaaaaggatcataccgtggcagagtatcttcatgagttcaatcgtctggcacgttatgctccggaagatgtgcgtactgacgaggaaaggcaggagaagttcttggaaggcttaaaggatgaactgtcagttacgttgatctcccatgactatgttgattttcagcagctggttgacaaagcaattcgacttgaagacaagaagaacaggatggataaccgtaaaagaaaaatgactgtattccaggaggcacaaggtagtagccagagacagcgtatcaagccactccaaattggtgaaccttcttccgctggtcaaggacagtcgcaacagttgaatatcggtggtgagatcaaatcagagactaatgaaagcaatgaagttaacatcgagcaagctaatcagccggtgccagttcagcaggatcagtctcaagtgaataacagtagtagaagggagcagcaggtatgtttcaactgctacaagccgggccactttgcaagagagtgtccgaagccgaagcatcagcagccgcaaggtcaggtcaacaacattgttgtcacaggagccaatgcagtgccagttgcgtcttcaagagttgtgtcttcaagtgttacaactcagccaccagtttcaaggcagcagtagttttctttaaagccttagaataattatcggagttatggaataagatagactgcagtttacctattccctttttctttctagccgttccgaatctcgggacgagattctttgtaggggggtagatctgtcacatcctgattttcgtttcaggatttataaattatttaataaattattaatagaatttatattaaatgatctttaattttcaagtgaagtaaaatgtgggaaataaaattttcttaaatctaaagcatggatggatttaatttttattaaattctccatggttaagtcaactctctgaaattttctcggatttttcagagctcaattcttaaataatacaaagaacagttcagtaattatttgatcattaatgatctaagtataattgttaagagcttttcttgtttaaaaatccttaacttataaattgttgtttaaaaggaattattagaaatgattttaaaagcctaaaagagaagatctaattttaatttgctaaatctcaatataaaaaggggccagataaaatttcattaaatactttgcttaattctataattcctagatttttctgggatttatttgagctaaggaagtatttttaataaatggaattgcatttaagaaataatttaattgaaaaaggttttaaaaagtcttcttttggctttgggccgaaagccggcccaaaacccttctctctctttccctcggcccagccggcccagtccgccaagccgccgctctcctctctctctctcagccgctgacaggtgggccccacctgtcaggttcgtcttcctcgagccgccgctgccgcctgaaaccctagcgcgccgccgtcgccgtttccttccaaatccggccgctcctttccttctccggccgaattgattgaggggaaacaatctccgggatctcctctaccttttctcctttggaaacatcggctaaatcgttttggaagttcgtggaaatagagttcgattcggatcggcctctttccttcaagccgcgagctttccttctcgtcgccggccgccgtgggcctttgccgccgcctccttgcacctatataaggacccccgagctcccctctacccgtcgcctcctttgccttagcctgccgtcgcgtctagcgccgcctccgcgtagccctagttgccgccgtcgttgccgtcggttcagccgcgccgcgccgccgttgcagtcgccgtcgtcggtcgccgtcgccaccatcgggttcgccaagtcgtcgccgtccccgtccactgcttcgccgccgccgaagaccgtcggagtgccgtcgccgtcgtcgacccgaagagcttcgccgcttcctcctcgtcgccgccgccgtccgttggtcttccgccgccgttttggtcaccggtgagttcgccgcgtcgtcctctacgtgctggtgccctccgtttgtgccgaagtgccgccgttcgccggcgagcgtgcgccgcccgagctgtccgctccgccgagccgccgccgctgtcggtgacgtcatcgctggcgtcatcgtcccttttcccgtgagccggtcgtggaccgatcgatctcagccgtccgttttggatagggttgatctcggccgtccgttcccgtgaaccgtcgcccgtgcgcccggtccaccgaaaccctagccgctgacgcaataatccttcttttccttttcaaaaataattcattattgcgtcataattcaattaaaatcaatttaagtgttttaatctgatttaatctttaaaaattcataactaattcatcttaactcagtttaatgtggttcaagttgcaaaagttgtataaaataaagatctacatattaaaattgtccataaattgaattaaatttatttaattctttttaaatgggctttaattagatttaatcttgtaaaattcataataaatttatatgaaatcagaatgaggccgttcaagtctcataattcatctaaaatcatgatctacatatttgtttacttttcatgtattgtttatttggtttttattagtctttttcttcgttttgcgtgttagcttgtcgtttccgtcgttgcgaaggttcgcgagtgcgccggaagtattcaagaagattaattgaagaccgattattgcaaggcaagtcacacagatcctaaacacaatcctttgagcatgttgatcctatatttaaattctctatttatttcaactgtgcatttattttcgaatgtcactgggtggtgtgaatcaattcctttgttatggcctgtttgcattgattactttattccttgataccttgggttattataacttgactagttgagctttatatattggttcagctagatattagatatgattgcttagccatgcttagaaacattagcacactattgggataacttatgactcactattatttaatgatggcttaatgatagttcacgatggtcaatcgtgattggttaattaattacttgccaactaaaacttgataatggtgggttgtgagcacatggttttgagagtcgtgctcatgacaattaaggaccagttcgcgagctactgttgtgaaacattaatcgtgccaaccacaagccagcgtgggcaacggctttaccttttgtatagcatggttcattgcggagcaccagactgagaagtggcggagataagcccacgggggtcgctggggagtccatgccttgtttataagggggtgactatgatccgggaacggtgcactgtggtgggttgtgttatgcaaggggtaatgtcacagctcctttccgaggtaccgtggtggtactgaggcacatggtgacatgttgtggggctgtgtcttgtgggtacagtggtacacctctgatcagagtaaaactattcgaatagccgtgcccgcggttatgggcaggtctaacaatgtttttcgtgattagtctcacacctctcacaataattattgatgctataactggtaataatttgtttagctcctggtttggagttagatctgtacagccgggtatggttgttcaggatggttgggcctgtgcagcatgggtgtgctgttcagtgttgattaaaatttttgattaactactccactgttttatttctcttaaatgttttgctaaatgctgcttttgcaaatgagcctatattatgccatcctttggtatccttgtgcacttgcatatttgctgtgtggcttgctgagtatgtcatatgctcaccttgcaataatcaatcaacctcagttgaagaaaaaggatccagaaggagaagacgtttggcttataccccagttgagctgcctgtgggagtggagccggagcttcgctagaatttattttccgctgcaattttcttcctggtgaggactaagtgcctcataagtaagtatttatcgttttagttaatttgatgaatctgtatattaaattgtcagtttgtgtacctcggctgattcctggacgaggattttatgcacaaataagttcggaaattactagtgaatttccggacgtgacaagttttctttgcaactgcttgaatgaaaagacgacgatatcgatggatattagatccaacgcttggcataagaatccatgcgacgcggtaaggtcccaaaggtagggcgatatcgatgaggagttcaggagcggcgcatggcgcacaaatccatttggcgcagtagggtttcacgggtcgagatagaatggaggataattgaacttgtgtatgacaaataaattcgccgaacaattttagggttttgagcgagtggccaaactcggtaattttgagcagaagggatagggaagaaatgaattcggggagagccgagtcgaatagacgagatggctcaggttcaactctagtgttcaatcggtctgaggaaaagaagatgttatgacaaatgaaaggctttcggagattcgattagcttcaccgaaacgcttaacaaatcagtcggagaggaaagacgacaaggaaggatgtcgattggagaacatcctttaggtggatcggtttaatcgcggtattccaacgattcaaggaaatgatggggtattgcaattgtacatgagagttgagaggacagagaagggattttaccctgacgggcgattctggaagaactattgagttcgagtaattccagacgctagaacaatcggttcgggaggatccgattgagaaggaggatcgaactatggaatttgattccggaggaaaggtacgacaaggatttgaattcacaaggatgaattaaccgagatccttggcataaacaattaaatgcacacaaataacacaaatcccattgtgcaggtcggctaggcctttcaaggaggaaaactagacttttccgtgaattcttttgaaataaactctttttagattttagttcgtaaatagagttttgctagtaaattccttctagtatttatttgtaaaataattgccaaacacttatagtttcaaaatagggttttcagaagttaactaatattagcccgcatttgtaaaaatagttttctcagagaaatatctctcaaagtatgttttctaaatatttagtatttgtttttatttatgaaacaaataccccaaataggttttacttcatagaatgggttttcagaaagacaaatggcatttgcaaacattttctaaattaatatatttcataatcatggttcttttagcaaataatatttgaatcaaaaatagattttgtttctagatttccgtcctcgtggtccaagcgtaacccaaaaatgggagatagaatccaattaagaccagcatgatggattttggaaaagatttttgattaacacgaaattttgatttcgcaaatcaggacagaaattttcagggtgttacatagatcaactgaattccttatgattaagataaccttcccatttactttaggatatatcgtatttgcgtactatataatataacccaggatataaggtacttcctccgtttcacaatgtaagtcattttagcatttctcacatttacattgatgctaatgaatttagatatatctctagattcattagcatcaatataaatgtggaaaatgctaaaatgacttatattgtgaaacggagggagtatgattcattcataacctgacaattactccgtgtaatctccctctaaaatttatttttgggaataatataggactgtttggtgatgctcttagcgatctcgtggcaagtgtccaagtgacacccatttgccggtggcgcgcctttgggcccatggccatggcgcacatgcttggatgggccggcccgtcgctccacgcctcggatcaccactgtcttcgcccgcggcggcgcacgccgccgccggagcccctgccccctctcgggcggcgcggcggggaccggggctcaccgcggccatgcgctgttcttgctatccctctcgtcagtttgtgccctcaccctgatgatttccgtttcactagccttgcacttcttgtcttcttccactcaacaggttggcgctaggttttgccgattggggatgaactcgtgacgaaattgcaatgtggggctctctctcggtaatggattggaggtaatagtctggggcttttttttttctccatgggttgctggtaaatgtaatctttaaactatcggtgagaggctatccaacaaagataaactaatgcatccaagggttcggtttgcttgatcatcagttccattttgtaaccatgcactttttaaaatctgtactccaatgctagctctgaacttttttttttctttacaaaaataccacggagcatgttctttactggtgtactgctgctgtccatgttttgctcatggtgagcttttgtaattctgctacatgctattggaaacatgggagatgaaatttgtagatacacagggcatatacgggttatcagtgactccttaacaagggctgtatgggctatgaaatgcgcactgtcttctttttttcggcatgaagtttctaacttcttagcaaatgggaaagaagatgatgaaccaaaggtaaagaggtgggacaagagtcttcatggtgagtgaaactatataagggaaaatttacatatggtgagttaaactatacaagggaaaaattatatgctagcgtaggaatacctcatcggcttggtcatgcagaagaaaacaaatttacaacagtttggtgagattttaattgggaactacaagtattggagtgcagatatcacctaagtataccaaagcaaaaatccgtcccagttgacgagtgtccgttcttgaaagcctttctccttactcacttctgcctttgtcaccctcctgaccttttatttagtacactgaccccttcgaaattgtaaaaagaacccctttcttccttaagaacccctttcttcctttcagaaactataataattgcaatatgtgttgtgtagagtgtagacctataactaaaaatataagagtagtttacactacatcccccaaaagctctacaacaaagctttatgagaaagcgttatttctgggatatactgtacccaggaaaatgatttacttttggctaccatcaatatttttatctttttttatgctttcctttgttctagttttgcatataatatgcttgcaaagatttcttatcccatacaactataaatgccaatataaaataatacaattatctttatgttctaaacaagtagtaactatgataagcaatatggcatgacaacatttatgcttagcctatcaccattccgttcccattcgattttagaaattaattaaagttggcagtgaagtggcatgacagctggcatctagcaagtcacctcacattctcctgcctcgtatgcccgtccagatggatggacaagtgcccgcaagaatgcaagcctaaggagcgcatcctgccacgtgtttccttccccgtatttccgcagaaaaaacagtttcttttacaccctatttaaactattctctggagtccagaccttgcattccctgctaatggagtggtcttagaatttcaagaaaaaataggaactaaggggatagaagcctttccacttctcatctctggccatctctgttgaagtaaagaggtaccttcttgtttcaatctcttatttggtttgtgatgatacttttagttggtgtttggttcttaggaactgatggggatgggatagatctgtttcagggaaaggggttatccctggacgaaaggtctatccgccacgctactcatttgggatctttttttttttgtttctgtgtgtttagcagatccatttattgtttga

SEQ ID NO: 48927 - DNA, 19750 bp, Oryza sativa
tcccctccaatccctccctcttggggattaaccgaataagatcttagtaagtgggggaagagaggtcaccataccctggcaacaaccccagttactgtggataaccgcggtaaacgtgaaaaacaggaaaaaaaataccaaaaaaaaataatttttgtttaaatatttttgaacttggtggggttattgggcccttaccgttaccggaccctggcggtcagggaaaccatgggatccgctctgttattggttgttgccccttgctggctacggtgctctgcgttagttccctgtgagacctttgatctcgacaccaagtcctcatggtctcgtgcagcagagtcatgctgaatcggtcgatagatgcagtcatgaagagagtagatagaaagagagcatggggggaggggattagctaggccatatactgttgaacactaggggaattggagttcgccctaggagattgataaattggtccatccttcccgactgcacaagtgcattacctgatgggaattggagaatacgatttgagatggatatatactatacctagtcttctgtcgaaaatattgggggtgcagtactacatagctctgcccctgctaccaaatatattgacactgactttttgtgaaaccaatgatgatggtggaaatactgccgatgactcctaaacagcatcaaacactaaatctctcttgtagaacaaggtgatgcgattgtgtcttgcaggtaggtaggaggaatatagaataattggcgaaggattgtagtgggtctacctaaggatttaattctggaaaaccatctggtaggatccgaaagaggaacacctagaccttcttctgagcaaagttttccatgaccaacccattctgtggattatgtggcaatcggtaccatcgttgaagttgatgatgttgctagccatcacacatgccagtctgagatgcccagagggtttgacctagactttgtcgagaaattgaatcttctctcataccatgcgagtgagcctcagtggacaaaagtttgctctttatcctgttgttcaggatctcgcaaatagccccagtgataaggtcagctaggcagatttcagggggcctatctcctgttatgaaacctgactttgaggtgtagagaaccataaagagctatgttatatatgatttcttaataaataagtcagtagtgtagtatcatcaatgtgatatctaagacagcattatatgtgcttatgaataagttacagcatactaaactctgaaaatttctgcttgcacactgcatttacttagctggtcatggtgcaatggtgttaagtgatcatatccattacattcagtcattggcttaattgtatgaaatagatcattgatgaaaagatcgctagtgtttgttttttaattgtgcaaaagtttacatacaactatctgatgcaaatgtttttttttctcacaaaaagaagaatttccaccgttatgcatcctaaattctctaatatttttatcttgcaattaattagacatacttctctaacatccgtttttgattttcagaagtgatgaacggcgagcttaaacttatggcttcctatgtgagcaagcttaagttcatcttgcaaaaagatcagcagcaggagccccatactgcgaaccttctagtcctacttgggagtagcaatcaggacaaaagaaatggcctctcacagggagaaaacagaatggacacttgtaccagaaagaagccaagaagataccaactcctcaccatgcaacaaaaagaaacgcttaatcggtacgcagtgcagttagcaaaatcagcctgttatgtactgtctcaaaatataagagacgtgatttaatataattagtttgtttgctgtttcgtcccagtgcatttcaatcatgtccgaaccctgatagaaatgacttgaagaagttggccaaggaactaaacatgactgagacccaaatcaaatattggttccagaactgcaggacaaagatgaaggtatattgtgtataaacttctctgttttcaaaataaattgctccctgagtaaatcatttatcttcttgatgtagaaattcaagaacaatgaggagcgcaaactactgcagaaggagaatgaggagctaaagaaggagaatgcagagttgagaaataggatgaagaactcaacatgccgcgcttgtgacctccctttgttccatatagattgccgtcattgggagaatccaatgctcaacaagggtaatcatggcgttacaagtaatctcattcctcaggcagtgtcatccttgctccccagctcaagtggttttgtagcttcaggctccaatcttagtagcaatgctgtgctcatgcccgtatctgccatgccatcatcagttttgcagcctgctccagccgtctctggtgccaattttcccatcttgcacaatctatctgccaatgcaaatgatggctatacggaaaaaaacgtacttcttgatctggcgaaccgtgcaatggaagagttctttagtctaatgaaggagaatgagtctcttcttgtcaaaaaaaaggagaatgggccttctggctcccacacatggatattctgggagtcgaatcacttaactaccaggaataccttgcaaaatccaggacgattggacaaaaacctgttgacttcaaagtggccgtcaccagggacactgccattgtcaatggtagctgtgttgacctcgtcaaaagccttttggatgctgtatgtatgcaactactatgtgctgcatatttaattagtatcatggtttgcctgcatatcttaaacatgttctttatgcagaaccgctggagagagttgtttccaggcatcgtggcaagtgcaaacaccaccaagatcatctctactgggccctctaacttgcacgacgggttgcttcaattggtgggttacatatcataatctcttctgatgtggttatccatatactcgactgcttgcatgtggtggattgatgtgcagaaaaatttgcagatgcgtgcagagctccaggtaatgtcacctgaagtcccagtttgcgatgtgacattcttgaggcagagtgtgcagtttggaagtggactgtggtgtgtggttgatgtgtctattgataccatccttcctggagagagtaaaacagctcagtccagtgtgcagaccagcagtacagctgccagacgcatggaagtcaggctgttgccatcaggctgtgttattgaagaaatggagaatggctattccaaggtgctttgcttcctcattgactcaatcactggtacaaggtgttaattattgttggtttcctcagtcactgatgtgatgtatagaaatttgtgtttgacaactattgaggatgtttaattctcaggaacatatgaaatgagaatcagtcacataacatgacaaaatgtagcagtagttttgaacactagtatagatactaacgtttgtcagagaacccactctattatcccagcatgtaaagcatgtaataaaatgactaatatacccacctgcatttgtgctagccataccattgcattgcaaaaggaagaggaaacaggcacactaaccaacaagttttcagtagaaaacagaacaaaactacattcaagcatcacttaaaaacaacactgtagatatactgacaaagatggctgtagtttcctgttttaggggtgccttactagatatggtcttgttcttgtagaatgaagtcactactatcggtctctggcccttgttgaacattgtacgaacacactatcatgtcaaaaaatctctaaactaaagtacattcatttttttattttattattattcttgacgggaagtgcattgaactcatatttcaaacaacagaatcagctaacctttttagcatcatttttcgtgggcaggtgacctggatggtgcatgcagcttatgatgagagagcagtgccagtgctttatcattcacttctccgctctgcaaaagcccttggtgcgtgccgctgggtagcatcactccagagacacagccagttcctttccggcctgcacaaatacatcttttgtcctgacagcacaagtgagtgaccgactggtgctattatatatgcaaaagaattaactaatctgcacatattgatattaacagtcagttaacactatgccacatcatgttttttatataggggattttcgatagtgacagcaggcatgatgcgaagaaaagtcctgtacctggtgaagcagatgacgagcagcttcacaggcctatttgcgtcgatgtctaaggccacgctgcaagatggtgatgatactcacttcgcgcatcagatagttggtggtgcaacaggtgaacctgccggactgctgctgagcgccaccacaaccatatggctccccggcgtgaacccgaggcacgtgtatgaccacctgcgtgatgagcagtgccatggtgaatggcgctgcctcctcggtgagcagctgcatcagggcaatgccttgccgtatggtgcccccctgaatggtgagaccgtgccagagttctatcgcatggtgaacgggctgcatgaagggcatgctatctccctgatcagccccagagtaagctccttactagttattgtttccctgtaactattaagttgcatacttccagtacagtgcagttttagctagaaagaaacttccattgattgttactccctatatcctacagtaatacagtctcgagtgcctttcaccaaggaatatgttgctgccaaaacttttttcatctttgataattcttgttcagtgaatcattgatcacattaaaagtcattaaagtatgcttatataaggatattatagtttgctcagacacactttgatgaggactaatattcaactttaatctagaagataatatcaagttcctgtgaccaaaggattaataatttatgtcacgcgtaggtgctgcattcatccaaaatccagttgaggtgccagcgcccataaaaatgtattgttgatatatcagtaggacagcaatgtgataatctagacctcctctggttttttcttgaaaagtcacttttgagtcttgaccagtaggatgtttttcgggaagttggtttaatatttagcgaattcctttataagttctcataaagaattaactcttatctgcaaaacaattactttattaatactctgcatcgcatgtggtctttagtttactaaacccctattttacacatgcaggaaatgggtggtaacataagcaacactctgctcctgcaagaggcaagaactgatctttctggctccctcatagtttacgccaggacagatgtgaacaccgtgcattccatcatgaacagtggcctcaaccctgccaccgtcttcctcgtatcctctggatgtgccattcttcctgattgcctggaatcattccctctacacccagctgcaactgcagatcaggccggcacctccagtgccgctatcgctagcaggagcgaaaccggtgggtcattcgtcaccgtcacttaccagatgtttttcagcagccaaggtggcgcagcacctgccagctcatcaattcatcaaggccgtgatgcgctcaagaaagccaccgacattttcaaggtggtcctcgacactctcaccgtggcatagcgcaataccccaggggtagcatttgcatgcgaaagtgaaatccagatcgagttaaatttcagtgtttaagactatgttgtttctgttgttcaggggatggctttatctctgatagacccgtggatcatgctgtttaccttgtttaccattttcagactatcgatttgaaatgttgatcagacatttataataattggaactttgagacatcaatgtttctctggtttctgctttttatttttatttttttacttttttgcaaagggaagccttcagtttctgcaatggtacaatgaaaatggtaagtttacgtccaggttgtttgatgatgattgattgatctattggtgtttcttgttatgttcagtagtcagactgagacgagcggcaacgcaatttgaaaatatgagaattgtatctatatggaagcaatcgtcatcccaccacaattgctggggctatctagttgacaaatgaacgaaaataatttttcaatcgatcaattttttgtagtcagatcccatattgtttctgcagagttttcggttaggctgtggtatgtatgtggttaatgtctgtttagaaacttatttatggcacatatatcttccagatagagagttgctatcttgttctattattattgtatacgtgaagtttctttggacttttggcctcccaattcttgctgttcctttgaggcatagaaaaaaaaaagataaagtccatcttactcctcaaatttaaagcctatttttcactcctaacttttggaaccggaatatagcctaaatcatagtgattttcgctatcattaacttcaattatataagtgttgttgttgtagacctttgagtaacttttgcatcgacaaaaacatgtatagcggacggtccataaccaccttcgattaaatagcagacaattaatatgaactaatagagcaattaaattagtagtcttgttttcaattaaactatgattttttaatttacagttattcaacctataatctttacaattattgattataacttcatgaaacaaatgttaataaaatttattatctaaaaaactaattgtgcaatcgtataagcccaatttcatgtcctcttagaacaagtttaatagtagagctaactaatagctataagttaatctaaaagttaacatatataatagattagctataaaagcaagtttaatagtagatatgttactcaatgttaaaatcaatattgattcaaaggaaccataggaattttgaaggattttattcttgtaggattttttttcctatatacccctttaaattaaaggaatgaatcatattgaatactatgaaatttctacagaataactcattacatacaagttttcgaggaaattaaacatgaggtagaacctcatggaaagttatctttgagtctttatttcttctcaaattcctgtgttttttcctacggtctaatcaaccggtcattcctttaagtttttatttttttccattcctacgatttaaaggaataatgtattggtcttggaacatatgtaaagctagcttttgcatgagagctaacagtctaacacctttttttttgttttctcttttatccacataagtttttatagttggtttatagttcactattatctttgttctgtggttatctctattttctctctatatataaataatgcatttgcttagaagaacgtactccctccgtttcacaatgtaagactttctagcattacccacatacatatagatgttaatgaatctaaacatatacacatgtctagattcattaacatctaaatgaatgtgagcaacgctagaaagtcttacattgtgaaacggaggaagtatatagctagctagctcctgtatgaaaggtagcactcactattttttttctcaactccaggtaagcatgctattgaacttgctcttaggtaaaaatcgacaaccataaaaaccgcctggcttttctctggtttttcgggtcttttttttttttttgctagagctactaggctctccgtcctccgatcctccatccatttctcctctctctctctctctatccatttcctatctaccgcctccgggcgagattgccttcccacgggcacaacctcctttccagtgcggcgggggcctccacggggcgcgtaggtctgtgggaggaggcgacatggaggctgacttctcctgcaagtagtgccacctacctccatctttgctgcaatcgagctcaaggtactcaaggtactcctcattctcccctcgtttccgcggcagttcatcagccgcacttgagcatattggaaatgtatcccaaattgaatccccttgggatagaaaaagaaacaaaagggaaaagagagagaagtttttaatcggtttacctggtgtcaattcatatttgttgtgtgttgttaattgttatgaattaaagtatctgcgagaattggagtattttttttagtttgaataagtggtggacgtaggattttataaatgggggtacgataaactaatttatttataaaactgtttgatgaaaacaaaacaacaaacacatggaaaatagggaaaccttatattttattaatcatgattcattaacatgaatgtttatagatacatgggggctcccgtaggaattcgccttttgccttcgtgaggaatgcttaataaaaaggtatgctgactggagattgcttgtagtccgttgattcccagcgcctagtaatgaggctaccggttaatttcatccatagaacgagcctatggaacacctccgattaagctgtgcttgtgatcgtcgtcttcagaattatttgctcaccgagggttgaggttggtgcaaatttaatggtgaatatagtgaatgtggaacgggtggctttgtttcgccaaaacctggtcacggtacactaccatcacgtcggcgtgaagagggaatttggtgaagcggggtgacctttgcctcatcggtgcccagtcatgaaccctgccttcatcaaacatagattttgtgggtgcttttgcctcgttggtgcttagcaacggtgtctccgattcccatccattttagacgtgttaatagtatagtgacctagccttgttggctctatagtttcgtctagcctcgtcggtcatagacagatggaatgagtgaatggctagagcgttgttagcttttagccaacatgtcgtccagccttggacgcaacgccttcgtagttggtgtatgcatgagtcaagaacagctcccgtgcatatgcatgggtcaaaatatattttaattatgaaaacaacgcttagatagtccgatcgtatgagggccggacatatctagtaccattgttattggtatcatagtaattgatagacgatccgatctctaatgagggctagacgcctaattttaatcatagaaaatatcaaatggcacttagatgatccgatcgccaatgagggccagaccagcctaataccattgattatataaatgcagtctgatcatagccgtgtttcggctctcatcgatctgactttaatcatggtgacagattaagaacacgtagatgtccaatcgccaatgagggccgaacatcgtgtttaatctaaaagattaatatttattcaatgtacccaccgtccagcgcaaatatcctgaacggtggcatgttgtggataaataaaccaacttgacaaaggacgccggctgtggtgtttaattttatccgcaatggcgcaggttctgctatcaccggcaggcttcgatcttttgattttcctaatccaccaacaatcagagagatgagacgaatgaaaataatagttgggtgcctcctgtggcgtcttccacgtctccggctcgagatggggtctgcgccttttatatagaggcagaggcgacggcggcctcgcctaatcacagcgaatgtgttaatctaccgacctgctgcagataaagaaagtcatgtgcattgctgattagatgatcatgggattaatgatgcttatgacaggtgggtcccatgcatcacacgcgtttgccgatgtttatctcctagttacagataataaccatgtgcttaactttagcgacaaacaaaaacaacatactgcatgctagctagtactagttaatctcttctcttttcaagcgcatatctcttcaattgtgcattaaatttaaattctatttgaaccattattttctgtttgaaatatacaacaaaacaagtccaatattgattatatttggacatcgtgtgatatttgaatcttccgggtccacacgtcacagagacacgcctcatatgtattcagtaaaattgggctgcaaataatattctcatataaaattaaatacccaataatttattatattttctatgatttttagaaaaaaaattcatcaaacaaaaataataaattatctaattattatataatattatttctaaagaaatgtaaaagatccgatacatcataaagaaccagactagaaataaactaaatcttatttttatatgtagatgtcattgtaatgcataggcatgtaactggtaaatagtgaatttcacaactcacttgaacaatatatatagtgcattatgatcattggattcattacaagtgttgatcactagttcatccaaaaaaaattatatgactatatcgtttaatattaataacctttatagcattctagattatatttagcaaaaatatatttctcttaaaaaacctagtcatgtaccttttataaatacaatatcattaaatttcctcatgtaaaaacatagataatatatattacggagcacacacacatgagctagcttgcttagtattcatatgcaagtaatagtgttggctgtagcaatattataataaaaaataaataagaatgagaaaacaagaagaagatggaacaacagaagaatataaggttaaagtttttagtttcacaccatttactacaatgaacaattttaatactattagtatattatcgattaatgtgtgtatatatcataccatggatgtgagcaaccaccctcatgtgtttgggctagtgactaacctcctctttttcttacttctttcgaagttctctgaacgtatttaggtaaaagatgttttggtttcaataaaaaagaaacaatttaactagattattttttagagagaatccatcctgtgccgctgactttgtccttgttctataatatgccactgagttttgttaagttctacagtatgtcattgtatttttcttaaattctataatatactatctgtaacgccccgattttcgttcaggattaaaaatcaattaataatgcattttctagaaattaaataaaagttaaagcaatttaatcaagtgaaattattgagggaattaaaaatttcctttaaaaatcattggccggaaatattttgtaatattctccgtgccctaaaatactctccggattttttcgcgaatttttggagctcaagaagtaattttaaaatcacaaagttcatttaaccaattaaaatgaaaagaaaacaaataaaatccccttcccaccctcttgggctcggcccaagcctccccttccccttcccggcccggccgccccctctctctcccaggccggccgtcccttcctctccctcagccgctcggccctctcctccccttccccgaagtccactttgcctccccagccggcctccctctcccctttggccgataggtgggacccgtgggctccacctgtcatccccgacctcaagcctggccggcaaccgccgccatggccgcccactccgccgccaaatacgcctcgtcccgcccgcgcctctcatccaaaacgtgtggacatggatcccctccacctcctccaccaaatccccactcgtcccgcaaaaatcggcgccggttaaccctacttcctccccaacgtcggtgtcccactccgccgccggttgccacctctcccgggccgccccgtcgccccgagccctataaaaaccatccacgtgccatcctttctcgtttcccctcctcacccaggctcatcgcgccttcccccgctctctccacgccgcccccatctccgcagctcttcggcgagctccggccgcctctagccgccactcttgccgtcgccgcgctgtgctgtcgccccaccggcttcgccgctccatgccgcaccccggcctccacctctcctcctcaaaccgccgccgaaaccccgccgccacctctaacccgagtcgccacctcctccatcgcctccagccacgcgccgctgtcgcatggcgccggtgccacctctgggttcaccacactgccccgcacgtcgtccgccgctccactcccctaatctgccaccgaaaccccgccgccaccacaccacccgaaccaccaccatagcagccacctccagccgcctctcgccgccgtccttatccaccccgtgctgcgctgtcgccttcctcagcaccgcagccatcgtgcgcagcccggccgcccctctacattcgccaaaggtcgccggaactccgcttcctccgcccaagatcgaggacgagcccgtccgcctcttcctgagcgccacccgccgccggtgacgtcgttccaccgtctcccgtgccgccgccggttgcttccctggtgccgtctcaccgtcgccgccctcgcgtgtagaatccgtcgtttcggaagcccgcggtcgcgaggaaaagagttcagaagattgtttgaagaagcaaagcaagtcacacattccccttgagcatgttgatcccaatttacaaatgttttaccgtttgcaaataaatatgcatattttgttaattacatgggatcagggttttcctatctgctcgcttgtaccatgtttactatatctgtcctttgtcaaccttgggtgataaatcgactagatcgtgttacttatgtgacctagctagaattatttgcttagccatgcttaatcatcactagctcagttgatgggataattgcagtattagaccttctagtatcttgacgagctgcgtgctcgagacacccgaccatgtttcattggtcgtaactatccaactaaaatacgactgaatggtgggctgtgggtgcgtggttttgcgagtcgcacccatggcatttaaggaccggttcacgggaaaccctggaagacttaccgcgcttgccacaagcgggagtgggtaactacttgatttgaagtatagctcgaccctttcctaggcaccggtggcgagggtgggcgtgatggagttgggtcggccggggtatccggttgtccagctgacggattcaccgtggcgcacgaggggactgcccacctccggggtagggggtgggggtgaaaccttagcgtggtgtggatggttaggggagggttatgcggagggtcttgtcacaatcactcgacatggtgacgtgtctgcgcaggcacggtgacatgccggtggattgtgttttgtgggtatagttgtgcacctctggccagagtaaaactattcgaatagccgtgcccgcggttatgggcgatcgaccggattcaccgtgattagtctcacacttaataaattgacccaatgtactgtagttcaggagggttggttgggcctgttcaacgtggtgtagcgttgatcagtggagatttaatattaccttaattacttaactgttttactgttttgcgcaataaatgttttacaaccgcctttatgcaaatagccacaaacctccctttgtgtccccttgcatgtctgcatcgttggtgtggcttgctgagtacgatggttgtactcagccttgctatttcccccttttcataagtgtagtgcttctgagctgaagacgaagttagaagaccaaggctcagaccccagttgagttttgcctatggagtggagctgaagccctgctaggatcgcctttttccgctgctgctattttcttttcggtgtaaggactaggtgcctcttctgtaagtatgtacgctttatttacgtttggatttgtttattacttgtcgttttgtgtaccctggctggtcctggacagggatttaatacacaaaatagtctagaaatttgggctaaatttctgggcgtgacactatcgctgtccatttagatcccgttagtactgtataattttgtcctaatgattgaaatatccctaggacaaaaattttcaaaatttggctaaaaattctaaaatatcatattataaattaggcagagaagttgtccatctcaaactctttaagttttacaatctgtattataaaattgtacaatgctaacggaggctaactagacgacgatgttatattatagaagttaagcaaaatgcgatgccatattagaacttgacaaacccaatgacatattgcagagcagggacaaaatcagtgacacaatggattgtctctgtttttttatggttgttcggttaactacctatctactgtgatgcggcatttttagaaaaaattaaatcttatactataagtccatatcttacacattaaattgcatactgaaagttcaagtgccattaatttggttttgatgattaatggcaaatccaattacatgagactaatattgttataagcatttctttgtctactagtctcatatggatatgaaagtggaatatgtgaaaggtgatttctggacttcatatgagttgagagagaaacgttcattgatggtgtacctaaatcacaaggatgaaatgcatggagatcaagctatatgtatcactctttctatccatgcacatattgatatattcatatataatattttcatgtgattacataagcatgtgagactaatgttttgtttgagccatatcttgtttagtctctttacattgagaacatggagatgatgaaggtatgtttttattttattgtctatatttgataaatgccttctattcttgtataggataagctctcaatgtttaatatcttattatgcatacttttgcttcacacaaatattttgtattcatacatttagggggagcaaatcctatactttagttatgcatgtaatcgatccaagttattcaccttcatttaattgggatctttacatttgaacatatatttgagtatatgacacttgtggtgttgattaatactcatcatttattcatatccttttatacatgcgatcggttggtcaacatatggaggttgacaaccggatcattgggactaataattttattgagttaaatgaaagaaataggtcccaaggattacaaaagtgtttatgctcaagtggtatcattacacctaacaacaccaagaatgacagagtgaagatattgaagatgtgtgatacgaagtggctattatggcaaagacggtgaagggcaagcgatgctcggtcacgatggaccatgcggcggtgaaggacaagcaaggggcttggcgctaaagaaccaaatctggtggtgaagggcgagcgacggctttatcatgatggaccgtgcgagacatttgaagctacaagtaaccgcatcaatcatttgaagaatatatggtgaaacggtatcggcattggcgtccctcaagacaatgaaagaaagatgaaaaaaagacattcctaatggtataattctcttcttatttacatttgagtttaggaatgccgtattattaagagggatgcaacgtcgaggtgtttgtgtatgtctcggtgctcaaagtgacctatcatagtgctaccttgagagaaacccaagctttaacctatcctttgagtggttttagaccttgtttttggttgagttgggtagtcctctgggtgagctttccatagagtccaagatcatcaaaaaccgactcctgagcgaaaagttatagtcgttttactctgtgtttttcggaaagtccgaaaaattatcggaaaattcgaaaattttcggacattccgaaaatggctgcgaatatgatatttgcttctgtagattttcggacttgtccgaaaatgcttttcggaaactccgaaaattacagtcttggtctccaacggctagtttttgaggggctcgggtatataaactcctccactcctcctttgagtggctagtgttcttaggcaacattagacacatccaaagccaaatagccatccccattgccttacctttgtggtgcctctttgtgaggggggtttgagaaggggagagagttggattgagagagtgaggagttgagagctagtgagattcactccatcctttgtggtgcctctttgtgagagggatttgagaaggggaaagggttggattgagtgattgagaagttgagagctagtgagcttcactccatactttgagcacttgagttcatagcaagcaaatcttcgattgtgtttgttactcttggggactaaggtctcctagacgtttaggcgttgccggtgagcacccaaggttgtggtgtgctacggaaagtttgtgaaggcttcgatttcgcctccgcaagggaagaaatcaagagtgaaaccgaggagtgcatttgtgcaacctcgtgaggaaagggttgaaataggcccggcccttgtggctcctcaacggagacgtaggatccgtggatccgaacttcgggaaacaaatcatgcgtctcctctcttggcttgcccatttgtgcattctctcatattgtgcttgagcttgtttttacccgatctacttgcatgcttaattgatttagttggtgaccttatatcttgtttagataccttatttgtcaccttttgattcgtatacattttgtttatttgagctacaagttcataactagtgttttattccattatccgccgaatttttcggttgagaccggaacttccaatctgatatcggaagttcctatttgaaccgaaagttctcatcattctaatatgctatgaagttgtgataatttttaggaacgcctattcaccccccctctaggcgacgttaaggtcttttcacatacacttataatataattttcaaattataaaatgccctattctcattttataggagaaatatggaaaatgatttattatctatttaattacgaaaataatattagtccaaattaacatatatgtagaaaataaaaaacaatatgaaagaattacggaaatacgtactaatgtagtcatcatgtataatgcaatgagaaaagaagaccatagtcgaatgctttattattgagcaaaaatgatggtattatttttatcatcttttagcggaatctatctaaccataattaataagcccgtgttagtagaagtctatgtcgtcatgcatcaacatatcatgagactattagttgtagctaagtacaccggcccaaccatacttagcatatcacaagactatcgggtaatggacaattatctttaattgtgctagagaaaaaaaagtactcccttcgttccataaaaaaccaatctaggactggatatgacacttcctagtaaaacgaatctagacatgcatatgttcagatttgttgtactagaatgtgccacaccagttctagattcgtttttttttgggacaaatggagtgaattacaatccatactatatattcttgaaaatttttaaaagttttcatataatattatcctttaaccattattttcatttacacaatagctaactttacattcaatttggaccaccatattctatccatatccaaatccggtgactcagtaatcactctgcatattaactctctctctctctccattttctttttccctccgatagttggataaccgatagatctagcaagaaggagcctggatatatagcgccttccctcttcgtcaggtcagctcctgcctcctaaagtccctgcaagcccgacatccctgacctcaacggcaaccataacaatagtgcgcatcatgatagggaaggacaaaaagacatgtttgttactagagggtaagtatgcgcatgtaaaggcaaatggaaggaacgatggtggctcatggagaaagagcggtgatagcggtgcgtagagtggcagttagcggttgctggtggtatgaggaatttgttgtcgacacaatcacttaatttttccctaaatattgattatacgtgggttaccagttatataaagaaatagcactagctagttttaaaatactacctatgtcccaaaataagtgcaaccgtgaaaattcgtgtcgaacttttgaacgcccatctttgaaaagttaatgaaaaagttaaaataaattagtcaaatgtaaaatattattcatgttttatcatctaataaaaacaaaaatactaatcataaaaaaatttcaaataagacaaaaggttaaacgttagatatgaaccgtgtaaaactgcatttattttgggaggaaggagtagttaataaaaatagggactgtctaagtacaatccggtttaaaaaaaatttgtatctcagcggcttttttttggtactaccgtacaaagggtctctgtatcgatgacgctagatggcgtcatgcacaaaaatattgtctctgttttttgtccttttttttgttgggccacagcccacatcatcttatttgtgataacccagaaacccttgtagcccacaacccactggttcgtgtgctcatatcccacaacccaccacatgattgaaaaaagcccaatactagaataaatcaattatatcagtgatacagcccacgacagcccatggcccacggcttttataactattaagtttagaaacttacatacaatacaaatcattcatacagactgttttgtatgcatggcatacatacaaatcattcacgcataagtataatcataggctatttgttttctgggataaaaacactgctacatatgctacagtataatcatagagcacacacatttacaaaatccatcaggacacacacatgcaaagaaaagggtgtacagataggcatatgtacatggtacacacattcataaatccatcagggtgcacacatcagggcacacaaaaatgtacaatgtagtgatgcattgcagagagccccatcaagcatcagctagcaaaaaaaaactcataaaaatcgtccaacatattcagagtgataaaaatgggcttcatctctgatttagacgccctgccagcctgcctgttgcatggctgctgcaatgcactgctatgcatgcttaccaaagctaccaaatagaaatctaaaaacaatgtgtaacttatgcacagagatgcagtagtgaaaaatttatcacaaaaccaaatagtggtgtttctggaggagtcaacagcctgtgaacccaaaaaaaagttaagatgacagaactataattattgaaactgaaaataaatgaccaatagaactttacatacagaggtttacatacagataagcctataggagcatatagtataggagctatacaataaaaaaaatacaaagctatagtataggagcatcagaagttcagaccacaaaaatatgcatcttacaaggattatttgatatatgaattagataccaaggctttttctgtcatagcattagataaacatgcaccttataagtattatttgacataagactgtttttgacaaaagcatggacgttagaattgagagatttttatggcaagcaaacaacggaattttgaacgatttccagtggttaggctatgacctaaataagcgataaactgattaatatgtaccaaaattataaaaatctaacaaagacaaaaaaaaacaaaaatatatacaaaaacaaaaatacatcatttctgaaactatactgatttcttacaaagtaaaatttttggacaaaaacaaacacaaaatcaaaaatacaaaaaaacaaaactgagagagtaaacacaacgctgacacaacataacttcttcagacaaaactaacaaaactaagtgatattcactaaaattatgaggtgatgcagtctt

SEQ ID NO: 48928 - DNA, 7934 bp, Oryza sativa
tccccctttttggtgattgatgacaacatggttaaagcttacaaaagattgaattaaattttgttttgaatggttagaggtgaatgaaactcccccttaatgtatgcatatggaagatatgagtggagctcatatgcatatatataagggagcaaccgaggagagtttccttcatccctactcattcgtgggatgcaaaaagcagtaagaatagatattatatgcaaaagatacgacgtggtgagcactcaaaaggataaaatcaacatcacatcacgaacaacaaataagacactcaaagcataaaagaaatgcaatatatataaagagcagctaagagcatctaacagtcattacatccacacaattagagaattattacatgtccataagttcttaagagtagaggccaaaggactgccaggtccggaacttccggataagatacccggaacttccggacaagcagacaagacaataaagcaaggaaactgccaggtccagaacttccggataagaggatccggaacttccggattaaacagacagagcaggtagcaagcatcaaaaacaaaattttgaccccccttaattgcaattttctccccctttggcatcaaggcaccaaaaaaagacaaaattacaagggaagaagaggatcaagcctcatcattatcgccatcagaaggaatgatctcagtgtcgctggagtgaggagagtcgatgtcttgctcggcggcgtccactgcctcatcgggatctgtaggaacattctcggtaggggcatctgactcctcatcatcactgctctcctcgagtgagaggactcctcattgaagaaacgagaagtgccagagggaccctcaccactagcaatgtctcgagcagtctcataagcagcaaaaggatcaacaaactcatcatcagaaatcaagccttttcttggtggtgccaaagaaagcagtggagtagaactatccaatcacttcctcattctaggaatactgcaaggccaacaaatctgccacgtgcttgcgctcacacaccttgcgtacctcattgaagactatgttgttctttgaggacatgtactgccaatctagccacttcatctctaccactggatgagatcttcccatgatcacagagttataccaatcaacctgcaccaaggtcctgaatctgtcatcctgagagtcagctggcagagtatcaggactaaccattctgtcctttccacacttgagtagatttttcagatagttcactcttgggcgtttaggatcaggatcaacagcccttgtcttgtacagcctcaaaggattgctttcagaaccaggctcatcctcattgccaccatcatctgactcagatgcagctggagagggagagcggggtgcatcacgaatgacaatgctaccagccctcctggaatggatcagaatctgactcccattgtaaaaatctccaactttttctttgcccaatctccccctaggaccacgaaccggggggctcgagtcaccaggaacatcttgagaaagcttctgtctcttctcacgaggcataatgaccactgcaacaagaatcaacaaggttggagtgcaatggttaaatgaaacagtagcagaatcaaggttactggctggctggacagagaccggaagttccgggccaagaacaccgaaacttccggcctgcaaaattgaagaacagaggatttaaccaggccagtgcatgtgacaaaatcctatagatcggcaatttacaaggtagcaggaacaattctatccaaaaggttttctccctaggttcacatatttagagatcggggcaaaaacatgatgaaccaaaggagaagatcaaaagtgctaccttgagggaaaatcgcaaatcgatcgcgggatgaacctcctagccaccaatgtggttgattccacggagaggaatcaaatttccacggttggaatagaaagtcgccgagaggagcactgtagcggcagctagggtttgggaatcggggaggagaagaagtaaggagagagaacaagctcgggctccccctgggtatttatacccccgacccccggaagttccggactgggatgaccggaacttccggcctgacagaacagagggcagtcaggcccaagttcaaaggaatagatgagaattcaatgatttagaaatgaaaacctatggacataaagagacttatgatgtatatgaccagccaacaatcaacattacataacaatggtcaatatacatcacaagaagggataaaaaccaaattttcgcaataaaaacacacaaaaattttcgcaaaatttcacaaaagggtttttggataatagagggaatgtttgagctttattcctggtatcaagaccatcttctacacaagaagtgatctcaagacacaaaagctcttttttttttaatttacattttagtgacacatgtttggctattaattagccaatcacccatcacctaatgttacgagagtctaagatattgagctcactcctaagctcgcaaaatcttttctcatctaaaggcttggtgaaaatgtcggctaattggctttcggttctcacatgggtaaggcatatgtctcctttagtctcatgatccctcaagaagtggtggcgaatgtctatgtgtttggttcgagagtgttgaacgggattaatggctattttgatggcactctcattgtcacataggagtgggatcttggtgaagttgtagccaaagtcttttagagtttgtttcatccaaaggagttgggcacaacaagaaccggcggcgacatattcggcttcagcggtggataatgcaatggaattttgcttcttggaggaccaagaaacaagggaccgcccaagaaattggcaagtcccggttgtgctttttctatcaaccttacacccggcataatccgaatcggaatagcccaaaagcttaaagtcacaacccttaggataccacaagccaagattaggagtatgaactaaatatcttagaattctcttgacggcaatcaaatggcactctttaggctccgcttgaaagcgagcacacatgcaaacactaagcatgatatcgggacgagatgcacatcagtaaagcaaagatcctatcatggagcgatataccttttggtccacacatttaccattatcgtcgaggtctaggtggccattagtaggcatgggcgtcttgataggtttggcaccctccatcccaaacttcttgagtatgtctttcacgtacttggtttgagagatgaaggtgccctcttgtgcttgcttcacttgtagcccgaggaagaaggtcaactcgcccatcatagacatctcgaaccttttagtcatgatactactaattcttcacaaaaagagacattagtagaaccaaatattatgacatcgacataaatttggcaaatgaataaatcactcttaaattttttagtgaagagagtagtatccgcctttccaatttcaaaactatttttcaaaagaaaatctcggagacattcataccaagctttaggggcttgtttgagcccgtagagcgccttgtggagcttgtacacatggtttggcaactttggatcctttaaccccggtggttgctccacatagactaactccgagataggtccattgagaaaggcactcttgacatccatttggaataacctgaaatcatggtgagcggcataggctaaaagaattctaattgactcaaggcgagtgataggtgcgaaggtttcaccaaaatcgagaccctcgacttggatgaacccttgcgcaactaaccaggctttgttccttacaaccaccccatgttcatcttgcttgttgcgaaagatccacttggtgccgatggcattttgcttgggtctctccaccaaagtccacacttgattgcgagcgaagttattcaattcctcttgtatagtgtcacgcccggaaattcactagtaatttccgaacttatttgtgcataaaatcctcgtccaggaatcagccgatgtacacaaactgacaatttaatataccaatccatcttaataataacgttacatacttacaaagaaaagaaaacagcagcggaattaacggtctagcgatggcttcagctccactcccacaggcagctcaactggggtataagccaaacgtcttctccttctggaccctttatcttcaactgaggtttgatgattattgcaaggtgagcatatgacatactcagcaagccacacagcaaatatgcaagtgcacaaggataccaaaggatggcataatataggctcatttgcaaaagcagcatttagcaaaacatttaagagaagtaaaacagtgaagtaattaatcagaaattttaatcaacactgaacagcacacccatgctgcacaggcccaaccatcctgaacaaccatacccggctgtacagatctaactccaaaccaggagctaagcaaattattaccaggtataacatccataattattgtgagaggtgtgagactaatcacgaaaaacattgctcaacccgcccataactgcgggcacggctattcgaatagttttactctggccagaggtgtaccactgtacccacaagacacgattccacacatgttgccatgccccgaaataccaccacagcattgcaaagggggaaatcgtgacaatacccttcgcacaacacaactcaccacagtgcaccattcctggatcataatcaccccctcaaaaaccagagacatggactccccagcgacccccacagacttctcgccgcttctcagtccggtgccccgtaatgaatcatgctatacaaaaggtaaagccgttgcccacgctggcttgtggttggcacggttaatgtctcacaacagtagctcgcgaaccggtccttaattgtcatgagcacaaccatcaaaaccatatgctcacaacccaccttaaccagattttaattatcaattaattaacatcacacgattaaccatcgtgagcgaccattaaatataaccataataataatataatataatatagtttataattaacccctttagttagctaatgtttctaagcatagctaagcaaacttacatatagcatttagctgaaccaatccaatatataaggttcatgctaatcaaattatacccataagaaaataagatcatcttcggccattaattaacggggaaaggttcaccacccgatgacattcaaaaataatgcatagttgaaacaaaataatagctttaaacgggttcaacatgctcaaagggttgtttgggatctgtgtgacttgccttgagcttccgcaaacacttccgaaccttgctcaacgaaaacgctctcctttagaacgtcggaaactaaagtaaaagaataaaaatcaacaaaacagtacaaaaacaagcataaacagtacatgtgaatatttttaacatgtagatcttgattttagaaaaatttagcaacttgaaccacctgaaacggatctacggttatttagttatgattttcagaagatttaatctattagaaaaaactggaaaaggagaagatgatgacgtcatgatgacatcatcaatggcggccggctcggatggcgacctcgccggagctagggtggtcggccgggattttggaggacacctatacgtagagaacgacgagacgaacccgatggtactcaccaatgcgtccaacgacgaccgacggcggccggcaacgacgcaagaggcggcggcagctcggttgaacggcggtgatggcgctacgacggccggcgacggcggagaaggggcggccgagcttccccgctcccgtgcgcacctaacggcggcaacgagaggcggcaacgacggcggacgcggcggcgcggcgtggccggaggatggccggcggcgacggcggcggcgacggagctacggagcacgggaaggcttgggaattggggcaaacgaaagaggaggactagggggtcctatttatagccttggattgaagagatcggactcctcccgcaagaaatcgatccgggaaatcaaaaactcggttttggagataaactcaaaaacgagttcgattcggataaaatactcaacggtttgctccgattcttggggataaggatagaggaggataagaggaatatttcccctcaactaattttaggaaaacacaagagaaaagatcagatttggaggggaaaaaccgagcccactcggtctcggttcggctgctagaggtagaagatgaacagtgcccagggaggaaaattagacttttggttggctgagaacagaacagagcacttgacttgggccggcttgggctgcacagcacgcgcgcgagggagagagaagaggaagaaatgggccgaaaagggcccaagctgaggaggaggatttttattacttttctaattaaaataatcacttaaatgatctttcaattgttaaaaatacttccaatgctcaaataattccaagaaaaatcttgaacatacttggacactcaaagtatttaatataataatatccagatcatttaatgattaatttattatttaaataattgctgaactgctctttgtatgattaaaattaataattgagctccgaaaaatccgagaaaattccagagagtataattaaccatggagaatttaataagaattaaatccatccatgctttatatttaggaaattttatttcccacatttaacttcacttgtaaattaatgaacatttaatataaattctaataataatttattaaataatttataaatcctgaaacaaaaatcaggatgtgacacatagccatcacccaatccggatcaccaagcgcatcttccaccctggttggttccaaagaagagacaaacgagaagtgttgacaaaaacttgcgacacgagagcgagtagttaccccttttcttatgtcaccaagtatgttgtcgacgggatgatctctttggacagtgtgatgtatccttagatggtgcactgggggggacctgagcctgatcagaatgctctaaagtgccctcaacatcgatcccatccacttgtgctgttgacacgtcttcactaccactggtctggaggttccggactgtagaacccggaacttccgggcctggagatgtccggaggttccgatcaataggacccggaacttccggctcagcagacacagcacttgtagggctattggatgtcgatgacggaggttgatccctatcttcttggtcatcctgcgtctcgactggtcgtatgtctccaatagccttagtacctatagcttgacttggatccacatcccctacaacatgtacaacaacttgctctccttgggagccattagattcatcaaatgtcacatccctagtgacttcaacaataccggaggttttgttaaagacacgataggcatgtgcatttgattcatagccaagtaagaatccctcatccacctcaggtgagaacttagatgagcgaggcctcttacttaaaataaaacatttgctcccaaagacacgaaaatatgaaacattaggcttcttaccactcaagagctcatatgaggttttctttaggatcttgtgtaggtacaagcgattgatggcatgacatgcggtactcacggcctccgcccaaaatacatccgaagtcttgtactcatcaagcattgcccttgcggcttcaatgagggttcggttcttcctctcaacaatgccgttttggggaggatcatagggggcggagaactcgtgcttgattccttcttcatcaagaaattcctccacttgagtgttcttgaattctcctccattgtcgcttcgcaccctcttgatagtgagatcatagaggttttgggc

SEQ ID NO: 48929 - DNA, 1852 bp, Oryza sativa
  unsure (1)..(1852): unsure at all n locations
nnnnnnnnnnnnnnnnnnnnnnnnnnnnnnnnnnnnnnnnnnnnnnnnnnnnnnnnnnnnnnnnnngagaagtggcggagataagcccacgggggtcactggggagtccatgccttgttttataagggggtgattatgatccaggaatggtgcactgtggtgagttgtgttatgcagagggtattgtcacagcctctattcgggtactttccagtatcgcgacgcatggtagacatgatgttgaggctgtgtcttgtgggtacagtggtacacctctggccagagtaaaactattcgaatagccgtgcccgcggttatgggcgagttgagcaatgtttttcgtgattagtcccacacctcccacaataattatggatgttatacctggtaataatttgcttagctcctggtttggagttagatctgtacagccgggtatggttgttcaggatggttgggcctgtgcagcatgggtgtgctgttcagtgttgattaaaatttctgattaactactccactgttttatttcacttaaatgttttgctaaatgctgcttttgcaaatgaggctatattatgccatcctttggtatccttgtgcacttgcatatttgctgtgtggcttgctgagtatgtcatatgctcaccttgcaataatcaatcaacctcagttgaagaaaaaggatccagaaggagaagacgtttggcttataccccagttgagctgcctgtgggagtggagccggagcttcgctagaatttattttccgctgcaattttcttcctggtgaggactaagtgcctcataagtaagtatttatcgttttagttaatttgatgaatctgtatattaaattgtcagtttgtgcacctcggctgattcctggacgaggattttatgcacaaataagttcggaaattactagtgaatttccggacgtgacaagttggtatcggagccatctcgactgtaggataagtcaaatggtcaaactttaaggacgaatttttccgacaaaaatgatttgtgaaaatttctcctttcttgcttatctagaattctttacaaattgtttcattgtctactcccgtctctctttcaacttgagtagttctgagacattgaaacttgaagacgccaatgtgtctacttgtggaggttaagtcaagtggatcgatgaataagaaggtgatggtcgatctgaagtgcccagatgtcaagatggaatgaagttggcatcctaccttagaacctatgccgccaaagtgtcgttgaagaatagttagtaggatagaacgtttgttgtttgctttgtgtgtaggtatggttgcattcccatcattggagtagttcagtgatgagcatgtaattatactaggttgcttgcttaatcaacttgaacaatataatggtctacacacaccagatcagtggtaacctggttaaggtcttaactttagtgtaacctctctccttctatcttctctaatatgcaacagatggtgaacactcgcgctagtggaagtggaaacaataacaatgaagggaacccaactcttgctcaagttctggctcaacagactcagttaatgaacatgatgatacagcagatgcagaaccagctcaaccaaggaaacaacaatgctccaccgccgcagaataagctagctgattttcttcgtgtgaggccacctaccttttctagcactaccaacccagtggaagcaggtgattggctgcacgctgttgagaaaaagtggaactgctccagtgcactgatcaggagaaagttgttttcgcttcacatcagttgcaaggatctgcttcagaaaggtgggatcatttccggatt

SEQ ID NO: 48930 - DNA, 4177 bp, Oryza sativa
  unsure (1)..(4177): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttgtccgcgttggctttttgtggcaatagccgcatcatatcgtcgtcctggtggcccaagctctcttctccgtaccacttgtaatatgagtctactttctcgatcctataaaaataaatattgtacaagatatgatatattctagtactataaatttaaataagctattcagattcatatagtactagtatatgccatatcacgtatatattatttttgtttttatagaacggggagagtatataggtagtttaattactgaacttcccaacctagtggtaggcatgagacgtcactagtcagatcatttaggccacaacagaagtttcatgtttcttcttgtcatgttttctggatatgctaaatagttccaagagcgtaaaaaagaaaagaaagagtaaaataattaaatagtgttgtctgatatcattgtagtggacacaacagttatggctttgctagtctcgcctaatttcagtaccctacggccctaccacaaccctcctaaactagcacgaaccactgtctcctacttcaaaacattctgaaccaaagtccagcttctagatttttcacttttgatctttttaaaattttattttacaaatagatccatcataacttattatgagaatggatcatttttatggcatcaacatcattagcgtcatggtccaatataacggcgcaatgacagtgatgccatcccctagcttccttgcaaaacctatgggtatgtttccgaagcttaagattttgagaagctgtgggttggtagtcagcttctaagaatttagaaaagctaagttccccttcccgtggatggtcggggcatggtggaccccaccgagacctacaacgtctgcctcttcaaggtttcaaaaggagtgtcgagatctactgaatctacatcttccaggtgtcaataagagtatcaagatcaacaagatctatatcttcaaggtgttaggaagagtgtcgagacttacaagatcatcttcaaggtgctaaagcagacactgacggataccggggtcttgtctaaagctatgcccaccatgaactccttctttatcaacatcttcgagaagctcatccaaaacacaataaaatctatctttggcaatatgagcgcgctcgagtgggcaagggttatagttattgagaccggactagtaattgagcngacaaggctcttggttcgatggttcactggttcaaccggttgaaccattggtccaacctagttcaataggtattaaatatattactcattccttgacatcacgaggtgcatgatagcctggtggttcgtgatcagcttcctctctcacatgtgatcttgtgttcgaatcccatcctagtctcgttttcccctacctgctcccctgcatgcatgtcttctcgcgcatagctgccacaaggctggttcaactacagttttccctggttttatagcagtttttcctcaaaacaggacgctccaatcggttcgattgcatatccagtcttttaactagaccggactggtataggctctggttttggtttttacaggtccaaccgtcggtatggttcggtcttaataactatggcgggggtgccctgaggattcgaggtgacccaagcacggtggctagtcgaacacaagttttcaatcccttggggacctgagcactgattaattagtgccctaaaggtttaaggagagcagatcggatccggtgattacttttaaccaccactttacgtttattatagggtggttcaaacttaatgtacaactcatccacaacttgtacgtggccgcacatgcagccccttgcatgcccacatcacgttggagaacacgagacgtgcgatgtggctcatcttcagcaacattccctaggggtcacctctattggatacagtggctaataggtaggctcggggacagttttaatgaagacttttacctcccatctctacttgtcattcggtatatgtggctatcacatctggccgactagcttggaggtacaacaataatactaaacatatcaaattcagaagagtagacctcactcctacatgcatgcaatggcattgtggactccccttcacgtataaggagaattcatgccaccgagaaaaggttcacactttcatctaagctaggttagctgaacattcagtgagcaagcaacctctccttctcacttagaactttttacatcactttgtagttcacctcaccatccatgcatagtccatcacacaggagtaaagtgctacgcatccgtgtgggccgaatttgtatatccgattgtgttcactctattcgcgtaattaaaacccgaacttagaattggtagcccggccgaactcacaaagagggagtacttagctttctcactagaggagttccgtactccgacaaacgccaatatcatttgcgccatcatgttggaccacaaaatcaatgatgttggcgccacgaaaagagaccattgctagaataagtttttaagtgtctatttgtaaattaagttttcaaaaagatctaaattaaaatataaaaaatccagagcccagcttagccctaaccatgcctggtctggcccagcctggctctcctagcgcagcccaaaccgatcagctgactcactaatccaattccaaataccacacgaatgtactccactccattgatcactcatcaatcatcaatcactgtaatgcactatccatccattaattttcctcccttgattcacgtcgaccgaccgagacggagtcatgtcacacggtcctaatttctttcgccgtgtggaaggcattggatggatctccccagccacggggcaagcgaggggaaaaagggctccgagcccacaaaggacgagccgtctatgccatgccatcatcatggcaagatcacaaacttcacgggggatatatgtaatgtaggactaataataatattgcaacaattgtgtttctgcctttttcgctgtgatcattacacgggtccagccttttagggataacaatagttacctataacacttggagggttgaaaatctagtgtgtccttatatactttatgtgtatacatcttggtaggatatttggattttttttcaagccttgttcagttagtctctccaagagagagggaattgagggaattaattctacatcttaataagtgcgaaataaattaccttaaccctcgaaaaaaatcaccttcagatcccctcaaccttagcgatcaattatcccagctgagcacatacaaagtggacattcttatggtgcgggtgtttgggttttccatgtaattaaaaagaaaggccacgtgtctgcttgatataaagatcgcacgatgggtacgtatgggctcgatggtgtgttcaagggttgatgccatgccaaaccaacaatattgttgaataatagaggattagatattgaacacattatattgatccttgggagcctgtgcatataggagtacaacacttagttctcaagtaagcatagagatatactcccttcgttttaaaatgtttgacaccgttgattttttagcacatgtttgaccgttcgtcttatttaaaattttttgtgaaatatgtaaaattatatgcctacataaaaatatatttaacaatgaatcaaatgataggaaaagaattaataactacttaaattttttgaataagacgaacggttaaacatgtgctaaaaagtcaacggcgtcaaacatttcgaaacggaggtagtagatatataggagatacaccacgacgtgtgaatctcatatgtatccatgttttatgcagtcataca

SEQ ID NO: 48931 - DNA, 5392 bp, Oryza sativa
  unsure (1)..(5392): unsure at all n locations
attgatgagttgcttggtttagttcaatctacttctgataaccaccagagatctaataaatcagaacaggaaaaacaatgaagtatgcaccaaatttgactatatgaggatgatacactctctggtgttgtttattgacaatgtggcacattgttagaacaaaccatggcaggaattgatgatgagttatactgtggtgaagtgcagagaagaaaaaaaaaagaattaatcttagtgtgataaccatccttggtgttgagaaacaaanaggaagaaataaaatgacaatttctttacaagcttatattacttgcagaaattggtaataataaaacatctaactttatgttctgcatggatgaagtcctagccagaatacggacacaactgtttgttattttgttaatactcatgcaaagctgcaaaatttgcattttttttcttctctgttatgtactaatgttgattacttcaatgaaaacatgtttaccttagcaagtgtatataactataccaaaaggagaatggaagatgtcatataattatacttgacaaaaaatgaaacggtttgaaatacattttatttttctctgtttgaaccaaagaaaatagatttatgcatgaatttaatcatgccaaccttgcattagtagattacgcacaggtcaaatcccaacttgttcgagggaaagacattgaaattcttgcaagacagaatttaacacaaagtgtgcaagaacatttagtaaaagttcagaaaatgaaagcaactaaccttccaatacagttccaaagacaatgttctgtccatcaagctctgggcagggccctggtccagtggtaaccaagaattcaacattgtgataattaggattgagcttgatgtcatcatcgtcatcgttctgtccaaggcacaatgagagggtgccaggccttgcatgctttagttcaaatgctttagggtcaatagtctcagcattcctcacaagtccggtgggaggttggacctcgcccctgtcacgccgaggaccttggcggccagcaacgaagaactggccctgaaggagcttgtggacaagtgttccccggtatgcagcagaagtgcaagcagctttgaagttggcagtagtgagggggaggagtcgaccatacaaaccaaaaattacacgaccaagaggttcagaatcaggacatgtagcaagctcagctcctaaagtgcggtcagagcgaaagtagctagggcagacactgaagtccatgaagatccgatctgtgatggtggtatcaatggcagaggtggatggaatgtttgcgtcatctaaggcaggggatgatgaagcgtatagaagagaagggaggacagggaggaagatgagagaccgtctagaaattctagaggattcaataggtttatgagtattatcatggtttgttttcgagggaagaaaaaaagcatggtggttgttggggtggtggtggaggctgctcagggaaacagggtaagccatggaagaagtggccctggtatttgatgaaggcaacaccatactgttgctaactgaattcttcagttcttgtccttctgacgaaacagcagtagaaaatcactaatatccttccctgcaaatgtaatagttggcttttgagatataacattactgaaattctaaaacctactgttagcctcttcgttgtagggtcacaattatcacttgtgaataatggcaaatagctgacagcccaaacaattacaattttaaaatggaagctttaatctaattctcaacataccattctccgattacttcaaatggaacctgcattgcggtgagggggtgtatgatggtcacagcaggtcagcagctattccagagtgagcaaatatggtcctcttaagtagttgtagtatgagcgagtgaatatttctcaccatgtctttgcatatcatccattcacgattttactataagcaaggttttttgttctaaaatttaccagtttctatagggcagttccaacaatcaaattcaaatcagcatactttttttttacatttccaggcatgttgtctcttcgtttaactagctcgaaattatgtttcagcaattcaaaccaggggcggatccaacttggggcatgggggttcggttgaacccccgaacttttaggtaaacaaacaaactgttattacttgaaataagagaggtttaaggctatcaaattcacgaacgcaagcaaattccaggtcccggtggggtgggagagagagagagagagagagagagagatggatcagaaagaggacgcaccaggatcccctcctcccctccgctgctctgcttgccagatggagatcgccgcccggccctccgctcgtcttggcggcggcgcaaggagcggaggagaacgagaacgagacgggagatttcttcttttacgcgatactcgattactccgcccttatctcaatatcccttttacatgggaattgtgccggctgttttttttcgttttcatcagccgaatttatggctatcagatccttcaagattcgtgctggttatgcaggccatctggtgtgaacccattttgtccccctatagaaaggcaccgcatctggtgcaaaccatggttggcaaccttggaaactcttaatcaacacgacaggctcatccgatggctaggaacaaaggtgaattacttttacacttaaccgcccgcactcatccgatgctaacctcattttttacaaatcccccctcgtcacttcgtgtggccgccgccctccgcctcgccgctccctgcgtgcctggccgcgaacgcgtccccgcccagccagctcgacgccgtcgctggcccgccgagctgcgcctcccgccgtcgccgctcgccgccgcgtcctcgtgccctcccagccggctcgacgccgtcaccggcccgccgagctgcgcctctcgccgtcgccgctcgccgccgcggccgcgccccccctgtgcgcctccacgactccatccagccatgcgccgccagccgctacaggtcagcggcaacagcaggttcggaccgacgcctctgttcttgttcttggaggttcggaccggcggcaagaccctgtgctcttccagcgctaacgagcagtggacggatgtgcagcttctgatccacacccgtgcaggggcagcgctggaacacaggcactacacattccctggcctgccattcaagatttgtaaattagtgtttccaatttaattacatagaatagtagaaagatttaccaactgagattgacactgatgtacggattttgtaatccgaaactctgaagcgtggtcgaggcgccgtcggcgcacgtctcctccaaccgacggagcccatggtctcggtgtctcctccggtagaagcggagtccgctgcaatggatgtgaagggggagcggttgttcaaagggcggtcgcggaggttgtggtggtcgccgacgaggtttcaacggagaccttcgcgggggatgttgatgcagcgcgaggccgttctcgcggcgggtggcgaggtggctaatccgatccttgcctgtctgttccaggaatgaagctagtgacatctgaaccaccaagcaagggaggcacaccgatccacacagtgagtcagtataatgtcatatctcagaactgattattgtttcacatatgttttagaaactatttttaggggggaatgaaatgcttgatatgtgtaaaacattttgctggtttgtttgtccagatctataagtgcgtcaacatatacccaaatcccattatgaaacatttgcatggcatgtacatcaacagctcaatgtctctttgctggctttttcgtggccaggatcaatcagatttgtggtaaaaaatgagtggtagttttcattgatataatataactaacgctaaactgttgtgtcaattcttaattgaagtactatgttattgaacactgcgctacttatactgaaatgccatgttcaatttttgctctgtttgattcggcattgtttcaggttctggtaaaaaaatcaccaataattttgtgatgtgctcagctagctacacagccgatgatctggtgccttcagtctttgaccctgtttggtagtaatatgtattctatgtactttttttaatgatgtattcatttgtgtaatttaaatcacaagttctcatgcaaaaattctattgcttagcctcaggaggacaccatgcttgatagtgttagattgttataatatatagcgcttccaatatttgtaagacagcttattttttaggattctaagatactttaattttgtgtatttttcactgataggaaaataagtacatgaggctgccttaaattgtgcttgctgggtgtttctaccagcattaaagacaagttgattcagacctatgtaggatttgtgctcttaaagatgcataatttttggacaatttgcattgcatgtgttcatggatggaaaaatccatactttacatctgtttactgctctgctcttgtgttgtgagcaatttgtgctgactcacatccttcatgctcctccttttcaatgctgatgattattttcctttttcctgaagagcttggttggcttttctctcttttcgagttagcttttgtccccgtgaatgtaataaggtggccgatgctttagcatcaattggttgtaatagcccagaaaatactgttctcagctgggataacactccacctggtgttgaggatttggttgtcgacgattctgtcgagaatatgggttaatggaaacaattagttttcctctaaaaaaaaagagcttggttggctgttgtttttgcagtaggtattatccccgtgtgccgcattaaaggcaagttgattttctctatctctgtgttagcagcacacaagatcaatcttgttgggaaagatgaggagatatgcatatgtaagctcccccatccctcccattacctctgttggtaatgagtttatgctctgctaattttttatctcttggggggataaatgcatgttctggacaatggttgcatggttaaggtgggatgcaaccattttatttttgactgatcctacactaagtagttagaatcatgtatataaaacaatttttgaattatgttagttctttctccattcactattctgttaactgcaatcttaacagattcatttttgtttaatgaggttatatgttaacttttttttgtcagcaagcatcatttactagcaatatttgcactaaagctttactatatccacggaagcatacaaatttcaaatattagtttcctaaaggtcactgtttagaagtaattccaagtacttttacaagtacagttagcagttttgttaacga

SEQ ID NO: 48932 - DNA, 711 bp, Oryza sativa
taagtaattcttcttgcctttcgagagattgtactttactatccaaagctctcattaacttagccaaatgttgcatagcgggtttgctaaagctcttaagcacatcatctaattcattatcactttcctcatcactagaatcaacatcaagagaggtgtgagagggcttttgagtcatcaccttgcggccttgggccatgaaacaagagtagtggtaggagtcgtcgtcgtcatcactcaaattgttgaagagacgctccttgcttgaagaagatgacttgaaggcaacggtagcaacaccaccttctccttcaaccttgtcttttagcttgggcttgggcttgacctcgggatcttcctcatctccggagtaccacacctccgccatgtgtgcctctgccacatgagcacgctccggcttcttcttgcctcccttagccttagcttcatttgacttagaacaatcggcaatgaagtggccatattcaccacaattgaagcaagctctctttgattgccgctttcccttgtcatcatccttcctccgtttgccatagccactcttgcgaagaaagtgcttgaatctcttgacaataaaagccatctcttcatcttcactttcttcacaacttgactcttcttcttgttttgccttcaaagcaacttcttgatttttgatcatggcagcattcttcaccatttgcctcactt

SEQ ID NO: 48933 - DNA, 10471 bp, Oryza sativa
agtctcttgacaacaaagtgatttgtcatgtccccactcccaagtcctttgatcttgttgacaagaatcatcatcctatcatacatctcttgtggtgtctccttgtcatccatcacaaatcttccaagccttccttccaataattcaatcttggcctcacgaacggtaggtgatccctcttgagccaattgcaaagtatcccatatctccttggcctcctcaagcccatcaaccttgttgaactcctccagactcaaggcggagagaattgcattggaagcttgagcattgcggtggatgagttgctcttgctccgaagtgagctccatgtcatcattaggtacatcaacacctatacaaaacaactttccaaatacttggatgcaaagagattagatgcaacttcatcttgtgcttccaagcggcgtaatgtgtcccatcaaattgaggagcacgcccagaaggcacggagacaaagttgtgagggggaatggtaagtttgctgtaatcaaaaggtatagtagctcccttgggtgatggagtttccttgctgctcgctccatcttcatttccattttccccgttctttccccctaagtccgacatcgtggatcactcaaagcggtgaagcttgaatcaagagcatatcgctctgataccaattgaacgcgctgatgaagcctagaggggggtgaataggctgtccctgaaaacttaaaaacaaatcgcagcggtaaattccaaacagacccggaacttcctggtaaggaactccggaacttccggcctcccaggcccggaacttccggtgttctaagacaggaatttccgggtaacagaatagagatgaaattcaaatttcgaaacaaaagactaagccaatcttcacaagatggtgcacaggtattctaagcagaggatatatcacagaatcatccatagaaacatcacagaaagagacaagagcaattttttcccgaagttcggatcttgcgatcctactctccgttgaggagctccaaagagctgggtctcgattaaccccttgcctcacttgtgcaaaaaccccagaggaaatccacaaccttcaaccccaaacacccctaggcaaatttctagaattgagtgaccaccaagatccaactcaacatacttctagaaatccaccacaagtgtgggttgctctacttgaaaagcctctagaatctcagcacaagaacttcactaacttacctcgttccctttcggaggagaggaaatccttcacaaacttacacgggacatccacaatatgtaacggattctcgcgggcgatacctaaccgtctaggagatcatctccaagagtaataagcaccgagatgacagcccacgagatattccaagtgctcacccaagatcctagtcttcacacatctccaaatcttcttctctccctctcaatctctctttctcacaagaattaggctctagattgagtggagaaggcaagaaacacttgggagaggctagcaatagctctaggtttgaaaagtgaaagtggaatggccatggaacgagctggaaacgagctgtatatgtataacggctaggtgacgtcatctagccgttactcacaaatttgaactggaaactagacaggaagttccggacctagaagaccggaacttccggactacacttaggaaaatctttttcacaagaccggaacttccggacctggaagacaggaagttccggacttgcatttttggacagatggagtatttgcaaaaaagactcctagggaaacttgacacttggttcacactaagagcacttgatatatctcagagcatcacatggaacccctcttaatagtacggtttttcctaaaaactcgatttcaaaagataaactatcctatacacttctcgagttccggtccgctttgattttgtactttttgggggtctccaagcatccatcttccacaccttggactaatgcacctgaaagtcactcaatgaactcattagtcccttaaccacatttgtcattaatcactaaaacccactagggggattaatgcactttcagatgagatcaactagcgacttggccttgtcgagatgaacccgacgagatcagctagcgacttggtctcgagttctccggattgcttctactatggctggtgttgagattatgattcgatgatcccataccctctgagggtcttatatctatacccttggcttccaagtagaactctgagaataccttatttgtacgagatcacagagttcactcgctctcggagtaggattctaacacctggggggacggcttcctggtagattgtgggcccccggttttacacaccggaaaccccatgtgtcttacaataccattccctggatcactagatggtacacacatagcatagttgtatatcacaagctgacatcgttatataggttgaactatacattaataataatacaaggatagcccaaatgggacccaaatagaccgagcatggtcatatacaatacaaaataccagaagaagtagatgagatagcggaagcgaagcagcggcagtccaacgtactccacaggcatcgactggtgaacctaggtcccgactccaccatcttcgacatctcttcatcagcattgtttccgaacagtcgactccaagtcctttctaaaagatttagttaagcaagggtgagtaccaaccgtactcagcaagccaccactacaggatgcatttagtgcacacaggggttcaaggatggcttggtttatttgcataaagctagatttcacaaatcatttcacaaacctatgacctagcagttttaactgaaaacaacgttaagtggaagttgtcattaatccgcgagggtttatccaccttccccaagcctcgcttggtccggtttaccctcgcatccaattttccacacttccaacatcaacatgaccttcccgcccatcgggcaaggtcacaccactttcctcatctaagcaagattaaaatctatgagactagtcaagtgtagtacaagtcccggtgctcaataaccgcgagcacggttattcgaatagatttgatttactcacactgcagtggatgtacgcttttaatcccgcactccgcggcttgcccaacacatgagcctagtcccaacacacgagacttgccacggcccggtttttcagtcattctcgcgtttcggcactcgctccaaggactatggatccccattgcactcccggcacaacacaccacctcgagccggcagtgaggagagtcctggcgctcccgggatcacaatgggttatattacatataggttaggtgtgttttaagttttgccggccttaaccaaacgatcgatccactcgatccttcacctccatcacgtcaccacttcagaaccaccatgacaggggtgccaccccacgagaattcacttagtccaccgggtctatacccactcgagaagtgcggtcgtactctgatcgtttcctgcatagcttcttgactcagtccttaactgaccagggtcggcgactagccgtttccagaaccacccatattctatccatgccgccccagtcgaaaacattttgtttaattaggtttttggttttcgcaaaggtttttactgcgggtggcgctcatgtctccacccgccttctggcaatcactctcgacgagtgaccgctaccaacacatccatacccaactattatggagtgtacaatcttctataattataagcaatactaagcaatgtcaataattgaccacgcataattaatagactcaggcaacaaggatataataaaggtaacaatatcaaggaggggtaggtacgcattttataattagcatgcaactttatttataaacaaaacatttataaactgggttcaatatgttcaaggaggggagcgtagtgacttgccttgcttttagaaaccgatatcttcgagaaatccacgatcgacgaataaccggaatacccgatacgcggttagcacgagaaaaccatataaaatcctctaaataaagtaccaaacattagtgccattggatagatcccgattttagaaaaattccgaaagttgaacggaatcaatcggagtcacggttgaaaagatatgaattcccgaagattagatgatttataaatcgagggggaaggaatacccaaaataggatccctttattttgaggaaatatccccatggttgccctctggataggaggaggtagaaaggacttatccttgggtgagcttgggcttcaacccaaggatacaggaggtctaatagggaggtattatggactttcagagaggaacttgggttctggagggatgtaaaatagacttttcgtaggaaggagtttctgggcttggataaggaagtaggggaggagaaatagactttttggcagcagtcaaggtcacgagatggagtcagcacagtgggctccactggtaggtcccacgacatttactttttccctttttatttctttctctctcgattcttcctcttctctttctctctctctcgttcccttctctgatttctcctcctccacgcgagttccagagaagaaggtgcctgcggcggtgccgggcgcagcggttgcctggcgcggggcggcgcgccggggaggaagggagtagcgccggctgggaagaggaggccggggcgccagcggctcgggccgggtggcgcggcaagaggcggcacggcggcgctcggtgcggcggctttcggcgctcggtgcgcgacgtcacggccggcgtccgggcgcggtggcgcggaggagaggaggaggtagcggtgctgggagcagaggaggtggtggtggatgggggatggttcgcgcggcgacgacagaggtcgtcggggtggcgttctacccggagcggcggcgcgtgcaccgcgcggtgacggcgcggcgcggccgagcgcagcgcgcgagaggtcggcggccgaaaggaggtagcctcgtggcgggcgacgctcgtcccgatgcggcgatggcccggatcgaggcggtgatagcgacgaaggttgtggtggctcccttgttgggcggaggcaggggtggccgcaggaggtgcctgcgcggtcgtcgtggccgtgcgcggcaacttcaacagcagcgatcgagcgcggcgacggcctcgatgggtgcccgtccaggtggagatggaggcgggtggcagagaggggaaaaggggtggctggctgtggtggggagaaaacagcacgaagagaaggctgctcctggcgatggttttgcttgtaatgccaatggcttcgaggagaatgatcggcacagtggtggaagggcgatgtggcgcgcgtccataggttggacggcggcggcgcgggcccgggtgtcgacatcgacacagtggaggggaggtgcgaggcgggcggcgtgaacgcagctcacgcggacgctcgtctgcggccgatggagagcgaggatgcaaggcgtggacgaggagtagcgacgctcacgcgggcgacgtcctgggaggcggcgaagtgaccatcggtcacaaggcttccttggagcacgtgtcgtcggcggatgggttggacggcgataatgtgagccccgagtgtcgacatcgctacaagaaggaggcttacaaggtaagcttcgctgtaaactagctctccaattcggtgtgagctccgctctttctttcggcgtgaaccatcctcactgtgtcttcggtgtttgggggaggacttggtgaactgggagtttgcagatgaagagagacggacgtcctcatccagggaatgccagggcatggcttcggtgcacggcggggtgcgtgcgacgcacggggagggcgtgcctgcgaccggcgcggcgcacggccggggtttggtggctcggtgcaggagcgcaatgcggcgtggcacggctcgacgcgacgcggcgcacgcaatgaggaggagcagcgcggcacgacgcggtggctcgggggcctggtgcgccagccttgcccgactcggcattttgccgagcacgtggcgggcggcgtgtcagcctgctggcggaggcaaggaaggagggggagtagacttggctgcaagatggagggagagctggagagggagtaaagacagacttgtgctggggggtgagttgggctgaccggaaaaggaggcccaacagaatggggactttttgtatttgtaaggattggaattgggaagaattttgtatttagaatttgtagatgaactgtatatttggacatttggtttggctctgggttgaaaccttgaattgtggtttggagctgtaaatggaatgtttaatttgggtaattggattggattcaattcagccgttcaatcgcccaagtatttaacttaggttttgtcacatcctgattttcgtttcaggatttataaattatttaataaattattaatagaatttatattaaatgatctttaatttacaagtgaagttaaatgtgggaaataaaatttccttaatataaagcatggatggatttaatttttattaaattctccatgattaagtcaactctctgaaattttctcggatttttcagctctcaattcctaaatgatacaaagaacagttcagtaattatttgatcaataatgatctaattataattgttaagagcttttcttgtttaaaatccttaaattataaattgttgtttaaaaggaattattagaaatgattttaaaagcctaaaagagaagatctaattttaatttgttaaatctcaatataaaatggggccagataaaatttcattaaatactttgcttaattctataattcctagatttttctaggatttatttgagctaaggaagtatttttaatcaatggaattgcatttcatgaataattttaattgaaaaaggttttaaaagtcttcttttggctttgggccgaaagccggcccaaaacctctctctttccttttcttcctccccggccagtcggcccaagtcggcccagtccgcgccgccgctctcttctctctctcagtcgctgacaggtagggcccatctgtcggagccgtcttcctcgcgccgccgccgccgcccgaaaccctagccgagcgccgccgccgtctccttccaaaattcggtcgaccctttccttctccggccgaattgatagaggggaaacgatcctctcgatctcctcttccttttctcttttggaagcatcggctaattcggtttggaaactcgtggattcgaagtcgaatcggatccatctctctcctccgaaccccgttctttcctttccgtcgccggcagccgtgggccttcgccgtcaccctccaacccctttaaaaggacccccgagctctcctctacccgccgccaccttcgccttcgcctctcgtcgcccgtagcgctctagcgccgtgtgccctagcgccgccgtcgccgccgtcgttccagccgtgcgccgccgccgttccagtcatcgtcgtcgctcggggagatcgccgtcgtggtcgccaagtcgccgccgtcctcgtccgcctcttcgtcgccgccgaagaccgccggagcaccgtcgccgccgtcgacccgatctccgccgccgcttcttcctcgtcgccagcgtcgtccgttgcttctccgccgcttctttggttaccggtgagttcgccgcgtcgccctctacccgttggtgccctccgttcgcgtcgccgcgccgtcgttcgccggcgagcatgcgcgtccgagccgccgccgccggtggtgacgtcatcgccgacgtcatcgtccccatctcccgtgagccggtcgtggaccgttcgatctcggccgtccgttttggataggatcgatctcggccgtccgttcccgtgaaccgctgccgtgcacccggtccaccgcaaaccctagccgctgacgcaataatcctccttttccttttcaaaaataattcattattgcgtcataattcaattaaaatccatataagtgttttaatccgatttaatctttaaaaattcataactaattcatcttagctcagtttaatgtggttcaagttgcaaaaattatataaaataaagatctacatattaaaattgtccataaattgaattaaatttatttaattctttttaaatgggctttaattagatttaatcttgtaaaattcataataaattcatttgaagtcagaatgaggccgttcaagtctcataattcatctaaaatcatgatctacatgtttgtttactttttatgtattgtttatttgatttttattagtctttttcttcgttttgcgtgttagcttgtcgtttccgtcgttgcgaaggttcgcgagtgcgtcggaagtattcaagaagattaattgaagaccgattattgcaaggcaagtcacacagatcctaaacacaatcctttgagcatgttgatcctatatttaaattctctatttatttcaactgtgcatttattttcaaatgtcactgggtggtgtgaatctattcctttgttatggcctgtttgcattgattactttaatccttgataccttgggttattataacttgactagttgagctttatatattggttcagctagatattagatgtgattgcttagccatgcttagaaacattagcacactattgggataacatatgattcattattatttaatgatggtttaatgatggttcacgatggttaatcgtgatcggttaattaattacttgccaactaaaacttgataatggtgggttgtgagcacatggttttgagagtcgtgctcatgacaattaaggaccggttcgcgagctactattgtgaaacattaaccgtgccaaccacaagccagcgtgggcaacggctttaccttttgtataacatgattcattgcggagcaccagactgagaagtggcggagataagcccacgggggtcactggggagtccatgccttgttttataagggggtgattatgatccaggaatggtgcactgtggtgagttgtgttatgcagagggtattgtcacagcctctattcgggtactttccagtatcgcgacgcatggtagacatgatgttgaggctgtgtcttgtgggtacagtggtacacctctggccagagtaaaactattcgaatagccgtgcccgcggttatgggcgagttgagcaatgtttttcgtgattagtcccacacctcccacaataattatggatgttatacctggtaataatttgcttagctcctggtttggagttagatctgtacagccgggtatggttgttcaggatggttgggcctgtgcagcatgggtgtgctgttcagtgttgattaaaatttctgattaactactccactgttttatttcacttaaatgttttgctaaatgctgcttttgcaaatgagcctatattatgccatcctttggtatccttgtgcacttgcatatttgctgtgtggcttgctgagtatgtcatatgctcaccttgcaataatcaatcaacctcagttgaagaaaaaggatccagaaggagaagacgtttggcttataccccagttgagctgcctgtgggagtggagccggagcttcgctagattttattttccgctgcagttttcttcttggtgaggacttagtgcctcttaagtaagtatttatcgttttagttaatttgatgaatctgtatattaaattgtcaatttgtgtacctcggctgattcctggacgaggatttcatgcacaaataagttcggaaattactagtgaattttcgggcgtgacatttattaatgtgccaattaaaacttgataatggtgggttgtgggcacatggttttgatggtcgtgctcatgacaattaaggaccggttcacgagtttcggttgtgaaccattaaccgtaccaaccacaagccagagtaggcaacggctggacactttgtataacaaggctcattgtggtgtgccagactgagaagtggcggagataagcccacgggggtcgctggggagtccatgccttgttttataagggggtgattatgatccaggaacggtgcactgctttgagttgagttatgcgaggggtcttgtcacaatcactcgccatggtgacgtgtctgcgcggacacggtgacatgacggtgggttgtgtcttgtgggtacagtggtacacctctggccagagtaaaactattcgaatagccatgcccgcggttatgggcgggtcgaacaatgtctttcgtgattagtcccacaccacttattaataataatgtgataattgatggtaattaatttagcttctggtttggaatgtgtcggtgacatgggaccgggagtatcatgactagaggcttgagcaggagcaatcacccacgtggcctgaccccctcgggggggggtcgggcc

SEQ ID NO: 48934 - DNA, 18789 bp, Oryza sativa
gaaaaaaaagggaagagggttttagagtaagagctctctggctctccagctcttggtagcttcttcatacacagatccaccagaacacaggagtagggtattacgcttctcagcggcccgaacctgtatacatcgcccgtgtcttgtgttttttccattctcgcgaactttccacagactaggagcttagaatctcacccagggcccccggccgaaccggcaaaggggggcctgcgcggtctcccggtgaggagtaccacgctccgctatctggcgcgccaggtagggggctctgcgtgtgttttttccattctcgcgaactttccacagactaggagcttagaatctcacccagggcccccggccgaaccggcaaaggggggcctgcgcggtctcccggtgaggagtcccacgctccgtcatctggcgcgccaggtaggggtcgaacctacggccttctgcttaggggtccgtatcgagtgatcggcgtcccccggccgggctccgttcggctggccacgggcgacggcacagagctgcctaacccgtggaacattgagcaccttcgtcgcttctacccctaatggggttcgggtgtcaggttttgggctcgggccaaccccacacccccctcgggcgtgtagggttggccgggggctaccacatatgcatattttttcttctatctgtatttcaataaaagcattttcgatttcctaaaggctgtatctgtgctgttgtttccttttgaagaatcttgacttgaaataggtcactcgtgctcaatcctgccctcggaggctcgggtcggctaaaatcgccaaaaggggcccagaaccgagccgtgccccggggcgtggtgaactccgggggggaatcggcaaaaacccacaatcgggtcacccataaccctcggtcaccacgctcccggcctggccagtctcgacacgtggatctccccaggcactagccccgacccgcgccttttgaggaccgagacctgggcacgagcccttagtcaagctaagacacaaaaggaccacggcatagatcatcctcatctcatacacatagcaaaatgaaattgacacagaaatttctttattttgattgcagattaagttaatctatacaaaaaggaggcccgaaggccttggaagaaagaaaagaagaaaaaactgaagattggcgggggcctgggggctcactccgatgcacccgggttgccagcctcgtcgccactgtcgcccactccgccgtcatcgtcctcctcgtcggagttgagggcgaacgcgagccgaggggccgaaccctcgaagctgtggacgatatggttggcggcgtcccggacctgcgcgcgcgcgccgtcctcggtcccgggagggaactcgtccagcgctgtccagggggagaagtcggggtccctggcctggtaactcgccagtacgagctccaccgctcctcgggcgaggtccctcgaggatgacttaaccgtcccctcgagctccttggggagccgctggagagtcccggccatctccgagaggcgctgggcgaggcccccctggttggcggcgtacttcacagtccgcccgccccagagacccgcctgccgcccggcgcggtctaaacgggacacggcgtcgcgaagcatgctgggccctatctcgcctgccaggcgaagggcctcgacctccccggtggacgaattcagcgcgccctgcagatccgcgatggtgtgttcggcagctgcgaggcgggcggctaagtcgctgtcgcccgtggccgccctgccgctacgcgcccttgcatccagctcccttgcctgcgcctcgagttcagcggcccgctggttcagtgcggccctctcggcgcgggcaccttccagattgcgacgcgcttgttcctctagcgcagcctcacggagggacgcgctctccgccagcctttgcgccgcggcctcagcctcctcgagggctcgctcccgctcgatgagcgcatcttcgcggaggcggagtgcggactcctcttcggcgcagacggcttcgtgcgccgccagtgtgacctcccgaatggcaacggcggcctcgcggtccgccagatcccttaccatgacgcaggaacgctcttccagcgccatggcacgggcctcgagggtttcttcacgctgccgggatgccacctcggtctccgccgcccgccgttctcgggcagcggcagcgtcaaggaccccccgggcggcgtcgagcttcttccctagctccgcctcccagctcccgtattgaaggcggaggtcgtcctgcgcctcgttcatcacggtagtggcgatgagggcagccccccgctactcctccacctccttggcgatctcccccagcaccttccgacgggcttcgagctctgagacgtgccggcggtgtgccttgcggcccacctccaccatggcctccactgagcgtcgcccctcttcgacacgcgcccatgcgacgtcgagctccgcccgctctgcttgcagggcctccatctgggcacttaacccgtccaacaccgtggtgtttgcgacggccaaggcctgcagaaggggctctgcgctcagtggggcagcggaaggcgtggggaagagccgcctcggtgaggatgccgcgcggctcggcccgccgatggatgtgccggactcggggacgtcccccggacctggcttgtcctgagcgtcgcccgagggagtgggcccaagcgatgcgcccgcggcctcgtcgcgagctgcctcggaagtcgtcgtcgcctcggcctggcgaagtctggcctcctcctgagcggcttcttcagcttggcgagctcggacggccacctgggcagcttcctcggcttcctgaaggcgatccgcggcttcttgccggtcagtttcgcgggttgcctcggaggatgtcgtcgcctcggcctggcggagtctggcctcctcccgagcggcttcctcagcctggcgagcccgggcggcctcccgggcggcctcctcggcttcccgtaggcgatccgcggcttctcgccggtcagattcccgcctctaggcctccgtggtcgccgcattctcggcctcagattggccggacttggattggcaagaaggacgcgacgggatctcgctgaagcagaagaaaagccagaagacaaacaagatgggtgaataaaaactcgcgttgggagaatgaatatagccacaatgggcgtgggacgaacctgcgaaggggtcggttaaacgaccaccttcgaggggaaataaggtttccccgggatggttctgtcccccccatcttgtggagccgtttcttcttccgctccccctcgggctgcggcgtcggcgtggccccctccgggcgcctgctgctgacacgcgccgccccgccccctcggggaggagatggggaggaggtaccctcttgcttcctcttccctcgggcgtcggcagggcggctgccccccgagccctcatcacggggcccggaagcacgaccccctcctagggtagattgatctcccttgcggctcccgctcgcaccgtcatggcccttgggagctctctcctctgaggccccgaccgtcatcatgatggtcaggatgttggcgcgatctggatcgctgcagagggggaggactccttgggggatgagggatgcctccacggagctgagatttagcacccgttggatcattaccttgaagtcttcagggacccagtcccatttgaccccccggtgggtcctcatacagtcctcgaacccggtgtactcccaggcgccccgggcgcgccgcttgagtggcgcgatccggcgacgaaggtagtcgccgtacaccatggcccctgtgagcccctgggatcgcaggcccgccaggcggtcgaggacggcgtcgtagccatctcccagatctaccggcgcccgccagttggaggcctgcgctgggggctggctcggaagtcggaggcgcgcttcgtcggcgaggggggtgtagaaccagtcgctcttccagtcgtcccacttcttgcggaggacgcagggaatgtagcggttcagcaccggcccccgcggctggaagtagcagccaccaaccaccgacggcggtgacaccggctgtacggtgaagaaccaccggaacagccgaagggatgggcgcaccccgatgaacatctcgcacaggttcgcgaagatggccaatgtcattaccgcgttgggggtgaggtgcgccatctggagatcgtaaaactccagaacatccatgaagaaagaagaaaatggcggaaccagccctgccattgcgaaagggaggaagaagacggaccgccccgggtagcgtggcgccgggcgtccctcgcccagcgtgactatctcccggcgggtggcagattccggcatgaagcggcgcggcagcccggcctgtctctcgctcacgatgcgggaaggcggcagcacgctaccgtcaagcggagcggagccccgtgccatgacgccggaagaagagatgtttgagagcgagcgcgtgtggcgaaggtagggcacaggaaagaaggagttagggcgcaagcggcgaagacaaggggaataatggcgaaaggaaggaagcaaatctcttccttagcgtctttatacccttgccaacgctgtgcccggttcctcgcttcccgcgcccactatctcgccccctcgcttcccgcgcccacgcttccactaatcccactcgcccgtttgcggcgcacgaggtggatatgcggttgtggcggtcgagatggtacatatcgtgcgcgcattaattacgctcgccgaccgaagcgccatcaccatatctccaggcaaaacgaaccggctcgtcccgattcgcgtgctactcgagtaatatggcagtcttgaagagaccgctcattattgacagccgagttaccattgccgatgtgcgcgatttgcgactgctgggtttctgcccaactgtggagaccagccccacctgtcaccaggccttagaaagtggcgtcacgcccgaccgcttccctcgaggagggcgatcgccctggcataacgccgggggctactgtcggtgacatgggatcgggagtatcatgactagaggcttgagcaggagcaatcacccacgtggcctgaccccctcggggggggggggggccgggcccgagggtgatgtggccgcccccctctttgtctccccgaggggtcggaccgctcccgtttcggccccgagggctgaggcgccccgaccccttgtgggttttgcgccgcgtgtatgggttaggtgagcacaacggggctcacctaaccgcatttattgcggtttggacgagcgcgtcacgccgcatgtaacgcagtgcagcgcgctcgtctatccggtctgtgacagaccggtcagattgtgggttaggtggcaacaggcggtctgacacacgcctcgccccatcccgtcaggatgagagcctccaagcactcgtccctagccggagccggcgtgttagctcctggagatggcacgttggtcccggttagatatatgccaggcttcatcccaaccattacaagtaaaatattgtatgaagaagggcgaacatgcagatcgataaactgacacgtggtgggcaagaatgaccgatttgtgaccggtctgacaccggtcatgtcgtaggcagacagccatgttcccacgtcgcacctgcttccggcggaagtggaggtaggtatgggccgtcccatcagaaggtcattcggacggcaaccattgcatgtctccgcccatttatgaagaggtgacagggtgatccccgaggtcagatgagtaaggacgcgtggccacactcaaaaacaagcagtgtttttagctttctagagaaggcaagccaagtttgagtaaagataggataagtccccaccaaaaagagagataggtagaggtggtgcatgtggtatccccttgagatataaaaggaggaccttgcccacggaaaaaaggaggactggaaggagagaggatctggagagtagatcccaggagaggaaaaaaaagggaagagggtttctagagtaagagctctctagctctccagctcttggtagcttcttcatacacagatccaccagaacacaggagtagggtattacgcttctcaacggcccgaacctgtatacatcgcccgtgtcttgtgttttttccattctcgcgaactttccacagactaggagcttagaatctcacccagggcccccggccgaaccggcaaaggggggcctgcgcggtctcccggtgaggagtcccacgctccgtcagaatggtacattcctggtttggagataaatctgtgcagccgggtatggttgttcaggatggttgggcctgagcagcatgggtgtgctgttcagtgttgattaatattaatgattaattattctactgttttataattctcaaatatttgctaaatgctgcttttgcaaatgagccctatattatgccattctttggtatccttgtacacttgcatatttgctgcggggcttgctgagtatgtcatatgctcaccttgcaataatcaattaaacctcagttgaagacaagttgcgaaggagaagacgtttggcttataccccagttgagctgcctgtgggagtagagccggagcttcgctagaccgtaattccgctgctgttttctcttttcttttgtaagtatgtaacgttattatattgatgaatctatatattaaattgtcagtttgtgtacctcggctgattcctggacgaggatttaatgtacaaattagttcggaaattactagtgaatttccgggcgtgataaacatgagtagggttattcattattactcggatcgggggactgaacctatattacaaaaatccttgtcgtatactctctttattccatattcgcgcataccttggtattagccacaaactatgtcccaaaatatcatggtcaagtataacccattgatagttagatggacccaaccagaggaacggtaaggattataatgtgccatcaatttttctcaagtagtattggctccttacacctaagattgttacggttctcagggttgctactatgtaattgggtaattttttatgaagaatagaagagactcctactgcaatatatatttacaagaaaactacaaagaggcagaatttacaataaagttaatctaaagattgtatccatgattatcacattgctctatgatcctcctctaccctgtgcatctgtagggtaaactccttgttgaatccattcttccaagcttgccatgttaggttaatgtcgaagataaagctatttttttcttatccatatatttccaagaagcaatagtaacggcttctgtgaagaaagggaatgcaaattggttgccagcatcgggggtgccacgcaggggagggagggggagggtcggtactatcatcattcgtgttgacccattgaacctcaatgccgatggggctggcgccgaaaaagtgtccactcctagaataaatttttccataggtctatttgtaaaaaaaagtttcaaaaggccattttaccttggagagcaaaatggctggttgtagtcggcagctaataggaaaggttttctcctagtgtagattcattgtgacgtggtgtaaggtttacgatttgacaacctccccttcttggatgaaactgctaattgacaacccaccacacacggctagtctcgcgcgatcggtcccacgcctactgcttttagcctatcggaattttcttttttttcctatacatataaagtttgtatggctacacgtacaaactttttttacgtctaaagtgtgcgcgtacgcgttcaatgtttatactataattttatatacatacatatatacatagaaataaaaaaatatatgtatttatacatatagatacatatttttttaatacaaatataaagttgtatacttatatgtataaagcttttgaacatactagggcccataccgactacgctttagtccccccccctctccctactaggagaccgtggtatttagggatgtagggtatggtcgatatcaaggtatatatgagtatagaataaaaagagtaatggactaggatttttatacatgttcacactccctaatgtcgtaatagtcatactcatgtttatacatattgacctggggcatattacacttagtaaaaaaaggagcagactagctaatctagcctactgttcgtactgatgaatccgcaaacgcactgatatcgctgtatcacttcaccttagagcactccaagggtattgaatcacaggtaatatgtgcactccaagggtattgaatcacaggtaatatgtatatatatctaataacatgattctatccaaggacaacaactaatggtaggcttagaggattcttatgggttaatttattagacttaagtaaaatttgctatatggcatccaaaaaatgtgtaattagctgctggacaccgcaagaacgcgaatatgctatcgagcaccacaaaaactagtaattagctgttggacattcgcgaccttattttattatttccggaggaattggagaaaaaaacttatgtaagagtacaattttgcccctgccttcattccgcttacagagcgggcgctttgcatttgcgtcccaccggccactgctccccacgcttctccgctctgccaccatggccgagtcgatcgtctctggcctcctgatcacggcttccgccgtcgcgcgtcctcacagcagccacagccttccccatggctcctgcgcgacgcgtgtcccccaactccagcgcgacaggctgtgcgtccggcccacggtggatgaggacgaggcgatgagcatcgacaacctccgcctttttcgacgtcaacgtcgacaagtggaatggagccttctacgtgcgctcgccttcctgttcctgtgttcgtaatctgcacactgagacgctgactgtgcttgtgttctgctcatcagcatattgatgcgcatgggattagcacgcggctgtcagtgagcacctatatatggcgaggacgacctcatcaacctcctgcagtcgtataatattcaattaacacatttagcccttttcccagtcttacttcaagtattccacgtttacaacatcttctttaccattactagtaatcaagttcagtattttggccgtttgattgtgcccattgttcctaacgatgtgtttacatattgtgaatttccaggttgtatatcaagcaagcttcttctcagatatcaattgtagatgaggaggattctgaaccagagtgggcagagtacaaaatcaaagagacaaacatgttcacagtagataactatcaacagctgcactgaagtttgatgatctcttggcctcttcagacatttttttaaaaaaaaattgtgtatttctgagtatttttaacgagtggtgttttttagtatacagatcggattctttcatgatgagaaggcatttactgtgatgggatcgatatagtgcgattagccttgtggttggtttgcaccggatccagtcagattgaactatattgagtgtttctctctccaatttcttcgaaaataataaaataagttggattgaaataagttcgatcacaggcaaacttgtctttattgagtgtttctctcttcaattccttcgaaaataataaaataagactgcgagtgtccaacagctaattaccagttttttgtgattccgatagcatattcgtgttcttgcgatgtccaccagctaatcacacgttttttgaatgccatgagtaaccaatactcgatttgatttggatatgtactcggacactgcacgttggaattgtatccaaggtggcctattgggccaagtccgtatggagaagcaaggcaatcgtggacagccatccaatggccaatgtgcaaccgcacatgcgaggcacaatcttgcctaggagctgacatatccaccaatcacagatagcacactaccttcctggtacgtggcgtgaagcctaggcaaccagtcgtcttacccaggaggtagatccacccctgacttaggagtaataagagatagaaaaagaaactaaacatattcattgttggatagagatcacgagaaaggtagtggcagaggacgaaaaaaatagcgaaaatcttctctctcccctcaactactcctggcgagcagctaggagttgagctttgatttcgagtcttcgacctcgccggccattatattccttgctatgtaaccaggatgccgaaggttggcatctcaatctcaatcatcactgccatctccccgttagatctggccacattgagctcaggggtgcctgattctttttttttttttttgggggggggggggagtgggggacaccaggcatgagggaagttgcaagctcggtctcggcttcctcgccggtggacggcggtgcaacgagctccacctcaacttcgtcagcaacgatagcagggatgatggtgtacgagatgtggatacaacttcttcatggcgtacaggtaaacaaaattgccaaagggtagggggcttcttggcgccgatatggtggtctaaactcaaagaggaggaagaagtgtatcgttctgtgattttttttttatgttttagcgcagtgtatctagggctgtcaacgagccaacctcgagcgagcttgcttgtctgagctcgagctcggtatagactcaggtcgagctcgagccgagccttgtcaagtctgagttttcagtcgggctcatactcggctcattcgaccttcgagctttttctcgagcttggagtatgtacatccactacaccatgccccaagtttgcttactacatatctgtcaggaaaggacctatatgctgtcaaattatttgttagcataagttttcccgacagatagggtctgtcaggccaagtgctgccggcaaaggtcttttccgacagataaatgtttgctgacagataactcgacagtcctacaaatgaattaccgacagacggaagttaccgacagatggtcctttaccgacagttaacggattactgacagatacgcagtttgcatatatcagtttttctgacagatattctgttagtgtgccctgcattgggttaaaaaaaatatagttcatggaatcaaatcctactgatctagaactgaatataccaccaacagttctcatgcatccacattccattagtactgaatataccaattccatttaattacaaatgccatgtacataggttagttgtacaaaaagagaaattctcctatacaatctacaaaatgagacaaaacgatggcaaatctacaacaggcaaggcatttcccttgtagagaaatgccactccaaaatatcttgtgaccgccatgataagttgagcatctaaaaacttgaatcagattatcagaaagacaaaagtattaagggtcagatatatagattataataatactccattcaatgttaagtaatctatgcaacacctactatttcaatacagaattgaagatcagtgtcaaatgtgcaggataagtgtcaataacataactgatgtagttccatttaattcaatctgtagcatagcttcgatattctcacaatccaccaatattaaattaccagttccattttatgagaaatttatgttgaagcagtataattgcaatcgtaacagattcaattacaatttacaagcagcaaggattgcaatttatctcacaaactatgggaacaaactgattttagcttacatgatgtatgagcctttaagttagtgttgatcttctgttccttcaggtacccttctctgacacttcagcaagaagttgattgctcacccacaggtcgcaaatcatagctagtaaataaataaaaagaagataagtgctgaagtacagtttaattggctcccacttgcaaatgttaacttatattagaattgagatgtatgtaggtgacattttcataattaatgtagatggaaaatctgaagcccgaagactgtttcaaatttgtactacgacaactcactgcaaggacagctagccacctaatttgcagagatcaactaagggagttttatttaaaataattatactaggatggtacattctacaagtaaaaactcagtaaacacacaatgtacatgcatatttctaataaatggattgatataagttggaaatggcttcactagtaaatagaacttggcttgagtagttgctgtactatgtggtgcatgcaaagttctcaattagcatttcaattattccaactggtcctgatagctgatgcatgtctgtgtgaaatcaataatagatcaaatcttaaaaaaaaatgttcaccactctttctagtacatatataataatgtctgccatgaaatgaaaaggaaatggagcaaacataatctccaatttattgaatagtgcatcatatagaagattagcacttaattgttaataccattgaagttcttgtaatggaaaagtaagcggaaatctaaaaatatgaacaattatccgtttttcaatttgatacattagatcagacagaaaatgtccataatgtggtacactacatgagaaatagtgcattttcttagtactaccacatttctgtaaacattacagctaacttcatgagaaatataaagcagaactggagcattagctaagattcatggggaaaagagacaagtaggttcaccctaaactcttttgcaccagtattaagcatggttgcaatgcaagtttccatcccatggctatgaatgacagccccagctctcatcaaataagcctgcaaaataccaatgaaaattagacagtttagaacacactagccgaatgtgcgctctttctcttttggcaaccatgattggacaatcaataaatgagaattctataaaagctcctaatcaacaccactcccgaatacggtatgctcgatcctaacagaagacacgagagtagccactgctcgattaaccgctcgtgagggggaatcgagtgcccctcgcaggcaattcgtcgaacaggagccgtgcaggctgtgatgagagagagagaggggggggggaccttgggtgcccagaggcggtcgtcggcggcgacccagcgccaggtgctgcgtgcgtccaggagctccatcacccgccccatcacctcctccccgagcacatccacggggtcctctcgtctctgccgcctcctcctcctcctccccctcttccgcctctcccactcctccgcctcccgcttccgccgccgccgccgcccgcgccttggttgccgatgacgtcgcctgcaccttgctcaccgccgccgccgtcgcccgcaccttgctcgccgccgccgcccgcgccttggccgccgatgccgtcgccttgccgccgccggaggaagcgtgagtgcgtgacggctgggtagggaagaaaaggataaggttgtggggaaattagggtttggtttatatatgataggctagatgggctttttgggcttgcaatatagtattattaatagtctaatatacaccctctaagttttgctgacatataattagctcgtactcttacaattactgacagatattttgaccaaaaatatatttagaattactgacatataccatgtctcattatgcactattgctgacatatagtttgccaaaaacctttaccgacagatatgttatcactaattgtttatttttgccaacagatgtctgttggtaattccatgtcatggtgtagtgatcatgcgagcttgtactattactaacaagcacattacagcatgcaagcttgtactactagcaccaggtagacaatatgtgagagcttgtactactagcatatgggaaaaacaattcactgatagagattgtcacacccagaaattctcgaaccagaatttctaagctgaatgtgcattaaatccctgtccaggaccagccagggtacacaaacgataattgttgacatacagacccacatcttacaaaaatataaaagattacaaatgcagcgggaaagataaaagcgagctaaaccgggaagcttgacttcaacagcggacgactccactccacaggcaaaccttgacggcagcgacgaaaccaacctctctgagacagctccaactgagaagaacttcaactctggtatgggggaaaagagagcaagactgagtactacccactgtactcagcaagtcataccggaagaggaggtatgatgcaggatataaccaaaggaagctaggggttcttttgcataaagcaggcatttcaaagcagtagttgaaagcagtaaaacagctgtagtaattaatcaatattaaccaatcactgtccaacgctacaccacgttgcaacaggcccaaccaaccacctgaactacaccagttcattaagctaaactaggggtgagactaatcacggtgaatctggttgatcgcccataaccgcgggcacggctattcgaatagttttactctggccagaggtgtacaactgtacccacaagacacgattccacacatgtcgccatgccccgaagtatcaccatgatactgcaaagggggaaatcgtgacaagaccctccacataaccctcccataaccatccacaccacgctaaggtttcacccccacccctcaaaaggcagtgggcggtcccctcttgcaccgcggtgaatccggcagctggacaaccgaacacctcggccgacccaactccatcacgcccaccctcgccaccggtgcctaggaaagggtcgagctatacttcagatcaagtagttacccactcccgcttgtggtaagcacggtaagtctcccagggtttcccgtgaaccggtccttaactgctatgggtgcgaccagcaaaaccatgcactcacagcccgccattcagaatattttaattaactgacacccttgcggtagcaccaatctaaagctatgccaatagtcagagtctatgtaataatgtgatccctttttgtgtactagttgagctaagcatggctaagcatttcctaaaccaacatctaatcattttgatacccaggttatcaatggcatatggtaaacaataaatggctaagtaataggacccatcccacatgacattgtaaaagaatgcaacatttaatagaaatgcagggtgtttgtaaattgggtacaatatgatcaaacgtatggcatgacttgccttgctctcgaactgatgagacctcagcaacgtctttgagaaactgcggatcgacgaaacggccgaaacctacgcgacaaacagagcacacaagcaaaacatgctataagactactgaaacaggaaacaaaaccatttttaatggattctttgcatttttcttgatttactgagacttgaatggacttaaacggagctcggatgaattacttatgtattttagaagataaactgtgtttttactaataaagaaaaagtccttaattaattattgcgcaataatacccagggctgacgtcatccagggggcggcgccgacaggcggggcccacgggtcagcggctcaaaggggagaggaagggggcgccggcatataggccccacgggcagtggctcaaggtggccggtctaccgtggaccgggaccacgcgggtggtccaccgccggtccacgggaccgacggtccggatcagccgggaggccgatcggacggcacggcggcggctaggcacggctcggctcggcttcaaaaccggccggccggccatggcaaccggcggcgacgcgcacggtcgccggcgacggcaatcggcggcgcgggaagcgacggcggacggggtacaggacggcggcgtcgaccgaaggcgacggcgagcgcgtggagagaggcgacgcaaacgagagagagggggaagagggaggaggggggatcctcaccggcgagtatggcggccggagcggaggatgaaggtggcggcgacgacctggcgatgaggaggggcggacgggcggcggcggcacctacggagggagttgagaaggattaggagtaaagagggtgaccacggcggccaccattgttggccggagacgaaggagaatggatagctcaccggtgtgcgaggagaaccgggctccggtggggtttagcggaaaccgagcggcggccgaggtggctcacgcggcggcaatgctaatggcggcggcggcttggcgcggcggcggctctagcggctgcggcgcgcgaccggaggtggcggccagcggcggcgctagtggcgagcggcgcggcggcggtaggaggcacgggaaagcgcggcgaaaaggggaaaagggagagggagatgcggggaagctttataggggctcgagaggggcggacatggccgggaaaccccccgatttggccggcgacgtggggagagagagagagagagagagtgggggggattcaaatcgaatcccgcccatttgcgggcgcgcgtgcggacgggaatggcggggagggcggcgacgtggggacgcggagtgggggcgcggcgtggagcggagaaggcggcggcgcggacggtttcggcggcggttgccgtcgtggggcgggcggctggaggaaggggacgacctgacaggtgggccccacctgtcagcgtcccggagagaggggaaaggggaacgggccggcccaaaggaaggaggccgagcgcgggagggagtgggctgacggcccaatagagaaaaaagaaggaaaagaaaaagaaaaagaagaaaggatttttcctgggatttaaaattgcactttggtgatttttaattggttaaaattatttccaaggctctaaaaattccactaaaaatcttggtaatgcattggagcatggggaactcaagaaaaattccaccacgctatttccgattattaattgcatttattaactagggatttagctctaggttaattaagataatttcttcgggcaatttatttaaccaatttttaaagcaagaaaaaggggaaacttctgggcgtgacagagatgctcacgaatctatcatgcagctctttattggggagtgtgctagtgctggagtactactacttgttggtctttgaagaagtacgggcttgctgctagcccgtggtgcatagataaagaataaaagaagtcaaacatactactcgttgagctgtaggtgagcagctgagctcgtcgagcttttcgagctcggttcgatggggctcgcgagccttagtgcaagctcgggcttggcttgtatgatggtcgaatcgagctcgagccgagcctaagacgagccgagttcgagtagcttgcgagccccgagcttttttgacagccctaagtgtatcggtatgttttattagttagacacaaaatgttgcagtgcccttttgatgatgttttcattcttgccttcagtgtgttcagatgtgttgatgctttggtagttcaaaattgatgtttcatatgtaacaaaatgtttcaattatgtttcaccatttgaattgtcgaaacatttttgttcgagatctgaaacatttttgttcaagggatgaaactcttttatctcattggtgaaactttttttatcgagtggtgcaacatgtgaaacacttcataataatacagtgcaacatcgtccgatgatttataaaatattggacatctgatttgtagcactctccaaaaaaaaaatagaggtgtggccatagactaaggagatgctttagcgccagtttgccatcgatgccatgaaactcatagcaactaaaatctctagccaagtcagcagtggatgccatggcagaagtcgatcaagagctcggacaaaccgtatgcagctgcacatctacgtccttcacctgcgcctctattggccacagtgtcgtatgcccgcgccgcctacacccgttgcatgctcaccattgccactagctttcccatcggtaatcaagattggtgttgatagtcgttatcgaccaatttcgaccgtcaatattacccaatatatgaagactagctatgcttgcaatgcataatttccaaataaaatatctacttccactatatactatgctattaacatctatgtaggagaagcacatataaatggaggagaatcgacaacaaaatagacgatcaatcaatcagaggctgtcgagatctagacttacggatgaataggccaagaacacataattgacatgatctaataggcccaaaattcactgttatgtataagggaggagctaagagggccacctgccaaaaatgggccaaaatggtctagcacatggttcggccgaacccctctaagcgccgatggatccagggtttcttgtggacggtggagattcactccctatgacggttggagggcgtttcggacctttccaactatcataactgtcataagtgttggtatttcttaacgacattactagaaatataattcccagtaatgacgcagaaatacttctggtatattatggttacagtgttcatccgcaagcgcacggatataccattgtaacatttcacccgagagtattccaagggtatcgtatttattttatctcgtgggaagatcatatagagagaacttgactaataatttatatattacttgtgataatcatattctaagcaggggttaagataatccaagggtagagtgacacacaagcat

SEQ ID NO: 48935 - DNA, 8915 bp, Oryza sativa
tatccgatgtcctcctggtacttcgagaagccaccctgactgccgagttcctaacgacaacccgtcatgaccatacaaccggggctaaatacggaggaataaacaccccagggaattaacttaggattatataccggcgcggaggaatacccgtactgagctgtcaccatcagcggcccacctctcatccgctatatataaccccaaataatgatatcccgtaatctagacaccacgtctaaactactagatactactctaatatcatcgtcatgacatatagtaattgcatatgcaaacattatacccgcaccaaagcatctcccagataagctagccgtatattcagtataacatgaacataatgtaaagtaggcattcatatactcggaaagtatttcaataccataaatgcatatagaagagtattctaataaaagtacaaagcttacaaaagagaagagaaaagctactagagccatacccgaactcttccgaaggcttccggactcctgatttatactctattcctattccaccagctagatactactaaactaaacttgagagaaatgagagagctattgcttgaggtgtgtgtgtgaagtgagaagaggagctccttttataggcaggtaatgatagttgtgacggttggaatggtcggtaataccctccaaccgtcattggggatcaatcccagccgtccatccaaaccctgcatccatcggcgccacgggaagttcggtcgaaccatggactggcccaacccagcctatcttcggctggcggcctcctttgttgtccttctctgtagacttgtgaattttggctcaatgtgtcgtgttatttctgagttcttagcccattcatacataagtctggttctcgacaccgtctgattgatttatcgtctgagttgatgtcgattctcctccactttattgtcattctctgcaaaagattagtatacctaatactagtggaatattattattctaatagatatatgcaatgcaagcatcactagttctcctctattttagtaatattgacggtcaaaattgatcgataacgatagtcaacaataagctgcctatttaaggagctcccctcactccctccaacacacactcaagcaaggatcaaatctctctacaaagctagtattagtgttagtggagtagagttagaatagttccaagtccgcggaggcttcgggagttcggtaaagttctgtagcttttcctttctactttgtaagacttccatttatcaatattatgttcttctttatataatttcggtgttttattccaatcatagaatatgagtaccagtcttagtttattcatgagtattataatctgtggttaaactttctgggatttgcattgatgctggtataatgtctaactactaggtcattagtttgcttaggctaagccaagagctatggtttcagggcttagttgcttctacactgattgcaagactgtaagtagtaagtagtaatttaagcatggagcttaggttaccgcttatcattattttggagtatatgctctgggtgatttgtaggccgctgatggtgacagctcagtacgggtgtcttccccgcagtttatatccctacatacaatttcctggggttggatactcctccgtatcccgctttggttggatggctatgacaggttgtcgtaaggaactcggcaaaccgggatagtcttgcgatgcatcgggagggcaagcttagctatgttgcattgttaaaggggttataatacatagtgtatactagttagaatatactaagatgttgtatactagaagtacaggaatagaacgtatctaaactactaccccttagccataattatgagatgtagaaattagctaaattagctgtgtgtcactctacccttaagcttacttacccctcatagatcttgatgtatacaagtaatatataaactattagcatagtactctcttatcatatcttccgttgggattaaacaaatatgataccttggaatactcctgggtgcaatgctacaatggtatatccgtgcacttgcagatcacatctgtaaccataatataccaggattatttctagtgctattgctgggaattatatttccagtagtgtcgctaagaaataccaacaagcatttatgggctctcctgaggagggagaacaggagaattccaaggtatcatatttgtttaattccaagtgaagatatgacaagagagtactatgctaatattttatatattacttgtagacatcaattgggattttagaaggcagagagctagggttcatcaggtccacaagtccacaactaataaataccactacaagagatcttatgatagatgacacttcatttacgtcacaaacattgaatttttcgtcacattttgtaatctgtgacgctcgcatgacgaaaattcattcgtcacctataaggtgtctctaatggcgttctatgacgaaaccttatttttttcatcattaatctagtgacgatccttccgtcgtcataactttatgacgctcaaattcgtcattatctagctaaaaaacgtcataaaatatctaatagcccattaagatccatgtattgagcaccctgtttatgggcttagcccaatggcaagcccgactagattttagcctagcccatctacgatgtagcatattttcagcccaattctattatatctattttctttaatatcaaataataaatgggccaagtacattgcaaaagcccatataggcccaaacattataccacactattttcagcctaatcatattatattcatttacattagtatcaaataacaagtgggctaagcccatataggcccaacaatcaaacacaataacaacccatatagcacaaaggtaacaacccaattagcatcaaacatccaatacaacacaaaatttacaacctagttaacagccaaatccagtcatgttccaaatacaatcacaggttcactgagttactaagtacatgtaactatcctagcaaaataaacaagttacagtcacattcactaacaaaacaagtcgcatgtctgaatcacaccaatcaaaagatattgccctctcatcatgaatcagcaagtcgacatgaaaagggcagacaaacctgcatggcatgatatgcagaagaaataacaagtggaacttgttgcatattgagcacaaaggaatagttatgaaacatggtacaaatgactaatagtattgaaacattgcacataccttatcaaggacgccttgttcaatgtcatcattaccttcaagagttggcaaaagaattgatcatgagcatacagagaatggtaattgctttgatttttttttagaaaaaacagattttctatacctcttcatctaaatcaagatagagctcatcaccatcttcagtcttcagcatccacctaccatctagcgccctggggaaaatgagcagcaaagaaaataaagcaacataaatttatgtagaaagtactttcctcatgacaaacggaacaaggtagcagtctgtactcagcagcctcaggtgacatccactgtcctcagcagttatagagtttgtttttaaacacagataaagtaatccagaacgtatttaagccatcgcaaagattctgttttagttcctgactgaattaaatttcaatagtattctgtttcataataaccaatctggttttcaagcagatgcaacataacaagttaatctaagaggaatcaaaatcaaaatgtaagatataactccagagaaaagtaagcacctcaagttttcaaattatagtagttactgctgtataggaacaacaaaacaaaacattacctagctgtgccatactgcatcaagtgcccaggaatgcttatatcactgaagaaatcaagtgaaactgccaaacagatgtagccatatcagctcaaccaattgtttgtgaatgcagcttttcctactaactagtaccagaagaggaaggggccatttgtaacttctatacacatgtgaggcacaattagtccaacagtaaagaacaggaattagtgcttgtcaaagataaaatttatatattcagtttaacagaatactatgttgaaaataaataaccatagttcagcattaccctccagatatttagctagcaatgatttgtgtaccccaacaaaagtaatcactctaatgcaattgaggatattgattccaggttagtaatcaggtctacagggacaaagaaacatactaggatattaaccagcgccaaacttcagttaaatagacctttctcgacagttgcaagatgccaacacacagaaaactcagcccggcgcaaaaaaataataaaaaaaaagtaaacagagaaaactcaattaatcattttgcaatctactttttttttagcaagaagggcagatcccctcccatttccattaaagaaaccagcacaaccactacacccagaacaactataggataagtatataagctgagaagacctgataaggcaattccatccccattggcacccctgaactagcctaagcaacaatccagtaaagttccagcaaaactactgctaatgaacagagatgacgcaatctattgcaaattgcatcagaaacagccctacagaagcgaaactcgaaatatctacacagcccaagtataatcaagaaaagaaacctttaggcaccgccagtaaccacagaccaaagatcagttcagtcagactcacggtcgcaccgcagctacttagctaattaagacgatacacgcataacatagtaacacatagagatggagattccgttagcagtagggttgtttggtctgctggtggcagccacggcgccggcagatccaccgctcccacacccggcagtgatggaaacggaggtcggcgcggcaagcggcgaggggcgagcaagccggcgcggtgagcggcgacggagaagaccgccgctgcaggccgtcgacgctgccgcacggtgtcgccgagccgcccgaggactgccgccgctggccgtcgacgcagccgcacgccgtcgcaagccgcccgaggaccgccgccgcgcgatctggccgccctagtgtcgaaaccagatttcggcaatattaaaaggggtggctatcaaactgaaaaaatagatgggtttagagacaagaaattttatacaggttcaggccttcttaatcaaagaagtaataccctactcctgtccgaggattgatccgccgagtatattattgatcgtatgatctgggtgaaaatcgtgcccctagaggcacccagacccctccttatataagggaaggggtccgtattacaaaatacagtccatatccctaacggaatatgtagttacagataaaatacaatcgtaactgactagaatctcaagtattccttgacatacaagtttggaatttaacccgagtcctcttaaagatattctatctatacatggcaccctataccctgtcggactatacatgacgtgtaggtatggggtatccataatctccacagtagcctctgagacctttacagtcaacgaaatagtctcttctcgtagcacaaaatgataatccgagtgcttcaatttcttctgcattgatctcctgagtaccaaaatcaaagactatttggctagaaatattcaggactgtttggcttggtcttttgaatatctgcatcagtgccaacattctaagagggaaatagttcttttaaaattggattttgagaaagcttttgatactattgaacattcagttatattaaacatcatgaggcagaaaggcttagatcctaaatggataagctggatttctcagattttttcttcagcctcttcttcagttatcctgaatggtgttcctggcaaatccttctattgcaaaaggggtgtaagacagggtgatccactttcacccttattatttgttcttggagctgacttgttacaatctatagtcaataaagcttgttctcagtgagtttttacaatgccaatcccaacacctggtaatgaatttccgattgtccagtatgcagatgatactctacttttttttgactgcttccaaaaagagcttttctgtctcaaggcaattttgaatacttttgcctcttcaactggccttaagattaactatagtaagtcatgcatgattcctctgaatgtagatttggaaaaggttgatcatctctcaaaattgtttggttgctctattggtaagttaccttttacttatctgtgtcttcctcttggaaccacaagaccaagagttatagattttgctcctctagttgatagagtagagagaagactctcatcaaccactgctttgttatcttatggggacagattgaccattgtgaatgcagttctttcctcccttcccacttactacatgtgctctctttcacttccaaagacagttatagaaagtattgatagagctaggagacattgcctgtggaggggatctgatattaattctagtaagaagtctttggttctctgggcaaaagtttaatagaccttagattgcaaaataattcccttctcttgaagaatctgcataagttctataatagatatcctgttccctgggtcagtttgatttggaatacttactacactgcagaacctcctcatgctgttactcctaaaggatctttttggtggagggatgttttacaatttgtggatatttttagaggcatctcggcctgtactgtgcaagatggaaaatcttgtttgttttgggaagatttgtggaacaataaagtcagggccttggtttatcccaaaatatattcttttgccaggaattcaaatctctcagttatgatgttctctacttctgatctacctcagctctttgccttgccactttcagagcaagcttttcaggaatatttggcaatgtcagctgcagataccttggagcatcttaatgatgagagtgatcgctggacatatgtttggggcaatggtatcttttcctcacagaaaatttatgccatgaatttttctcatgtccatgtgcctgtttatattaaatggatttggaagagcagttgtactatgaaagtcaaggtgtttgttggctactcttaattgatcggttaaatacttatgacatgttagacagaaggcattgctcccctcaaaatgcttccttactctgtgtactttgttcaacaggatcaagggaaacaactctccacttatttttctagtgtccttttagcactcaatgttgggcgcaatttggtgtggtttggaatctttctttaagctttggtgaaatgttggtcacggccagaaattcatattaatctacccattttattgagaaggtgctttatgttgcttggaacatttggaagcagaggaatagtttaatttttgaaaacattgttccctctgttccctcttggagagttctctttaggaatggtctctcccttttagttcatagagtcaaaaattctgagagagatacattgttacagtggttaaatttgttgtaattttttctcctttattaatataaaatcttaacggtggggacttcccctaccgtggttctttcaaaaaaaaaatcaaagactgtgtagagctaaaattaaataatcaggtgcatcgaatagatgcacctaattaggtgtagcccccgactatatgagtagctaaaagctaaacatatagtcaaagtgcaaataacatccatccgagtggctttacaaccgcatcatccatagtatcatatagctaagcatatgcatcgttcaataaaacatctagccgactgctttagctttaatataccaaaaattaagatataaagaggcccgagtaaaaaatactctagaggtccataaatcagcacatatgacaagaatctgagtaaaaattctcaaagatccatcacatgtggtataaatatgttatcatgacaattaatgagtcaaaatagcctaggctatgactcacgccataatcaaattaagcatataacatgccgagagaatgactgttcaaaatccaaccatctcaacaaaacccaaacagcctttgcagcctaaaaaggcttacaaaagaagtataacacatttctgtcgggtacctttttatttgcatcgtagtaattcaaaggaatcatctaactgcgtcaaaaaggattttaacagcattgagccataccactgtgacaaaaattgccgaaacaaaaatgcctaagtccctaaggatcacaacttagccatgctgataacagaattgggataaagtactattttaggcccaggcccattagtactcccgataccctaataacaccagaaaaccaaacaccgcttcgtcttccccgctgagactttcgccattttccccattccccgctacagtacaaaaccactccagcggaactagggttctccgattctcccaaatccaccttccaaaactccacagaaatcatccgcgaatccaccgcatcaatcccccctccattcccagccattcaccgaaccaaatcatattatccagatcgcatccatggcggaagagagagagctttgagagtcagtgggcgccctccgatgtaacggaggagaacctgaaggagatggtggcgcacggtgttcttccggcaaaggagatcattgggtggtgtccagcatgcggcaaagcattcccaacccctgacacacacgaggtcgtggtattttctcatttcttctgtggcgggttctctcttccaacctcaagattcttttgggggattttggatttctatgggattagtttgcatcacctaaacccaaattccatagtccat

SEQ ID NO: 48936 - DNA, 1613 bp, Oryza sativa
  unsure (1)..(1613): unsure at all n locations
cacctaaacccaaattccatagtccatattgccaacttcatacatgcctgcgaagcttttttgggcgtcaggccacattttgccctattccgccgcatcttcttcctcaagccccaaccgaacaagagcaaaccatgtgttgttgggggggggcggtttccaacttaggggaaccttgagccagaaatatttttccatgcccttcaaaacctcgaacaagggctggcatgcaaactggttctatgtacaaaaccccgagcctgcacttcctgagtactcctgtcttcctccagtttatcaggacacttggaactcacttccaatgggagaagaagccgctcaggcgcttgccctgatggaccgtatgctgaaactaaaggagcaaggtctgcaaggagaacagatcacccggcattttatcaagagccggctagccccaatcaaagaaagatctcgtacggcctttgaatttgacggcaaacatgaccccaaccgtgaagatctagactctcttgattttaaggtcatgaaggagagaatgtacaaaatcttctcaaatgctatcgtggtcagttattcgcacttgctaccagcggtgccatacaaccccttcaatcctcctccaccgatatgtattcaaacatttcagccttcctcaaaagcatgctttcatcttctgttaagctaattgaaagttcgaaatatcatgcccaggaattagccttgatgaagtcggatcctccaattgctcaacgctgatcaccccgccggcaaactagtcaggtgagtggaggaccaaaaattcggtctgatactcaaccaaacacctcgaaatcaactagccagtcagactctcgcaagaggaaattggttctgagtgatgatgagggcgatgatgctaaaaaaactggcaacaaagaagtgactggaaaacaaccaagacaaactaatccgaagaagaaaacatccagtcgtcccatgtcgaaaatcagaaaatcttccaggtacaaatcatttggccatcttccttgtattgctgcttacccactattgaaatagcattgatagcataactcaaatttgtaggaagccatctgacatagatccttctggaaaagactttgagccgactgacatggagataggcccttcaaaagaaactgggccgactgcagaagatcacccgagtgacaatcaaccggcaaccgacaatgtagaacccagcaacaagcccccgactgggaaccagtcggccgaagctggagttggcgctaatcaggatcccccaactagaaaccagtcgggtacagagccagataaagatatcccagaagtagaagctcaagctaacagccctcccaagatagacaccggtgctagcccaggaactagttctcctgttagggtgcaaggacctgctcgtccccgaccggaaatcaaaacaggtaagcaaatccttcaaacctgttttgatccaacagactttcttcaattgtttcaccattatttatgaatgcctaaggcttgatgatcggcgacgaagaagaggtcctccggatnnnnnnnnnnnnnnnnnnnnnnnnnnnnnnnnnnnnnnnnnnnnnnnnnnnnnn

SEQ ID NO: 48937 - DNA, 3402 bp, Oryza sativa
  unsure (1)..(3402): unsure at all n locations
aagaagaggtcctccggatacagtcagctgaagattctcgcccacctattttagtcaagtgggggatgacgacatgcaacctcagggaattgtgataaagaagcaaaaggaagacgaggaagtatgcctgctgaaaaaaggcactcggccaagccactcgtctcgtaaatgtaagttttcatatatatatatatatatatataacttcaaccaccctgtcaatcaccttacttgaacaaagacaaactcgcgatgcagagaatccatctcaggaatgaggcgaagactgcaacccttgaaaaattagttcctcatcttggaacccttgaagctaccagaaaccagctgcatgaagctaaagagcttgccaggaagactgaacatgatctgagagaccggatcgctgagctccaagattccaactttgagctgagtggttcgtcaaaaggtaattctcatccctgtctcacttatttatgctgctatctgtgatatcagccaacaagaagcgatacagtgcaagccgccaagatatctgaactggaaaaacggatccaagctctggagaaagacaaggccgaattggcaaaacaaagagactcggctctgaaagatgtcgaaggtactggtaactaatacttcaaaacaccactctcatcttcatgcctagtcattgatatagacttattcgtgtagaccgcaagatcaaatcccaaactcaattcgatgtcttagttaacaaaatcaagaagcttgaaggagccagagatgaaatcgccaatgccgctacaccacttgtccaagccatgttcttcaataacaatggtccgagtgcatttgatgctaccgaaatcttcgacaagctgagaattgctccggatacatattttaagaatatcaaggaagctggaagtatgggagcgagcttagcgttggcaatgaccaagtccttgtacccgaagattgacattgacgctggtgatggttttgcagacgggacaagcgaagaagccgctctcgacctcatcaatgatgcgcagaaagctgctgataagatagccgttgatgtagttgagggattctaggacaacgacctctggccgactagatctaataactctgatgatgaaaaaactgataccgattgatgtttattataacaatgatgatgatgatgatggaggcacaatttgtacaatactgatgaatttatgatgtgcttgatctttaaacttaacttctgatttcttaaaagcttttggcaaaccttattgaaccttaaaacccgcaaaagttgttgaaaaactttcaggtcttattaaccaagccaaaaaatcaaacagggcaatgataaatcaataagcaaattgaattgataaaaatcacactccattattattttagtagcccccgactgataactcaaggaaaagcttgacattagcagtcaaagagggaaatacaaaagtaatgcctaagcataaaaacgacgaagatgttcaatattccaagagttgtcgatatgagtaccgtcttcacgcttgagtcggtaagaacctggccgagtgacttcggaaattatgaacggtcttcccacaagggagataacttgtgccgatcccgtgtagtctgatttttctcagaaccaggtcgccgactaaaaaagctcgtgatcgaacattgcgattgtgataacggcgcatcccatgcaaataccgagctgactgaattaaggctgcttcacaggcttcttccagtcggttgaggtcatctactcggtcttctctctagcactcctcgctgaagttacgaaatcgtaaagattcaaattccacctcacttggcaacattgcttccgctccatagaccaggaaaaacggtgattggcccgtagcccgactgggagtggtgcgcagggatcaaagtacacatggtagctgttctacccacttgccggcatagggatgcagtcggtcgaaaactcgcgcttttattccttgaagtaccataccattggcacgttcgacttgtccattgctcatagggtgcgctacggatgcataacaaattttgatgctgaagtcttcacaaaagtctttaaatactctgccggtgaattgagtgacgttatcagtgatgatccgattaggtaccccaaaccggtgcacaatgttgattaaaaaatctctagccttgtctgcgtgattgtaatgactggtttggcttcgatccacttggaaaatttgtcaacagctacaaaaagatgagtataaccaccgacagcctttttaaacgggccaaccatgtcgagcccccaaaccgtgaacggccaagacagcgggatggtttgcagctcctgagccggtagatgagtttgtcgggcaaaaaattgacaaccctcacatgttcgcacaattttgtcagcgtcggacacagctgtgggccagaaaaaaccctgccgataagccttgccaacgatggttcgtgcagcagcatgattaccacagatgcctgaatgtatatcctttagcaattgtcttccctcctccaaagaaacacagtgttgcaggattcccgatggatttctcttatacagctcagtctcatgaatgacataaagtctgctgcgcctggaaatccgctcggcttcatctttatcttgaggaagttcttgttttgtcaaaaatcttatgaggggctctctccagtcggcttcaatcatgcttacgtcttgagtgtccgtggcattgattgtttccttccttggtacggttggctcgtagagatgttcaacaaatacatcagaaggggctgcttctcgttttgaaccaaacttagccaatttgtcggctgcctcattgttgtgtcgaagaacatgggtgagctcaagtccatcgaatttatcttccaacttgcgtacctcctgtcggtaagcggtcatgttattatcaaggcaggaccactctttcataacttgattaacaaccaactgagaatctccacgaactatcaaacgccgaatccctaaagagattgcaatccttagtccgtgaagaagcgcctcgtattctgccacgttgtgagatgcagaaaaatgtatccacaatacgtagctcagcctctccccagtcggggagattagaacaactcctgctctagtgcctgaaagcctttttgacccgtcaaaatgcatagtccaatactccatcttctctgcaggcgtgtcttcttggcactcggtccactcggcgatgaagtcggctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 48938 - DNA, 734 bp, Oryza sativa
ccgcggcagttcatcagccgcacttgagcatattggaaatgtatcccaaattgaatccccttgggatagaaaaagaagaaccaaaagggaaaagagagagaagtttttaatcggtttacctggtgtcaattcatatttgttgtgtgttgttaattgttatgaattaaagtatctgcgagaattggagtattttttttagtttgaataagtggtggacgtaggattttataaatgggggtacgataaactaatttatttataaaactgtttgatgaaaacaaaaccacaaacacatggaaaatagggaaaccttatattttattaatcatgattcattaacatgaatgtttatagatacatgggggctcccgtaggaattcgccttttgccttcgtgaggaatgcttaataaaaaggtatgctgactggagattgcttgtagtccgttgattcccagcgcctagtaatgaggctaccggttaatttcatccatagaacgagcctatggaacacctccgattaagctgtgcttgtgatcgtcgtcttcagaattatttgctcaccgagggttgaggttggtgcaaatttaatggtgaatatagtgaatgtggaacgggtggctttgtttcgccaaaacctggtcacggtacactaccatcacgtcggcgtgaagagggaatttggtgaagcggggtgacctttgcctcatcggtgcccagtcatgaaccctgcctt

SEQ ID NO: 48939 - DNA, 1019 bp, Oryza sativa
gatttcgctagcgacgggggacgccctccaggagtccaggttgcccttcgttctgatcatcggcaactatttcgactttgttggcgttgacgatcgagagacatgcatgcacgtcagaggtcaggacacactgcactatcatctgatgtttgcatgcatgcgcacaagttctgggtctcagtggggaaggcaaaaggagatccatttagtgatggctgctacctgatcaattaatcatgggcacaatgcttcatctcggattaagattttctacaggattcgggatgatgaatatttcttattagtttttccgataaaaggaaattaatttggaagcaaacacacacacacacacacacatatatatatatatatatatatatatatatatatatatatatattgatctactatgtttcaggtattgcgatgttgatcctctaaccgaaagttcactctttcctgcatgcacagaagatttatacaccgtcatcgcttcaaggaatccaagtaggtaacttacatattgtatgcaacctatttgaagtattcttgatttctaattttcatagaataattaatgatcatgttacaataagtgttaggtaatcaggtccctgaatatataattatgtttatcaataagtgtttaggtaattaggttgatcgatagcaaaactcccatagttcacaaaaaaatttgatctattctataataattttaaaacagagaactcacgttaatctctattttttcagtggcaactaataattacttttccatgtatgtcttatcatgtttcaaaaactgtatgaagccttattgttgacgttcatgcagttaaatgtcgtgactaattccaatttttagaactatatcatgaaaactgtactcatgacctattaataacgaatttcaaaaatattaaatcagaaaaaagttataattcagactgtcaaattggaactattaattataccaggaccgaatctacaagtgagactccaacatttttttt

SEQ ID NO: 48940 - DNA, 904 bp, Oryza sativa
ggtgcttcatgtcttatgtataaatctggtcatgaagctgtgttctctctgtgcctcgtggaagaatacacaaacatggcaagattaagtaagctaagggtggccatcatccagaagaaatagtccagatggccctcattcagattatccggaatccacccaggtgctccactgctcgtcgtgatcactgcgacagcgccaagcacgaacgtgttgaagtaagctcctgaagcgattgcgagctgcccaagcgctgcgcaaacgctcttcatgctgtctggcgcctggtcatagaagaactgtgacataccgatgcagctgaaaatctctgaaaccccttgcagaaagtatgctggtgtctgccacaggatactcattggagcagctacattgtggtctgctaagccacttgattgcacgattgccagccgcttcatctcgagcaatgctgcgtacaccatcatgatcatggacagtgaaaggccgattccgatgcgctgcgcatgtgagaagcctttgtcctgtccggtgaaatgcttcaccagtggcactgatatgatctcatacacaggaaccaagacaaggacgctgagcacggcgatgatggtgagggatgcacgtgggattgcaaatgaaccaacatggttgtccatggccattccctgctcaatgaacgttgaggacatctgcccattgaccgcgaaaaagatcacgaaagatgcccagtggggaacatccgcagcagcatcttcagctcctcaacttgtgtcactgtgcagagcgaccatgagctcatgggcttgatgcacgtttcgtttgatgggggcaatacaatggctgccttgtcaaggaacctgaagaacacaagaacatggttataacttataaggaggatggattctaa

SEQ ID NO: 48941 - DNA, 793 bp, Oryza sativa
tatatttttaatagaaaatatctttcattaatatataataaaattaaaatgttacttaaagtcatctatagcatacaaaataaaaaatgttatataaagtttggaaactccacaaatttttttaaaaataatcgctcatatatcgtacagatagatatgaaccacctccatcatttgtgacatattttttttttctaataaatttgaggatatacggtttcaactaatatgcccaatccagttattaatggacccatgtttaaaatagagtcaaaaataaacattcgtaataaaaattcaaacaacattaaacaaacatgcacgcgcgtatgcgcgggctagcttcctagttaactataatgagacaaacccataaatcaattcaaattgtaaaaactttatttagaggaacctgctagcactttattcaactaactgggaccttaaacactctgacgaaacagagaaccaggtcgaagtaacttcgttagcacaacattccttcgctaaaaaatgagctgccaaattggctgaccgatggatccaaatgaccctaaaatcatgaaacaaacctagtcgatgcttcaactcttggattattaccccatacatcgatctattggcgttctcaccagtcaccattttctgaagctttcagactgtcggttacaaggattaattttgaaacacctaattgtaaattttgtttgcggctcaagagccaacaagcagattctcagttaagatggtagaactaactcactacagacaaaaaaaaaagtcaaataagtca

SEQ ID NO: 48942 - DNA, 5139 bp, Oryza sativa
tgcagccctttcaaagctatgagtgaagttttgttttctgttaagttataaaaatatatatgcgctcaaaaaagtgtatgtggacatacgacaagtgatagagaaaaaagccgaacgcaatattcatcgaatgtaatatttttccttgtgcatgtatttcttcatttccgtactgaaaggaactcatatgatgcactggattattagaatttatgtggtattggattacaccatcgtgatattcgaactactcacagtcattgtttttatttatttttaaatcctagctcaatgttttaaaatttagtggttgaatagtgcgcgacatttttaaaattgcgtccaccgctccaccaaaccaaactagcacgaaatctctcttatggcaccatcatcctatagttagcgtgaaatctattagtgtgacacctgtgtcgtgctatatatgaggtgacaccaatatattttttcagaagttcttaaaatcggtatattcacgcaaaacactatgcaaaaagtgtgttttcaagaaaaaaaaattcccacatgccaacatacactaggaatctagcctttccattatctattatcttattaaaggaataaaaaaagaagtctccacgttcgctctcacggcctagaaattctcatattaatcagggaaaaagaaaaacagagtccatatagaaatacaatttaaaaatagctaaaattcggaattaaaaaataaggaatattagaagaagagtatagagtccatatagaaatataattaagaaataatagaaattcagaattgaaaataaggaatattagaagtagagtacagagtccatacagaagtacaattaaaaaataatagaaatttgaaattaaaaataagtaatattagaagtagagtatagattccatatagaaatataatttagaaataactaaaattcggaattaaaaaataaagaatattagaagaggagtatagagtacatatagaaatacaattagggaataatagaaattcggaattaaaaataacgaatattagaagtagagtatagagtccacatagaaatacaattaagaaataatagaaattcagaattaaaaataatgaatattaaaattagagtatagagtctatataggaatttaaaactaactaaattttggaataaacataataaaattaaaattagagtttagagtccataaaaaaatacaatttacaaataaccaaacttctaaattaaaaaaacatgggaagaagagtgcaaagtcaatacaggaatacaatttagaagtaaatgaaattcgaaattaaaaattaaagaatattgaaagatgagtttagagtccacatagaaatacaattagaaataataaaaattcagaaataaaaataataatattagaagaagagcctaagtatatatagaaatacaatttacagaaaattcagaattaaaaaaaatattaaaagacgagtctggagtccatataggaatatatataatctacaaataattaacatttaatattaaaaataattaatagctaacacatatatgaaatacaatatgaatattacacattagtagtttcgtaaagatagtacaaaatttaaaattatgtcgctcattttacatatttgaataatacattgagaaaatatatatgctcttatagagagaaaatataatgatgctagccgcacaatctgcgcggaccaccatactagttattaaataaagagaatacctgcaatgtgactgattcctgagatcctgtttcatacaaaaagatctttttgttgttcggtagtttcaccgactgatattccgctaatctccagtctccacagttcaccatctcccttcccacctccgaatgctcttcttccatcatctccattgctcactgcctcactctcgtcagctctctctctctctctctgctagtgcttctaggatccatcatccatggctgcttgcaaagtctacttcttgtgcagcatattgtaggattctattgtttgagaacattttagggagttgcatgttacaggtaaaccgcacttctttttcctgaatcaattctacatatgagctttttttcatgcacaaaaaaagtatataggcattgaatgaatctacttgttcttttttagtagtgagaggtctttttccacttgacaaaatgagaggtctgtttccttaattcagttaaccttcgttctgcaaaggatggttcagtgctttctgttactttgtttgccgatgtactggcgattattccctgaactctgtcttaccttataatgaaaaaagttcatgaaacagagtacaattgttcaaggttatttctgttttacacttcacttcttagttctgtgtttttcgtttatttattttcatgattgattttttttagacaatggcttttatgattgaatatgacaagaaacaggggtagctctaaatctaaatatccaagaaaaagactgtgatagttgacaaaaatatactcatggatgctcattactttttactacagttcaatgcatgtgtaactatagatatatgctttccttgtctacaaagtagggaatctgagggagcaaaaagtttatcacatggagggagcagatgaggagaggccactaattcatcacctgcctccacaggtactattctattaccttaagttggtaccaaatatattgcatctccatgtgacacatgacatgtaaagtcgataattaatttggcttcagtttatcagaaagaaacaagaaatacatgagttctcgcagcaaatttgcacatacatttaacgccgattctgtgtaataaaaattagcactggcattgtcattcaggaacaatgttcgcaatacacctgcgatggaacggttgatatcgacagaaggcccgcactgaagcatagcacagggaattggagagcatgcttcttcattttaggtatttcagagaagttcagaaatattccaaacaaatttaacactttctttgttaaacctgcacaacttttaaccaatatatattgggtctgaacatatatgaactaggtgctgaattcactcaatgcctgtgcttctctgcggtcgtgaagaacttagtcaggtatctgacgagtgtgctccaggaaagcaatgtcaatgctgcccgaagtgtgtcgacttggattggaacttgcttcttcacaccactcattggagccttcttggcggacacattttggggaagatacaggacaattgtaatatgcctctctgtttacagcatagtaagtgcaacaatcagaggctattaactgaataatctaatctatcaagtaaaattgctccatgaacatttcctatttttgtcagggaatgctcattctgacgacttcagcgtcgcttccatttctccttcatgattcctacaacaatggcgacgacattcgtcgtgttgtcgcctacctagggctctacctcattgcacttggagctggaggtatcaagccctgcatgtcggccctcggggctgaccaattcgacggtgccgacccggtagaacgggtgacaaagggctcattcttcaactattactacttctcaaacaacatgggcacgctgctgtccactaccgtgcttgtctgggtgcaggacaacatagggtggggcatcggtttcgcgactccgatgctgctcatgggttttggcctctccatgttcgtcgccggtaggagggtgtacaggtacaggaagctgggaaggagtccattgacaagggtgtcccaggttgtggttgcagctgcgaggaatcacaggctcaagttgcctgatgatagctcactcctgcatgagctgccttcactgaccgaaggtggctataggattcaacataccactcgattcaggtactattgctcatcatatcatcaaaatatatgtctagttactgctgcagacattaacctcaaggtccacaacctagtgataagcttatatatttttcaccatcactcttatgatatgagtggcattttgtgcaactatgtttagagtatgtgttgaaccttaaactaagcaggaatcttctaataacaatttattgaacgatcattgagcttataattataccacgcctaccaagaaaaatctgtcgcgttttgtggactaaaatttcctatatgtggaattcaccttcgtcgattgcttcaagagatatcaacagtttatttttgaaaacaaaagcagaactttgtctcatttcattgataagagttaccaagaaagggatcacacggaaaacaccatcctacaaacttctcaagatcattcctcaaagctacacttaacacctaaaaacaccaatgcaaccaaaaacttaaggatacatcggtttctaatttactctcagagaataattccttgttctttcttgaggcgatttgccatgcgacatatggggtaattaacagcatgttcgaagagctccaaaatctgaaatggatctagagttgtggacctaggaaaagttaactccatcattttaaaatgttttataaattagattcacctgctctgctcttaaagaaaaggaatatgggcttcagctctaccggataaggatccagatgagcttaaacccctgccaggcatgttctaactatttgccactctatagattactttgataatataccacttaattaacagatgttaattaatgattttccaattctaatttttgtaaaggttatttgctatcttaaaagttattactcccttggcctgttccataatacttcttgatatttttgatattaacacgatttacaaaatatatatgtaactatgtttttctcttataatacatacaataaataaatatattttccttttattatagtactttgtaagacaaataatttaaagttattgaatgtcaaagatataaaaatttaatctcaaccttatctaaaatgtctaagaattatgaaccaaacaatgggcccactattttcaaattctcgaaaatctaatctcaaagaaaacataatcccctgccctccctctccgcatggtgtccaggttcttggacaaagctgccatcccgtccgactccgacg

SEQ ID NO: 48943 - DNA, 4835 bp, Oryza sativa
  unsure (1)..(4835): unsure at all n locations
gattttttatttttctctgcgctgctgctgctactgttcaaagtaagcgaagtggctggagaggtgacgaattctaattcttccatttggatttggggcagatttggtggagatggtcgtgatggggattagtaggggatttcaattgcttttaacacagatggggaaatggagacaacgacctgctcctatctaatgcctcggcctgcttgtcagtgaataagttaatctctcgctttttggtaggagtggataattaatcttggttatatgatatagttagatgatgttctgtagatggatgaccagaggactactgctgttgaggaaactaaattattggattttgtaaagtacccttggatgagccatccattagattatttctactagagctgaaagttggtgtagtaggtgtagtacaagggtatatctggaaaatagatttgtggcatccatgtaaatttctaacctcttctttctatgaagctaatgcctactaattataaacacctaaagctcaacatggaagcattgtatttattagcacttataaaacctaaattcaagcatgctgcatcaacccattaagcacacaaagcccaacaaattacttcattctaaaactaaacatacacatgctagatcatcattctcaaatcattttcataatatttcaatccaaatcatttcattatttctccattatctaacatatatcccgcagcaaagcgcggggcatcatctagttgatgtaatgtacgaggccaaaggttggctgctgcccccacgctcttggttgagcaaagcacgtgccaacacttccaatgacatcgcccccgtctctcgttgtgtgccctagctttgccctgcctcacctccatggctgcctactccatcacgattcacgaatacggcgtctgcgagctcatcagacgctaagaacaagaccatcattttcatggctggcgcaacatgagctgcatgcctgaaccgacaaagggggcgtggagaagctgcggcgtatgaatccattccattgccacccggagtcactctaagcaggctagtgcctcagccagcaccacagagctgcataattgcaagggctagttgccagcaacaccagacccctgctatctctcacgataattaattccaccacttgattcactagtttctttcttgaaagtgacatccatgttaaccttcgcatgtccttctggtggcattgccatttctcattctgcacaagctgattttggtcatgcctttgatatgaatctgatcatttcagagataccatgccctacattctcagtttgttcaacatacatctttcaattccctttgtcatcattagttgtcggatcggcaacaatgtgttttcataatcgacaagaaaggctacagacccaggttttttgccatgccttttgctatgaatctggtcatttcggacataccacgccctccataacatgtacaacaaaggtgctttcttagtaccatttagagctttgagaacgatgattataggagatgcttgacaagtacatcgggatgtgtgtaattccttcgtcacgagttacttagcattgttggtttacgtaccaaaatattaagattgtaggctttagcagtgaggccataatggatgcagcagatgatcagaggcctctgattcatcaccagcctctcgccaggtgctattatatcaccttgatgtgaattgtgatcctgcatctctaagtataacaaggattcacaatttcggaccaaaaattttgggtttatgatggttactggttggatggtctactggctgaaagttccaaatctattatctattatattattaaaacagccttgaaagaaggcaccacgttcgctgtgggggttagaaattcccacattaatcggataaaaggataaatatttacaccgttaaatcgtagttgtactagattttagtggtgtagattattcatgacaatattgagtctaaatagaaagcaactttgatctaataggaaatatgggagtcggacatgttgaatgaatagaagtcggacatgttgattgattaggagtcggacaggttgtctgagtatggatgctatggtcttatggacagtaatcagacaaattacattaatctatgtttagatggtaattagagtgcaaattgaactatagtgatccacgtttcatatgtggctggaaaatatacgtgccatatatatatggccattgatagtaaagagggagaacactgcatgcatgtcatgccgtatgcacatgccaagatagcagagacattgggcggagatagcccacaatcgatctagaagcaaagcaagtatgctacgaagaaatcaacatagatatacattattttataggatgagactaccgatcgggcgccccatccaagcgtgaaaaaatcggacgctaacgtcagcataacgtcagagccatgcatgcgtgcaaaaccactttaaactcttttttctcttaaattatttatccaaatcatgatccgattacaccattaaattcgttgcaattaaatattcaaaacaagaccacacatggatatattccgacgaaatttttttagcttattatcaaatccggcgttatttcaccttatataaaaacaatattttagcaaatagcggaagaatgtttcagttcactgtaacattagatctatacatagtgaaacattgtgagtacacttggtggaacattttttgtggaacaaaaaaacaaattcccttaatagagaattttcaaaatatgtgggtgatttgttgcanaagaagttttgttaactgcaaacattagatctatacgtagtgaaacattgtgagtacactaggtgaaacatttttagtggaaccaaataaatgaaaacacctttcgttaataaaaggtttccaaaatatgtgggtgatttgttacaaaataatattttaattcactgcaacattaaatctatagatagtaaaacattatgagtacaccaggtgaaatatttttttgagacacgtggtggggccagggaacgtgcgcacggggagggggggagcgctctatcctgctccacccccgtcagtcaccctggcctaaacatattcgtattttataagacatggcaaataaaatttaaggtacaatatcttcgccagtatgatctatgcatgtataaaaccatctaaaacatttgacgagataaattaagtagcaggcctacaaaggagtagagtggtggcagttaatacgacatataaaaactgttaataaaacaccaaatcgaatcctaatgatgattaaaaggagggacgataggcaggccgtgaagcaaataggcaaggcggttgccgggacttctagaaagtaaaaaaataaacccgattgataccatattcgatttttaaattttcaatgacaataaaaaggagaagcagcgggcggggtgtatatgagtatagttacagagctgccaatggttggtgggacttctagaaaataaaaagtaaattctaacgatagttttgttcgatttttagaatcccaatggcaataaagagtaggcggcagatgggccttcgaggagtatagtggcatcgtttgatgggacttttaaaaactataaaaaatgaaacccaataagacaataagctctaaaaactaccaatttttaaggttcgtaacttctaaaaagtaaaaaaacaatgataatcatggtcgattttaaaatctcaatgacaataaagaagggaggcagcggacgagccatagaggagtacaatagcaaagcccctgacagtttggtgggacttctagaaagtaaaaaaatgaacccgaacagtaattatgtttgatttttaaaattccaatgacaataaagagaaaagacagtggacggaccgtagaagagcataatgacagcgtttgacgggacttctagaaattataaaaacgaaactataagatccaatttttaaaggtttcaaggagaatgaatagaaatagtggtagatctaagcaaataaagaaggatatgacagaagtaagaggtagcagctggtctgacttttaagaactatatagttggaaatacggagatgataagatttggtctttcaaagtcctatgacaacaagatagctatttaataaattttaatatatagttggaaatacggagatgataagatttggtcttttaaagtcttacgacaacaagatagctatttaataaattttaagcaaaattataccaaaaaatttataattgtgtttaggtgcttagccgcgcaatggggcgggccacccagctagttatattattaaacaagctttgaaaggaggtaccacattcgctgtggggggtagaaattcccacattaatggaggaaaaagaaaaaaaaagaaaaaggagagtccaagtagaagtacaatataaaaatagctgaaatcgggaattaaaaataagcaatattgggagaggtttccatataagaacccaatatgagattaatcaaaattcaaaataaaaataaaataaaatccaaattaagcaaaggaaaggagagtccaagtagaaatacaatttaaaaatagctgaaattcggaattaaaaataaggaatattgaaataagtttttatataagaacccaatacgaagattaatcaaaatttgaaataaaaataaaataaaatacaaaattagaaaaggaaatagagtccaagtaggaattcaatttaaaaataactgaaattcggaattaaaaaataagaaatattaaaataagagtccaata

SEQ ID NO: 48944 - DNA, 1600 bp, Oryza sativa
agaaaagaccatctaaaacacatgacgagatagattaagcgacatacctataaaggagtagagtggtggcggttgataagacatataaaaactgttaatagaacaccaaatagaatcgtaatgacgattaaaaggagggacgataagcaggccgtgaagcaaatgaacaaggcggttgccgggacttctagaaagtaaaaaaataaaccccattgataatcatatttgatttttaaaatctcaatgacaataaaaaggagaagcagcgggcgggtgttaacaaccaaatttggttatatcagtatcggagatgaggataagaacaaagcagaatcaaaggtggagattgatttgagaacagagcaagaatcagctggagtccggatcggctacgatcaggatcggctgggtccgagtcagactgggtaagccgatacaaccgattctgacaatacgacttggtgtgcaacatcaggttgagttgatgtgcttcaagatgattgtcgcgcatggatagagtcttgagaaggcaattgtatctattaattaggatattttatgtaaattccttagagatatgtttgggcaaaaatctgccgcaaagacttatggtatcttagagtttgttagagataagagtcgtgtccgatacggacatagtttgtaattttcgggtataaatagatcccgaaccctatgtaatcaattaacacacacgttcaatacaatttcggcgcatcgccaccctttcactttagttttatttcgacgagttcttgctttcgggttgagctgcatcggttttgatctttaacaagaggtaaaacttgttatgacggcttgcgttcttgggattagtgcttccatctttatgacactctaatcttgtttatgtaattcgtcgagttatcatatatcttatataatctttggcaatctcgctatctaacctacaatcggctaacatctatcgatagagggcaaccaattaggttagacatcgatgttgacttagattatatgagatatctaccactctatgaaacttccagcggcttgattgtctagatattgttcttcttttcatacttaatgttgcatcagttgagtttgatctattaagtcgtgcttagaatatcaatctctagcctgccttcttgacggagcgtggggctcctcaccgggagaccgcgcaggcccccctttgccggttcggccgggggccctgggtgaggttctaagctcttggtttgtggaaagttcgcgagagtggaaacacacaagacacgggcgatgtatacaggttcgggccgctgagaagcgtaataccctactcctgtgttttggtggatctgtgtatgaagaagctacaaagtgccagccagcccccgatcgttctgggatcgttcttctctccaaaaatcatccatcccttctaagtgggcaaggtcctccttttatacctcaaggggataccacatgcaccatctctttcttttttggggggactcatcctctcttccctccaacttgacttctcttcattaatggacggagatttgtatggctgccgtccgaatgaccttctgatgggaaggcc

SEQ ID NO: 48945 - DNA, 1998 bp, Oryza sativa
cccccccgggcgtgcagggttggccgggggcttatcttttttctcttctgtatttcaataaaagcattcgcgatttcctaaaggctgtatctggcctgttgtttccttttaaaggatcttgacttgaaataggtcactcgtgttcaatcctgctctcgggggctcgggtcggctaaaatcgccaaacggggcccagaaccgagccgtgccccggggcgtgatgaactccgggggggaatcggcaaaaacccacaatcgggtcacccataaccctcggtcaccacgctcccggcctggccagtctcgacatgtggatctccccaggcactagccccgacccgagccatttgaggactaggacctgggcacgagcccttgttcaagccaagacacaaaaggaccgtggcacaggcatcgtcgtctcatacacacaacaaatagaattgacacaaaaaatttcctctttatttgattgcagattaaattagtctatacaagaagggggcccgaaggcctcggaacaagaaggaaaagctattaagattggcggaggcctgggggctcactccgacgcgcccgggtagccggcctcgccgtcgctgtcgtccgcaccgtcgtcaccgcactcctcgtcggagttgaaggcaaacgcgagccgaggggccgctcattattgtcggtcggttttcccttgctgatgcgcgcgatttgcgaccgccgggattctgcccgaagagagagagagcagggaggagaggcccccgagtcgaacggcggcccaaggccccagacggccggagctggccctccgcctgcttgtccgacggtgccaggcgcccccgacccccaggatggccccgaggccactgcgggaaggccgcgcctgtcgtcctccgaccccgaggtcgtcggcacagaagacgagtgcaccccgcgaggccgcttggacaaagagcgccccagggatgtggcccctagcgaagaggatcggccccaccgaaaggtgcagcggcccgtctactttgttagtgaggccctccgggacgccaagacccgataccctcaggcccagaagatgctttacgctattctgatggcttcgaggaaactgcgccattatttccaagcgcatcgggtcacggtggttacgtcttatcccctcggccaaatcttgtataaccgagagggtactggacggatggtgaaatgggcaatcgaactctctgaattcgatttgcgctttgaaccacgccacgcgatcaagagccaggccctcaccgactttgtggcggagtggaccccagctcccgagctcgtctccgcccccgaggccagctcgggcccatcgcagctgcctcacaccgccctttgggtgatgtagttcgacggcacctgtaggaaccggccccacctatcaccaggccttagaagtggcgtcacgcccgaccgcttccctcggggagggcgatcgccctggcataacgccgggggctactgtcggtgacatgggaccgggagtatcatgacttagagacttgaggcagacacgatcacccacgtggcctaaccccctcggggggggtcgggcccgagggtgatacggccgcccttctctttgtctccccgaggggtcggaccgctcccgtctcggccccgagggccgaggcgccctgaccccttgtgggttttgcgccgcgtatatggggtaggtgagcatagcggggctcacctaaccacatttattgcggtttggacgagcgcgtcacgccgcatgtaacgcagtgcagcgcgctcgtttatccggtctgtgaccagtcacagaccgatcagatcgtgggttaggtggcgacaggcggtctgacgcacgcctcgccccatcccgtcaggacgagagcctccaagcactcgtccctagccggagccggcgtgttagctcctggagatggcacattggttccggtcagatatatgccaggctttatcctaaccattacaggc

SEQ ID NO: 48946 - DNA, 3843 bp, Oryza sativa
ggaggaccttgcccacttagaaagaaaaaaaagaaaaagaaagaagaacgatcccagaacgatcggggggtggctggcactttgtagcttcttcatacacagatccaccaaaacacaggagtagggtattacgtttctcagcggcccgaacctgtatacatcgcccgtgtcttgtgtgtttccactctcgcgaaccttccacacatagactaggagcttagaatctcacccagggcccccggccgaaccggcaaaggggggcctgcgcggtctcccggtgaggagccccaagctccgtcaaatatctacagccgatcgaatagatttagttctttattatctatttacaaccaccgatcgatttacatatgacatcggctcaaagataaatgagatgtcatcggcacctagccgatcggctatcgtttataggtttaaccgcggtttctttgtttttatttcttgtggattacaggatcaaatcaactggcacgctagcatacccgaaggcgagttttggacctgtactggagttaaccagatctcccaggcctcgtattttacgtcaacagcggggtgtataggagtatagttctagagccgccgacgtttgacgggacttctaggaaataaaaaaatgaattctaacaatagctatgtttgatttttagaatcacaatgaccataaagagtaggcggcggacgggctatagagaagcatagtggcatcgtttgatgagacttctaaaaattataaaaaataaaacctcacaagacaataaactctaaaaactacaaggtccaatttttaaaggttcggaatttctaaaaagtaaaaaaaaaatgataatcatgttcgattttaaaatctcaatgacaataaagaagggaggcagcgggcgagccctagagaagttcaatggcaaagtcgctgatggtttggcaggacttttagaaagtaaaattgaacccaaacgataattatgttcgatttttaaaatctcaatgacaataaagaaaagagataatggacaggccatagaggagtataatggcaacgtttgacgggacgtctagaaattataaaaacgaaatccaacgtgacaataaactctataaactataagatccaatttttaaaggttctaaggagaatgatagaaatagtggtagatcgagcaagcaaataaagaaggaaatgacataatgggtagcaactggtgtgacttttaaataactatataattaaaaacacggggatgataagttttggtctttcaaagtcttaagacaatgagatagctatttaataaattttaattaaaatcatactaaaaatatatgattttgtttggatgctagccgcgcaattgcgcgggccacccatctagttttatttaagctagtgaatatttgttcaaattctagtatactactaaatacctgagtttttttttctttttctgaattttatgaaatttttatctaaccgaaatgaatgcaaactatctaaagtaaaaaattttaggttgacaatctatctaagggcctgttcactttgatgccaaaaaaaccttaccaaattttggcaaatgccaaaattttggcaactggtaggatttcttatataattaccaaaatttggcagcaaattaaatgtagccacttttttagtaactttaccaaaatttggtaaggttgaaaatggcatcaaattaaacagacctaaagtaaccaggttgacaaattcaatgaatgccatgtaggatgaatttgtcaacctgagttcattacagtacattgagtttattatttccaaattttatctaagctagtgaatattattttctttttcttgttcaaactatctaaagtaaccagtaaccaggttgacaaattcaagttttatccaaccgttttgaatttgtcaaccttgttactttagatatatagcttgccatgtaggatgaaggttcataatatagaagtgatgcaatggtggattttaacaaccagcctgctctgaagcatagcattgattcaagattggaaattggagatcatgccttttcattttaggtaatatcgaaaaggtcatgttgattcaagatttcatttttacggtcctcttttgacctctttaacattcaaaagcaacctatattgaatcttctttggcttcttggctgatacatattgggaaaaatattgggtaatcataatttttctctcaatttaaataattgtaagtgcaataagaaaaatattaactggccaatctatttagggccatattttatatgccaatagtaatatatcttttaatcacgggatgctcattccgacgatttcagcatcaattctagtgcatttgcatttgttcggcattcattgtgttgcggtgtatcatgggctctaccttgtctcatttggaaccggaggcatcaagttctgcacttcagccttccgggctgatcagtttgatcttgctgacctactagagacgaataaaaagtgctcatcactaattcttcaactgctactacttcttgatcaacatcggatcccagctatcagcaattgtgcttctctaggcgtgggacaacattggttggggggtcagattctgatgagtctctgtatcgcagtgttcgtggccggtagaagggtgtacaagtgaaataaacctgatgaagaaagtctagtgaaaagtgattcccgatgatttttgcgtctgtaagaaattgacatctgcaactatctgatgatagctcaaccctccatgagttaccgttaactacagaatcaaatttcaagacccatcatactagtgaattcaggtacttgaattgtcaccaaatacaagctgctgcatgttggtaataagaaagtttccaattttgaaattttgttttcttgttgtgagatgtttgttttgcaaagtataggtcctgccattacttaaaatatagtccgtatatgcatcgccactccaacatgagtagtgttgcacacatccatggagtagctttctacaatagctatggtctactcggcattgctcgaatcaaagcactttgccggccacagccaatgcaatgagcatcatgtggaatgctccatcctgcctcaacctcagcgccgccaagttgttcgactgcattggcatgattgaattgttctatatatgaccagtccccagacaccatgaagagcctaagctttgtgcttgggcagctcggcattgcagctgggaactatctcaactccagcatcctcagcattgttgtggtaatgacacgtcgcatgatggggctcgcctgggtggttcccatccaacctaaggcttcttttggttgagttgggaacccatccctccggtacagaaaacgaagcagtccattagcacatgattaattaattatttgctaattttttttaaaaaatggatcaatataatttttttaagcaactttcgtatataaactttttgcaaaaaacacaccatttagcagtttgaaaagcgtgcgcgcaaaaaatgagatgggggagttgggaactccaggaaacgaacagagcctaaatgaagtgcacctagactactgctgctactgttataagactttttagcattatccatatctatttatttatctatctattatatactaaaagtccattaaacttgctataaacgctcctaaaccgccacgtagcaatctaaaatcgctctcaaactatcacatagcattaatatctatctcttgatttttagttaatatggtgggtccaatattctaaaccgttagatttgattgagatgtaaaacatagagcccaaacg

SEQ ID NO: 48947 - DNA, 1414 bp, Oryza sativa
caaaacagaaaaagaaaaccggagatttcattctgcattgttctaatctcctaacgatttttgtttgtcgctttatcctgagataattttgtttgccgcttcacatagggacgcgaaccaaagctgctgaaagcaatatgttttaggcctgaaaccaacctacacttggatcaaacaacggtgtttattgagtttaatctattttgatctgattttttttcttcgtttaactttagccccaggagagagacaggtaacgagatattaacatgaatagcgaaaataaaggacacgcaaaactaaaaagggattggtaaaatagtatgattcttaatttctcctaaatcgaaacaaacaccccatgtccataatgtggacatactaattaccttacatctatcctatgccatgctattataagtttcttcatatattattaaatatataagccacgctaaggtaactaaggtaataatacatacttggtttaaaagttatatatatttgttagttaaattcaaatttttagactcatgttaactaggtttttctatgataagaatatattatagaagcgagatatatgatatgtgtatcttctttgtctttatttaggccatgtttagttcctaaaacaaaaaatttcacgttgtcacatcgaattaatgtttggacatatgcatggagtattaaatgttggaaaaaaataaaaccaattacacagattgcgtgtaaatcgtgagacaaatcttttaagcctaattacgttatgatttaacaatgtggtgctacagtaaatattttctaatgacggattaattaggcttaataaattcctctagcagttttctgacggaatctataatttgttttgttattagactacgtttaatacttcaaatgtgtgtccgtatatccgatgtgacaaccaaaaccaaaaattttctccagctaaacaaggccttattcatagtaagtatgaaacaaattgtatcaatctgaaccaattagaaggaagaggctatccccatggtacaaacaaaaatattgtcaggattacggataaggtataccctctacccttggatgtatgctatacggcaatacggtatatcggtgcatatacggacgttctctaaacatgctaaggaaatccatcacgaagtctaccaatggaaaggttccgacccatataggactgggtcgttactatatcgtgtagggtgcgatgtctccgagtcctacttggagaccgcctgacctgcgatataaaagggaccccccaagggacctaaggcatggaatttcagagcctacacaacgaccacagcctacaaacgtcggagactacaggagccaagtcgccgggtgatctagtcgaatcaactcgactacgatctcgtcggggctgcag

SEQ ID NO: 48948 - DNA, 1105 bp, Oryza sativa
tggtctacgggtacccaccgtcgacagtggcgcgttaggtagggggccttggtgcttaaggttctactactattacatcaagcttcgtcgacaacggcgtcaacaccggccccatcctaggagtccctacttcaacaatgctggtgtggactcaagtcggcgaaatcgtctttccggtttacaccacggtaccaatctcgacagattcatcaatgaccagaaacgagaacgtcgtggctataaacccggacgatcctgtgtcaaaggatcctcccgccgtggcggagaacggaacatcgatgccatatgagcccgagaaggttcctagttcggccaaatcttgtccttccgacaagaactgcgagccgacaaggacatcttccgaagtgacaaagtcctggtgtcctattcacaaatccaggaagcacaacttgcaagcttgctgggtttttctcaatgtacaagctgaaattcctgcttgcaaatagcgtggaatccagcgtacttctccaactcgtgatatctattgtcctattcacaagacgaagaatcacgacttctcaagctgcaaggtctttctccgcaccatgaaaacgacgcttcctaaggtccaacagtcaggaacctccctcaaggacacagacaaggaacaagaagcgacgttgacctcagatcgattcgttggagtaatcgacatcgatccccatgagccatcggtccttcacctactcgaagactatggctcgtcatcttccagtacaccgcgcgacgtgtttgccatcggtgggactaacacatctgcacaggctaacgcagaggcggagaaccagacggtcacgccgacccaacatctcggcaccgtcaacgcaatactgagagaagctccctacgaccccgtgcttaacaatgatctcgcacgttggacagaacgactacgggaatcggtagccaatctcagtaatgcgttcgaggaagctgctaccagagcacaaccagaacgaccaacagctgaaggtgccgacggcgaaccaccgaagcagcggacgtcgccgagatgagctacccctcaacctcgcggcaccggcgatctccatgaccatctgaa

SEQ ID NO: 48949 - DNA, 1930 bp, Oryza sativa
agacgcaagaacgacaaaccaaaggcgggaggagagaagaagccagccaaggacgcacccgaatcaagaaagaagaaaagcggcaagagtgggaagaggaaagctcaagcagaagtcctcgcatctgaatacaagcgcccgcccaaacacccagacccacaaggtagtgatacgaagagaatatgttgccccatacacaagtcggacagacattctctagaggagtgcctcatcttcaacaagtcgttggaaaagtagctggctttggagaagggcaagcaagtacgtgtagtcgagaaggccactgaggcaaccactcaggattcggacttcacatacccagattccgatcttcatgtctcgcacatcttcagaggctccatagtgtactcttcaaagcgagaatacaaaaaagtggaacgtgaggtttgttcgacatggcagggggctgcacccaagatgaagtggtctgaacagaagatcgagttctcagatgaggaccaccgcaaggctgctattatatcaggacgatatccgatcgtggtcgaacccactattcggaatatcaaggtagcactagtcctcgtcgatggcggcagctccatcaatctcctcttcgccagcaccttggacgcaatgggaattccgcgaagcgagttgacacctaccgatcaacccttccacggaatcactcctcagtcctcgtccaagccattgggcaagatcacgcttcctgtgaccttcggccaagcaagcaacttccgaacaaagcagataacttttcatgttgctgagtttgacacagcatacaacgccatcatcggaagaactgcactcgtgaagttcatggccgcatctcactacgcgtatgaggtactcaagatgcccgggccaaagggaacaatcactattcaagggaacgcaaagctggcggtccaatgcgacaagcagagcctcgacatggtcgagcacatgcccagcccacccgccacaaccgagccacccaagaaagtgatcaaaacgactaagacgccgaaaccagacggcgcaatcaaaatcgttccactctccagtgccaaccccgacaagacagtcaagatcggggcatcactgaacgagaaataggaactcgcgctcatcaccttcctccgcgacaatgcggacgtattcgcttggcagccgtccgacatgccgggggtccccagggaggtgattgagcacaaactcatggtgtgacccgatgccaagccagtaaagcaaaaactgtagagatttgcaccagatcggaaacaggccatacgagaagagctcgataaacttgtcaaagctggtttcatcagagaggtactccatccagagtggctagccaacctagtcatggtgcggaaggccaatgagaagtggaggatgtgtgtcgacttcaccgacctcaacaaggcgtgccccaaggatcacttccctctcccttgaatagaccaactagtggactcaacagctggttgcgagctgttcagcttccttgacgcttactccggctaccaccaaatcagcatggcaaaagaggacgaggagaagacagcattcatcacaccgtttggtgtattctgctatgttaaaatgccgtttggactcataaccgcaggaaatacttttcagcgtacggtccaaggggcacttagcgatcagctgggtaacaatgttgagacctacgtcgatgacatcattgtcaagaccaagacaagtgactcattgattgacgatctatgggaaaccttcgacaacctcagacgatatcgcctcatgctcaaccttgagaagtgcacgttcggggtaccgtcgggcaaactgcttgggttcctcgtctctggcagaggaatagaagcaaatcccgagaagatcaaggcaatcgagaatatgaagtcacccacaa

SEQ ID NO: 48950 - DNA, 4551 bp, Oryza sativa
tccactttgtaccaccaacagccatcaagtcccaagttctcgccgattttgtagccgattggactatgcctgaaaacgggttagacagcaagacagacaacgaaacatggacaatggctttcgatggcgcgctcaacagccaaggagcaggtgcggggttcatcttgacatcaccttcgggagatcagttcaagcatgcaattcaccttaacttcagggcgaccaacaacacagccgagtatgaaggactactcgctgggataagagctgcagctgcacttggagtatgaaggggattctgaactagtcataaaccaggtgcacaaagattacaaatgctctagccctgagttgtcgaagtacctcacagaagtcaggaagctggaaaaagatttgataggatcgaggtccgacacgtatacgtaaggacaacatcgagccggacgatctagcacggcgtgcgtccagacgagagccactcgaacccggcacctttctggacatcctgacaaaaccatcagtgaaagaggcaaatgacgaagatagctcagtcacccccgacatcagctcgggggctacagaggtagagcgcgccgttgccgacatcaagaccacggacgactggcggaccctactcattaaattcataagcagcgacgagttgctcgaggatgacgcagaagccgagaaaataacccgtcaagcaaaaatctaccgtatgatcggcaacgatctatacaagaaagcgccaaacggggtacttctaaaatgcgtctcgtccgacgatggcaaacaccttctccacgacatacacgaagcggctgcgggtcacatgccgccggtcgtacattggtcggaaaagcctttcgacaaggatttttctggccaaccgccctcaaagacgcttgcgacatggtacaatggtgtgaggcttgtcaatttcatagcaaacatacaaagctactagcgcaagcactacaaaccatccctctcacttggccgttcttgtgctgggggctcgacatactcggtccattcccacgacgacagggcggctacaaattcttgttcgtggtgatcgacaaattcaccaaatggatcgaggcaacacccacgggggaaatcaaggccgataacgccatcaaattcattagggggatattttgccgatatggattgcctcaccgcatcataacggataacggctcccaattcatcagcgctgatttccaagattactgcatcggactgggagtcaagatatgctttgccttggtttctcaccctcagagtaacggacaggtcgagagggcaaacagtatagtactacaagggatcaagacccgtgtctatgacaggctcatgtcacatgacaagaagtgggtcgaggaactcccctcggtacaatgggccgtgcgcactacaccgacaacgtccaacaaggagacacctttcttcctcgtgtacggctcagaggccatgctacctaccgagttacgacatcagagtacacgagtacagaagtactccgacgaggatcaggacgaacagcgaaacgacgacgtgaacctactagaggaacatcgagaacgggttgccgtcagagcagctagctaccaacaggcccttcgccgataccacgagaagcgcatccgagcatgcatactttcgatcggtgactacgtcctctgacgagttcaaagccaagcagggcgaaacaaactctcgcccaaatgggaaggaccatacacgatcacacaggtcttgcggccaggcgcgttcaagattgcagacggtgatggtcgcgagttagcaaattcttggatcattgaccaattgcgtaaattctatgtataagtcaatagtgtccacacttgtaagacatcaaagtgttccttcctgatgatcccttacccagacgacacctagcgttgaaacctatcctcatgtccctttacgccgtcttgacaaggcctccgaggaacctaagggaacttcggctggggacgcccagagctgataaggccttgtcgaatccttcagagacgaaagaccgtgtaagatctggtcatgtaagagttctcgccgtgcgtattaaccaagccgtgtaatcggaaatggatttttccaacttcacggctgggggctagggtcagtgcttattcaactaaggcaagtcgaaggtccaagagctttatcttccgagatgagttctccgatgacaaggctgggggctagggagagtgtataactcaagtgactgatcgaagtcgcgaagtgagaagacactcgtacacaccgcatccagagtaagaaagcttagttacatagatttcctttctacttcacaagtatttcctacagaccgaaaagatatccaaaatacattacatttttcttaagatgtttgtcacagatatacaagcactaccaggaaggccaacgccaatccattgactgaaagattttctccgccaacggagccatcgacttcgccaggttgtctatctccgcgggattcctccgagaacgggaaaacccttcgtggaggaactctaggtgcaactgcggacgatgatctcgtatacatgccaacacgtgccctccagcgtatcggctcaatcgacgacacttctgctttagggcctcatcgatacgcctgccgatgccttcaagctgagcaccagccccgtttagccacgagatgtagccagccgctgactcctcgggatccccacgaggtactcggagctccctgcagacaacggccatggttgtgcaacagctcctgaggtacgagttgaaccatacctcgcgacctcggagcgcctccatggcccggtccttcttcacttccaatatagtcctctcaagttcggcgacctcgaactttgtcctccagtactgaatgcgacggtcgcgatcagcaatcgcattttcgaggtctgctcgacatgcaaacactgaagtcaagctaatcaagacagaagagtcaaaggaaatggaaacgacaagaaccaacctaaaggagtcgtcgccacgtccgtctcctcgggcagatcctggtctacgccgtcctgcggcacatacggctcaagctcaagtgctggaacgactaccggcaattcaggctgcccgcgctgctggatatcctcgacatcgacatctctacaaacaacaaactaattacccggaatcaaaacgccaaagaaaactaaggtgatgattgcacacacaaaggcagtcggaaccaacgaaaagttttaaaaaacgcgattggttaaggggtacagacaagcggtggccctactcttcaaaaagtgggaggacagactcccctagttcgccgacttcttccatcacatctttgcgcgcgtcgctagccgccccctgatccaagatcttctggagattgagttcagggtgtgccaacctcacacacgcaaggacgtggcacgccccggtgtagatcccgttggacgtctcctctctgatcctggccgcgtgcttagaggggatcgcctccatcgccgttgccagttccgtgagcgaagtcgtcagcgagaactcatcgggattctccgggatggtggtcgtgacaccgcactccccggagagctggtgcagactagtgtaggtgacccacagcgagccacggatctccgacaagtcattctcgagctccgacatacggtgctcgagcccctgcagttgtcgctcgttgccggccaccagttctctcatcttctagaggacctcgcgaacctccgccaaatcacgcgtcagccgatcggcacgctcatttgccgacgatgccgccgccgccctcgcctccgcaatctcgtgactaatgccgtgagtgccagcctcgatgatgtgccccatctcgacctggagttcctcccaggtgaggacggcagccggcgggcctcgaccagctgtgggattgctggccgggccgctgggcgtcacctcgcggctccaaggcacgaccacgacctcggacgaggccactgcaggagacgcactggagtttgctgtagacccatcttgcgctgccttcgctcgtgccgccctacgaaagacggccatgtcggtcatcgtaacaagacgacaaaatccaaccaagtcgagaacctcaaatttcgtccacttacttctcgccgagtgtcagtagcctctgccatcgtggaggtgggggagacgcatccgagacctaagtaaaccgagtacgacatgagggcgacattctccaactacgtaaatcaataacctagaaagcttaccgatggagtgggcgtcttccggcggttgccgagcacggaggaaaacttcctccccttcttcggaaccttgctgccgctggtcgtggcagcagcaatgacaatggccgtgtcggacgcctcccgggcaacgccctccttcaacgaggccgccgtctggtggtccacgagcggcccgatggcgtcagtcaggaggagagcctgcacaacatgaagtcatgatgcgatctaagaattgaaaggtaaaggaccatcgactacactcacg

SEQ ID NO: 48951 - DNA, 4438 bp, Oryza sativa
ggggttcagatgaagcagagaaagaccgtagaagttcaagacaagaaggaaaaactcggaaggcggaggaagaaaaccacagagaatgtagtcctcaaccgcaaccatgcggcccaggatgggttcaggttcagtacctcccggttccctctccatggtcccgtgaccggggagagcgccctcctcctgcaatttctccaaggacgcattgctggaggtggacttgtcgaggtccattccctgagaagaagctgaggcgggcgaacatagggtttgtgtggaagcggagaaggcgaagagcgtttggaggcaagatagttctcacaacagccggacaccaaattggattcccaaaactcccataaataggcgtactaccgacggtgtgaattccaaggaaaggagagaaatggccgccggaaatttctaggtccgttgcacgacgcggtttcttggacttcaatttaaattcactcataaccgttcgacttcgcatggtgttgtcgatcactctttgtctctacggtcctcacaccgagatcgaccaatcgagaacgacaacaactccgacattagaagtcacgattggttacacgagttcatttaagttgatgtcgggggctcctgtcagggttatggataaggtataccctctacccttggatgtatgctatacggcaatacggtatatcgttgcatatacggacgttctctgaacatgctaaggaaatccatcacgaagtttaccaatggaaaggttcctacccgtatagggctgggtcgttactatatgtgcagggtccgatgtctccgagtcctacttggagaccgcctgacctgcgatataaaaggaaccctctggagggacctaaggcatcgaatctaagagcctacaaaatgaccacagcctcgaagtcggagactatagaagccaagtcgccaggtgatctagtcgaatcaactcgactacgattctcgtcggtaccgccgagtcctactattccctttgtaatcgggggttctttccatataatcccatatcaactggattagggctattacctgctaaggggcgtgaaccagtataatctttgtctcttgtttccttcaggccgtactacgtagatcctcgtaccagcgtacccaataccctctatatccggtctacgggtacccaccgtcgacaaatacatttattagcaatcatagttttcataatttattaaaaaatagggactctaaacattcaattaaatctggaaaacaccatatgtttaatttatacttaatttataagacatcttttatacaaactaagtcaaactcctctcaagataatgaaaaaaaatataaatcttatagtaataaattaaatatatatagtttaaagctaataaatagtttggaaaatttcaaataatgccgatgatgaaaatttgaagagaaataatacatttgaagcgtagaggccagatcattcggttgatatttcatcttataaatttctcaaacacatcctacaatatatacatgcccgcgcgaatgcgcgtgctactttcctagtccatatagatgtcaatgaatctaggcacatatatatatgtctagattcattaacatatatatgaatatgggtaatgctagaaagtcttataatatgaaatggaggaagtacttctggatgatggctgctcttagttccctaaattttctgctattattgcacagctccatgaggtaagaggcagctcatcaacatcttgacacttttttctagtataaatactcaaatgtgaagtttggtggggacaggctagtgagccttttgaccaacctgccaaagcataaaaaactggcgaagcaacatgaagcgaagcaaaccgtggcgaagttcagcaaagcagagtggcattaagcaagccgacaacgaggtagctattgcttaaagccaaagcactctaggtggccaaggggaacgactctagtgtgcctgattggaacaaggctaccgttggtattttttaacgacattactagaaatttaattcccagcaatggcgctgaaatactcttagtatattgtggttacagagttcatccgcaagcgcacagatatacaattgtagcatttcacccgagagtattccaagggaatcgtatttatttaatcccgtggaaagattatagtagagagaaccgtactaatagtttatatgttacttgtaataatcatagtctaagcaggggttagtataatccaaagggtaggatgacacacaagcataatccaaagggtaggatgacacacaagctaaatggaaagaaaatagaaaagaatctattcctatacttctagtatacatattatacatacattctagttatatgattaactagctaataccctctatctgatgccctcctggtacttcgagaagccacccctgactaccgagttccttatgatagcccgtcatgaccatacaaccggggcaaaatacggaggagtaccctccccatgaaattaacccgtactgaactgtcaccatcagtggcccacctctcatctgcagcatataaccccaaataatgatatctcgaaatctagacaccacgcctaaactaccagatactactctaatatcatcatcatgacatggagtaattgcataaacaaactttatacccgtaactatgcatctcccagataagctagcagtataatcagtataacatgaacataaagtaagttggcattccctctgagactgcgccaacgactgcaacacctgtaagctttctttatcttctttaagcaaattagttaatatcattattaattagcagttagcccatacatatcagattaattatcatgctccaagtctgtatacaacgattaattatatatcatctttatgaaatgaattaattcacggatgcatatatatgctgcaggttgtatggcgtgatggtggccgtgcatccctgtcggccagatcgcagaaatcgtcgacagaggctcatcatgtaatttattaacctcatcgactcaaattctcttatcattaatatgattttactgtgcagatcgatgctgtttgaaattcccccaattttcataatttctcaaatagatcctgtacgttttgcacagcgtgcgcgttgaacgcggtgctgtactgcctggtgttccacgtgtcggcggggatgtgccagtgggtgtactcgtgcgcctaccgcgctcgcctccgggcggcgtacgacctgccggagacgccctgctccgactgcctcgtcaccttctgctgccagacttgctccatcgcacagatgcaccgtgagctcaagaaccgcggccacgaccctaaccttggtacgagtatattatattctctctctatcacctctcaaactcaactttacattgtatttcctacttccagtagctcaatcgtacatccatcttattacataagtttaatgatataatcatacatccatttcatataagtcaaaaaaaagtttcttcaacatatagtttttagcttaaaagtgtaagggtgacttatgactttaaaaaaatcaaacagaaaaaaatatctggtttaggtttagatttttgtgatcacagactgatttataagtctaaacaagagggtctaataagatatatattccgatcttccaatcttaaaaaaattagtaacttgtaactcattaattcactcaatgtgtttaattaatttgtactaattaatgtggggtgatgaaggatgggaggtgaactcgcggaggacgatgatgactcctccccaacaccaagcgatggaaggaatgacaactccctcataacaactactcatcatcacctctcgatcgaccaaacaatacatacacacgatatatagctattacaagcatgtacaccctttgatttataaagtggcaatacatatatagatgtgtgacgcttattttattttataaacatatttttttttctgttttccaggttaagttgtctctgctattttaaagacacagccgccctcctccctccttaccgcgcgcaccccgtattactctagagtctagatcctatcctgctgctacaattaatgcttgtacataatactagaaattcaaaaaactatgtattaatggcttgttggaaaacgtaaataaaaacataaggagttccacatcccacaagcattgggctgcactatacctggccaactgggccgtgccaagccgggccggcccgagcacagcagtactgtagccggcccaggcccggcacggcacgccagcctgtgggccgtgccggcacggcccattatcccgtgccgtgtttgggccaatgcctcagcccgtgggctggcacggcacggcacgtttactgtagcgtgccggcacggcacggcccaggcat

SEQ ID NO: 48952 - DNA, 3681 bp, Oryza sativa
agtttttttactttttcatttattaatctttaacagtgtcaaataagcttcactagtttttaagcaattaaaaccggtgaaaagggtttgaatgacaaataaaaaatttacatttaagtcccttaacgccttctggaaagggaatttttagaaaacgatctcccagagggcgtgaggcatctagatttgtaaatttcgaaacgaaaatctgttttgtaaatattttaataaaaaaatgtaaaaataggaaaaagaagttaaaagatcaagcctgtaggatcgtaaagggcatttcccacccaaaaagccattgaggtgaggggctccccgacttatatcttaggtcctttacccttctacaaccaatacctttgattttacaaagcctaccagaataccataataaacgttccctccgttacatacatatgagaagttattttaggtttgttctatgtcaaggtttcctaactttaagcgagtttattgaaaaaaaaatacaacactatggatttcagtgaaattaatttgattttgtaattcaattcactggcacataaaacattttgtgatggcgatccataacttatttatataggcattgtttgaaccgcttaatatttgcatagacggatcctagaaccgcttaatatttcacatgcaactcccttaaggaaccaatttgtagttttttatttttgtaggcataaaataatctgaaaaaatatgtacaagtgcgtatataggatttgatccagaactctttcttcttgcttagcctcttaccatctcacctatgaagcacttcgtgaatgtggattggatgctatcttttaacttcacctctccaaaacttggcacattattatactctaaatgatattaaatacaaaggttcttaactacaaacctgtaaatcccgtcgacttctacaactatcatatcgatcatattttcaattgaggtaatttgaaaaactcaaaaaaaaaatcaaaatagatctgagagcatgtaagaaatattaacatctcaaatgaaaaacgttcaactaaaatgttgaagatctcttcaagagatacaaatttggttacaaagtttatcatcattcaacttcatataagttatgatttttttcactttagtagtgcctccattttcagtggcagttttttttaagagatccgcatatgaaattatttcataggtagctctctaagaagtctgccaataaaatcattaaagagtgttttttcaagaagtccgcttataaaactgtttttcttgtcatttatagaaagtccattttaacttcgatagaggtgaaccattttaacttagatggaggtgaaacatatatgcagtaatagatatacataacacagaactgagttaaacactacatatacaatagtgattagacaatcttgtgttacacagaagttgcttctctgctttcaaatacagagaacataaatgagagatagatgcttgaaatcaatctatttcaaatgaaagtacattgatttataaaacaggttacacatatataacacaagataaatatattgcttattaaacctaatctcttccagtcgtcgatctataggttagagagttctttgtggctagattggataaaagctctgcactgctacttgagctgttgtcatcaaagctcttagggagttcatctatactattctcctcaaagaactgttgacgacttatgttgtagttttcttgtttaagcttcctagatcttcgcagcatcataagtcgtgccactacctccttcatatcaggacgctcgtcaatcttttcgtttaaacattccatcgctaacctaccaatttcttctaggattaagacatcttcctcgatggcaatatccttgtcgaacaataacctcccactatttgcttgatcatatgcctcttggaactcaataatgaggctgcggttcttgccatatattgtttgccttctgctgatgagctccagcaatacaactccaaaactaaacacatcacttttttgtgttaagtgaccagtcatatagaacactgggtctatgtaccccatgcttcctgccacaaccatggtgaattctttgtctacagtaagaagcttggatgtcccaaagtcggagatctttgcaacaaacttgtcagttagaagtatgttggcgggcttaacatcaccatgccgtatggtatgacttatggacgagtgcatgtatcttagaccttctgcagattcaattgcaatgtctaggcgtagatctagtgtgagagggactaggtgactggcatcactatggagaatgtcttttaggctaccattagcggcaaactcatataccaacattggaacatccatctccaaacaacagcccaatagcttgataatgttattgtgcatcattcgcgattgtatgataacttcgtttgtgaaatcctccttttgagcttcagttacctcaattgaagtcgtcactgctaccagggtattgtctttaagtctacctttgtagaccttaccaaagcctccttgaccaataacttctgaattgttttttaggattttcttcatctcatctttggagaaaatcacaatattgtccacattctgtagtattgaaccaccattctttttgaaatattcgttcatttttctcctttgaagcatcattagtgtgaaaagaacaacaacaaccaggaaggaaaatcccaaactgacacctagaaggatcacaaattcatgtgagctaatataataaattcatgattttgtattactccctccatcccaaactataaggtacactaacacaaagactaataaataatttaattactcccttggttggaccacctcaatgcatgcaagtaatgtgattattggggggggggggaggggagatgggtgttgagggtagaggatttaaaacaaagtgaatttagaggagaaagaggttctagttaatatatgcatgtatacacgccttatattacgagatatgaagaaattgggttgtgccttatggtttgagatggagggagttgattttgtgacaatagaaagagaggcgaattctcactttcatgaacataactatcaactattgttgtattaatattatatatgtacattggacatgttatattagaattattttaatctataacaacataatagcatctgcatgcactttcctaccctaattttggctccttaaaactagaaatccaaacttcttttttgagaagctggaaatccaaacttgaaacaaagtagttgagtgtacgctgtgtaccttcttctattttacactaggtactaggtgtttagtgattgcactcaacgtaaagtcaaagtatgcatgaaaataaatcagtgtaaaattaattcaatttactcaaaatagtatacacggaggtacataaatagtcgcataccaagggcaagctgtgctgcaactggaaactttggattgcactcctgtttctttggaccaccaccacttggctggtaaccagtatgacagctgcattcgtaatctcctacaatgttcttgcaaaccccatagcaggggtacttgtccttgttggatggatcgcactcgttgatatctgcatacatgggtgcatataaactattcattggccggttcattcgaag

SEQ ID NO: 48953 - DNA, 1651 bp, Oryza sativa
caaaggccagatatgtgctttgtagacatcgaggttggcgccacctaagagatttcttttctcatcactgagccaacctagcaaagactcaccttcgctggctcttctccattccaccttgagaactggcaatccccttgaccaagctcaccatgtccctccgcactagcattgccatctattaattatcgattcttcttggcctctgcgccaacgccctcaactccatcgcctcatggagcaacccccgagctcgaggcggtggggttcggcatccctcgaccttggggagacccgttttggattccccaatcccaggggcacctaatctgattgctttaaaggtcatggtgggtgcgactggtctgccctttccttatggtgcaatggcatgaggtcccggttctaatgcacagtggcgacaatcaaccttcgtgccaatggcaatgggcttctgaggggatgtcaatggtgatggatctggttagtcaatccttttcatcgaaggccccggttataacgcacgatggcaataatagcaacattcgtgtcgatggtgatggaactccgaggggcatgacaacggtgagggacctggttagtcaaccatcttcatcgaggttccggttccaatgcatgtcattgacaatagaaggtgggctttctgagggccatgacaatggtgacagatctgattagtcaaccatcttccctcttctcaagcttccttggtgttgccctgctctccttcgatgcataatctctatttggctcctctatgtggatagcgacagcctgccttgacatattgtctccctggagcagctaatagctacgagtagtcaggcatattgacagcactggcgagctgacctacgggcacaattttagttgtattttcagcacatttttggtggaatttttctttatcttagcacattttttggttgcattttcctttatcttggctgcgcgatcagttatgggtcaccatttaataataataataataattttggtgggtaacccattatagatggggtcaccatggtgaaccattcaagtgtttatcgcgtgcacatgcgagacgagcgaaagcacgtgtttcactagctatcttcaccacatattactaaagtggctaggagagcgcacactcaccctcttttaagaagttatccatcttctagaattagcaagacgatggtactaaatatttacatatatactacatccattttttttttttgaaatgggtcttaatgatttccctaccaattattgtctatatgggccttagcccacatgccaatttccatatgtagatgatccacgtcatctctgaccgttaatatattatgttaggtgggtcggtgcactgacataagtaggggttatgtggtagtggggtttcattggcttaatatcgaggtaaatggtaattatatatttccctcggtttcataaggtaagcctttctaccatggccaccattaatatagaggttaataaatttaaacatatatgggcaaatagattcattaacatctatatgaatgtggacaatgctagaaagtcttacaatatgaaacagagggagtaactttttctctccaatcttaataagatttagttgggctctggcccaacc

SEQ ID NO: 48954 - DNA, 2683 bp, Oryza sativa
atcctccggttcaactccattttgagatccgacctccggaatcggtactcctccttgtcgacgaggaaggcatagtcgcaggggctgaagtccacctgttcgccgcgcggccattgctcgaagtagacgacgttgtcggtgagctccggcgggatgtcgacgtggcagcagccgacgccggcgcacttgccgtccatggcgctccgcgagtcgctgcagtaggtgacacagccggcgtagtagaggttgcggtagaggcctttgccaccgctgtccccgtgctggttccacgccacggtgttgcagccgatgacgacgaacatgttgcgctcgtcggagatgcggtacacgccctcgttgttgagctccacgtcgccgtcgaactgcctggtgacgttgccgccggagttgtagcacgtgtacgccaccggcagcatcaccttcacctccggccgcgggaacaccgtcagcttctggacctggatggcatggcggcgggcggcggcgagggtgggcactaggacaccggtgctgttggtggtgttgcaggcgatgtcgaagccgtccccgcgggagcagttggggccgatgccgaatggataagggatatcgacgtcgccgcacctatccgggcagccggtgattccgtcggcggcgaaagcgaaacggagaagaagcagcaggccgccggcggcaattagccagaacgccattcaacttctgtgcaacagctacctcttcccgcgcatatttatatttcaattggatcgacgacgatatgatccagtcaaggaatatatatatatatatggagagcagaaatcaacgatctgtcacttgctactaaaataactccatttctagaatttagttcgtctaccctttgtactaagataaatttattatttccatactctttaccaatccacccaataatactgctttggtactgatgaatgactctttaatcttttttccactatatttgttttgagcgtccaacactaagataaatttatttttggcacggaggaaatatgaatttaattttgcttacatagtgataagagtaagcggccaatatatataatcaaggaaaattaatgcagatataatatattggtactttttcctatgtccattataattggttttcgtctcttatagtttgtatagtttgtgttagaggacgtactcgtagatatatgagtatggtgttgcgtgtaataaaaaaagagagagagagactgaaaataccttgtatagtgtgtggagcacctagcatatatattgcacctggttaaatctttgaacttatgcgttttacataacactccccgctttttagatcataagtcgttttgactttggtcaaaatcaaactgctccaagtttatataaaaaaatagttatattttcaacccaagataaatataatacgaaaatatattcaattattgatttaataaaactagtgtggtgttgtaaatatatataactagatttgtctataaagttagtcaaatatgaagtagtttgactttataccaaagtcaaaatggcttataatatgaaacagagggagtagttgtaaacccactctttgcttcaactgagttaaacttcagccacttagttcttggatcaaagtccaagtaaagtataacaaaataaaagaaagggagacaaaaagatgacaaaaaccaacacaccaacaccaatcacaagaaatgaacatctaattcaaagttcaagtctattgctaaatcgttatacaaagttggtgaaaatctgcatgacaattaactctaaatttctacattcggtgtgcatggcttccttgtcctcttcacatctttgtagcttgatccagaatcgaagccaatatattgatctgaataatacctacatataccattttgttggagttatgttaaaagccatgtcatttctattaagccattaagcctaacataatgcaaatgcaccaattaaaatatatttcttggtttttgacttcatgccaacaggccggttcccaaaatgtgagagacattacagggacttcgcaaaccaaaggaaatgaagactgctctgcatagaaatttagcaaaatgacatttaaagaatagatgttagatagtttcattatacataaaaaacaacagtttgtactaccattccgatttctttttgctaaattatctttagtcaacacaactcctttgattaaatagcaaataaaaatcttcacttttataggcatctttaattttcataacaccttattcctatccactttcccattacacctgtcactacttggcaatacaataatacaattagtattactaattttgcttacgtagtgataattaagaggcagtactggccagtacgatatatcgagcaaaatgtggatatgattagattggtacccgtttcttgtgtacatgcatattgtccattaattaatatatcaaagagagaaattggagtaccttttatagtttaaatttgtgtggacaaacctagctagcactagcagattgcaccatcctcaaatcgtcaaactcaaacgttgaacttcttgtatccttagccagcacaacattcacacgtactgatccattttcttatagtgtgccctgcctgcttagcaacattatactccctccgtttc

SEQ ID NO: 48955 - DNA, 2429 bp, Oryza sativa
acgaaacggagggagtattaacatagcatgtatcatccatcgatcatacactacttaaaaaaaggtttttcctgccggccaaaacatgttttcgctgacggctggctgtgccgccagtgtcgccagtgaaaataagtcatttgtgctggcggacagccgaccgccagaaaaaatcagttatcgctggcggcaaagttaagtcggccgccagcgaaaatcggccaagctaagatagccaccagcaaaagtcagtttttgctggcggcagagttaagagacctgacagcgaatatatttttggagcaaattttttttttttgaaaatttggatccataacaacctgcagaaaatcacaaattcgaaattattgtccccaaatcctaaatcattgtcccaaatccccaatcacagttcacatttagctgcagaagtaaatcacagtcacaatcccaaaacaacaacaggttgccatcggtgagggagccaagttgccgtcgtcgagctcccgctcaaggcagcccagggccgccgtcgtggtcgccgcgcggtcgctgttgtcgctgcccgccgaagcccgcccgcgagaccaccgccgccgccatcgtcgccacccgccgaagcccacgcccgagccgaagcgcgtgcacgcgaccaccaccgcctgccgaagcccgcaccctcaccacgttgaatccgtcgtccgcgccactcccgccgcccgagcacttcccgctgctgtctggcggacagatccgacgcccgcgcctctcccgcgaccggatttgccgcctgcggccctctggcggccggatttgccgccggcgcctctctcgcgccggtcgatgcggcagctcgacgaggaggaaggaggaaggagactcgccagatctggagggcaaggggaggccgcaccatccacggtcagctccgcgccccgtgcaccatgtgcgtatcgctggcgtcgccgtcgcaggctgccggctgccgagaggagggggagaggcgtgggtgtgggaatggggaagaggcgcgggcgtggaggaggaggaggcacggtgcagtgctgagacttgagagagagagagagagaaaatatcgatggggacgcgtttatattatcatgtggctaactttcctggcggtcctctttagcagcagcaagcgaaaataactttatttttacaatcggacctcttaactaaacgctagtgaagattctccatttttgttggcggtggtttaagtggttcgccagtgaaaataaagatatctcgctggcggcccgtctaacgctgccgtcagtgaagatccattttcactggcgataagtgcccctcacccccctcattatgtacttgttggcggttttcgtattttttccgccagcgaaaatcatagggcaacgccatgaaaaatcttttttctagtagtgatacaacagatcaacttcaaaaattaatttattcaaaatgaagaatatataataaacaaattcggtgatgcatcgtgaattcgtgatagtactatttatttcaaatttgtgtttttggttatatgatgtgtagattgaaattaatgttattacgtgtttgtggagacattgtaatgtatgctatttttttttaaaaaaaaaatcgtcaccaccattggatgacgtatggcatatttggcaatgtaaatatatgcgcaacagctgcaattccacacaactgttgctgacggcagtggtatacgtactacgtacgtcctttatgattggcacaaattgcatgaaaactattggtaaatatgccaaaatttcaatgtacggttgtgccgtcccaatcatatcgaaaatatcagaacagaatgcacgacccggccgaacttgtggtgcatagtttgtgacgtcaaccttcgagtgtaatgaaataatctccgacatcaatgttgtacagtggttgaaacatatattgtcggtcagtcatcaaaactaaagcacacgagatgaatctgatatcttggatgtgtatcatatgttgcaacgttgacctaagagcatgtctaataggccaacctagctggactggcgatagcgttgggaatggtagagagagaccacgagtcgacgatagaattatcaccggctgtagcacgcggtgcaatgaagaaagagaaataagcctgatggagattggttcgtgcttggaacaatagtaaataatgtagtaattagtaggacccatatcaattaaaatatatattagctgttaccacaaatgatagtaataaagaccattgttatatgagcagcctatagtaacgggctatagacgatgtggttgttttatagctagcaaattgacgatattattaaacctgctctaactaaggttaattttgttccgttaatccctaaaggaaggtctagaaaaggattaaaggtaat

SEQ ID NO: 48956 - DNA, 1393 bp, Oryza sativa
ttcctgcagcccttgtttcatatgttgtagtaaaatattacatgaggtgatttgattgtgtttcagtcttttaaaagagtgaaacattttcgatctacttggtaaaacaacgctcgattggcttcgaaatttgcatgatggaagcctaaaaaatcatgcgaatcccatataaactttttctcgatgtactcggatttgtttcatgttttaatatatttagaaccatagtttcatatgttatgttgtagcaaaaagtttcatggggtgatttgattgtgttccagctttttaaaaagattgaaacattttcaatctacttggtgaaacattttcgctctacttgatgaaacactgcatgatggaagcctaaaaaatcatgtgaatcccatatagacagctatttataacgcacattacaattacaagaactaaatggggtttatgcagatttttgctaaccatagatgaaggtttaggaataggtcatcatttgtgcctgtaggctggtgtaggctggtgtttcagttagttctcttgttttccatcaaattgcgttgtgcaattcacaatcgttttaatgcaaacttcgtaataatttggttgtaacttattcagagcaaagactggaatggttcttccattatctaaaatgtagaattcataaatcaacaattaggatcacttttactagtgataataagcaaaggtacatgaaattggttttttagaatattacagaaattagaaaatggcaaagtatttattgttgtcctgctgttaattaaaaaaccgacgtttaaacatctaaaaaaacctccgatgaggtttacacatatcacaaatagcacatttataattgattcaaccctacactacataggcacttccaaggcaattttattactaggactaattaattaattagctgaaaacacacatacacaaaaagaaataaaaagtcaagtggtaggcagcttgcgtttgtaggtggcagcgcagcagacgaaggcgatgaggttgatgagctgcaacgccgccatcaaccagaagaatcgatcgagatgtccctcgttcagattctccgggatccatccgccatggccgccgccgccgccggtgacggagctgatgatggtgagcatggcggagaggaggtagctcccgggggtgaccatgatgagcgagcacgcctggcacaagctcctcatggcgtcggggctctgctcgtacgcgaactcgatgtacccaacgacgccgaacaccttcgccaccccgacgagcacgtactgcggcgcctgccacaggatgctcaccgccggagcatccgcctccacgctgcggaggcgcgccgtctcaacggccgcggcggcggcgagcgcgagaccggcgaaga

SEQ ID NO: 48957 - DNA, 6713 bp, Oryza sativa
gatcagaattggcagaatttagtttacctgagtccatcagtgtgcatcagcttcctgctgccaacaatggcagactccttccctggcatctcatagagcagagagctgtcacttggcacgtccacgtggaccttgcgaaacgccgccacgacaacctggcagatcctagtaagcgcgctaccgccgggtttctggtacctgtaaaacctcatactcgcaaggaatccgacaacgccgatgaccgagaacagtgtagggatcccaaaacccagtccccaaccacagttatcctgaacccacactataaccgtgctcgcgacgaagaacccgccattgacagcgaagtagtaccagttgtagaagagctccttctgcgccttctctgaaacgtcggtgtcgtcgaactgatcggctccgaatgtcggcacacatggccatatgccacccaagcccagagctgtcatgtagaggccaagagaggacaatgcctcctgaggaaaggttgccattgatctgtgcatgtttggtggaaccactgctgaaagtgtgagtagaaccattccctgaaaatgtacagtacataacacaaatgttcagacaacttaactgatattcagacaactttgctcgtattcagaaaaatatgaaaatgttgtgatctcttacaaaggtaaaggtggtcagggagacgacgattgtgcggtgccttcccccataggagtttgcgaggaacgcgccgaggattgtggtgaggtagcagttaccctgccaagcagcgatgttgctagcagcagtgacattgctctgtccctgtaccttggtcaggtagctcaccaggttggtccctactgcgtagtacgccaatgcgccgcaaaattcgccacctacatacaccgtgccaagaacatgttcttcactagttcaaaatgaacactgaaatgtgattgatgaacactgagatgttgggcagtgtgtgttattcaacctagaatagagtagcatgccttccatttcccagtgtgtgttttagatgctggattgcctttgacatcaactgatccattgcctgtgtatggaccttcctcctgcaaccaagcacaagcatttgattactcctacatttgattgttaggacacctcatcagatgagcaaaagagatcatagaatgaaaagaagttgcaatggtgaatttctccaggcaaatcaaggaaatcaaagaaaatgttagcaaccggctggcagccaaactccccgtccatccactgccgctgctcctcatttgccatgctctgctcgatcgccggcgacgaagcggacagtaagttttaaggagctcccacgatagcattaacaagaagcacttgccatgtcatttggcacggaaattcgtatcgttagaatataaaaagcaaactgcttgtgcgacacgatcgacagttgcagcctttgcagcagagattaaggttgattaagtacacttaataggtcgcgtgaaggttattgaagtgtaatgagtcatcgtactcaactttcagcacgccgactttcagggatcctagcaacttttgtgtcgaagtagttggacggcccgcgcaattgcgcggctagcatcaatgtaaaattatatatttttacacatgattttatttaaaattattatccccgtgactctaataattttatagtttttaaaagctatggcagtcgctaccccttacttctttggcacatttttatttgcttacccgatttaccactacttctattaatcctttttagaactttaaaaattaggccatatagtttttagagttcagtgtcttgttgggtttcgttttcataatttttagaagtatcgtcaaacatcgccaatttactattctatggcccgtctgctgacacctctctttattgtcattgggattttaaaaatcgaacacaaatattgtttgtgttcttttttactttctataagtttcaccaaatcgttagtagcttcgccactatacttctctatatcctacccgctactttccctccttattgtcattgagattttaaaaatcgagcatgattatcaattggttttatttttactcttcataagtaccgccaaccgtcgtgaccatgttgcttaacggcacacccatcgtcatttctcttaatcattattggggttctatttggggttttgtttataggttttagatatcccatcaaccgccagcactctactcctttacaagcctattgcttctcccctctttattgtcatttgttatcgttctgttctagatggactgttttttttaaacaaaattgcatatttttcattccgataatttttatttataaattatattcctacttaaactcttataattatttttctatttttgaaatatattttatttgttattttgaactttaattcatctcgccatgtgttccagattgccgcttatttcaatagtcattacgtttttattaaaacttctagttatttataaattatattctaattgagctcttatttttctttttctatcttttgaatttatttttattttatattttaattaatctcgtattgtgttctatatatactatttttaatattttttaatttttattttcaatttcaattgtttcaaaattttattcctacttgaactatctttttaatttttatttttctaattttgaattttatttgattttttattttgaatgttatttaatatggtattggttttttatatggactattctttcaatatttacttatttttaatttcgaattttagttattttcaaattgtattcctacatgaactcttctctttttttctaacttcagatttaattttatttttattccgaattataatttatctcgtattgggttcttatatggattcttctttcaatattccttatttttaatttcgaatttcagtttatttttaaattgtattcctattggactcttctttttgttttctaatttcgaattttgttttatttttattccgaattttaattaatctcgtattgggttcttatatggactcttctttcactattccttatttttaattccgaatttcagctatttttaaattgtatttctacttggaatctctttttctttttctccgattaatgtgggaatttttagcccccactgcgaacgtggtgtctcttttcaaatatgttttaataatataatagatagagagatatatagatggcataaatactggctttggatctaggcagatcacattagctttcttcagtgttgtgtttcctgggctcttctgaagtcaaatcgttagtacaaatcgatatttattgattcctaattttcaaaattattaaattgacagaaagtaacgaagacttttaactctgaggtagggtttgttattccagttcaaaattttagtaatttcagaccccaccggcaaacttaaatatcccccaaaaatttcagattttttcaaatatttatgaatttgatcaaaagttattcattaaaaatacatgttaaaatttcaaataattgcgtgcaaagaaataccaaaactcctaagtagattgttttttttcgttagccttaaaacgataaattctatatttaactttcaacgtaatgtagttaatatctataatactaatgaaagagtaaagtgcacaagcgatgcaactcacatgttggcagttagtggaagctagtaatacttaagtggcaaaccgatggttgcaagggccatggaacaacaaacgtgaacttggtatcttccatggctctcttcgtccttagttcagacctcaactgattttctattcatgtatcccgcccaaggttcacaattctgacgaaaaccggtcgaattccataaaatttcgaagcttcgacaaggctcgaaagtaaaagccgtatgagatttcgatgagtttcatcgaaattcaaatttgaattgataaaaaaggaaaaaaacaaataaaatcttataaatagtatgatattcatagaacctattgggatataaatttttaaaaaaattgatttattccgtgtatttactgaaatttacactgggaaagaaaagaataacgaattaaaaaaaggaaaaaaaattcagtttaccttttttctagttaacgattgaaatttcaatgatttcgctcggaatttcacccaaacccgactgggttttcatgaagcttatcggtaaattcaaaaaaattgtatttcaattttgggttattaaaattggtccgaatctacccacttttcccccgattttgcgaaaactgtcgttccgctagggatgggtcatgatttcatttggcccgtccaaataaggcctgagttacattgaacgatttggagcaataggttgttctggcccaacaaaaatataggaatactatcaattattggcatgtaataaaagacatgccaatacagtgcagtagtctatataaatgtgttcttcaaaaaattattataaactttgaaaatgccaacaaatatgtttttttatacataaaggagttttgtttattccggaatgccagcatatatcgatagcacatataagctcgcagctttaattctgcgtctgctccaaatttttcttagcatgaatcagtacataccataaataatttgaaactttctgtataaacgtgtgagttataatattctgaaatacaaacataaaaaatcagaatataagccaaaaacaaggttttaaaataatgttccggaccatcacatcgatcctaggaaagtaggaatgagttataaaaacgaacggctgcccttgcccttcccaaaagtacaaaaccatcctttcattctcttgtttttttgttaaaaacaactagatctgccaagaaaaaggaaatcaaagaaaaatctcaccaacaaagttcaactttctcatatgaaatataaatcaatgcatgcaactgaggaggtatgtttaaccatccgtctcaattctcaaacaaacaaacgattttttttaccctcgcccagaagaaaagtagaaaactaagatgaaagcagagacatgcatgaaaggttagcaatggttacctgcagagaaggtgtgccattgaggagaggaagaagaggtagtttggcgtcagtaatggagccttccattgtgccgaccctgctgtggctattttcctcttgtccaacaactctgcctcacaagcttacagtcctgagaatcgtggatatatataagcaattctcattgtaaaggtaagattaattagaggagcaaataatggaagcacctgaagaagaagaagaagaagcctcaaaagaaggacatgaaagaacgagggccatgccttttgtcattcttttgctgtataattaaagcgagtagggcaatgactgactagagccttccatgtcagtgtctccttaaaaatgtggaggcttggtactgtttggtgatcagaaatctgtgaccagagaggaaacagatcaataaagatgtggttggtaaatatttattctatggaaatcatagatgatgtgctatttgttatttttaatttttagatgaactagtctttcgaaaatttttagatgaactataaaaacttgtggtcccctatatggatggatactcatacagtacatattgtaacgaaatatttatatatttataaggtgttgtgtgcttccaattaaacaaggtagttgccaaaatatttatgaattagtactatcaatgtatgtcctggattggaccaatatggccgtgtttagttcgtgtaccaaattttttttaagtatatgaatacacatttgaagtattaaacgtagattaataagaaaataaattacagatttcgcctgtaaaccgcgagacgaatttattaagcctaattaacctgtcattagtaaatgtttactgtagcattacagtgtcaaattatggtgtaattaggctcaaaagattcgtctcacgatttacatgcaaactgtgcaattggttttttttatattcacatttaatgctccatatatgtgttcaaatttttaatgtgatggaaaagttagcagtttgaagaaaaaatttgaatctgaacacggcaatctcaagttgttccaagattagccatacgatccgtaagctattgaatattgagtcttcgagtcattataataatatagtagtactccattagagtccccgcacccatccgttcagaaataattaatgcgatcaataatgtacggaaccaatactcataagtcacaattaatggcctaatgaccatcttgttggccccatgcccagacactttcaggatgcttaattaaacaacactgctctacttgtgttctgattggttaagctatgtttgataaagtgataaaaatcttttatacgtgtgttattagtattttagaagttaacgtaggatcgaatcacaagaactaagccaatcagagggggtgaaaagttagtatacccaaaaaccgaaaacttttaacggaaataaaagttaccatcgaattcgacggagatcggtctgaccggagttgtcctgccggtctgaccgctcagatgccgtcggtctgaccggttgaggtatagatcaaccggtctgaccgccgaagctgctcgccgcgcctgtctccgccgccggtctgaccgccgtgctt

SEQ ID NO: 48958 - DNA, 3317 bp, Oryza sativa
tgcaaaagcaatctctctctccattttctgtttatgagctaatctgaaacaaaaaccaacaatatgtccatctttgccacaaaaagaacaagtatatttttcacgatgattagacacattggtagcactagtagatttagcaacatgagcaacaataggagattttgcatgcacaacattggattttgaagaagatgcattcatagtagacatgataccagcagatttaaacacagttttgttagtataaggtttaaccaaaatctcaccacttctagcaccaacacctaacacaacaggaggatgtctagaattatgaacataaggattaaaacctaaacctcggttatgtgtgctaacctttgattgatccaaaatcatgttgagattctttttaccatcagaaaatcctagcaaagaatttttcaaataagaaacctccttttccaaattagcacaattttcacaatctatcataacacttttgcttttacgacatttagggcaagaaagcacttcattgtttttcacgacgtcttccataaactcaacacgacctaaagcatcttttagtttcatcttgttcaaattacatgttgagcaatccaaaacatcatgaggttgttttaactttttagcagaaatcatgttaaacatcaaactagcatgaaaagcaatttgatatttttgcaacaactttttagttaaaaacaactcatccaaagtgcgtgtgtgcaaagcaaaactaaaagcaagagaagatctatttttcaaatcatgtgcagcattaacatctctaatttttgaaatatcattcattaaaacctcgcaatttgaacaatgatcatcattaggaataagagattttaatctatcaatttcagatttaagagattcaatgataaattcctgttttctatacatcttctcacacttcttattttttgcactcaaaatattaatagcttcctcaaaagcactcacctcactatcttcatactctgtgtcagattcaccacgcgccatgaagcaaacataggagatgttctttcccttgtcatcatctccactttcaccatctacatcacttagtggctcgaaggcggcgcaaacttgttgaaaagccttcctgagattgtccagcttcctcccttgggatgaacacttcgacttgttgttgggcttgtagttgttggtcttctcaccatctttgtcttctcttttgcctctcccaagcttaggacaatgcgaacgaagatgatcaattgaaccacattcaaagcaacgatttggaccacctcttttcctgttcctggcattattcatagctcgagcaattctgttagcaactaatgccaaatcctcctcctcgatttgttcgagttgatcatcggatgtggcattaaaaacagcaagaaaagaagacttagatgaagaagcatcaacatccaaagaggaaaccaaagcactcgacttagaatcaacttttcgagaaagaacattcatctcatgtgttttcaattttgtataaagtgaatccaaagtcaaagtagacatgttaatagattcctgaatagatgtaactttcatctcccaaatagacatgccaacaccattgaaaaagtggcgagaaatctcagattgtagataattagcatcataagaagaatcaacagatctaagatcactcaaaattttattaaaccgagaaagatagtcatccaaagcttctccaggtttcatctcaaatttaatatactcctttttgaaaagatcacgacgaagttctttaatattatttgttccttgaagaaaattactcaaagcagtccaaatctcatgagcagtttgaagatgagcaacacgatcataatccgaacgagaaataccactcaaaagaatattgcgagctttgcagttttgttcaaaaccgttttttttagcagcagtattaatagcttaaggaatcacataaggatgagaatcttttctccaaatatcataatcttcagccataatataagattgcatcctactacaccaatgagaaaaatccgttccatcgaaaacatgaggcttagttgaaaacctagcgggagtagccatggcaaaaactctagatcgataaaaatccaaagaataaaacaagactctgataccacttgtaggatcgaatcacaagaactaagccaaccagaggggggtgaatggttggtatacccaaaaaccgaaaacttttagcggaaataaatgttaccctcgaattctacggagatcggtctgaccgaagttgtcatgccggtctgaccggtatagatcaatcggtctgaccgccgaagctacttgtcgcgcctgtcgccgccgccagtctgaccgccgtgcttccgtcggtctgatcgccgcttgccgccggtctgaccgccagtagatcgccggttagaccgccaaaaccgggtaaacacaaattgaataactcttaaagtagatgacgactttattgattttctttgtgtttacaaagtgcaccaacagcactccttacaaaaattttgactaaactcgaaaccctaactcaaaactcaactcaattgctctcaaaagcgataccgggaagcctcacgctccccctctatttatacccgaggtaggcagcctaaagccacaaaccaaactcatactaggagttctaaacaccttaggaaaccctctagtacaagaaagaaactttacataaccaatcgtaccaaatttggactccttccaaattcgactctgcatcccacacgcacacaataactccatcgtatgccatatggaatctccatcaaccacgtgcatcaactctagcctaagtatcccgcatgatctccgaccaccacggacgtcgccttatccccaagccgactcccggtccatctccgcaaatactctcccgagacatcgagtcacctacacatggaacaaacaaagaaaccatattccgagactaagctatctccaacttgactcattagtagcaaacaacaatattacatacgtatagtatccatctagaagtcataatcatgaaataatcacggatatgcaaacaaacaacccgaaaccgaaaccaacacagtatcggccggtcagaccgcgggctagccggtctgaccgcgcgcattccgccggtccgaccggctaccagatctcggtctgaccggtcacatgaaataacaaatcctatgatcacctgtgaaatccaatcatctccaaaaccacttcgtgaataaattccaaataacaaaaccaataatctccgatgcccaattgttcat

SEQ ID NO: 48959 - DNA, 3766 bp, Oryza sativa
agtaacatgtagtacttctttaggcagtcggcacgacggcggcagcggcggtggcgacgtcgacggggtgtaccgtgcgagccctcttccctgcctcccaccactgggcggcggccttccagccagcgcagcaaacaagagtaactgcagcgagaagtacgacgatgaccacaatgaaacctgaaaaattcattatttagtaattccaaaagaaaaaaaatatatgaagaactaggacttgaccttatgccttccaagttaaggaaaccaaattttttgggggctaatgatttagtacagatgattcttttgggaacttgattcgtttaagactcatcgccattattacgggtttttattctaaatactaaggataaatataaagaagagataaaatccaacccatctaaaaaaatagatactccatccgtttcatattacaagtactagtaaattttttttaagttcgactaaatttgtagaaaaacataggccttgtttagttggggaaatttttaggtttggttatcacattggatatacggacacccatttgaagtattaaacgtagtctaataataaaacaaattacagattctactaggaaactgcgagacgatttattaatcctaattaatccatcattagcaaatgtttactatagcaccacattgtcaaatcatgaagcaatttggcttaaaagattcgtctcacaatttacacgtaatatgtgtaattggatttttttttcctacatttaatactctatgcatgtgtccaaacgttcagtgtgaccacgtgaaaatttttgttctgggaactaaacagggccatactagtattttcaacacaaactaacatgaaaatatattcaatgttagatttaatgatataatttcatattttagatgttgttaaaatttttataatttcgatcaaacttaacgattcaaacgtcttatgatataaaacggagggagtactaacattacaaacatgctccagctcaccaccgataatcgtcatcagtagtaagtactaacaaacattcaaaagaatcaggggcggatctagagtgtaacaagcggggcccttggcccccactcaattttgcagcgagcgggggcaaatgcccccttgacactttttacttcctgttaacggccaaatctggtaaggtgtgaactaggttcaatactaggatcgaggcggattcgatgaagagatcgattcgaagaacagagtatacatcggctgcgaaggtatcggctggagtgtacatcggctgggacggatcagacagagggtagccgatacagccgatagaggtaatgcagccgatgatgatgaagacggtttcaaggctgtttctagaatcgatcaaagtacttcacagggattgccatggtggagataaagctctcttatgtaatttccttagagatatgtttgggcaaaagtctgccgcaaagacttatggtatcttagagtttgttagagataagtatcgtgtccggcaaggacatatcttgtatctcgggtataaatatgacccgaagccatgtaatcaaataacacacgttcaatacaatctcggcgcgtcgccacccttttactttcgttttgtttcgacgagttcttactttcggattgagctgcatcggttttgatcttcaactagagataaaacttgttatggcggcttgcgttctcgggattagtgcttccatctttatgatactctaatattgtttatgtaattcgtcaagttatcatatattatatataatctttgacaatatcgttgtctaaccttacatcgactaacatctattgttagaaggtagccgattaggttaaatatcgatgttgacttagattatatagggtatctaccatcctatgaaacaaccaacggcttgattgtctagatattgttatcctcttcacacttatagctgcatcagttgagtttgaccttataagtcgtgattagaatcttaatctctagtctgcttttgattgctgattagggcagtatcggggttttagccgatcttatctgatttaactaatttatatcttatatgcttgattggcatgttaaatccgccctttatgttaagatcttgttgtgtttaggtatattaacctttttgtttgatatatcctacttgctttaatatcttaatatagagtggtattggagtaattagccgatacatgctagatctatctgatcggctatgctataaatgtctataatctcattgttaatatatatttcgatctaagtgatttatactatctcggcatggcgaccgatctatcccaatcacttgatttaagtatatatcgatgtaaggattatatattgttaatatctacaaccgatcgaatagatttagttctttcttgattattcatgactgtcgatcgattgaaatatgacatcggctcaaagataaatgatacgtcatcggcgacctaccgatcggctatcgtttatggatttaactgctatcttcttgtctttatttcttggtgatagcaggatcaaatcaactggcatgctcacgaacctaaaagtaagatttttggacctgcactgaagctaagcagatcttccagggctcgtgtttttcgcatcaacacttccttagtctacctaagcggtagatccttatcccccacttatgctattttctgcatccgccattgaaaagaatcagtcgacgggtagacacggcacattattttacaccattagattagatatattttattttaaaaaaactaataccttattaatctatgtacgtatacaggtgattaaataactgttggctaaaaaatacaaaaaagatacataattagtccataagaaggtacgaccaatagaaagaaatgaagcttatctactgtccagcggaagaaaaaaaatatgagcacggacttactataaaaacaatacaaccaaaaaagtacatatcattagaaaatgatcgacggtattttgaaatagtattttatactatttaaagataaacatattactctacaactttacgtaaatatactttgttaaactagatttatattataaatacgagatatccaatcaattatctttaaatgttctattttaacttacgaggctaatatatataataactaatgctatgattattttttatttcgcatcatattttagggtgtcaaatatcacttacgaatatacaacactaatttaaatctaaatatgtaaaaatggaaacaaagcaatttagttgttttattttacaccattatattagatttattatttaaaaataaaacatttctcctatatacggacacatgagaaatatataattgtcaaccagaaaagtactccataggtacatatgattgaaaaaaataataatgcttacgtatcgtttgccggaagaatagaaaacgtacttatgataaagccaacaaaatcgatagtccttaaaatagaactttctaataaaatataataatattcaaatttacgcaaatataaatataaaatatcctttgaatgctttttaagcattctatctaattattttaaaactatatatatccattttttttatcccattgtattcctttaaataaataaactattaatgtctataaccctaaatacaacacaatatatggagctgatatgtaataattaatgttatgataataatttcgcatcatattttaattaaaaaaacacttgacgaat

SEQ ID NO: 48960 - DNA, 3771 bp, Oryza sativa
catcaggcatggcatatgttgagtatgaaaactttcttgctactgaaaaattaacgcagaatacttccaagaaagggtaagaaaatattaacatataacaaaatctaaaaaataatattactacctccatctcaaaatatagtaatcttatactagatgcaatggaatctactttcctccgtttcacaatgtaagtcatcctcacttacattgtgaaacaaagtgagtatctagattggaagtcctaacatgtattacattggtcctaaaagtgatatattttaggatggaggagtaacatgcattattaaagcagctcatcaatgccactctggttcttgttagagcatgtagcccagctcacacaagtagtccaacttgtcacattagatccgctccaccatatatctaatcggaaccataactttaggtttcgagactacacatcccaaaagacgttatatatagtcgcctcgcgttgtccatggatatacttcatctatcattgaaagtgttggcaccttttttggcaagaagacaattatgatcgggacacctaaacatgttgtggtgatatggagtcacaaccacctcgatctagaccaagaagggtttttttaaaactaaaccggctagcggagccggtttagagatcaaaatcagcctctaggtcgatttagattgagatggacgaactattaaaactaaacccatctcgtgggtgaattggaaagtttaaagaacaaacctacaaagggcatcacactctcacagcgaaggcggacaatttatggcgcaaatcaacaaatatggatgaactattactaggtagaagataaagtagaaagcatggctaaaaagcaaagataaaagaacgattcaatagattatagggattgtggtctatggttagaatcgaaccagccatagcccttataaaggggtcgctcttgccatctacaggaccctttccatgtcttacttggggtagagaccaatgagaactcaagaaataccttccgaagcaaggaaacctgagacccgacaaaattggactcggcgtcagactgagccagtctgaccggcccaacaccccggctttatgacggcggttagaccggccccgtgaaggataccggatcatttccaaattcgtccatattttcctatttttgttctaggtgccacctttgggtgttaacacatgccccctacctttttggcgaacttgcgagccgaaaagcatacaacacatggtcttagggtgacaatctatattggccataagggcttccaagtgcctagtagatctttctctttagagcactgctcccgtcctgcattttgtaccgcatggtacatgtaccatgtggaaccaaaacccatccagccgttgattttgcaagggtaggattggaacaggcaaagaagcgaggcaccgctccatcctttgattttgcgcgacttctcccccaaatcagacacgagacccgcctaccagacatcgtaaaccctagccgccgaacaaatgtccgccttctgaatcacgccacaaatctcgccgacgtcgccgcccgaaatcacatcgccgccggaaacatttgccgccccaaatcacatcgccgccggaagcatctgccgccacaaatcacatcgccgccggaagcaactgcagccccaaatcacattgccagaagcaactacggcgtagcagttgccatcgtctgagtcgctggagcagccgccattccccttgagcggtgtacatcaccggcgaagaagcccttgcgatgcggcggctcaattgggacaaatcgctagggttaccccttcactccagcactcatcgatccagatattgtgaaaagacatcagtgcctttgcaccaaacgttccaggtggtaccgcgtggtaccgtgaattcctaaccattagatctgtgcgaatcaacggcgcagattttgtacctcgttggtaccgcgcggttcctcgggggtgtgctgtacgataaaattcctattctctttatagtgtcctaacatattagcaattttcttagagtgattcacataactcagcatagatattcccaactaaatgattacccattgagcacctcgcacttggaccctaacggtaaaatcgttttttgatgccaagtccctaatcttgaaacgatcttactccaattataaaacttggctatacttctcctttcatctttttagtccattccaaagtcttcaagccttcatcggtccctttgtcactgttagtgtcttataactattggctgataaatcaactcactgaacataggagaatcaaccagctgaataatacatcccccaagccaattgataagttccacgatgccttatagcatttcatccataagatttcaggttgaccggtatctaaacatgtatcttgaaaatactaactccatggtttggcaatgcaattctttattaaacaaaatatatttaaatgcttattgccgaactctccaatagatcttatccgatcaaccatcttgcttagatcatggaagtattaaactagtggaatcctccaattggtaaaattgaatttcatagcacatcaaccgaattttataggatcaattcggctatataatcaaatttaagctcatgcccccagctacatactgtgggttgccatccccggtcagggcggcattaaagttatggtctgaccagttctatattcggtcagaccggtcgagaagctacgattagatcattcaagaagcattggtcagaccggtgtggttgcggttagaccgacctgatctggagtaatcaagcaccggcttttagaacatgcctctcctatctttatggccagatgtttggtgtgtcaaattactggtcaacatgatttctcaagtggctattttaaataactaggaaggtagccgcgcattcgcgcgggcatgtgtcgtacgcttagttcgaaacacttataagagtgaaatattaaacggataacatctgccacgatttctccaaaaattgtttacgtcggcattaattgcttttataattttctaacttatattatatcataattaagtaatatctataagcaattgaaaagaaggtagacttattttcttaagaaaacatgtcaacgaaagtaaaagtaaggtgtttttcttttcttagttgcatatattatcatggattattagaggatgaattgtgttagacacgaagctccactaaatgtatgggtttatatagacactaataattgatgtagtttgagaggtgatccatttatgaacatttcatgtagagtgggtcagaacctccacgcagcttaacatgaatacgataaagatgaaatataattgcgcagtaatatttttgaaatgtgatgtaccatgaatacacacttgtttttttaataagatagatctaacaattagaaataatggttctaccggtttaaaaggcataggtgtattccaaaaatgtagcataaaaattatagttgttttagtatccaacattattataaagcaagcgtagctcaactggttaggttacttgttctggaacttgccacctgggttcaagtcctatacttgatatgggtgcttgcatttacgattaattgttctttcagttgtaggtgacgtacccatcaatagtgaggcatccgtggtgatttctttaatctcaaaatatgccggcccagtttttcggagatagtcataatggtaggtatgtgtgtgtggat

SEQ ID NO: 48961 - DNA, 3715 bp, Oryza sativa
cataaatttaatcgaagttgactggcaggctaaaggcccagcaatgtctccaatattcttctctcgaggcgtcagatatttcattatgtttgtttgatgacttgaattattcacttcatctctcaaatataatggaaggtccggagaggctacggcatttaattgtaagaaatataacggtgtgagcgaataataattgtttgggtacctaaaagttgcttttttgagatttattatgataaattaaaaatattatctcaactacttaaaaataaggagtaaaggggagataagacgaggtgaggagaggggtggtgggacagttggcagaaaggcattgtgtatatttctaatgatagaaaggcattgcatatatttctaacggcatatcattgtcatttagatttagaaatagagactgcctatctaacatttgatagaaaatcagcctaaaattctggcaaatgtaattatcgtataatagcagtgtaattacattcgtaattcgtatgtaactccagtacaagaaagatgtaattattattgtaaaatagaaaaatttacaaagcttggtagtgaacacatgctctagcgttttgcacgtcgatcgccggttcgatccttggtatccatgcgccatttgattttttctctcttccacgcatgcatcttaaagcatatctaatggtggaaaatttgcatgtttttccccatgattttctttcaaaagataaatatcagttccataaaagtttgagaatttttaatgatcgtctttaatttagtggtcttggggccaacgtgtaatatttgtcttttactctgaaatatagttcaatgcgcctgaaatcgtttgagtaaagaaatacattagaatggttcaaatcgatcacaaattggttatatacaatttaaaagccataatcacttaaaatactgtttatttatttttaaaaggtccaactcgaaagtataaaccacaaatgcatgcgaagtgcatgggtgcaaccggtgtatagtccgctctcagccttcacgttagaaaaagagaagtgagaatttaattaagtttctatataaaataggccattaaatatcttaaccaccaataaaaaggaaaaaaaagaaataggggcctacaggaggtggcaggtacgtgtgcgtggagagagctttgggcctttggcaggagagggacctgtaaattaatctaatttaacggtgtaaaattatgggtccaccagtttaaatgaaaattaatggctagatcttttgcttttttctcggaatttctaggactttctctaatttattagaacgccaagtggcgacgtgagagcgttttgaggaagtttaatgggcttttaagtatgtaatagatcgttgaccaataccaaagcaaacaaccaatgttagacgtgtagtagctgtatccatagtctaccacaattttaagatcaaagccgtgcctcctagtataacctggatttatattattgaaaggcaagattaagattattgtttgtttaaaaatgttgtcaaatagattaagggcaaactaaagttgtgataatggtattttataataatttagggttctatttttcttaaggtatctcaaaaaaccattcataaacttttgattaggagatggattaagtactttaccacttttgaatcatgtttttttctcgagtaaataagaaactattgctagttaattatcatgcaatccatccatatatatgtccacaaatgaaaaatgcgagagcaagatatttagaattcttgtgaattaaatcgtcttataaaggcgcatgatatagtaagaaagggagggaagtgtatgcttggaaaaaaaagaagaagggggaaaatcaaaaaggaaggggaagtgtatgtacccacgtacgtaggtgcgcacatatgccgtgggaggagaggtgggatctcatagtatttagtttgttctaagatcaaattaatctaacggtttataatattggacgtaccgatttaagtgaaaatcaagcaatatatactttgctttgtttttcatagaatttctaatatttgctctaatttattagagtaccacgtgacagctcgagagcattttaagaaattttaaaggtagaatattaaccgcgtaatatatatttatggggcatatggtaatatttgttccagcttcatcgatgtttatatacatatagagagaaattaattatatggctagcaagctattagatgtctaattagtagcaattaattttgacatctatttacagttgttcgtagtagctcttacatattcatcttatgactttgagtatccgttgatccccaatttactgttcaccatgactcgtatgaaaaaaaatatgtactacttagggtttaggacaactgaaaatgatgaattatctaatttatgtgatagctatttgagggtataaatgaatgaattgacttctaaaagttaaaatgttgttggtaaaaaacaccatttagaaacttggaacgcgtgcaaacgaaaatccaaactatggaatcaggaaataaagagggtcttaaactcccttgtcttagaagagttctattgctattcgttaatattgtgctcacatttataacataataatttctttcacctgtacgaacaaatagtacaaaatccaaatacgacataacacaatacactataattattttgtaatcaactcttggttcagcttaaacggagctaagtgttccaaaaacataacccacgatgcttaattcttctctcgctgcatcacacctttaaatttcttttcatgctattaacaaaatttattatctccatatatgatttggcatgtagcaaagtggtagcgctgcggcggtcgtgatcaccttatgcctcatacacgatgctttgtcacacgtgcaaaaggaaaatgtgctgacgtgcattgtgcagcgggccaaagagggaactttggacgctttatttattatcaaataatagattcgatgatttaaataatgggtccaccggttttagtttaagtgtaaattagttgatatatattttaaattgttaatttaatgggtacacaatataatgttgtagacttttttttgaaacagtgcattatttgagaatgatagtccactgtaataaaaaatagatccgatgatttaaataatgggttcatcggtttaagtgcatgtataaattagttaatatagattttaaattgtttatttgataggtacacaatataattgtgtatactttattttaaaatagtgaattatttgaaaataatagtatgagtacgacggtttattctaattgaagttatcttactccctccggtttcattctaattgaagttttgaacaataatacggtctacaaaatatatctttgatcttatttttctattataatatatacgataaataaatatatgtttacttttatcatagttttaagacaaatctatatatgttgttctagttcctttaaactaaatatttttaaagtcattgatagtcaaagttataaaagtttgaccttcgactttgttcaaaaggtcaattattatagaaccgaatggagtatattattaatttaatgggtaccatataatggtgtcaattttattttcaataactgtagagctaatttagttacatgtgagttgtatgatggtagattctt

SEQ ID NO: 48962 - DNA, 4508 bp, Oryza sativa
atattgcaaaaacaacatctcttgataataataacgcaaagctagcccattggccattcacaaaagccggattactaagaagcacaactttcatggtgcaaggattataaaatcgatatcttaatggtgatacataaaaacatacatgttttggcttttaataaatatcaaacactcatgagccaaatcatacttcaaatgaatcgcttctttcatccggaatgtaggtatcatcatacctatgccagcactcggctgtcacgtgaccccatttcaagcaaacctaagagatggggcgatcattgccaccctgggttgatttccgctgttgccgcgtccacgcccagcggtggcaggagcgccattaccgcgcggagtacttccgccacgacaaccgctacatttgccgatgccacatgcacttgccgaataggtcacctggtctcaaaattaagaagttgagaacaaacttctgacattgtgaccgtctcattgcgtgccacaatagcagatacaacaggttcaaaatcctcatttagcccatccagaatgtaagcaagtaggtcttcttcatctaagggtttcctggaggtagcaatttcatccctgagagctttcatcttgccatagtattgagaaacactcatgttacctttttgtgcattgatgagtataagccggatgttgagcgactgtgcttcggtttgggtagtgaacatggcgcaaatttgctgccatgcttgcgccgccgttgatgcaatagccacctgggtgagtacataccttgatagggtggagagcaggaaccctaatacctgttggtcggaggcgaaccactcttgaaaggcgggttgacgatcttctctgtcctgccgtcggtggtgcgctcgatctccatggatgggacagtgatggtgccggagatgtgcccatccaagcacgacccgcgtatggctgccaaaacttgctctgaccacaactcatagtttcctttgtccagtttctcttaaacttgaacgctgaagagaggattggtgagggtagcactcaacgaggaacttgccatcaccaggcttgttgattttgccggactttacagctctgatactgttgacgaaaaaaatcgaacacaccggcctgagagatctgcttagctcctgtgcaggtccaaagattggtgagatgcgggcatgtcagtcagtttaatcctataactgacaagatatgcaaataatagacaaaacagccaatcggctgacaagccgatggagcagttccagccgatagccgataatagctaaatgcgataccagccgacagcgatagggttttgagcaatcggctatacgtccaatgtagattctaacattttagtaaataatgatatatagtcaatcggctactgataatgaaatataacagtaatatagtccagtataaaccaatcggctagcattgatatgatagaataagcactgatttaaaggttaaagcatacatcggctggaagtccgatgtcatgaaatccacaagattagattaaacagtgaaacctttgttatcatcggcaaaatccaacttatatgtatatgcaatccttatgagctgatgcaacgtccagataactcaccggctaaaaccccgatgaaaccctcattagcaatcaagaagcaggctagagattatggttcgaagcacgacttagtagatcaagcttaactgttgcagcactaagtatgaaaagaaacataatatctagaaaatcaagccgttgattgagtttttggggtggtagatgtctaagctaatctaatctagcaacgcgatttagccgataccaacagaaaccctaaaacgagaagcagccgatagagctaaattgatatgctaagactagattaacagagacatatgataaatagttaggcaaatatatcatccaaaccagagcaatccaagaggtcgaatgtactgatgcagccttaccccctagccggagatcgaacaccgatgcagccccacgtcaggtgccaagtcccgtcggacgataaaataaagtagaaaaggtaaaaggtggcgatgcgccgaattgtattgatcgtgaagatagtttacaatgaccccgggtgtacatatttatacccatgggtagatactagtccttgtaggacaagaaagaaacttttctaaagataaaaggaaaacataaagtccttacaggacactaaacacactttcctaaagataaaaaggaaactaacaaactatttctaattaatagataacttgccatgccgcactctctttgaactcggtctcttctggataagcttcctttagtagatcaatttccttaaccgaatatagcaagaatccgacaactgacaacttgataaatctcatcggctaatctcaggacttcgaagcctatgctgactctaagctgatgattacttcgggcttaccaaatttcactgttaacagatgccatataagaactcagatgcgagtggaggaagcgtcaaggtggacacgttacgtgttaatcagcttgtgccgaatcgtgctattgttacatatgtatatgcatctggatagagttggtttggaggtcgagtcggccagtcagaccgcaggctggccggtctgattgacagcacctgcccagtctgaccggttctcacctgtcagcagcacctgttcatcacatgcaaatccaatcatctccaaaaccacttcgccaataatctccaaatattaaaaccaataattttagatgccaattgtttatcacaaaataagaatcaaacacactttgattttacattgattacatgtgataagagtcctacctttctatctatccaaaccaactaaaatccatgcatatctgttacatatgataatatctaacagcaacttcgtcaatctcaattatgatatgtcgaccaaatattcgaagatgcttatagaggtagagtatgcgtgtgcgtatttataggagtgaatatgggtgcgtttgtaagaacgcctacatttgtactgagtttcagaaaaaaaaatagcacagtttttttatggtgctactttgaaaataattggtccaaagttccaaacctaaaatcatgaaaagcaagaaaaagaagacatgcgtgtagatggagaaaatatcgtgcaaaatcatatttatttctcagaaaccggttaattaaaccgttatggagggggcacatggaaaacagatcgaggtgattttaagaattattatataagaatgtgcaaggcatactggtaagcaaatatacgtcgctattgtctattggacacgttgaactcacgatgaaatgtcatgtaggtttcatagagatctcacatttgcattaactgtgagaagcctcggtcatagccggtgatgtctcgtgcaagtgacaccaaaatggtgtgatagatagggatcaaaatggtgtgacagcaaaatggccgcatcaaagctgaagagaggcatgtggcacagtgaacagaccgatgtgattattgtaaatcaccatctccttctggatgaatgtcaatgccatctgtacattgaccatgaaaaagagcacctgtgatgcacagacagggcataagacgctgtttaaatgggactttaaagtcgctatcatatcggatgtttggacactaattataaatattaaacgtagattattattaaaacccatccataatcttggactaattcgcgagacgaatctattgagcctaattaatccatgattagcctatgtgatgctacagtaaacattctctaattatggattaattaggcttaaaaaatttatctcgcgaattagctttcatttatgtaattagttttataagtagtctatatttaatactctaaattagtgtctaaatacagagactaaagttaagtccctagatccaaacaccaagagcagcagcagcatcttgtgttcctccatctggtacacaatgcacagcctccatgggcccactactacataaatcgttttcccaaacggccaaaagtgattttgcatctggacgggtggtctgcctacatgcaaaggcctagaaaaagaatataattttgcatgtgaaaatccgattttcgtaggcggacgccgcatgcaaaaataatttggagaaaaaaattccaaaactaaaaaccctagatccacgatacagaaaccctaatacgttgctgccgtcacaccggatccactgccatcgtcatgttgggatccgccgtcgtggtcgtcgatcgaggccaccactgatgtggtcgaagtcacctgggcccagtggtccaacaacgggggatctgcaccgtgctcgaagtcgcccgaggcccggcggcgcacagatcctgtgtgcccgaggcctggcggtggtggatttgcacacccgaggcacgtgaactgtggatcctgccctccgctgccacccggcgtcatcgtctgtcgtcgcagtatatgacatctgct

SEQ ID NO: 48963 - DNA, 2257 bp, Oryza sativa
ctgcagcccctcgtatataaaaaatgtttctgtagtagtggcctgtatgtgttgctactaattcctttgttgtccgagggtgtcgcggtagaaaggcagccttatcatagaacctggaaaattaatatataaatcatgcaaatgtagaaatacaagtgaactattaaatattttcaggttgctaatgttcaaacaaagtatttcctaggtacaatcaacttacgtggatggtgattacttacccctttacttgttgagtacatttagattgatctataatggtagtattttaccactattatcactcataaaagtggtcttggctgttgttttatatattgtagtactagtaggaaaaaaatattttagagtaaagtgcatggctggtccataaacttgcacgactatatcatctaggttcccaaactcttaaaatatatatttagatcccaaaacttgtaaggtgtgtcattccggtccaaaatggcacaaccccttcaagatcctacgtggcgctaatgtggcatgccacttaagcgccaccaacacagtatcatcactaactctacactgacaaatagagccttggcgtccaaatgaagaagaagaagaagagaaggaaatgaaaatgaaaaaaatggagaaaaaagaaaatttctgaacgggccctacttgtcagtcggtgtaggattggtgaatatgccacgtcaacgttcatgtggtatgtcatattggcatcatgtagcatctcggatgggctgttgtactttgggactgaaatgatacattttgataaattttaggacctaaatatgcatttgacagtttaacgacccatataatacggtcgtacaagtttagagaccatccgtgcatttttactcaatattttactaccaatagttggtgtggtagtataaatagatatcatccattggattagaaaaaaaaaactatgtagctagattggatcttctaccagtagagagttttaattgaagaacacctcttgtttttggactattgcatctcatgttggagtaaaagtactctattttaagtaatcacataacttatacttgcagaaggcccttgcaaaacaaacatctcacaactaagaaaacattttaaaaaaaattgtatgcagtaactgaattatttcatcataactcaagtacctgaatttattggtatgatggatcttataacttgcttctgatagtaatgatagctcatggagggttgagctataatcaagtaactttggatggcgatttcttactaacggaataattacttgagaaacactttttataggactttcttcatgtttcttgaaccagtacaccattctaccacccacgaacacagtgaaaccaacagtcataacaattatcgggattgtgaatctgacaccctaaccaatattgtcctacacccaaacaagaacagttgctgacggcaattatccagtagtagtaccagttgaagaattaatgagcactccttatcccactttagtggtcagcaacatcaaactgattggcccctagggctgaagagcagagcttgatcgatgcctctagttccatctgagacaagatagtgcccaaggtagacggtaacatgatgaacactgctatggtaggacaaatgcaaatgcaatgaaagtagagaactattagaatgagcatcaccaatataactaacagatatattagaagtcacatgcgagacatgaccaggattagaggattatattaaccggttgatatttttcttgttacacttacaataataaaaattaagagaaaaactattattatctgctatcttccccaagatctgatagcaaataattctccaataaacaacgtgaaataacaacggctcatccaattaaacacaattcttgccatgtcaagatatgtaaatgaaccgtctataaaatttttcacaccttgataactgattgcatatttagctttacaatccttattacatatccagctttacaatcctttggaagtccatgataaaccccaatataacatgctgccacatttaccatagcatctcccgatgttccagccgtaaattgatactcaaccattttaattaaactcatctgatatcctttcttaatcaacctaatgattgtgtcatatctcctactagtataactaatgtgcccacaaactagagtgcatcttatcacaatcgagaccaccgtttgtgaaaataaatattcagactg

SEQ ID NO: 48964 - DNA, 1922 bp, Oryza sativa
caagaaacgagttcttgcagtatattgttcttcagcgaatctttgcagaaattgtcattatgtgtaacataaattggttttggcattgtcattcaggaacaatgttcacaatacacatgtgatggaacagttaatagtgacaaaaagcctgcactgaagcagagtacagggcattggagagcatgcttcttcattttaggtacttctgagaagttcacaaaattattctgtttgtgctcctcaatttccttgattaaacatacgtaattcacctaccgagtcctgaacatgtcataggtgctcaattcgctgaaaccttgtgcttcttcatggtttcgaagaacttagtcatgtacctcacgagtgcgctgcacgaaagcaacatcgacgctgcacaaagtgtgtctatttggatcggcacttccttcttcacaccactcattggagccttcttggctgatacatattggggaagatactggacgacagttatttccctctttattatcatcatcgtaagtgcaacaaaacagatcagtagcaactgaatgatataagctgcagtctcctctgtaatttgctgctctgaagagttgtgttttgtcagggaatgctcattgtgacggtttcatcatcaccattgttcctgaattcttcttactacaattggaacatttgccgtgccacggtctacacagggctctaccttactgccgttggaagtggatgtatgaagccctgcattccagcctttggagccgatcaatttgacagtgctgacccggtggaacggctggcgaagggctcattcttcaactggtattactttctcaatgaacgtcggctcactgctgtcgacaactcttgctggtctgggggggggccaacataggggggaccgtcggttttgcaatcccaatgctactctcggggttcggccttccccctgtttttcgttggaggaaaggttaacggtacaaaaaaacaggaaggaagcccctgccaggggggcccaaggggggggtgcagctggaaagaatcataagctgaaattgcctgacgatagctcactcctgcatgaaggttcaaaagtgactgaagatgattacaggactcaactcaccactcaattcaagtattgctcattgcatcaaccatcaagggttatgtctaattacagcttaaagtttgtggacacaatactcaacttatactttccccgtctgaaaatatagcaacctatatctatgtatctgaatagctaaaagttgttatatttaatgtagtattatttagtacagtacaaaataatgtatttcccgggaacaattctcactgtcaataaggctcccacgttattctagaccatacgttttaaaaaatcatctgtagttgatttgactcttacctcgtaggaggtaatttgtcatcacttaccatatcatttcatttataaaaacatatacattgatcctctactaatattcctgaatgtcaaatacaaaatacaaacatcaaacacttttgaaaatatactgacaaatattattaaaaggttgaacatatactccctccgtccacaattataggggattttggtccctgggtttgtccaaaattataaaggattttgtttatcccgaaaggatcattacaacagccatcaataatcccactcccatccattcacatatgaaaagacacacagagaaaatcatgtgtactactagtactaatccccagtccccacccttgtaaggaaaaataaaatataccccgttcccaccatccctaatccccatatgtccttagatgcactttttccctcttccttaagccatgtttccttcgtgggactaattcatttaagccctatttgtttcagtttaagattattgtaatctagattattaaatcagatt

SEQ ID NO: 48965 - DNA, 802 bp, Oryza sativa
ggccatggcgtactcggcggtggtcgaggcacggcggctggggacggcgccagcgccggtgagcatcatgtggcaggcgccgtcgtacctggtgctgggcgtggcggaggcgttcagcgtgatcggcatgatggagttcttctacgagcagtcgccggagtcgatgaagagcctgtgcacggcgctcgggcagctcgccatcgcggtcgccaactacctcaactccggcgtgctcgtcgtggtggcggcggccaccacgcgcggcggcggggccggctggatcccggacaacctcgacgaggggcacctggactacttcttctggatgatggctgttgttagcgtcctcaacctgctgcacttcttgcattgctcaatcagatatagagccaataacaacacgctgtcgtcttgacatttatacctacactcttcttgggtgcacattcgtcatggttcatgccaaattaagtatactagccgttaacccgtgcgttgcatgggatatttattaacacgctgtaaatattaaattataactatatattgggtatcttatgaattataacgacttggttaaaaaaacacttaacatcaattgctaattgctattattaatctctaaaaaaaatactgagttgagagtatgagataggaacataattcttaattatgaaatcataaagtattaagttctgaaaaaaaatgaagagtttgtatagtactttgtaagtataaacagttggttagattagtagatctaattatgttattcttatgttttaaattatcgcattcagaa

SEQ ID NO: 48966 - DNA, 1923 bp, Oryza sativa
  unsure (1)..(1923): unsure at all n locations
tggtatagcttgtaggtactaaatactactatacatatagttattggcaaactgtataaagtttgattatctgaaattagaataagtctagctaggttagtaaaagtggacggaattgaaagagtaaatcatgcgaaaagatatttcaacatctattatgagggtatctccatattctgcattctgaattattccaaattttggattcacatgtgcaagatagataaacacgatgaaaccttctggctttatatgatctttgtagattgtaggcatggtcgtttgcaaatgcgtccttgcttgatcaatggattgtatatttcatccttttcctcattttgtggaaaaaggaaagaaaaaatagaataatgatagcccagctgcttaatgtgacaaaattagaagacaacacgcataaaaaacacgacccgatattntaacgtgattaattaaatcgtgcctttcttatatatgatactcaaatgaccagttcatgcatatatttatacacggaacaactaggcttagagtttttaattcaactgtttttttttccggtcagatcctcttaattagctcattatctaaaagagatatcatcttagctaattgatgcgggagaatatatttacccatgaaaacagtgctataacataatccacttgttctacttaattaccccaattagtccaacataatctggccgaacaaacaattaatacttatcaattcctgctaactgtgcataatatatattttatatgttcaagatgtgtctaaactatgttcatttggaggtgcaaacattgatttgtcctgggcttctcaaaggaaatcaataaaagaggtcccaatggatataaaattcctatgaattttctatggaatcgatggcaaagatagatttcctccactttttctatgccccattccttcattaattccaaatgaatcaatagtggcaaattctataggaaatggaatcatccaattatcctccaaaaaccgttcaatccaaacaaagaaccccttcaattcaaaggagtactaaataacatttttccaatgcccttcaatatttctcattgtttctgaataacatgattaagaaacattgtgctagtttctttgatttgatcttactagatgaaacaactataagacaaatttcatgatccgcttaatgatcgcgctttgagacaccgcgcctccctctacgctgatgacttggtcctcttcctctccccggttcggcaggatctcgagttcatccagggcattctctcggtctttggtgcggcatccgggctgcgcaccaattttgccaaatgctcgattactccgatccgctgctcggatgaggacctggagctggttcactcttgcttcccctgctcgatttctgattttccttgcacctacctcggcattccgctgtccgttcgcaagttgccaaaggcggctcttcagccactggtggacagggtcgctcatcgcctaccaccttcgaaggggcgtctcaccactcttgctggtggctctgtgctggtccagtctgttctctcctccataccagtccatgtgtctatggcaatcggccttcctgcctgggttgttaaggctattgacaagaagcgacgcgtcttcttgtggacgggtacagatgcggttcatgggggacagtgccaggtgtcctggacgaatgtctgtcgtcctaaggccttcggtgggttaggaattcctaacctcaggttggcagggttcgccctgcgcgttcgctggctttggctttagcgttccgggcatctctattgggatggcttgaaggccccggtcgagcagtctgtctccgacatgttcgaggcgtccaccttcttcatgccggggaatggtgaatctatgctcttctagactgaccattgg

SEQ ID NO: 48967 - DNA, 3615 bp, Oryza sativa
ttcagcgtaccaggccttcttttttggccagcactcctttgcctgtgccgatcttctctggcacgcgaagggccctgctaaatgcaagttcttcctctggtttgcatttcagcggcgctgctggacggccgacctcctcctaaagcgtggcttggatagtcattcggccagccccttctgtggtcaagagcttgagacagcgaaccacatcctcctcgattgcatcttcgctcggcaagtttggctccgtgtgctgtcgcctcttggttggactaccctctctcctccccgaggtagctgtctccaagattggtggccttcttctagggttggcttgccggggcatctccgggccagtttcgattctatggtcctcctagtctcttggcaactgtggaaagagcggaactctagagtttttgactctgcattgtcatcggtctcggaggtccttgagtctatcctctctgagggccacctttgatctttagctggtatcactaattttggggttctattgggaaggtagtggctctgccccctcccagctatttggagttgtgtgtagctgtcacagtagtctttcgtctcttctttattttagtcttttttttctcccctttcttggcataagtcggtctgactcattgcgtcgtgtaacaaacattcttttcttctaatatattgacgtgcaatccttttgcgcgttcgagaaaaaaaagtaatgaaaggcactgaatttcgtgtaaaattttggatctcataatacctaaaggtacaataagattactcaataactaaacattacttgctgtatgcatgtgttcaagatattatgccaagtgcaacacgatgaaacaacctgtgtttaactttatcacagggtcgtcgtctccaaaatatcgagtgctgcaacacaacacattttgagacagacatatcctcaagttggttaaatcttctagatgaaagcctttgcaattgcatatatgtttatgtcatcagcaacaagaagttttctgcaatattttttgctacttttctccatggggaaggaaaatcttgattgggataaggatattgcataattcagttcgaacactacttaaaactgcaaggttgtaacaagctcgatcaagaatatctcaatacgtgtagcttaattaactatgtgatcaatgatgaggtgaacaattccatcagaaaaaaaattatgaggtgaacaagtctaatagtatcataaataacccaataattcgatctcgtgtgtttcaggtcctcaggtgatcaatcatgaggatcattagcatgatccttcgaagctgtaacctcctgtacaacatcattcttgtttatttttggaaagagtcattactcttggttatagacttaatagcattgttttttttatggtctcttgcttatatattattgagtatatatatggatgcatcatgtgtgcttgtgttgcattgtgcatttacagacaacattcatacagcacttgataagacacatggacacaaacaaaccgggtgctttggcagatgaagcagggcttaacaatgaggtgactgcctgcttctgctttctaatgaacaacttctctttctacactgttctttttatttcacttttcctattttatttccaaaaaatattcagatgacttttcacttaacataaatttctttgtgccaaagaaatgtggttaattcctttcttttcccacgtttacgaaaaaataaatctacctgcacaattcaaattgtaattcagagtatttgagttcagcttttacagttcttgaggaagaaaatgtaaagaaatagtagaatgacggcaaagtcacgtgtcaatcaaggtgtccataaatattatacacatatatctgtgctcccaacagtaattcagtgaggtttgggatttatccctgtcctcgttcgtttctgatttttttgatattctagataccgttctcatttctaatttttactgtttttgactatgttgtacagaaagaaaaaaagttattgaaatggttgaggctattttctgaccgttttcttccctatatgtcaccgtgtaataaaaaataaatactctaaaaagaatattattggtatgctacaaatttacctatgctcgtgaaaaggaataatacacatcaaaaaatgaggaatatgttgaagtaattatgacgggccattttggttttaaagccctaccagaaatttttggtagtgacaaattttgggtaggtaaagttagatcaataatgaagtcaaatattaatactacggtgaagaaactggtaccacattatttggcttcaattgaagctaccacatttcctctttttttaaaaaaaatggtagggcatagtaatttttgtatgaattaaaaacggccctacttatcctttttttttccaaggagaatggatcccaagtccaaactgtcacaaagttgtgttcatggttacgttgagttcagtgcttttctctcctgtcaaaaaaaaaacaaagaaagaagatatgtttgtgccccaacagtttattttattttgttgtagaaaaattcttgaaatatatatatatataaatttactgatatggatgctactatatagtgacagctagggatgaacagacatgaagaatttacagagtggcacgtaggtaacaattgttcagttgctgcagggtaaactaagccagcacacaggagatggatctgttgatgtcaaagggaatcctgcatccaaacactctactggttgctggagggcatgtgctttcgttcttggtaaacatacaacaccttacatgaaaaaaaaatgatacttgtgctattaaaataaaaaaaatggcattttgaaatataccatttagctcacttagtttcttgaaattggtagtacggatccggccatgctgcctgttcagtttctccatgttctgaattcttacagatgctacatggttttcaccaattttccttatcttctattcccatttcaacctgtcttataccagttgcatcgatctgcaggttcatgtaataagttgcatattgaaattcggtttgttgtgaaatatgaattcatcagggacggaatgcttggggcagttggcgttcttcggggtgcagtacagcctggtgacattcctgacgacgcaattgcggcagggaaatgcagaagcagccaggaacttcagcatgtggcagggcacctgctacatcgctcccctcgccggtgccatcgtcgccgactcctgcctcggccgataccgcaccatcctcgccttcttctccatctacatcatcgtaagcttgatttaatcattcttgttgatttcacacaactttctttaacaatgacaatagttcacatcttaatttgctctcccaaaaaatgtaccatgccatccatccacattacgtactctctccgttttatattataagttgatagaaatttttcctgaccaaatttattgaaaaatatagtagtattttcaatacaaaacaaacatattatcaaaatatattcaaggttaaatttaatgaaactaatttgatattttatatgttattaaatttttatataaa

SEQ ID NO: 48968 - DNA, 1436 bp, Oryza sativa
ggactccatgaggagcctctgctcggcgctcggccacatgacgtgctcgctaggcagctacctcagctccgtcgtcgtcaccgtcgtgtcccatgccaccgcgaggggcggctcgccggggtggatcgccgacgacatcgacgacggccacctcgaccgcttcttctggctcgtcgccggcctcagctcgatcaacctcgtcgtgttcatctgctgcgcaaagcgatacaagtacaaggattcaatcaattaattgagaattgctgatcgaattgtgaatctgtaaattgtaatcagctcatgtgttctttagtttctgtacacgggaaaatttatgttttctcattgttatttttggaatagaaatcaagagctctgtgaattcactgggagtaaagaattacagctcaaatggcgaccacgttgactgtagcaaaaccggcaaaattgcaagacagataacatgtaaataaagaaaagaaactaaaccaacgtgcatccgaatttcttatctcacatgactctcgatcaatcatttctctgtaatgcttttcgattaggatgccattaatttgaagagtaatagattcttccattatgtaaagatttgaagacaaaattgttagttcagtttggttctattgtaaacaagtgaaagagttgatctattgtttgctacttttatttttcagtacgagcgtgtacaagaaaacctgtacctttcagcaaaggagataaatttgagtttctgctcggtcatggatttgaatcaatcagtcattcgctgtagtgcttattgattaggatggcatttgggctgtgtacatccttttctgggtgtagaggccagtttaatccattatttaaaaaaaatcagtttgactttgaagaagctttatttgcatgaattaatgcatgattacatcattgcactggactcaattggtaatgcagagacaacttgtatgcagcaccaatgcactttaagcctcatttgaatcttttgataggccagatgaatttccccacattgcaaacatgccaccgttgccactacttaactgaacaagtgaacaatccacttatcttatcatgcttcagacatttgcaatacccaaatcaaacacgaaactgcgatcgatacgttaaaattccttttcagctggttggaacacccactaccactttggatttgatacaaaaagctggttagcactaggaagcaaggatggtaagtgcaggtccattaccctagttagtgactttaccattgcagagcagaaaggaagaaccgcgttccagtagccattttcagaaagtggaatatctggatagaaaactagttagcagcatcagaccagtgcatgcccagccgcccactatcatgccgacttggcctttcggaaatagtataattcatcgatctatcgctttaa

SEQ ID NO: 48969 - DNA, 4454 bp, Oryza sativa
gaatcccgatagtttaacaccagatttgaaaatactattgtcagcctataatcagcaagtaagaaaatactcaaccaacgatttaatcgattcccacgtgaaaattgtattttttttggactaataggagttaaccttgcagaggagaaaatcaaatttgaggtcaatctgtgaaaacccagaaaatccccaacttttgcctctcttccctttttccttcttttctcctcctgctttccctgctttctgaaactcctcctctctgttcgttgtagaagcacagcagtagaccagcagcagcaacagcagcaacagcgaggaacgttagcagaaacagccacaacatggaaacatattagatcggtggcagcagcagcagcagcaaggattggcggcagcactcaccaaggaggagtcgagcaagaggaaacaattagtggcgcagaggcagggttggggactggcgctagggctagctgccacgatccctggtttctttttttttcttcttttttttttacaagttggttaaatagagagcctaatgaagatcaaacgacgtacattaattcaacctctaggaccttgttcggacttccattactctaaacttatactctattttgcactactcggcgagctctacgcatccacggttcctaatcgcctatttgaacaacggtttaaaattttaacttttgcgcgtttgttctaatatttcccgaaatacactaattcgatactcggggtatcaccacccccccccccccccgggcggatctggcagaggggagagcgcggtcgctgccgagattggtgagagagacggagatattagatatggacaggaggatggataagatcgagagatggatatggcggctcgctggctcggctcagtataggtagcattttttttaaaaaaaaccgacacctataatagattataggtgccagttttttctttaaaaccggcgtctattgcttaatggtgccggttttatgtgtttttagtctgcggatgaggggaaagaactatatatgacagttttaactgttccaacacctatagtgtcaatctctatgagcttttttaagtagtgcaactacatatgttgatagaggaatgtacagtgaactctagaccggtaagagaatcgatcttgaccatccatcctttctcatttagatccatttgttccaaatataaacatttctaaagtttttcattgagattaaggtgaagggataaattaaattaaacagaaaagggttttgattggttgagatatgatgatgaaatatatagttgcagaagttgctatatttagagataaactatatatgctagctagaagttgttatatgtatatttttttattacggagggagtatctataacattgccacccaattactgttagattatcagttttataatagaattcctaaattaatggttaaaatcatttttactgtgaattaatggtgacaataccggtagtattctactattagtcaagaccatggtaggttagaggaattgaaggcatgcttcactacgccagaccaagtcatctctgacgggcccaaaccctaacctttaacgggtttggtcttggtcagtgattagtggtcacttatgacaaaatcacctgtgatgggtgaaacacccgtcatagataactcatctctgaccggtatataagtcatctctgacgggttaaaacttgtcacccgtcacagatgtgtcatcagtgacgtgtcgtaactacctgaccgtcactgatgactaatctctgacgggttgtaacttacgacccgtcactgatgacaaagcaagaaatacaatttttgaattttaaacgcaacaaaaaaacctcaaaaaaatattttgaattttactagccatcctatacatggttacacatcactacccacaaattcacaatttttcacgcaatataacttgcatgctaaactatacatggttacacatcactacctacaaattcacaatttttcacgcaaatataacttgcatgctaaacgtgagattcaaactcaagacctcaacctccatagagagctcccttaccaactcacctactcaacacatattgactactcacccaatgttattattttgtctatgcttgtctgaatcatttaacatatatttaacaccctaaatgacttcaaatgaaagtattatcaactaaatagttatagatctcattgtgttttataacttttacatagaaaatatcttcatccgatgttgtttgaagaattcaaaatttcatttttcaaaatagatttcactttataacatgtattttgaacatgtaaactttgtcaaatgaaaatattttcaattataatgttgtagatctggttgagttctataactttgatatggggcatgtatccatccatgtcatttgaaaaatactcaaaaaaaaatttttaaacgtaagatctcatcacttgtaatgcatgttcggcgatgtaaacgatctctaatagaaatattgttagttataaagttgtggatatcattgagagctacaacttttatataggacatgtctcaatccgaggtgttttgtaaaatttaaaaatttgaattttcactcatcactgacgggtcataactaccacccgtcagagataacgttatatgtgacgtgtgttagttaaagacccgtcagagatgagtggtctcttttgtgatggttcataatactacacctgtcacagatggcatatcatccgtgacaagccatggttttctatgacgggttacaagtgtaagccatcacagatgacttcacatctgtgacaggtcctccatagtagccatatattgaagaggatatttttttggcccatcagagatgactcatctttgacgagttgcgttggcctgttacagataacccgtcactgaagcccggatttttagtagtgcttgtagctagacacccatttttaacatgcatgcatgtattatcccattatagctggccatattttcccacacaagaactttttgttggattttgtcggctataaaaattatatctgccaaacttcatgcttccaagatagactttacaaaatgattgatcgaagcaaacgccatgcaaaaatttcgtcaaattaaaacaaattaaacagaatacaaataccatgcgtttgaattattagagcacatcgtcaacattgcaatcattaaatattcaaaatagagcatatatatagaatcttctttggaaggcaacattgtagacacctctctttcactcggcgacctatagttgaacgagtctgcacatgtaaacgtaggaacatgtatgttgacacgtacgattaaatatttggccaacaatctctttcatggaactagtgttaattagtgcaccctgcattaatgacatgtgtatgtatatactaaatctatccatgtgcgtgcgtggtgcacgacagcacacacagccacaaaccaagtataatgataaaattagataataaatcgcgtacttagttctccattaaatttatatctctaattaagcacgtacttagttgccctttaaatttagtttcccacaggaagacggacacacacaagtgccaaaaggtagcttaggattgtgatgcacatccaaccatattaaggctaatagctagcatacttgtgtttcgatggagacaatcttgaaaagactagtaactgtttccctccgttataaatatgtatgctcacaaaatgaacacattaattagcccattaaaattaagttgagagaagtaatcatttaagcatatacttcctccatctcaaaatacaaggcacaaccattttttttctatacaagacgtccatgcatgcatacattaactattacttcttggttttttaaatttgggttattttaatttctctaccattaagtccccaatcacattgttgcatgtatgatgggtggttccaattgatgaggtgattaaattctttcttagtttttgtgtcacgagtggctgagccttatattttgggatgaagtaagtaaatacttttagtgcatagtacttccgcttcaatcaacacacgttgtagattgcatttgcaattaacacgactctgattaaggtgagtagaagtgatattttaggatcgaacaacaataactaagcctatcaaagagggtgaatggtagctacactaaaaaaaatttttagtagaattaaaatttaccccaatcgatagagatcggtctgaccggcttgattgccccggtctaaccgttagtccatcttggagaatagcgtctgtcgggccggcgaggatggcgggattccttaccgttgtctgagcccttgtggtggcgccgtggcaacaaagtggtgacgcggggaaaagcggcggtttcaccggctaggagagg

SEQ ID NO: 48970 - DNA, 939 bp, Oryza sativa
tttggaggcgatcttttcgagcatgcggttgtgccgcacaccccccctgaacgcgtagatcaccgcgtgtgcagggatgcatggtatggtgttgcggacttgacagaaccgctgaatgtacgagcgaagtgactcatcatcccttcgctgtactgcgtgcaggtccgcttcttcacctgggcgcggatatgtgccttgaaagttcatggtgaactgttggcacaaatcctcccaagagtggaaggacgcgggtggcaagttcattatccaaccccgtgcctgtcccttcagggccatgggaaagaaattcgccatgaccctgtcgtcacccccggcggcctcgatcccggtcgtgtagacctggagaaactcggcggggttgacgctcccgtcatatttttcggcgatggtgggccggaaccttgggggccaacggacgttccgaaggctcgccacaaaggctctacagccgacaccaccaaccgggggcacggagggttgatccccgcgtctgtgttgatgtgacactccggacgaggaggcgccctccgttgcgtgggcagcacgtcggccattacgccggcgctcgatactgatgcgggcatccggccccccacgcagatcttcctgggtcggaggcgctgacgaaggagtggcggccgaatggcgagctacagccgccgctcgccgcgccctccgccgaaccgagaccgcgcaggcccccctttgccggttcggccgggggccctgggccgcttggacaaagagcgccccagggatgtggcccctagcgaagaggatcggccccaccgaaaggtgcagcggcccgtctactttgttagtgaggccctccgggacgccaagacccgataccctcaggcccagaagatgctttacgctattctgatggcttcaaggaaactgcgccattatttccag

SEQ ID NO: 48971 - DNA, 1989 bp, Oryza sativa
tattagtcatgttagttaattaagtaattaattaattgagtagttagcgattaagcagagggacatagtagttgctaggaaaatactgggtttgaaactttgacgcacgcatgcagcgggattggcctggcaaactatgtcctgcagtctgcaactggagtagtagttttcttacatgcaaatgtcaccattgacttgcagcaggagtattactggccaggtgcatctatctgcttacctatctctacagaaccgtaccatattataatgttttgttctctctatctcttgactattgtctagcttaattcactaacatctatataaatttaaatacatatatagatagcatatatacttgagataaagtctattttccttcatcgaactagttcactagatcatacaacccctaaactattttttccctcattatataacctatacaaacggtacacgttactctataatggtatttcttttttttctctccacattgtcatggttatggattgcacatacctaatagtagttgactaaatctcggaaggacccaccacatatcatgtcctatacggaaacaacctgcggatatggagggagttccggataaggaaagacaaccagagttctacatggaaacgacaaggactactcagattgtatccatattggtttcccacgttctacttgtacaaggggacacctatgggtataaatacaagaccccctaggaggagaggggagaaccaccatggaagacacccatgacaatcaacacacgcccaccagaagccacaacatacaagcctacatacgccaagacacgccgccggatatcgacttcagggataggcatggctattcccctacggtgtctccggataccgtcaggagatacgaaagcgctatctctgatctcgccgggcacggattcgagaaggaagactaccctgttgtcgactacgagtcagaccttcagatcaacatgtggacaacagttagatatgctgcccacatattgtactggtgtgattatggtgaataaaagcaactccggctccggccaacaggatgtagagttattacctgacagctcaggggcctgaacctgtataaaaatccccgtctccgtctcttttacctcagtctcgcgtatatcctagcaccgacgatccccatactgtccaaataccgtagtcgaaacatcaaacgtcgacagtggcgcgccaggtagggggattttggtacttcaggatttcgacgagatgggtttaagagatggattctccaacaacaagctacttgacgacttccgaccaggaagattcaacccggccagagtacgtctcccaacgagattggaatcatcgtcaccatctattcgatccggtgagatcgaccaagcttcgacacgtcaccacggcagagggccatggtgtcagcggcatctaagactgatccaacaccaatccctcgacgcgtgggacatcgactggcgtaaggcattggctgcccgagtagccaaactcggctggcgtgaggcattgatctgttcattggcttgtagtctaatcggagttgaggagttcctgtgattgcactagaattcaattcctagttggcaatcgagctgctcattctggtgacgtaagccaaaagcaaatagatcaactaaacagccaaaaagccgcagtacaaattctaaggtaattagtaagattaatttcctaattaatctactaatttcgtagatatatccggcatatatctacaaaggtacgcaatattttatatataatttaccgtacctattttcagattatacggcattgtcagatctataatttattatgtttacctagagcatgttctttatacagtatatatcgcgcgagcgtccccgatgttaggccaactgcggtctaacgctggagcacgctctgttttcctctgtataaatcatgcttgtttacggtttacataatg

SEQ ID NO: 48972 - DNA, 1227 bp, Oryza sativa
gaacggacatccggatatgctgtaagttaggcacgtgagtcatgctggccacatgagatacacttgcaataaaccaactctagcaccttccatcggtgttcgagagataattccgctcgctcactggttctcgcaccagtacgcagcaatctctcgcaccgcaccttccatcggtgttcgagagataattccgcttgctcactggttcccgcaccagtacgcatcaatctctcgcaccgcaccttccatcggtgttcgagagataattctgctcgctcactggttctcgcaccagtacgcaccaatctctcgcaccgcaactcccatcgttgttcgagagataattctgctcactcactggttctcgcaccagtacgcagcaatctctcgcaccgcaacttcagatggtcgaggtacgactacagcaataacgtagtggtcctcgtaccacgactcaaaatgatcgagagacacctactcaccggttctcaaccagttaatcgtagtgatctctcgtacatttgcttctagtggtcgagttacgactactgcctggtcctcgaccagcgatgtagcgtttctcccactttccactttaagtggtcgagttacgactactgcctggtccacgaccatttctcccactttccactttaagtggtggagttacgactactgcctggtcctcgaccagcgatgtagcatttctcccactttccattttaagtggtcgagttacgactactgcttggttctcgaccagcgatgtagcgtctctcccactacttccactttaagtggtcgagttacgactactgcctggtcctcgaccagcgatgtaacgtctctcccactatttccactttacgtggtcgagttacgactactgcctagtcctcgactagcagtgtagcgactctcctactacctctatttcaacaaagttgatagcaggtacacaatatcgccaagtgttttacccagagatcccttaccacgacgacctagcgttgaaacctatcctactgtccctttacgccgtcttgacaaggcctccgaggaacctaagggatcttccgttggggatgcccagagccgataaggccttgtcggatccttcagagacgaaagaccatgtaagatctggtcgtgtaagagttctcgccgtgcgtattaaccaagccgtgtaatcggaagttgacttttccaacttcacggctgggggct

SEQ ID NO: 48973 - DNA, 5671 bp, Oryza sativa
  unsure (1)..(5671): unsure at all n locations
cggggctcagggaatggccgggcgcgtggcagagaagggtctagggctagggaccaaaatcgaacacctatgaggcaatgaacagtgacttttcctatttatcccgattttagtgtattttccatataaatttgattccacaattcctaattttacatatatgcattttactcaatatttgtgttatcttaactaataattcaccctagattaatattactcatattttatttttatataatttatttgagttttaattagggttaattcttattccatcgtatttaaatttaattgatccaaatatggtcgcgataatattttatttattactatccacacctaatctttatttttaatttatatttattttaccaatttgtttttttaaggtttattcctgattaactattctttactcacgattaataatcttcaaaaaaaaatccagataaaataggcgaataagatcagcatgatgcaattaatttaaaaaagtttttgaaaatccgtatttttagagttttgattttgtcggtccaattttcagggtgttacatgccacctccccatcttcgctttgcagccgatgccgtcactagtatcctggagcgctatcgccaccacccttctctggatctctttgacggagagaagtagagaggataactctaagggagaaggagaaagagggaaagtctaatattctaggagcccgcatataaaattatttttataagcaatatttttagagggccgtatgtataaatagagttgtttttatacatggttatgctaatacgactgtctatttctacaaagtggggttttttcttagtctgcctttgaaaataaatttgaggtgctaccaaaatacttttcttatagcgtatcacattctaagacaagtttcacttactttggttaaatatataggagtatactatatatacatgaaaaactaggcacgcttgcccaatggatgcaaatacatacattttgaacgttcaacgacatgggaccagtgctttaactagatagtgctataattaataaaaccgggcaaccggccacaagctggtgaggaagaataaacgatctggatagcttaatttaattataaatcataattcttttttatcaaattgttattcttcatccatcctagcttcatgcagtgtaacgaatatatgatccttgtcttcacgtacctcttaattaaagctaagttgtgagctgttatgttacctctctagtcaatattgctatgttacctctctggtcaatatattactccattcgttgtaggttataagatgttttgactttggtcattaagtttgactaagtttatagacacatataataatatttatgttaccaaattagttttactaaattaataattaaatatatttttataataaatttatctttggtcgaaaatattattatttttttctataaacctagttaaacgtaaagctgtttaacttaaacctgaaacggaggtggtatataggagtatgtgtgtacgtactgtacgcgtgcaatgtatttttgctatgaacgtagtacaatataggagtatattatgtggctgctatatatacacattgcagtgagcatactctggccacatcatcagccaattaattgttcatcacaaattaagtgatcatggatgcacattagcccacaaattaagacaaagatcgctactgttgtcttgaaagtggcttctacgtaccaagcttggatttgtacatataatgcaggcagacatagctaacaaggccaactggcatatagatggttggcagatagctctttcccgttcatgatatatatcgaccgttttcgttaaacaactaattggctgcattattcgaggtttctatatattatgctagatatatatgtgcacaaatgtacgtgtgtatatatatgttcacacatgtcaataaagcagaaaaataagaatatactccctctattttcatgttataaaacgttttgattttggttaaagttaaattactcaaaggctgtgttcgttttagcctcttcttaacccatctccatcattttccacgcgcacgctttttaaactgctgcatagtgcgttttttgcaaaaagtttctatacaaagttgcttaaaaaaattaaattaatccattttcgaaaaaaaagcaaatacttaattgatcacgtgttaatggactgctctgttttccgtgcggaggaaataagttcccaaccgcctgaaacgaacacaacataagtttaactaactctatagaaaaaagtagtaatatttataacaccagcatagtttcattaaatctataattgaataattttttataatatattagtcttgggttaaaaatattactacttttttctacaaaattagtcaaacttagagtagtttaactttgactaaagtcaaaacgtcttataacctgaaacggagtgagtactatacttttcgtatatagtcacagatttttttatatggtttatttatcaagtgtatatatatgatacttgttttctatttttcatgtgactgtttttattcttatcaatcactttttttcaacaattaatagaatattaggattcgacaacttgcatatctattaagtttcaacaaccagaaaaataaaaaaaagtgaatataattttgagtttgtactgaaaacttgcatcgtttttatataaagcaattttaagctagatttacattttgcaggtttagttgagtgataaacgagaaaaaaaaacatcgtgttgtgcaaatttagatgactgaaaaaaaagaaataaaatagataactgataaataactaatatggaaatttttattttttaaaagtatatatgtttgtatggtagctagccagcatatgcatacgtatacacacacgtgtgtgtacgcgatacacaaggtgcttcgcaaaggtgtttagagggcttttagctgcttcatttttttccagaatcaaaagttttctccaaacaatcttgcttcaggtccagattctagaaaattgtagaatgaaaaaaataaactaaaagcaagaagctgaaaaatctagctttttccgattctcataagccggttaccaaccagctaattctgagaattttaaactcctcaaacagctcctcaaactggctgattcttagaattctcagaattaattcgatgattgtaggttgttggtcagcagcgtcagattttaatcggttgttcgtatgacacattcgatcgcttgtcacatttctagacggtacgcgttgagcactggtagcctggtacagcgctagtatacataaatgtgcctcgatttcgctatctatcgagaaataattaattacacccccgatcaatatgcctgcctccactagttcttaatacatacccatatcatctttacggaaaatcgaactataactaattatgatttttttggataatatataactataagtaatgatagtgaaattgataccctaaaggaacttaattaatttgttgccctatcgatcggtacagaaaaaaaatcctaataatggtgaaatgggtaccaaaaggtactttgttgtccctgtcggtaaaccatacttaagtaacattacctctacgattccttgaaattttcgttatcgactaccaccgaaaagaataattagctgtaaatatatatgagcactcatgttagttaaatctaggatttattatttgaacctaggtggagtggtttccttaaaaaaaatctaattagntgagttacattcacttcgcagcaatataatggtcgattggtcgtacggtcgtgggcttccatttgatttatgattgattaacgtacgtacccttcanagtgagtggtccagtatgtgttgatctagccttattattggactcattatttttcctagatgccattgtataccttgaggttcatggacggtccttaaacactagcacgtgttatcttgttcttaaactttcaaatacaaattcagatctttaattaatccatcacaagtccaaaagtgtcatgttttctactccttccgtccctaaatataaggaattttagttggatgtgacaaatcatagtacaacgaaactaggatagcttgtctagattcgttgaaatatgatgtgtcacacctaaccaaaatcccttatatttagggacggatggattatcttttatgctactgccttttgtgacttagctacattaattttagttacttccttcatttcatattacaagaatttttagcattgcccatatttatatagatgttaatgaatctatatagcaaggctataaagtcttgcaatatgaaatagagggagtactacgtacgcaccatatgtttggagcactggccggcgggatctagttctcgacaaattcctaaggaaagaaaaaaatcagcattaatttttattaatgttttagatcacatatgttttaattatatttctccaaatttgccccatttattcactcggccagacataaattggtacacatgtgtgtaatagttgagtctaaagcattaccaacagatcgaatatataatccgctctcaaaaatttgttattgggtttttaaattgaaaattggaagtgaaaaaactcatctgagaaaacctaaatttaataaaaactaaaagtgagcccttgttattttttgcggtttttgcaggaaaaaagtgagcccttctattaaattaccaactaaaatctttgtttttccaccgtccccgcgcggaaaaagatcactcctccagccagcccacacgtgggaaagaaaaaaaagcttgcaggaaaaagaaattgggaacaggagtggtgtcgatccacctcaaatgaagagagcgatgaatgcggtgatagggttgccaaaacattactccctccatctcagaatataaagagttttagagttgacactgttattaagaaagtaggtcgaagtgaatggtggaggattgtgattggataagtaatggaggtaggtggaaaaagtaaatggtggagggttgtgattggttggaaagataatgttgggacaaatcttaagagttaaaagttgtaatatttttgaacggaaggaaggagtagtatcagcataggacatctgttagaggttttcttttaccaaaatccaaaaaagtcaagatcggggatgaaataagggtattgatgatgctataagctagcagtgttaattacttttttttaccaaataatgatgaactccaacccagctttcataaacgtttcaggcccttctaaggtctagctaggtacccaccgtgccatatcatgtcaccattcaagaagtcaagtgcatattttatttagcaattttactgtacttcaggaggtaccacgaggaaccattttttctatggacgtaactacatagctagtggtagctggtttgtctaccactctatctataagagacaccattcacctatacttcaaatacaattttctcttaaactactcatccgatctacgatccgattacaccgttgtgtttgtaacaattaaatcttacaacaagatctcacatcattatattttgaaaaaaatcacaaattacttttatgatatgtctaaat

SEQ ID NO: 48974 - DNA, 1359 bp, Oryza sativa
tattttaatcaaatctaaaaataaattatatatatggataatttgttcaatgaaaaaagacattaattaaagttactttcttttttgttataagttacttctatataatatatgtaaattacttttaagctttactaaatttacttttatatgtctaaaaagtaacttagtgaaatctaaaagtaatttagacatatcataaaagtaatttgtgatttttcatcaaaatataatcatgtgagatcttgttgtaaagatttaattattacaaacgcaccggtataatcggattgtaaatcggatgagtaatttaagagaaaattttatttgaaacatagatgataggaatatctcccatacttacttaatggactagtactataataaagtaagattcttccatcaacacatatctagattctggataggcgtcgctagttatgactaaatcgagagtgctctcgaattagattttgtgtttttcaattataaatttggtacctcatagtatctagatactaacaggtaccaaattttacactaattttttaatacctcatggtatctactcaaggaccatagaattgctctttttttacagctataaattaagaaaagcaatagtacttactcaacgaattcgaaggataccaaaactacaacactactttaaaaaatgtctatagatgcaggtttaggaaccgcctgatctgacggaggagacggtgtgagcgccgcagccgcagccttccatcccgccgcctcccctgtggctggatttggaggaggggagggcgcggatgccgccggcctccactgccgtctccaccgggccaccgttgcctcctcggccggaccgccgccgaggtccgctacctctcccctgtaacaccccaggtaaccacgtacctagagtgccacaccaaaatatattcaaaaccattaactttcaaaattattagaaatttcagcagagtctcccctataaatacggacatccacgataggcagttataagataaatcaataacgaaataattcatactttccaaaccatcctagttccataaattccacataaaaatacgaaccagaactttaattgacctttacaagttctacgcaaaacttatactaagcagaatcataatctaaaacaaaatttcaatagtacaataaaatgtgtaatccaagggagctacttcttgcccatgcatgctgatctcaatgtgtacctaaaagcaaataaacacgagtgagtacggaaatactcaacaagtatattatggaactagaagacacgcatacacatcatgcgtaataaagcctgaacataaaactttcttttttggaaaagag

SEQ ID NO: 48975 - DNA, 4943 bp, Oryza sativa
  unsure (1)..(4943): unsure at all n locations
cgtgtgcccacctgcatttagcattattgtcgtggtcgtcagctccggcgggcatgacggcagaactgaaattgagttcgcgggagaagtgatacgagtacctgagagggcgacgaggtcgacgtcgttgaggttgagggtggcgaacttttggcggaggacggtgaggttgtcggtgggggccggcaggttgagggagccattgaagtcggaggtcttgccgtcgagccgccccagcagcactccccacccgggcccacctgactgtgaccgacaaagagagatcgatccatgtcgtccaaaaattattacttgtacgctcaattcaattattcatcgatgagttgcacttgtgaaccctatatgctatatatcttagatatgatgttttgtagtgcatgcagcatgcatggtgcacacgacaagattggtttcagtacaacagtgtcgatcgatcgtcgtcttgtgtgtgtgacacacacacacatatatatatatatatatatgtatatatgtatatatgtatatagtatatatatatatatgtatatatgtatatatatttatatatatatatatactagaaaaaatacccgtgcgttgcaacgggtgaaggttattttaaatttattatttttatatggtttagttaagatgaaatttaccgtggaaattcgcttggatatatatatatttagaaaatcatgagctgtagttaagagtccgttcgtcttaagttagtatacgagttttttttaagagatttcttatacagctcattatgtatcgccaaaagtgaacgaacttaaaaccaactcaactacaaatatgtatttccacaagcgatccttctgtatttctaatagcaaatggacttaaaaaccgactcaaatatgggtatatatttccacaagcgaacgaacttaaaaccgactcatacacagatgacgtatcaaagtagcggcaaaaacatcttcaatttttataatagtagatagatatatatatatatatatatatatttatatatatatatatatgtatgtatatgttgatgctgatactttgtcctgtcgtaatgttgtccatatatattatacacaaactgtacatgtatatatagtagctagctctacatgtcttcctttccttggataattaagtgtggctttgttgttagcatgtgtaatagtttacagataaggttggcgtgagccgtaaaatgtaattaagattatccaatgatatgatgaaatatatatacggcggcatacatatgcatgcatgcaagcaccgacgacgggcctgtcaaatcactgttgaatgaaaaggtggtacgactgctagacagcactccaatttgtttcttcattatggttactagacctgtctatagagttacttcctccgtctcaaaatataagggattttgtgtaaatataacacatcctagtttagtactataaatctggatagagaatgtctagattcttagtattaggatatatcatattcatccaaaatcctttatattttgagttggaggaaggatagatgcatcttgcaagcacttaattaattcgagagacacgtacaaactaccaataatcatcgatcggcccaaccatatcacacactgtattgtgcaaccatgccgcatattatgatgatattcccacgtagctaatatgattggataccatcgaatccatacaattaagcatgcatgttaatcacgtacttctgtctgtaacgagctactattacgtnctgtgctgtagttagtagttttttatggggctcaaaaaatatgtgaagatatctaaattttacgttaaaaccttctactacctcaagatgttatctacccgagatactaagtttcatactagaaaattataaggtaactctcaatacttttataatgatgataaaattaccatggtaataataaatgaagttaatgaaaattaccagctcgacggagatctcggcggcgagggcgaggatgtcggcgcaggagacaacgccggggcaggcgtcctcgagcgcggccttgacgtcgtctacgacggggaatcccctcgcggagttgttgttgggcggcgacgtcttctccgacggcatcccggggacgctgtccagcagcagcgacgcgtcgcacccctgcacgaagcagtcgtggaaatggagccggatcaggctcgcgaagatccgggcgtcgctccggtgcgcatcgatcagcacccgccgcacgatgtcgtacgcgtcggggcacgtgcagtcgtagtactcctcgcacagctgcgccaccgccgcgccgccgccggcgaccagcgccaccgccgccgccaccaccaccaccgccagagaggaagaagaagaagaagaagccgccattgctagctagctagctgctacacgactactcctatacggtcgtgtcgtgtgtgttccacgagctaacacacagcgcctctcctgatttatagctgcccaagtgtactgtgtgttgccgatccattatttgatcatttagctaggcagctggggcagctagctagccaaactaattactccctcctattcgaaatgtttgacaccgttaactttttagcatatgtttgaccattcgtcttattcaaaaacttttgtgaaatatgtaaaattatatgcctacataaaaatatatttaacaatgaatcaaatgatagaaaaagaattaataattacttaaattttttgaataagacgaacggtcaaacatgtactaaaaagttaatggcgtcaaacatttcgaaacggagggagtattacatttactctcatcgtttttacttatttattgttacgcatcaagttgctgttcgtatttttgtgcatcgttatcggttgacatggtagaatatgtgaaggataagtatatgtaatccaaatggcttggcaataatgctagtctacagagttgtcaaacttggtctcctctagactgagacctgactatgaccagatgactacttgtgcagatacttgcaaataatacgacatgtattattcgtgtgttgggtagtgtacctactggttttttccttaatttgcttttctttaattttaagaaactaataatatatggatatatgttaatctatagctagtggtacgtgttgtttatcttatctcctctagacaaggagcagtccaattctttgcaacgaacatatcacaaccacatgcatttactaatatgtttttgggagtgaacatgataatatatatgtttaagataaaacttattacatcatgcatagtatttatggataataccttttggcccaatctcacagctataggtttagctttgcttggacaggacaatatgcaagaggcagaaaacgtcactgtcatgtcttgcaaaggccaagtaaagcttcgtttcttttctaatcattccacggcggctatacattaatttatagctttgcatgcatgcgtacatgttagctagctatgatcgatcacacgtgaaataatggagttaattaatcaaagggccatcgtttgttcatattataggtacgtaccgttgtgttttaatttgtacatatatttctcgtaccgtatgatactagtacaaataaatgtctgctaaaaatctctatattttttcccctggtccgggaaagttatcaagaaatgctactagtaaatcattacaatcacgtacaaaacaagtttctatctgaatcagtagaattgatcatatcactactacgaaacacgttttttcctaacggccaaaatacttcttttgcaggtcagcgcgcaccccgccccgcctgctaccaaagccatgtaaaaaattaatccacgatcttcatagacatgccattatcgctcgttaaaatcgattttcatagacggccaggttaagtcaaccgactgggaaaatgattttaatgaaaaaaaaaggggaaaagatatcccccacatcccattgctctccgcatgccgcaccaattttcatagatcaaacaacaaataaagcaaaacaggaagaccaattcatcataattgaaaatcaagttgctccataaaattttgtattcacaaatccaacctaaattcacaagcaaaaaagggaagcagcctatgtggagctgatgtaacagatgcaggaatctcatggtcacaagccatgcatcacccccatcggatccacttccttcaccactgctggtggatcataagctcccaatcactaccggcaccatatccatctcctccaccaccatccacatctcccctttgctgccgctgccatgtggaaccccgtttttataacaggaatcaatcgtgtaaacagtaccatttccctggatcaagtagtctggtacacacgaactcatagctgaaatatcaagtgcacatacacgagagtctaatacgaattattacatcataagcccgcaggcacagtcttaaatcatcggaccgagcggtccgggatacatttcaaaaacagaagtaggtaaggcagcggagttaaggcagcggcacgccattgccacaggcaacgaccgtaactaagacctactgagcgccatcgtcttcatctccctcctggtagtaggcatagggatcctccgaagcttcatctcccacttctgattaattttatatttgcaagggtgagtaccaaccgtactcagcaagccaccacagcaatgatgcacacgacagaggaattcaaaggatggctatggttcttttgcgcaaagcaagttttgtaattcttttcacaagcctaagacctagcatagactgatcaagttttaataccagtgttcatattaaacaatgacggttctgtccaccatccattgtgatcccaaggatagcttcccgcccctgggtcgttatggttttctgaagacgtccatatt

SEQ ID NO: 48976 - DNA, 1429 bp, Oryza sativa
  unsure (1)..(1429): unsure at all n locations
caaccgcggcttcctccagtcggaccaggagctcaagtcggcgccggaggcgaccgggacgacggcgcccatcgtcgaccgcttcgccaccagccaggccgccttcttccgcagcttcgcgcagtccatgatcaacatgggcaacctctcccctgtcactgacccttccctgggtgaggtccggaccaactgcagaagggtcaattaattatcacttcatgtatgacgttggttagtttaaaattgaagtaaccaacgtcatcatgtcaaacataattaattacgtatgtgtcgattattattgttgttattattagcaaaatgagagagatttatttgtgcatagttaattaagcgcgcttgcatttgtgagaaatattagtagtccagcttaattaatcaaggagaagaggatggaaaaaagaatgtacatgtgttcaatttggatgtgtgatcaaggatctattatgatcacgcccctccagcttaataattggcccatgggttgaccaatgtaattgtacgtaccatgattgtgtttgttccaaattaaaggtgcaataaacggtttacatgtttgattccatgtcccacttcacgttttatttattgttccactatatcatcaataactttatattgtcagtcaaaaccaatattaagcttattattttctgaaaaataaaacaaaaccaaggttgcaaaattacgatgtgtatttatgtttaaaaattaaaagcattcgttaagagatacgcatggaggaggcttgcacccttacttgtgttttaacattctctttttaataacaagtgcagtatttttcttttagagaaaacgcatcacgcccagctttacttaaaagcatactactccatcccaaagaaaacacaatcctagtgtgtcagattcattgctaggaatggtctttctttgagacagatagggtaagagataacaaatgcagtattacttccggttttcctaccaactaaggataatgcacactgtcaagctgctcacaggtggatgcctcattcatatggttggggcaactccaacacgagcccgtcgccagacactggaactggtcttaatggcttgcccgacgccggacacgaaatcaggtgtatgcgagacctcctgttatccatgcgaaccgatccatcggcatccagaacgcgatttctcgctaaacatcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 48977 - DNA, 5361 bp, Oryza sativa
  unsure (1)..(5361): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnatccgaaacaaaccaatagaaactatgacatctgtaattgttttgttacccttgagtgaccactatagtctctgtaaacactagcaacatgtggtactccatattttaactttcggtttgatagaccagtcgttcaaaatagtttttaaagttaaaattagttatctgaaaacacttgttgcaaacaatggtatttgataaactaatcattcaaaataattttaaagttccaattctgttatgtatatcatgacctatgaactgaaagaacacacgaattaaagcaatggcaatttatggtacttgattaaagcaatgacaagcacacgaataacaggaacagctcctttcaggaatgttacatcgtccagaaacatcagcaggatgctcatagaattttccttcagactaaaacatatattagcaatgcccagaaacaactccacagctggagttgtcagagaagctacagcaatttgcgattcaatgactgaatcgacaggaaagttgcaagatgacgaacagtatagtagtaacatttagaatgcagaggaactaacagctaatataaaaactgatcataatctcccgaccttacatcattaggaacatactttactcttttcactttcaggtcagctaaaacaaaagcagcagcaaatagaagaaaatcaagaagcgacgggcttcaaagctgcagatggcagcctagaagaagtgtgcaggaacacagatggaactatccccaaattatccacagaagaattttcggagtaaaagacaacctggtttctacctcaaacgaatcggaatagctatacaacatttgacagttttttggatgaaaaactttcatatgaatttatacctcaatgccatatgaattagcacacgagcttaaaaacatgtgcaaattcaattaaatttctgtcacggcctaataccatatgattttaaaaaggacaaagttataattgaaagaaaattttatacacagtaaaatttatgagtgtgtgtactccctccgtttcacaatataagtcattctagcattttccacatttatattgatgttaacgaatctagacatatatatttatctagattcatcaacatcaatatgaatataggaaatgattgaatgacttacgttgtgaaacagaggaagtattacttagcaaccctgtagctgtatctcgtagaagagtaaaccgaacgccagcaggtttacacagctgaggccgaacatgagccagaagaagcaatccagccgtcatcgattgagatcgtcgggaatccacccgccgccgccgcccttctccggcgccgtcgcccacgcgaccaccgcgacgatggcccgagttgaggtagcttccggccgccacggcgacgaggctcaccgcggtgcacaggctctttatggtgtcgggcgcctggtcgtagaagaactcgagcaggccgacgctggtgaacacctccgccgcgcccagcgccatgtacgacggcgcctgccacacgatgctcgtcgccgcgcgccgccggcggctcgcctcgagcagcgccgagtacgccatggccagcgccgacagcgccagcccgacgccgagccgctgcagctgcgacaggccgcggcggtcgccggtgacgcggcgggcgagcggcatcagcgcggcgtcgtaggccgggacgcagaggaggatgctgaccacctcgaaggtggacagcgtcgccggcggcacgtcgagcgggccgacgcgggtgtccatcgccttcccctgctccacgaacgtcgacgacatctgcgccgtggcggcgaagaagaacaccaccgtcggccacacggtggacagccgcagcagcatcttgacctcctccacctgcgtcaccgtgcacagcatccacgggctcgccatcgccaccgccggcggcgacgccactacggccgccttgtccaggaacgcgaactgattggtgtgctcgatgatccggtagtcgccgtcggggagctgatgcaagagcgagctgtcgcccggaagctccacgccgcgatttctgacggcggcgacgaccacctggcagagccgcgtgagggggctccccggcggcgtgtggaacgcccggaggccgcacagggtggagcagaagaagaaggcggcgagcgcggcggtcatgaccgccgccgggatggcgaagccgagccaccagccggcgcgctcctgcacccacacaagcacggtggccgccagcagcgagccgacgttgatgcagaagtagtaccagttgaagaaggacgccctcgccgccggcgccgcgtcgtcgtcgtcgaactggtcggcgcccagcggcgaggcgcacggcttgatgccaccgacgccgagggcgacgaggtagagccccaggaacacggtggcgcggaggacgccatcggaggatgcatcaaggtgtggggttgcgaacgacgccgagactgtgagcgtgatcatcccctgtcacagattgaaattttataacgaaatttcagaaatttttcgttctttattgttttttcagtccactggtgaagaccatcaaaataatttgtgaaacaaaaattaaatcttaaattttgattgacctttaagaaattcttgattgccataagaagatgttcttttctaaagaacttgtgaaaaaaaaacataatatcttcttaatttttgcttgacatttcgcagaaattcttgattgccataagaaatttattgttctctctctttttcagtccctgtaaagcatgaagaccataaaaaaatttgcccaaaaaaaatcttcttaagctttgcttgacctttaattccgaaattctctattgtcatatttgatatgcttttgtttgttatctaaatcttgttgtaaaaacatttcattcacaaaaatgtctgaataatgaaaattgaataaaggagtatgatatattttcacattaaaaactaagaaaaatctcttcaaacattcagtttttcgcattaacaaaaaacttgtttgagcatacttttcttaataaataaaaaagtataccatggagtagatggagaggaagaggaggatggtggtgcggcgacccaagaaggagtcggcgatgaatgcgccgacgagcggcgtgaggaagcaggtgcccgtccacgccgacacgtccctggcggcggcgacattgctctcccctaccacgccggtgaggtagctcaccaggttcctcgcgatgccggcgaacgccaggcagtcgctcagctccgtccccagtatcagcacgcacgccctccacccaccgccgccgcccttgtcctcctcctccttgccgccgccgccgttcggacgaagcagcagaggcctcttctcctcgtcttctgctgctgctgccgccgccgccgccgccatggagattttgcttccactgtgtctgtgtgtcttgctaggagctactagctcatggacttatgtcatatcgtatttccgagtgaatatttaagaaattttgatgagaatttagtgggggaaatttagattggagagaggagttaggtgtatgcacaagctgcaattgccaaaattgatttttgggatttgactcaaggtagtgtacatgccaacttattaaaaaaaaggatttttgttacgattagcctgttgtgttggttaatctagcgttgctgaaatgatggagtattttaagaataaaaaaaaaattctaaccttatatagattatttttttctttcatctaattttattattggtctatgattacatgagaggagaaatggggttctatactatagagttgcactcatagaattgatagttgacgttttcttttctttcttttttttttgaaatgtgtatgtagtactaatatctattgagttatttgttagaatctggtttccttatcggagattgaactagccattattttagctaatgtatttttcctttcagcaaagaaagctactctacaaaccttattaatttcagcaatgatagaggcaacgcatttcaattatctttagaaaaaatgcgcaagctgcattcgtagaatttgattggttcatgtggaaggtggggtttggatccagggacttaactttagtccctgtctttagacactaatttagagtattaaatatagactacttataaaactaattacataaatgaaagctaattcacttgacaaattttttaagcctaattaatccataattaaagaatatttactgtagcattacataggctaatcatggattagttaggctcaatagattcgtctcgcgaattagttcaagattatggatgggttttattaatagtctatgtttaatatttataattagtatccaaacattcgatgtgatagggacttaaaagttttagtcttatctaatcagggcctgaaatctgagccacgcaaaccaccaaccgcacgacaaggttaattagggcctgttcactttgatgccatttccaaccttaccaaattttgataaagttatcaaaaaagtggctctatttagtttgctgccaaattttgataactatataagaaatcctaccaaaattttggcaactatgccaaaattttggcatagttgccaaaatttggcattgccaaaatttggtaaggttttttttggcgtcaaagtgaacaggcccttaatttccatgtctccatcacactcacagtgccagcggttatactgggcagactagtcattcctctgttcctctttccacgttcatctgtaggatttaagggcctgtttagttcacgaatttttttttaactgtcacgtggcatgtttgaccggatatttgaaggggttttcggacacgaatgaaaaaaataatttcataactcgcctggaaaccgcgagacgaatctttcgagcctaagtaagccgtcattagcacatatgggttattatagcacttatggctagtcatggactaattagactcaaaagattcgtctcgcaatttccatgcaaactgtgcaatatgttcttagacagaaaaagtaggtagtagcacacattaattctagatgaagaaaaaaaaaactatgatatctctcattaaataatatgtggtgaataaaaatattgttgggagtaagaccggacagaagttctaatgattgtagctaacatataaatttataaaaaatgttggtcaaagctaaaaagtttaataagtataactaaaaccacgatgaatttaaaaggagaaagtacacaattaat

SEQ ID NO: 48978 - DNA, 707 bp, Oryza sativa
agctgaataatagtttgaaggagtaaaatggacgaatttccttaatccgtttgttctttggttaattaacgatgagtgtatttgtagttgagtgtaggcatcataggtgatggaaatattatttagtgcacgctcgctacttctgattctaaagcaccacttcttttaattcaggtgactcttaacatatcacacgactcgcacagaggactcccaatgtgcgaatgagcattcaatgagtacttctttaagtaatttgatttttgaagtgattttgaaaagatttaacatttggatagaaattttttagttgcacaaggtccagttgaaaaactatactcaaaatttgaaatctttgacttcaattaacacttcaaaactcaaaatttaacactttcaactataaattttaaaacttcctcccaaattcggaactctcaactcaaaattaaaacttttaccaaaatattttaaacctacccaatccaactcaaaatttcaaatattcacagaaaatttttaaaacactatccaaattttgaactttcaacacaaacttttaacctttcaactcaaattttgaatttttttaacttagtaatttatttataattattatacaatttcatcaaggggaagaaaaaaaagtgtgttagcgcattgtcccctcactactcgcgactcgtgtgtgactctgattcaattcg

SEQ ID NO: 48979 - DNA, 3253 bp, Oryza sativa
tgaactatctagattattaatttctactgccagtaataaaacaaattatgatcaggttcttgaacaaggctgcgatagtggtgacaccatcgtcgttaagcggggagaagggtaacgtgccagcggcggcggcgccggtgagccgatggcggcagtgcacagtgacacaggtggaggaggtgaagatgctggtgcggatgtgccccatctgggcatgcctggtgctcttcttctcggtgagcagccagatgtcgtcgacgctggtggagcaaggcacggccatggacaaccgcgtgggccccttcaccatccctccggcctcgctcgccaccttccactccatcggcgtcctcctctggatccccgtctacgacgtcgcgctggtgcccctggcgcgccgcgccaccggcaagcccaaggggatcacgcagctgcagcgcatcggcgtcggcctcgccgtggccgcgctcatcatggcctactcggcgctggtcgaggagcggcggctggcggcggcgcgcgccggcgccgccaggacgagcatcctgtggcaggtgccggcgcagctgatgcacggcatggcggtggtgttcaccagcatcggcaagtcggagttcttctacgaccaggcgccgcgctccatgaggagcatgtgcaccgcgctcggccagctcgccatcgccgccgggaactacctcagcgcgttcctcctcgccgtcgtcgcctccgccaccacgcgcggcggcgaccccggatggatccccgacgacctcaacaagggacacctcgactacttcttctggctcatggctgctctcttgctcctcgacctgctcttatttgtcttctgcgccatgcgatacaaagggagcactgctgcttcttgatcgacccacccaaaaatgtcactctatgtatggcatttgtaggactgtacaaaaattgaattcgaaaatattttatgattcactaatattacatagatgaacccctttaactgcacgccaagtgtgtaaatgcaacctcagacacaaagcatatttaatttacaacctcttgtaactactaactattgatacaaaatagagctcttttttcatccttgagaaggtaccatgaggtacaatgaggtactagtattatgaggtaccaaatcaaatctagccattgatttgggaggggcacgatcggaaaaaaagaggctcgctcattgggccactcggtcgacaccgccaaagcaggtgcaacaatcccttcaagtccagcacgagtcgtcgtccgccgcagcagttccgccgccgtagccccttctcatctgccggtgtcgccatttagttccgccgccggcgtcaatgctggctgggagcttttagttctgccgctgctcgacgacagcctgccaccgccgtcggccggcgcccgaccatagccgcccaccgcccgaccacagccggctgagcacaggtgcccaccgccgttgcccgccgcctgagcacttttctgtccgtcgccgccagccatcccggacagagcaacgccgccagccatcattcttatggattaggggttgattttgtccagcttcttattatttgcagacttgttccaaacctgtattgcacaagaagtactgcattttatatttgcaaactttcttatggattaagggtgtattttgcccagcttgttgttaaactgcatcggtattgaatgcaaagctcacatgttgtgtgcctggatttgtacttgtgtttaaatctggctgtttcagttaaattgcatctattaatcagtgaatgcaaagctcacatgttgtgttcctggatttgtacttgtgtttaaatcccaaatatccatgctagcaagtgtattagtgccaaatatgttatacggcagaagcagaaacaccagctttcatcagtgaaataaacaccagctttcatcagtgaaacaaacatcagatttcattagcttccacatgggcaactagtagacactagtcagttcagaaacagcagcagcaaaaaatcataggcagaaccgaaacagccagattttcaatactgaagcatccatttaggattaaacatatgtagatggttcatccattaacttaattacatcatagaaaggcatcacagtacataatagaaggaacattaagactaagcacatcttcatttagtcttaacgattactagggcacgactgaatgaagatgcacgcggccaatctacccgctgttgcgtagttctaaacaccagccccaccctacatgcggcaagatcacctccattgctcgaagggggccacgagcggatggacctatctagggatctgccatcccccatcatctgcgctgctccaactgccttcgcccacatgtaaatcgaagagaaatacgagatcaagaaagagagctgagagaatcaaagagaggtcttccctctgcgtgcgcccatgaaatcggacagaaaaacaagagaaggaaatacctctatgtgtgccaaggccggattcgagatgtgcggaggaagaagaaggccagcttcgtttctttgagagacgaaagaacgaaagagggacgagagaaggaaagagccgagcagaatcatcggcctctctctcgctattgcggcataaggcgaaattactttcctaccccccacctgcggtaccgcgtatatcagcccgtgcggtactaggcggtacgctgcaatctcatccgtccgatgaggccggatcgacggttcagatttggtaccgcatggtacctcaaaacctcaaggagtaaaaattctctacaagatatatacagtttctcttagcttgtacatctatgttagatgtatagccaaaggccaagtttagtttaaggctgagacaaaatgagtttggatgttgattctcccttgtttgtcatgatcacgcttcccaaactgctaaaacgtgcaattttatttttttaaaaaaaaaatcaaataaacatatttttcaagtttataataattaatactcaattaatcatgtattaatgattcgcgttgtttcgtgtgccactaaaaattaaggaaaacttcatttttgaaactcagcctaaatccattaccaaaaatatacaatatgcacccttttatagaagctaaaaatcgatgtagtcaatatgtaacgtacgtgaaatgatgtagtacacaaagccggctatagtcaaagtggcgtatataacaaaagctatatttagccaaagaccttc

SEQ ID NO: 48980 - DNA, 2540 bp, Oryza sativa
cttacataaggataaatatgggctatttaatttcatgaattctgtgataatcatcagttccactaaatattttggcaaatccttagcatttcacagatgtaggggatataattttacctaatctaaacgtatttgaacctcaattactgaaatacataatgcaattatcatatttatctgttgtgcacactaaaaaaattcagtacatttttcaaatacatccaagaataattcctattatttctttgtctaagtgaggagggagtgtggttgtaaaatcataaaatttacagaaagatgatattttgaaaatgacactttacccctttgccatgttgcagcaaggagttctatatttcgacgagtaatttctgaaaattcgggtcttgttccccctctccctctagatcgatcacgctaggatatcattccccagaaaaaaaaattaagtatttttaattcagccaatatttttttctttttttgaaattccagaaatttttattgcatcggtctaccaaattaaatttggcatgagttttgttttttagaaaagaaataaattcagtgaaaatatattcaaatttgaaattttccataatttttgtttcacctttcagagatttccattctatcccctgccttgaaatacttttgatatctgcaattttggatgaaaatataaccggctgcgcgtgcaacttggcatagggataaatgcatcatttctaaagtttcctctctcttcaattaagcgaaaaaagataaaacaataatcttttggcaaattaagacaaaaccagagtgtcatatggtatagacatgattttggagtgttcggtagcaaatgacacaaaacatcaacgtcataaggataatttaagctagatacacctgtgctagtccttctctaaataggtactccttatcctagaaatctcagtcctaatagaaatccttatcctacatgatacaaagagctaagtgaggaatttctcgctctcatttccattaggattagagtcacaaattacaacattgagggtcagctcccgcgagctagattcgctcgtgtagtagttgaacccaaaaacttaccctgttttcaccctaaaattggacttccaataatacccacgctagaaaatttacagttctctagcaaaaatctgtgacctatcaagtatcaaccatacctgaagattgcaactctagcccagctcaagccatattaacaaaaaaaaaagcaatataaataaaataaaataaatatagcaaatggggaatgtttgctcttttagattccaaggtcgatcgtgcttttctattcaagtacagatatgtccatgcaacaaggagacgacgacattgattgaccaacactgcaaggaactgatcatggccaagaaaacaaaggaaaaatacaaatacaagtcatgaataatcgatgccctcatgatctgcacgttactgtgacgcctcaatcctctgcatacaaacaagttatttttatctccactggaccctcccatctttctagctccttgcaataacccaataatgtaatgctgatagctcaactatttcttttgcaaataatgtagtaatagtagtctattttcatcagcaacaacattaattctccatgtctcctgatcaggccacttatatacatattttcatctcaggtaggttaccatggaaacagctgatgatcaggagagagcacccctgctttatcctcaacctcatgcacaggtaaatatcattatattagaacaaattaacatccaagaatcactttgtagtttcaggtttttgcagccaacagttttgctgattttttatgcaggagggtgcaggttcagaaggtgatggatcagtggacatacacaaccagcctgctctcgagcgcaacacagcgaattggagagcatgcttcatgatcctaggtagcaattcatatgtagctgatactagtgtgttttctttcttggttgctttgattcaaatcactgaaattaatttgtccgtaattactaattaggtgatgtgctcagtgagtgcttggctttctatgggatctccaagaatctagtgacctgctacctggtatgagagcaggagatatggcagctacctcacaccactcttctcatcttcctcggctgacacttcttagggtagatactggacagcgcttactttcctcccgctttacataaggaaaaagtacgaattaccccctccccggaactattgcggtagtacgatttaccccctaaactataataccggacatttgacacccccaaacacttaaaaccggctaaattaccaccctaactcgattcgaagcggttttcagcctacgtggcacacatgtggcgatacagtcagcaaaaaaaaaatataaacaggtggggcccagctgtcagcaccttttttcctctccttctctcccctctctctgtcggtgaacaactgaacactgcaggcggcgggcgggcgaggagccaacgccgacgggctgccagcgg

SEQ ID NO: 48981 - DNA, 2838 bp, Oryza sativa
gggcgctccacccgctcgacttgttccgcaagagcttgcttagcggccagcaccatagaccacgcggcgacaagggcagaggcggcggtggcgccgccaggagagacgaccgccgccacgacgacgacgaggaggaggccaacggcggcatcatccggtcagcggcggagctctacgaggcgggcatccggttcaggcgtcctcatcatccggtcggcggtggagctctacgaggcgagagaagagagaggagagggaggaagatgggaataggagtatgacacgtgggaccatatatttttaataaataaggtgctgactggattgccacgcgtaggccacgtaagacaaaaccacgctggattgggtcgaggggggtaattcgttcggtattgaaagttcagggtgagtaatatctggttttcgagtttaggggggtaattcgaccgaccgtgatagttcaggggcgtaattcgtactttttcctttacataattataagtgcgataagaagatggtgtttgaaaatgaagatgaagataaaagattaagtattttacgcaaaacgaggaggtaataacgtgcgattaattgagttttaattattacaaacttgaaaaatggattaatcttatattttagaacaactttcatatagaaagttttcacacgaaacgcaccgtttagtagtttgaaaagcctgtcacttttgtccaaaagttaccattccaaaaggttgcatttttgttagggaattttatgtcttaacagtatggtctcgacatctctctctgttgggttacgcacaggctatgatagtataaatcaaaattttctagcgcataaactaggaaccatgcaagtattagatcataaatcgttaccactcgacgcgctgcgcagcggaagaaagcgctaagaaggcaaaggaaccctcgcaaagtagcgcacgtcgatgtagaggaagtagtcgatcgtaccggctcgatcttctcctcctcgtgcgttctcctcgctgtaatcccacgccgatcagcaccgcaaagcagcggcacctctaccagtatccacacgtacagggacagaatactacgcgcagatatgctagtacccgcgtgcggctaggattttgctcagggaagggagtggcagctagggtttctcacgtgatgcattacctctgccggtcacacccctcacgaatatataggatccatgacttaggcccgtagaacttccattcggatctctatccaaattaagctcatattggatctccatccaatccccttattctggcccattaagcgtgcgaccctgtaggttcatacacactcggctataacccgaaaactctttttcggtccacgtgtcaccagcggtccctagtagaacatattgatccactgggcatacataaagatcatatcggctaaacctctagtgtatacttgtatgaacccctttgcctcacgatatcgatgaagctcaaggctagatatgtgccatcctctaatagcttaatcattcactcgagcctgtgatatattatataacttgtgatagactcctcaatcacctttggtatggccatgcacttccataatctataacatcgaggggaccagagatacctctccataggaggggcaaatcctattttgattattcatatcccactacatgtttcatagcatacccgaaaactacttttataactacccaattacggagtagcatttagcggtccctaggaatcatgataatcttaggtctaaggatccaacatcaagactaaatgggatcattgatgacacaacacatatggctcttacaatatctcatattgggtctattcaacaatatgttccccaacatgtgtccccattattaatttgttatctctataccataattcatgagacatgatcatcaattaatacatgtgctgatcatttaaatatatttgttatacatatgatatttgatcagggatcctttagaaatagtaacaaccaacataaatagtctcatactcattaatcaataatgagctatctatttcaagtaataaagtcagataaatatgtaaatatagtatgtgatacaatcatctctatgattgcctctagagcatatcacaaacactcccgacgagcatatgacgtcctccagcgatatgatggccaccaccttcaacctgtaatggtctatctcgggctgtacgcctgtacctcgtcgcataagagcaggtacaataacgtgattaagctggctccaaattttctatcaccttcctaatcctagattaagctagcaaaattgaagagagagaaatgagcaggcgcttaacctggcgccgggcgctagcgcttcatccgaagccgtatcgctcgcatgcagcccacgaaggtgattaaaaacacgttatgtagttcccacaagaaaaatccctgatcccctcctccaccgcatctcaaccaccgaaaatcccatcgctccgccgcccctcccttcgcgttcctcttcgctccttggacgcgcatcttctccgctccctgcgcgtgaaatcttctccgcccccttgcgcgcgaaatcgccggcgacgcctcgcgttcctctccctcttctgcccgtgcgtgcaaaattccctccgcctgtgcgcgcgaaatcgccggcgcctcgtgttcctcttccatagccccgccgcacgccagccctccgccattgcctctctctgatcccgctaaatcttgcccccgatgcgcgcgaaaatgcctctctcccgccaaatcgaagccaaattgatgcccaacaatctccccagccggctccgtg

SEQ ID NO: 48982 - DNA, 957 bp, Oryza sativa
atatatctaatatattattaagacaactcgaaaagaaggcaccacgttctgtgaaggctagaaattcctacattaatcaaagagaaagaaaagaagagtccaaatagaaatacgatctaaaaaataattgaaattcgaaattaaaaataagtaatattgaaagtccatataagaacccaatacgtgtttaattaaaatttagaataaaaaataaataaattgctgaaattagaaaaagaaaaaagagtgttcgaataggaatacaaatttgaaattactaaaattaaaaataaaaaaatattgaaattagaaaaataaatatgattgttaatgtaggaatacaagttataaataacataaatttagagaaaataaagagagttaaagtagaaatacgatttaaatatagttgaaattcaaaattaaaaataaataatattcgaagtagattctacatagaacctaatatgagattaattaaaacccaaataaaaattaaaataaaatatgaaattagaaaaaataaaaaagagagttcaagtaggattaggtttttgaaatttctagaattcaaaataaaattgattattaaaggaagcaatacacatatagtatacaatatgatgtaaatttagaataaaaaataaaaataaaatttaagtaggaatacaatttataaataaaaaccatcagtataaaagttaagtaagaatgaaaaatgttgaatgttgaaagaaccgtcaatataaaacatagtggtagtaaatgaaaataaagtgaggaggagcaacgagctcataaatgagtagggtggctgtggttgatgaggtatctataaataaaacctcaaaaatgattatatatgatttttagagtccctatgacgattaagatgaggatagcaggcatgccgttaagcacggtggttggcaggacttttagaagtaaaaaatgaaa

SEQ ID NO: 48983 - DNA, 3106 bp, Oryza sativa
tgctactttgaccaatgatatttataaaagtaagatgttttaaataaaaagaattacatattgtgatagtttgtttaatgataaatctaataacatcaatgttacataactgatcttttttatatttttgctattaatagtcaaagttacaaatatttgacttgacactatgctaaaaatgcttatattttgggacggagggagtaatgtttttctctccttccatttttctctatttcctcttctcctttattctcttgctttatcccccatgtaggggattcaataaataaagacttgagagcacataacaattttgtctagcaagtttcataactaatttcattgtaaagtgaagtgcatgggcaatccctaaacttgtgcaggtgtgtcatctagttctttaactcttaaaatgtatttttcaggtccccgaacttgtcttggtagtcatatatatccaaacggaatccaatccacaatgtacattgacgtgacatgccatggcggcacctacatgttagtgagacccacatgccagacacattgaaaaaagtaaaaataaaaagaacatattttctcctctctaccttagaattttttatttactttatcttttctcctctctacccaagaggaaaaactgtgattttaattttttttatatgtgactgacatatggttccaagctactaacatgtaggtgccactatggcattccacattggcgcatggagtgtgtcggagcctatttggataagtatgacaccccacccaagacaagttcgacaacgtgaaaatatattttgagagttcaaggacctgatgacccacccacacaagtttacggaccacccatatactttactttcattgtaactaggtgatccccgcgctttgctgtgggaattactaagtaattctcaatatatttttttttgacaatcaagctaggagtgaaaaggaaaaaaataatgaaacatgtaccatgaaataaacaaatgatacccacgctttaatgtgaaacatattgataagtatatgttaaatattataaaaatgatagatagatttgttaaaatataatgcaaatgatgtgaggggtgatgattggatatgcttgcatattgatttgtagaattaaataaattgtaaattgatgttgtatgcttgcatgatgttaaatatgtaattattgctagtgagttatgatgtggcatggttgcatcttgagctttagatttagtgggctataactttatagaaagtataggtatgcccattgcattgaatctcttgaggcacttgtaaacatttcaaattaaataaaaaaattaatggaaagtagttgggtgaattccgtgttacactaggtcgagttttccttgtttcactttacaccaaatttaatacatgtctacacttacaacatggtatattgggataaattttactttgtactaggtttatgtcactgaatgtgtgggacatcttgtaaagcataagcggaatccatgatactccatgaagttagatcattttttcatgaaatttctgtatgttgattaatggtgtatgatgacgtacgtgttaactgaaaattatttcaatacacgtaatcgtgaatgaaaagcctatcatcacgaaggtattagtgaaataaggtactacctttatattttaatgtataatgtcgctaactttttgtctaacgtttgaccattcgtcttattcaaaaaatttatgtaattatcatttattttaatgtgacttgattcatcatcaaatattctttaagcatgatataaacatttttatatttgcataaaaattttgaataaaacgaatggtcaacgttggtcgaaaaatcaacggcgtcatacattaaaattaaaataaaaatacggagggagtataattttgtgatacgaatgcaatttatacttaaaaagtatgttgaaggcaaataccaacagcaagccgtgctggaaaaggaaattttgaactgcactcctgtttctttggaccatcaccacttggctggtaacccgtgtggcagcggcactcgtaatctcctggagtgttcctacagacaccgtggcaaggatacttgttggggtgtgcgcactcatcgatgtctgcagatttattcgaatataagagttaattttggcctctagaggcagtacgagattccatatatggttaaaccattgctgttttttatatatgatatgtagttgtctttaataatttgtttgactatttgcagttcataaaaaaattgtgcaaatggagaaaattaatactaggtatgtatgcttaaagtattttagttgatatatatctcaatatatatataatattccaaatcttctaaccttaattaaccaagtaattaaataaatattgttgtcctaagtttaaactatatatgtcacatattaaagaattaaggtagtagttacctttgcatcctttattgggatcgtcgtcgtaagggttaccctcgtagccactgctgcagttgcagtagtatccgaggccgttggtggagttgacgcacgtgctgttgacgctcacgcaggcgtatccagctggcatattcttcttcgacgtctccacctccggcgccgggcaggacgccacgtcgcggatggcccagtccagccacaccggcatcctctgtttccggtccatgttgagatcagacctctggaattggtactcttccttgtcgacgaggaaggcgtagtcgcaggggctgaagtccacctgttcgccgcgcggccattgctggaaggtgacgacgttgtcggtgagctccggcgggatgtcgacgtggcagcagccgacgccggcgcacttgccgttcttggcgctcagcgagtcgctgcagtaggtgacgcagccggcgtagtagaggcttgtgtagaggccttttccctcgctgtccccgtgcttgttccatgccacggtgttgcatcccaggacgacgaacttgttgcgctcgtcggagatgcggtacacgccggtcttgttcagctccacgtcgccgtaaaactgctcggtgacgttgccgctggagttgtagcacctgtacgcc

SEQ ID NO: 48984 - DNA, 6623 bp, Oryza sativa
ctagctagcaaatatcaatttgtgattacaattatttttgaaaataggaacgttaacataataagtgtcaacttgcacctggatggtgtcgttggcggcggcgagggtgggcaccaagccgccgttgcttgtgttgcaagcgatctcgaagcccgcgctgcggaagcagccgccgccgatgccgaacgggtatggaatgtcgacgtcgccgcacctcgcctggcagccggcaggccggccggcgatgcccacggcggcggaggacatcagaatgagcagcactccggccaatagccgcaacgatgccatccgatcgagatatcacgtacgtgtgctaattatcgatctcggttgattcctaattgcttcgttcaatatatatatatgtacttgctctcacccgcgcttgttcattgcctgcagctttattatactccgatcgacgacccagtcaggaatggcagaaaattaacgacatgctagctaattactttcttaagttttctttttagtcttgtcttaaatcaaacgtttatactcgctctgtttcggaaaaaaaacttgtcgttcagagcaggtacaatagcaggctacaagttagctgtaagcacatatggaagagaaaagataggatacaaaaggaaagcgggttacatatttataactaactgcagcatagactccaaaatattgtgtgtatgagaggtgagaccatatattaatgttgtagtatatatttatattgtatgaaagagctattagatttgctatagatgacttggagctggtagctggctatactattaaacttgctcttacacaaaccgcaaaaatgtaaaagattgtggggataatctcattaaatatatcctaattatttttttcaaagcatatgagccaataggagttgtgactgtatttatatatgatgacgagggtagacaggaaatatcatttttaaaaatgctttgcaatgtgacaacgacaaccaatgataagtaatataaaatggaaggagtagcctatagataatcaatttttgaaattaatacaatttatgttgtaaattatatattataaaaccattttctagaatctaagaaccgaagtttgaaatgtcagatttaaactaaattaaaaaaaactattgtaatttgaaacggagaaagtagataggatctaggattgaaaaactaaatgtgaaaaggactgcacaaaacaaaagaacaagacaaggtcgagaccacaatgtgccacatggtgcaacatgcgaagaattgtctaagcttgcaagcctggcatctatatgttgaaaacacgcccttttttttaagaattcagaacttaaaaggagaggatttcaaagctgtcttagtcggacagtcagaatgagagcataagtgagaaatattttgacaaactatttgattcagattttgtctagatttatccctggtttttttggcaagaaagtcagccatcttattaacctgtcttaaaatccatttgatgttgagagcctgtgttctggaaataagttctgaaagtaaaggatttaagctctaatgatgatactgagaataatagacttgaacctgcaaaaggctaactaattccctattgtctgataaaagagtaacatcaataatatttaactttcgacaaatcaaaagttaaagcaaaagggatctacttgtccagaatattatctcaagaatactgctttgacttgtacgtaggtatatagagtggcagcagacagattcctacctaaaaatttgtttaaacgtcctagaacttactccaaaggtgtgtttagttcgcgtcaaaattagaagtttggttgaaattgaaacgatataatgaaaaagttggaagtttatgtgtgtagaaaaattttaatgtgatagaaaagttaaaagtttgaagagaaattttgtaactaaactcggcctaatttaggtatgcatgtgaactgtaccgagttcacaaaatcaattgactgctgcgcccacaatcacgtggtaatcacttgggacaccaatggcatctttcatgagacccgatttggtagacagggtaatttgtaacgatttgtgatagagaaacggattgctctagctgctgatgtggacagtatatccggcaactaaatatcttttttatcgttactgttctctaaaaatagatgctacgctgtaacgtataaatggtgggaagttgggatccgccccaggggatatgttgaacatcgatatgttgaaaacttttgttccacacaaaagttttacaccctatcatatcgaacgtttgacaatgtggtgctacagtaaatatttgctaatgacggttaattaggcttaataaactcgtctcgcaatttacaggtggattatgtaatttattttattattagattacgtttaatactttaaatgtgtgtctatatccaatgtgacacagcaaaaaaaatttaccccggatctaaacacatcctaagcttgtacaccatttttatatccaaaaaatctcggtagagaaagacttcagagctaaacagtgtttcaaaccttgcttgggctaggtaaaatagtcaaagtagcttgcttggttctctagctagcaaatatcaatttgtgattacaattatttttgaaaataggaacgttaacataataagtgtcaacttatcttgcagtatttcaagtcctagctagctgagcccttctatatatatatatataaaaagcaaatccagacatgaatatagtactgacactataaatcaaaattgtgtttttttttgtgtgatgtgtagattgaatttagtacttattgtttgtaaacaatgtaattttatgtatgtttgagataatcgaatgttacattaattaatgaaaacaatctgtgcaagtagtaccaaatcgagaaaaagtctaaatactagatgtgacaaaaacatctatgcaagtagtaccaaatcgagacaaagtctaaatactagatgtgacaaaaataacagggtcaatgtcagctagtgagatggcgggaaataagttttatcgtcgagagaaaagcaacccagtttgcccgctgttgacggaaaacacggcggtctgtgatctgcttaactccagtgtagatccaaggctagtctcgagtgtgttaaggatgtgtgttaacagtgaaatttggtaagctccgaagtcatcatcggtctagtgccaatatcggtttcagagtcctggaatcggccgacgggaattatcaagtcgccaatagtcggattattgctatattcggttaaagaaattaatctactaaaggaagtttatccagaagagaccgagttcaaagatgatgcgccatgacaatttatctattagttatgaatagtctgttagtttccttttatctttaggaaagtgtgtttagtgtccaataaggacttctatctttaggagtctttttttccaacaagaactagttatctacccatgggtataaatatgtacactcaggatcattgtaaactatattcacatatcaataaacttcgtcgcatcgctactctttttacttttctacattttcggcgagttcatgctccgacaaggagtaagacttgttatggttgtttttgcatcggcggggctagggcttcgacactccgatcttgtcaatataagcacttactatcatatatcttagttaatctagcttggtagttcgatttacttgtatcggctgagattcgctttaggtttttttgtcaggatcagctaaatcgctttaccagattagattagctaatatatctaccaccctgaaaatcagtcaaggacttgattgtctagatattatgtttcttttcatacttagtgctgcatcagttaagtttgatctactaagtcgagcttagaatcataatcactagtctgcttgttgattgccaataagggtttcattggggttttagccgatgagatatctggatattgcatcggcttataaggattgcatacaagttggatttagccgataagaataaaggttttactatttatctaatcatttagaaaaaaaaaagtgtgtatacgaacaacaggccagtacgtcaatggcataacacctatcagtctggaagaattatactaagtacatctaaggactgaagctagttcttattcctgaaacaatctattgacttattaaaggtataaaaaaaaaccctccacgttcgctctcacggtctagaaattctcatattaatcggagaaaaagaaaaataaagtccatatagaaatataatttagaaataattgaagttcggaattaaaaaaaggaatattagaataggagactagagtccatatagaaatacaatttcgaaataactaaaattcgaaattaaaaaataaagaatattagaagaagagtataaagtctatatagaaatacaattaagaaataataaaaatttagaattaaaaataaggaatattagaagtagagtatagagtccatatagaaatttaaaactaactaaaattcataataaaaataataaaattaaaagtggagtttagagtccgtataaaaatacaatttacaaagaactaaaattcattaaaaaatgggaataagagtttaaagtcaatataagaatacaatttagaagtaattgaaattcgaaattaaaaattaaaaaatattgaaagatgagtttagagtccgcgtagaaatacagttagaaataataaaatttagaactaaaaataaataatatttgaagaatatagaaatacaatttacatataatgaaaattcggaatttaaaaataaaaaatattgaaagacgagtctagagtccgtataggaatataatttaaaaataactaaaatttgatattaaaataattaataactaacacgtatataaaatacaatataaatattacacattagtagtttcataaagttagtacaaaatttaaaattatgttatcattttaatatattttaataataaattgagaaaacatatatgctattatataagagaaaatataatgatgctagcagcgtaatctgcgggggctagaatgctagtttaatataaacgacgaccttcactagaaatggtagtagtggcctcttgcacggaatttttttttgaaaataatacaattttaatggaaaattacaaaaatatatgtcggttagacgaaattataagtttaacaccctgtcaaacaaccgtggtttgacagggtacctatcgaacaaccgtggttcgacagttgataaaataattaaaaaacagaataaacactgtagcccctatcgaacgctgcccattcgatatgtcctccgatcgttctttgctggttcgatatatccctaccgagtactcatgtacttttttttatttttttcctggaccacctactccacagttcgacaggtacatgtcgagttgatctatattttaacaattttctattaaaatcatattatttttttaaaaaaatctcttgcacgaggaggaggatggcggcgacagctatccggtggtggtgtttgtaactgtggtggcagcttcctcagcggttcgacgaacgggctccggacgagagaggcggcagcgggatcatgggatggctcgtgctcgctccctcctcccctctcgtgcgtagcaccgccgatctgccaatctgccatgtttatttgtttgcttggccttttggttcgttgattgtagctgtgtttagatccaaacttcagttcttttccatcacatcaatctatcatacacacacgacttttcagtcacatcatctctaatttcaactaaaatacaaattttgaatccaactaaacacagcctgagaaaattaaccaggctcctagatctcgtaaatctcggattgtcggttgggtggatggattcgatatcccatattccaaactgatgtgcacaaaaaattgccagttgcttgatttttattgaattacaaaattcatttctgcaactagtataatctcttatgttatttttgggacttgggtgctatctttgaagtgaagactagtcaaaaatgtactatttggctcacgagcgaaacgaggtagctcgaggtgccatgcgagctgacctcccgtcatcacccgcacggttgcctgtgctgaccccgaccttctactgttgccagcatcgtccttggcagccgctagccaccacctgcctgccccgatccgagcgagaatatatgccagatctagctagccaagggagcaccgagatctgacaaggaaggaaggaagggatgtcggatctagccacaggagcaccggacacaagctttgcgaccccgtacccgtagcgtgaattcacgacgactagctctcggcgacaccgcggcggcgactcatgggtcgctgcctcctcccttcctcctcggcggcgagcttctgggtgcaagctgttcggcggtatgcctaagcggggtgcccaaccaaactgcaactgacgctcaggtcaccaccgcccaactcacaactgatttcttcttcttctttcttcttcttcttcttcttcttcttcttcttcttctttcttc

SEQ ID NO: 48985 - DNA, 1150 bp, Oryza sativa
tttatttcaatatttcctaagatgattcaggagcaaatttgttgtttgtcaccctctggccatacgggcaatatttcataagctcaaaacatggtgattgttcctcagatgtcaagtcttacgtacagtttttttttttttttttttttggggtgggggggggggataattgaagtacctgaattgattggtgggctgaattttatgacttgcttcagttgttgaagatgaattggatggctcatataaaagtgacttattttctggcaattgcagatggcacttcctaacagctgcaacaatcacctgacagaggctcttgagggggctaaatcccaggttcctaaacctgtaaactcttgagccggcaatgaatacagggaaactgatgatcatgaacacagtcgggattgcgcaacccaccccccatccaacattgtcttgcaaccaaacaagcactgtgcttgacagcaaggtgctgacagtagtcatgtagaaggaccaactgaagaaggaggccttcttcggtaactcctccagatcagtgctatcaaactggtcggccccaaaggatgaagtgcatggtttcattgcaccactcccaagggcagcaagatagagccctagatacactacggaacgatgaacattgccatgttcagaagatgtcaagaacattggaagtgatgctgaaactgtcacgatgagcattccctgacaaaatggaaatattcagagtctgcagaaggtactagctgatagtgcagaccatatctgtgagctgcatttgcgcttacagtgatgtacaccgggaggaaaacaacaattgtccagtatctgccccaataagtgtctgccagaaaggcaccaacaaccggtgtgaggaagcaagctccaacccaggcagagacatttctggcagcatcgaccttgctttcgtggagcacagtggtgaggaatgtgactagattcctcgagattacaaagtaggtcatgttttcacaaaattcaacacctggtatgcataaaaacattcacaaatcacaacagaagaagacaaacagtttgaaaatgatgtttatttgttgcatcagttgctctatagtacctaaaatcaagaagcacgccctccagttccctgtgctgtgct

SEQ ID NO: 48986 - DNA, 2262 bp, Oryza sativa
  unsure (1)..(2262): unsure at all n locations
acaaaatttcactaagcaatacaattgttctttacttttaatcactgttgagagaaccactcctttcggcgtgacgcagttgtccattcgataatagagatagttggtaacttcgttaacaccacaaatctttaggcgagtctcgtgttagttggaaaagggggccaacacgaggtttgcattttgttagggattgttttttttcactgtgttgagaaatgacatgtttattttttgagaagtttcatggcaatagtaaaacttgtcttatttttttgaattttttatagacatgtgctttgcattgctttgaaaaatgaattgttttgtgaaaggttgcatatttttttagggaaaatactgtaggagtgcataaatatatttaatagaaacaatatttaccctgtacaataaagatatgttacaaactttgcagccattgttgcatttggggtattgaacaatcttttactctatagataaccttgctagattcctttttgaaaagatccaagcaaacttggaagtaaggagagttgtttctgaaaatcttattgtttcttgtgttccaaacgctcctagccataattttgactgtgagaaccataattgcgaaaaaatcatggagccgccaatgactctgagagcagtaacgttgaccaagaccaaagcaaacaaccaatgttaaggctgtgttcggaatcggacgttcccgcgtacatagtaagaacggaaaacggaacggtccattagcgcgtgattaattaagtattagctaatttttttttaaaaagagatagatcaatatgatttttttaagcaactttcgtatagaaactttttacaaaaaacacaccgtttagtagtttaaaaagcgtgcgtgcggaatacgatggacaaggattgggaaccttgagttccaaacacaaccttagacgtgtagtagctgtatcataatttaccaattttagtatcaaagccatgcttcctagaataacctggatagaaaaatctacaaccccctagcaaaaatatcttaagtattgaaaggttaagaaaaaaacttgatcgaggcatatattggctaaaggtacaaataaaaaaaagggagaaatatcaaaccaaaaacagagaatgttagctcttgtaccgattggcagatctanattattatttatttttgtaggtccaacccacagggaggcgacagggacttaactgcaataggacgaacagatcattgcacatgcagaaacgaaaacaaaataatacaggtcaacaatacatgatcactgtgttgtgcacgtcagtctgacgcctcaatccttcccgtgcacacaaaatttcttatcctcccctctccatctctccctgcctccctcctgctcagctactactactagtagctatgctgccatggaatcgagctgctccgtacagctaattcttcaccatcaacctactccatcctctctgctcactctgaattctcaaggtatagttctcatcaggtagatggccatggaagcagcagatgaggagagggcgcctctgcttcaacctcaacctcaaccttcacgggtatctaacctacctaccattgcttcttgacttctgcatgcatatcattggaacaaagtcgaacaatccaccaagattctttgcttcaagtttcagcttctgcagctcatagtttggatgatttttctgcagggggatgcagattcagagtatacaggtgatggatcggtggacgtcaacaaccagcctgctctcaagcgcagcacggggaattggagagcatgcttcatgatcctaggtaccaagaataattagcaacagcaattcaattcaaatcgctgatcttccatatatctgtttctcacaaccttttgaactaaaattgcaaactaaagttaatcactcaacctaaccaggtgtcgaattcagtgagaatttggcttactatgggatctccaagaacctggtgacctacctcaccaagattctccacgagagcaaagtgaacgccgcgaggaattcctctgcttggtcgggcgcctgctacctcacgccactctttggagctttcttggctgacacatattgggggaaataccggactgttcttacttttctcccgatttacatcctggtaaggattgaatactctgttgcagaggctggactgaactccattatccttcccaaagacaactctgcactgtttgcactgtattgagatttgaactgttttgtttt

SEQ ID NO: 48987 - DNA, 4009 bp, Oryza sativa
agcactaatcaatacattaactgtagcatatgttagctagaccccaaaaggagcattgatgctggctatagctagtctttaaaaaccctggagctgagcttgcagaaagcgcatgcaaacagtgtactgatactccatctcgtaggacggccggtactacagagaagagattagcgatactggaggtaattaaataaactctcatcgtcctgtacactgtacgtagtactgggggtgtacagtaagtaagcttaattaactgaagtgaacggacgatgcataggagtatttatgtggtgtttaagtagccatgtggagtgtgttattactgaattctgtcactgctgctagctccagtgtctccaggctccagctgctactactagcgcgagtagctaacataagccctctccttgagcagagataatatccagatgctgacactgagatcgatgcatatgcagctgggcagagatgaaaaactgaatctgatcgatctggatggatggcatgttgggggggtccttcatagcaattgggtccagcaggagatgatcagcaagctagccgatctaaaggcgaaagccagagctactactcatctgctactctctctgtcttagaggatagcagtaatttctactcactccgtcctataatatactatagagtaaaagattttagataatgcaacacatcttagcaataaatctgaacagacagtctgtccaaatttattgtactagaatgtaccacatccacccaaaataccttattatgggatgaagagagtagcattttaaaaaatatttattctaaaatatatcaaatttatcgtctacttttccatctcttttatatcaaccaactttcagttagcttattgatctattatgtcatttcaatgccaatcatgaccttgtttaggtccaaactttttttcatacttccaacttttccatcacatgaaaactttcttacatacataaacttacaactttttgatcacataggttcaattgcaaccaaacttgcacttttggcgttaactaaacacacgccatgtgaccatgcatgtgtcttatttgtatagtttcacatatctgcttgaaattaaaaagcttcgagtaccttatactattttgtaacggatgtaatacctagctacagatagctgcaatgctgcagccaggtgcagtggctttgaattaatagatgcaaatgcaattcttaaattctgcaattgcatgcatgtactatccagccgggtggcacgcccatgtgagtgcccggccgagtaggaatagcaaagcaaggacttatttggcacggctagggcttcagctccatctcttctggagcttcatctaaaatgagagcgcacggagctaggtagaactctctcacaaaataaactagagagatggagctgagtttagacagctccataacttcactccagacccaacttctagagctaaatttaggagtttggagctctaacaaacaggcatccaaataacttcatatatatgcaagcattgatgcgattaataatattgcaaaagtaacagtaatagctcggctctggatcaagaacgtacacgttgttgattgggaccagttcgtccggcagtgctctccccaccctatccatggctatggattccccatgaagaaccctacgtacgctgtctgcaataagctactcctactactacactactactgctacagctaggtctatggctgctgcatctgtctcattgctgctgcatgcatcgattgctccatgaatcgtccttggcaatggccggcatgtattggcatttctctcgatcgacccaatacaatgcaacaagctgccaattcaaagcatgcattgagtactctcgttaagagcaagtttaatttaatagtatagccaactatagctcgaattcatctatagccaatttaatagctcattcatacaatagttacatattacactattaataactggtcccacctgtcatatacacactgcgtcttagagtccgtgctacagctggctacaaatctgtagctcactgctcttctctctcatcatttatctccttaaaatatgtttgcagctgatttatagcatgctattctacctgctctaattcgttactacacttttatcagagatttcagaagaacaacggcgcggcaaactagctagccaagaaacagcagaggcatatacactgtagcggcggcggtaaagatggagaaggccggccatgcatgcatgcagcattgcgcagcagtacatacggtagctacagctgctgcactagtgcaaactgctaagctttatttagaagcaagtttaatagtatagccaaccactggctccaattcatctatagataatttaatagctcattcatataatagttatatactacactattaatacctggttccacctatcatacacgcactgcgtcttagagtccgtgctacagttggctataaatttgtagcctgctgttcttatctctactcatttatcttcttaaattatgtttgcagctgtcttataggctgctattgtacttgctgtaacctttctttctgctctccttctgcatgctacatcgtccatgcatgtacatgtctacacacacacgtactcctatacaattgtttctggctggagctagacagacagggccggaaaaagtcgatgcagtgagatacaaattttgtattgttcatttgtatgtcatgtgtaatttgttcttactaccaagttgttctctctttactactgtagctggctatagtagtacaactagatggagacgagggtaaaggagataatagaagacagtagtaccactgcacccgtcacatccatgcttccttccttatttctgccctttacaaagggctgcaaaaaactcaagggagggggaaagggaatgtgtgtactcactttcatttctttttttcttttttgcaagggaaaagaagtatattccaggacacaccctttactttgcatatatactactgctcccttggccattatcatttccaagtttgcccttatgtagctcctttgcaccctcctagctaccttagctggctcctatatatatgtggggtctgatcagtccccacaccttggttacactttctagggtagtcagattaactaagagtaattattatttatattttataatctaataataacaaaaatactaatcataaaaagtttcaaataagacagatggtaaaacgttaaaaaaacaaactcacaactacacttaaatggaatagagagagtagctaattagcgagtgagtttcaaatctcacgagaatttgcatgattggttgagctatggcttataaccataagtagaaaaataaacaaattaactataaaggattttagggtgtgacttaacatctgcttttagtggtttaaaagccaatactgaaaaattgaaaacaatgaaaagattaatttagattttaaattgtggttgcgcagctgataagctgacgagcagccaatgaaagtgactactgaaccgaacataccaaattaaaaatggaagtatacatatatatggtgctaaaaaagaaaagcaactcatattggagaagagttgcctagatttgataatggtgtcatccattattccacaaaaaaaaatcttagaattaaatggctagtagaatttttttgagagaagaaaaattaatccttgttcattttcaggttcctttttagcatactactagtactaatttgtactcccattgaactactagaaaggtacctatattttggaatggattcagtagtattatttatgctttctccttataccaatgtaggagtactactttttatttgacattttgtgcagtaattgacaacacaattaattttctgcagcattaatttggaaaaaaaagttttgtgcacattagctgaagcacctaaatatataatttat

SEQ ID NO: 48988 - DNA, 4877 bp, Oryza sativa
  unsure (1)..(4877): unsure at all n locations
nnnnnnnnnnnnnnnnnnnnnnnnnnnnnnnnnnnnnnnnnnnnnnnnnnnnnnnttaacatctgcttttagtggtttaaaagccaatactgaaaaattgaaaacaatgaaaagattaatttagattttaaattgtggttgcgcagctgataagctgacgagcagccaatgaaagtgactactgaaccgaacataccaaattaaaaatggaagtatacatatatatggtgctaaaaaagaaaagcaactcatattggagaagagttgcctagatttgataatggtgtcatccattattccacaaaaaaaaatcttagaattaaatggctagtagaatttttttgagagaagaaaaattaatccttgttcattttcaggttcctttttagcatactactagtactaatttgtactcccattgaactactagaaaggtacctatattttggaatggattcagtagtattatttatgctttctccttataccaatgtaggagtactactttttatttgacattttgtgcagtaattgacaacacaattaattttctgcagcattaatttggaaaaaaaagttttgtgcacattagctgaagcacctaaatatataatttatgttctcaggattcactggaaatgttatcgctgcaagccctagagggtggtgtctccagcagaaaaggaggcagattgggaggaggatggtggggattagggaagcacacttgtaaatatatatctgtcactgtccaaagctaggtttgatgatagggaaaaaaaacacaaatataattaatcttcgaaaaaaacgcagatattatatacaaatgcaatagcattgactttgtgtatgcgcatgcaccgaatcggaagcgtatgcatcgcacttctcagaaaggtccaaacaaagtcacgtacaaattattcctactcccatgccttttcattgaaaggaacacatgccaaagagaagagactgaattgaagccatccatccatatctatccctaattcccttgcagttgcgtgagaaatacataaacatgcatgggttagtaattaatcctagatgaatctatctatcgtcagtgattaacttaagtttactgatggattggcatctcggattctgataaggtttttaagtgattttcagatgtcacttggttactttccaagattgtttaaagttgtcgacacaactgtagccaaaggtcttattgtactgtaccccatgatatgctagatcttccttaggtcatatgtcttgtcctcgaaatcttgctgccattcctacaggattatccgaatatttaaaatgaactatcggcgaacagaatcgaccaaccgattcagcacaacattactgcaccatatgcattttatccgaaagtatcatttgagttgattatatagtgcatgccacaaataatactcaaaaaaattgatggccttaattgagtgactgacaggaatttgagattaaataaacttaacggtgcaatgatcagtttatgccgaaatcaacaaaactgagctacagtattcccacaaaatttaatattgtaatgatcattaaagtgtgatttcgaaagcagcaatgaccagacatatatatattagggaaaaaattaatacttgggaataaaaaaatatcgaactaaacgcagatggcatgcatatatataagatcaaatttcaaaagagtttgaaattagagttatataatgcccagaagatcagggaagaataatcaccaaatgtgtgcaccgcagtattaatctgaaatacacgtagcgatctccataaatatggaaattccagaaagaaaaaaaaagtaaaatacaaagggcagagaagaccattcataaaactcaaatgccagcttccaaaaggcatgcagtacatgcatcaattagaataccaaataaagctctgcacctactacaaaaatagaagaaattgtacaaacactagcagtagaactttggaaacccagatgatcccattacaaagaaattccatatgcatggggatcaggcagtacacaaagtcatgtgcagcagaatgatcaccaaaacattaaactcattcgcaggtctaaatatctgaagagaaaagaagaaaattaatacagtactaaattttgcatataacttaaaggttctattgacagtaccttaagcgaaacagaaatcctaccccaccccacccaaaaaaaaacaaattaaaacatcgataatattgtatgcagaaataattaagatgtgcccgctataattctaaaaattataatttgacacatgcatgcaccttgtctctctttgtattaatgaaaacaacagagctcctgccatgtagctaggtcaaaaaggaattcaacgcatcaaaaattactaacctgattatattgactaatactagtataaataatgcatggtagcaactaattttccctaatgcttttgtaaacacaataaaacagataattaagttgcaaggtacaatattaattggtggttcaatgcatggtaccctgtttaacgatacgcaaaattcaaaagaaaatttcccattcctcccgatcctttctttggtgagaaaaaaaacagagcctatacaaattacaatgaaaacaaatccagcatgggaggaaatcacaaataaactcttgtgatgttcaaaagagaaaatatattgtatgagcttaattagtacaaactgaaatcttaaaattaataaacaaaggaaaacgatgaagaaaaacataacttttcgtgagaaaaaacaacagcctctatggccagctagcattcaggaatcaaagataatgtgcacgtactgctagtctgatactaggtagtacggataattcaagaggtgaaatgaatgtcacgcaactccaatgaagtaaaatatgaggaacagttatctgtcaattaagctaaaagattacttatcgcaagctagctaaccttccaagagaatgttgaatcgcacaaaaattaagttcctaacagatcactacaaatattatccagcaaattaacctttattttgggcagagtaaaattgcacctctagaaaaactacatactcctgctggagagaatgttccgagacatgataggatcaacgatagatttggcttatggacttagccgtttcaaatcctgtggtacaactctcagtttgaacactgtaacagcacaacaaaaaagtgtaggcgaattactaataaacctatctgtaagataaatttcatggccaaattcattttactttaaaaataacaagaataagaacattgtcaataaattaaggacatgcatgggaaaatcaagcttatctcttactactataattgtagtatttcttggaatatgaactggatttgaaaggatcattcccagcaaaagaagaagaggaagaagaagaaaaagaactaatttgaatgaaccgttaatttcatactatgcgcattgctacagtatcccaaattaatgaaattttggttgaataattacatttaataggtgattataaacttgatatgttaaatgctaactactgcaagagtgatctcatcatttgaccactgcagcttagctagatctctcttgaagtagtaaaattttctttgagcatatgatgactagaggaaattaatctctctcaatgcaagtggcactgttgagcacagcaattattcaaacaaaattcccatctaagtagaggtatagctactcctagctagggctcagcttttgaagagcaaattaaaggtaaagcaccaaagttgtgacaccttatggaggagacatagataggactagaagctaggagtattgagcaaaggcaaagaaaccttaactacttgcagtactagagaaaaaagacccccaagggaacagcatcatcaccatcatagaaatgaatgaagagcatgaaagaaagaaaagaagaagggcatgcaagagaatatagggtgagtgtcaatcaagccactcccccaagacaccaaaacttactaactgtcagagatttttcatttttaatcattgctccctagctagctagtactactagttccaactttatggagtaattaacctcatggatcgatggatgatggatggctaactacagaagcagtgagatgcagcacatcaatttatgcatcagtgatgagaagaagaagaagaattaagaagaagcaattgatcgaatagtaattagaggagctagctaagctagagaatgaagcggaggagctagctaggtggacgccatggatgcctaaagcaaagcaagcggccgatcgatcgagcttagcgcgaggtggccgtttgatcacctcgggtggccgtggaagaagtgcgcgccgccgaacgggccgggcgtcgggtacgggtccatcaccacagccgatgacgacacggccgccgccgccgccgcgacgccgctgctgccgccttcgccgccaccgtgcggcgccgcggccgtgctcggggaggagcccgcctcgcccgcggctgcgtggcggccgcccatgccgccgccaccgccggacgagtgttccgggccgacgtcgtggaggatgcccttgaagacgtggccgccgatgctgacggtggtctggtacgccacctcggcgtcggcctcttcgaccggccccagccgcacgcagcggaacaccgcctccgagctcacctcccgcgggaacctctcgcccaccatcatctgctgctgctcccctacaacaattgcacacatctatcgtaagaagaagaatcgaagccatggcgggcgagcaagcagtgcataattggacgcagcatgtacctgaggaggtggtgggcgtggtggaggtgg

SEQ ID NO: 48989 - DNA, 5524 bp, Oryza sativa
cgcgtagaacgggtgcgcggccggcggcggctgctgctgccatagctggaacccgccacgggacgcggtgctcgggtacaggaacgcggcggcggagtcggtgggttaacgggaggtcggtggtggtcgtcgcggccgtgcctccctccgccgcctcctaacgggaatcccgccatgcgcccagatccatagggtcgatcaatccgccggctcccccactctcgttccctccatgccgcttccgcctccgcctccgccgccgccgccgccccgcagcatcagcatgcagccgccgcgtggcgatcgaccgaccgatctgggatagaaaaacaaaatccacgagctcctaaagctgcctcctcttgctgctggtggtggtggtggtggtggtggtgggaaattttggcttgtgtgcggcgcggcgcggggggtgagagagagaggaggaggaggaggacgcggcggaggcagctttttgggcggcgagtgatgaggtgggggggtggagttaatactactgggatgggatgctagggagaggaggaagaggagacagagagagagagaggaggaggaggaaggagggtgagatttttactgtgttgcgttgcgttgggatctttgtttgcacgcaaaagcacaaaggcgcagccggcgccctgcctcccgctgcaacgccaactgaataaaaacaaggcactacctgcactgcactgcactgcactgcatgcagctagctgatgcaggggctgcatgccttccttcgccctcttgcttcgataaccaaaccaaaatactactagtgagttgtgatggaatcatattacaaaaagttttagaccctctcataaaaattttagtccctcctatagaagttgtgatggaatcattgtgcttttattagagggactaaaatttagtcattcattcccaaacacattaaccccccccacccccacccccaacacacccaagtatagctgtcgaccgaattaccttcctaaattaacaacaaaactagatatttgacatcctcaaatctctaaaccggacaaataacccccatcaatcctgtagaaggtggttttaatcctgcatggcatcaacgagcgtgataatgtattaatccattcaggaacatttcaataaaataaatattctaaaattagatggtcccacatgccatgctcatgccttttcctttcttccaccttccctctcttcgtcctctccagggtagacaaggaaagcagcgggggaagcggcgaaggcggcagcactgacatcgacgccttcaagacaagtcagaggaagaggaaaacggtaggaaagtggcggtggtagcggcaaggcgcccaccggatctgccctctccatcatcagcgtcaaatctgtgggagcatgccggtgccgagcggcagcaagcgcggtggggaaggggaaccacgcaggtactcgctgtgtagcgacaaattgcgtttgtccacgaacatgagggatctcgcgcgttgccgacatggcctcggcgcacgtctccaccacttgccacccctatcctctcttccacagaggtgatgcggacactggcgaggcaagtctcaccactgcaaacccagtcgcgctcgtcggcgcttgctgccaaccaaagcttcctctcgtagctcctgtcactacctggaactcactcccagccgcaccctctccccgccattcccactgccgcctggagcgccctcccatccgcgcccgcctcggactggttcccctcctatccacgccagccagccgccagctggagccacccaaccgcacctgcagccactcgcctccaacgctagcagcacaaagaaggaattaatatgacatgtcgctgccacgtgtctgccatgtaggacaaaaaccgctccgaattaagtcaggggggtaattcgtccagtttcaatagttcaaggtttaatatatgtctggttttgtggttcgtgtggggttaattcgtattgtcgtaatagttcaggggtaattcgcacttttcttaatcatatttagggctttgtttttgtgatggaatcgtagtatatactagtgtttgtttgagtttgctaacaccacatttgagctgacaggccaaagctttggtacacagtgataaaatttcgtgtatttatcatcacaacttttaaaatatgacgtgtactgggagaacattttaaaagtacgatgaaggcaggttttaaaaagttttcgagcaggtcgcagcaggagcagcgattcatccgagcgacgaggcgccgcgcgcaagggcacggtcttccgtatacgtattccatcccacatatcccaccgtgccgccgctccgcacttaattttaattgttttctccccgaggcttaaccaactttaattgttttcgatccatcagggctttcctgcctagcttttcagatatacgtatgtactgtactgtagtacatgcacctcttcagctgaaattctgaattgtacacacgtacgtacgtagagaggtgtataatacggacgtacatgcactacattaactctgatgcacttggacttcacacgtacgccaacagatcatatatctagccagccgcgttctagcgccgccacgtctctctctttctcatcacgtactactcctacatacttcctccgtttcgaaatgtttgacaccgttgaccttttaatatatatttgactgttcgtcttatttaaaaaatttaagtaattattaattctttttctatcatttgattcattgttaaatatattttttatgtaggcatataattttacatatttcataaaagttttttaataagacgaacggttaaatatgtgctaaaaagtcaacggtgtcaaacgtttcgaaacggatggagtaatccctaaggttttatggaccagttttcgtagaaagtcaaaatggttttataaagtggctagctaacgcgcttacccctattgtttctatagggaagtgacagccacataatcgaaatcctgaatattatgcaaagctagtcgattttttttggcatatctccttatcacacatagtcgttgcatacgggtcgtctatctactccctccgtccaaaaaaaaaagataaaccctaatttccgtgcccaacgtttgatcattcatcttatttgaaaaaattataaaaaaaattaaaaagataagttacgcataaaatattaatcatgttttatcatctaacaacaatgaaaatacgaattataaaaaaaatcatataagacggacagtcaaagttggacacggaaatatagggtttgccttttttttttttggacggagggagtatctctgttctctttcaacattaaatggaaaataatggatgtgcttgcttctcgagcttataaatgacacgtttttacaaaaataagaacaaattctatgtagtaatttgttatagaactattccacataattaatttactcctcgcttgcacactcacatcattttcatatatcatctagatattacccgtgctaatactttattggtttgtgtacgtacgtagctaaatatttgctgactgatgctctctgtcaatggaagaaggaagcaggaagtcatccaatccggtttgtaggccgagcaatatactagtactagtccatgttggaccagccgtggacagtggacttggcttcaattcttgcaaagagaaataagaactcaccatttgctatactgtgacaagtcacataaggtgtgatcaacagtttattggttataactatgataaactttagctagcaaataaaattacgatgcgtgaaccaatgcactaataaagtgtgacttgattcagcatgatattcaatcaaacactaacgtaaattttttttggcacgtttaaggcttggtgtggcaaactactgtcaccaaccaaacagaccctcgaactctcagtactggagtactagtagtagtacacgcatgatgcaatggttcacaatggatcgatcgatcgatcaagctggagatgatgttgccaaccaaggaaccaataatgcaccaacagcatcgcctacaccttgctgtagatgatgtacaaaattttcccgtgctgtactcgatcgctcgcggcctggctacgaacgtgcgacggtaatattaagcaaagataataaactcacaccgtcccataatataaatgattttgagtttttttttcactgtttgaccactcgtcttattaaaaaaaatagttttttgacttactttattattcaaaatactttaagcacaactttttatttttttatatttgcataaatttttttaataatatgagtgatcaaagaatataagcaaaaatttaaaattccttatattataggacggaaggagtaaatattaaggtgcccggggtccactattcggccgtgaccacgtcctctctccgttcctaaactgcatagaaattataggactagctagctacctcctccgtcccatagaaatcagcatagtattgatataacacatcttaatattatgaattgggacatacatctatctaaattcgttgtattagaatgtgtcacatctaattctagatttgttttttcttggggcggagggagtagtgatcactccctcgttttgctactagttacgacagattttaaaaaactagaacagtagatgattatttggaattatcgggaaaaataatctagcacgacatgcaatctggtttctgcttttgttttaacacagtacaaatgtagacgctcatataaacatatgcatactcattcatataaatgtacgcacgcacaatatactgctatgagttcatgagcaatttcgaatactgaaccgatacatctcaagatttatgagccctacataggtgtttcgctattgacgagctaattaatatcttgagatttataaagtctatgagttttgaacccggtgaaaagattccaccacactaagaacctaacaagtttctggttttgacccaacaacatactagtccctccgtattttaatgtatgacgccgttgacttttcgaccaacgtttgactattcgttttattcaaattttttgtgcaaacatgaaaatatttatgtcatgcttaaagaacattttatgatgaatcaaatcacaataaaataaataataattacatgaattttttgaataagatgaatgattaaacgttggataaaaaattaacggcgttatatattaagatatggaggtagtaataactaagtaaaagaataaaacagacttataagatttaattcatactctttttacttaatttgggctctagacaaaccggccccgtgcatgcatgtgttggttgttttacccctgcaactatcaactatgacaaggtgcgtgcatgcgtcctagctaccgtctaccgaacgtttcaacgacgacgtcgacgaccactcgatatatgggtgctaaaggggttttcctagctatggctactaagcta

SEQ ID NO: 48990 - DNA, 4331 bp, Oryza sativa
aatatactatggagcatagtacactaatatatatttgtgtagtacgcactgtacgtggtagggctcgatctccctgaacaaaattacttcgttaaatgtcgtgcacaaatataatcggcacatgctacacatgtatgcacatcgtttggtgtggagatgctagatgtatataaagcaggctaacattaatttgaaaagattttctataaaatggatagttgcctaggcatttcacagcttatatatgtttacatttatagttataaattaattcttttttagatgaaaatttaacaagagcttcaacctcttagaaattttcctttgagtccatctctcttatccgattcttgcatttttcctgcggtccaatcaaactatcatttttatgtttttttttattttacaattacattcatgtcagaatatcgtgtttttcctatttctccgtttttccatttctacgatccgaaggggccttgactccttgagaatcgtacatatagagctgttccatatacttccatgtcttgtagtaaaacagtaatatggatttatggtgttgtacgttggacgacagaacgtttattacttttccctacagtacacattattccatcctttgcaatttactcctacatcaagtacgtggtcgatctgagagacccggttgcctatagtcggtcagaaatctggtcccagctgctgctggtggctgggcactgtttgaattaatcagtgagagctatagctgatgctgatcgatgctggaaatctgcaatcattcagtatagctaaggagggcccatacccattacgtgaaaatgacaaagcgtttgttgtatatcgatctcgacacagtagttcatgtgtcatgtgcatataattaacaggacgtacgtacgtacggcccgatcgtacgtgggacatactgctgctagctacatgtacagccagcggcatacagtgaaaacaacaagccaaaaattgaaatgcatttgcatagtagtactcggcagtacgtttgccgggtaaattagttaactctcatcaactagtattgcattggttaatgaggatgcatgcatgtagagcattttgcatgcatgatctcctattcacacaagatgcttgcacgggttataataacgcaacgcactacaccagtagttatgacttaatgacagagaaaaggatgaattaacatgcatagttatgcaacacacagagagcatatgcaggagtactgatcgagaggaatataggagtctcttcagtctttacttacactgtgagcaactaatactccatccgtcccatattaatatagcaacctaaaatcggatgacacaacgtatcctatttctataaatctatacagagagcatattcagattcgtaaatcctatattactatatcctaggacgggggagtaatacagtaaccacacaagcatgcatgcatatctcatcatgcatgtgtccatataagccaaaagccagctgcaagattgcagagatatcaatcgatccggacaagaaacctgagtcagatccctgaaagaagatggtctctgtttacatcgacaatacatgcatactactgcactagacagtactccatgagcactaccatgcagctagcaatatacatatactgtactaaggtgagcaatacagtaacgacacatgcgtatattatagctgctgctggttccttggatccgtgtggctatatatacacctacctagctatatacacgtacgtacagtacacggggaatatcgagatgctgtatggaataattattggcttgcatattgcttctttttttttaaacgacccattggcttatactcctagtacgcaagtatattgcaatatatatgttgtgcaggaaaattactacaagtagtccctaattaactgtcaaaatgccatcatcgaataataagtcaatcggtcgatcggtagagattgctgatcctatgatatgcactagagctacatagactacagtgagactctgtatttgggcatgcatcttgttaattttactcttgagaggtcagctaagagagcttcgtgttttattagctgagcgagcatatacatgcaggctggcgagctagtagccgcggccagatcgagagctagctgcgttcttcttcaattaattgcttgcgcaaaacatgcacacccgcccgttctgatgagcgcatgtggcgcggtttaatgcaattttaattatccatctctcgtcgtttatcgatccatctgcgcattgcatatcaatatcaaaccagtgccgtcccctctgataaatcctagtactggtaataactacttcatctgaattgataatatttgtcgttttagataaagatattatctcaaaacacaattgtaaccattattttttattataatataaaaagaatatcaacaaatacaaggtttcattgaagtatttttaagactaatctatatatagctaggatcttcatatttctaagataaatattttagaaattatttatagttaaaaattcaaagtttcacatcactcatgtccaaaacgataataagtattatcaacctggaggaagtatgtgttttatttttaaaactaaactttggccaatgttttctcataaaattgcaaacacgtattttattagtatatctctaatagtcataaaaccaatattgtgtgaaagtacttggaagtacttcgcctgtttcaaattatgttattctagcaaatcacacataaactaattagaagtgccagattatattgttacctttaacaagtactccacccatctaaaaaatctagtaatagattagacacaacctatttcaacgaatatggagacggggtctattcatatttatagtactaggtcgtatcgtcacatccgatagtaagttgatatatttttgcgatggatagtctagtgagaatcataactgtattaataattgactacattaatgaagttagagagggaatgtcacctctaaaagtgatttggaacatgtgaacgacaagcttttgataaaaagaataaagtttaaaacgacatgtaacataaatctaagggagtataagcctaacaatgtcccttcattcgtttttatatagcgttgattagttcaaaaatgaattaaccaacatcatataaaaaaatacagagggagtaaaatttatagctaggctaattaaatgtatctatacattaatctatttatcaagatatatatgacttataaagtgcacggagaagtatgtatgtacaacaatcaagtgagaaaataattactcatgttaactccaaataaacctcaaatagttggtaagtactaaccatacaaaaacaaccgcggattcgtatcatgcatggggccatcaacaaatcgagaacaaatcaaaaagtccttgtctccgtaaaatttactactacgactgccactatagcagtggctgttaagatgcatgagactgtagcagtgcaagatggcagccggctccattgtagctgtatagtgcaagtcctacatggtcgatgaatgcatgatcaactacaggcaggcattgacaaaatggccgcgacgcatgcagcagtagtactccctccgttcccaaaatgatcatcatatagtttttttagattattcctaaataatcatcatatttatatttattcattaagtctattcgttatttgtgcatttgagtaaatagacattgatgcatgcattcatgcatacaagtatttataacccacatgcaatatcttgatttgttattggctaggaaatagtgggtatggtgcatgcatcgaatttgttgctagagtaaatatagtatgagagagttattagtttttcttgatcttgatgtactacctatgaaatatgtagatcaatttggaatggagagagtattaatcttgatccgatccgttagcattgacaaacgtgggagagatccgctgtgttcggattccatggatgggagctaatccctcgtgcacggaaaacggagcgattcattagcacgtgattaattaagtattagctatttttttaaaaaaaatggattaatttaattttttaaagcaactttcatatagaaactttttgcaaaaaaacacaccatttagtagtttgaaaaatatgcgcgtggtaaacgagggagaggggatgggaacatggggttacaaacacagcctacccactagctactcgatcgggtgtataaaacaaagcaaattaactcgaccgcagtaataggctctcgtctttgtttagatacgggata

SEQ ID NO: 48991 - DNA, 1327 bp, Oryza sativa
agagaaaattgtatttgaagtatatgtggatgatgcctcttatagatggagtggtagctggtttatacaaaccagataccactatctgtgtaattacgtccatatttgagggagtgacgtctcggttcgtttgactccattcataaaccacgccggtgcgcatgctatgctgaagtaatctcgtgttgggccaacgttgacaaggaagaaattttatcacaaacagcagctgctacctctgcaaatctctatgaaatcagcgttgacgctgacgtttttgtgacaaatggacgacttcgatcgtaattgggcactgtgtacagcgattcagaacgaatcaacgaggattgacttatcgccttccgttacatcattcctcaagcaatgcttcccattattattattattattattattattattattattattattattattattattattattattattattattattattattattattattattattattattattattattattattattattattattattattattattacacttctctccggttccttaattcctgacgtttttgataagattaaggtcagatttgtgtagctttggcaatcaataacttcaaaagtatttagtttaaaagaactaaaacggagttgctagaaatataatgcaatatgctacagtcgattttttttcagccacttacacagtagttacacctcatttacaccccacttacatatgtaattagtatgtaattttcgaatttacatatgtaattttagtacttacatatgtaattttgagacttacattgtaaatacactaaaattacatatgtaatttagggacttacaatgtaaatacatgccgactattttttgatgaaaaatatggcgccataaatatagctacacccaactaaaataacatacatatatattatctttcaaagttttataataaaagtaaacatgtatcttttatggtatatattataaagaaaaataagatcaaatatatattttgaagaacgtatcattgtctcaaacaataaaactatggaaccggagggagtacatcatttgcattatgcaaatcaacaagcaattaatcaagcaccgagttcacaaaaaaaaaaaaatcaagcaccgccacggcagctagctagctgcacgtaccaactgactcatccaccatcatcagtgcaatcaatgcagtgccggattattattgtccatacggtgatagtgacacacagacttttgcatgcgtacgtcatcatcaactgtggacgacgtcgccggcgccggacacgaacgcgcacacc

SEQ ID NO: 48992 - DNA, 20206 bp, Oryza sativa
acgatggccggcacggcggcggccatggcctcgcaggaggcgtggtagaagacgctgccggtggagaagaggacgaagccgccgccgtggaagtagaggatgacggggagcttggacgtcggcggcggcggcggcgaggcggggttggggaggtagaggcggagcgacgtggcgagggaggcgtcgagcggcacgtcgcgggagaggaccgggccggtggcggagggcggcgcgtcggggacgaaggggcgcgtgatggtgccgtccgggtggacgacgatctgcatgaagaggttgttcgacttgtccgtcgacggcgccgcggcggcggtgacgtcacccatggtgtcgggggcttgctcgctctgtttcttcttggatttgggaagataattagtgcttaccagcctcgtgagcatatatagtgtgtaatctttggttgaagtctttagtttgtgtttttttcatatcatgtcagtgtgggggtgagtttgtttacatatgtattttataataattgagtgtagcttatttgagcaaatacctaaacgttattgcattatttataataacatcattaattattacactctatttaaagatgatatcagatattttaaaataaatagagatgattttaaatgctcgaacagtaaggttatggacaatggcatgatgtgcacgtgtagtttttttttttatggtgatggatcatggaagcaagaaacagagttgagctaacgagtaggcgtcgttttttaagttgtgataataagtatacttgtactgtcacggttatcaaaagggaattgaagtcttggcaagttggcaactaagggcctgtttagttggtaaagagagaagccaaacaaaaggcctgtttagtactttagttggtgaaataaaatttttgggtgtcacgtcggacgtttgaccagatatcagaaagggttttggaagacgaatgaaaaaaactaatttcataactcgcttggaaatcacgagacgaatcttttgagcctaattaagccgtcattagcacatgtggattactatagcacttatggctaatcatggactaattaggctcaaaggattcgtctcgcgatttacatgcaaaatgtgcaattagtttttctttttatctatatttaatgctccatacatttgttcaaagattcgatgtgatgcttttacgaaaagtttttttgtggaactaaacaggcccaaaatagaagcgtgcataagggtaataagaaaatttagtaataaataacatttttataacagttaaagtatttcttgtctcaactattgtaagtagatagtcattaatttaagagtcccactacgatgctctatattggtagtagaaaacaataagaaccattgagctaatttgagcaaatggatcagatatattttactacaccctaattaaaggtagtagaaacgtggagacgtattattgtaaaaaaaaatatattgaggggggtataattgtcatttaaacaatgattgaatcccctcctaagctttttagatggaacatgagcgatgtcagcacaaagaatgactatagatcgatctagtcggaaaaaaaacataaacaaagttacgcttaatcactatattagtaaattactaatttaactttgataacgaacggttcaaatcatttctactggtagtataatattattaatatagagcagcggagcatcgttcttaatttaaattacatatattttgttataaaaacatatttgtttaagaggatatatcacacactatctttgaacatgtcgacaaaggttgcatacttccaaccacccactttggcgatcgaacaactaatgcagactgtttgtcgaactttcttccttgttcgatctgcagaggaagctcaaaaaggctacctgtggcgcaagaatatcgcaattgtggctgtcgtcgagtgacgcatgcaccattgctgctgctgcatttaaacaggataaataaattgaataaacctgcagctgatcgagctcatctccggccttcgttgagaatttgtctccttaagaactgtggctgattgagctcctccaaattcgtttgtattaggagggtcacgtccctttctaagttaagttatttttaggacgaagtaagcagcaagtagcagtggcagttgtgctcccttctcttaagctctttttgcttcctgcaaggaatgattgtggcttaatgcataaatatgacggataaaaattaaagttggatagcaagtcaaaaagatctgtaaaagcaggggaatgcacaccttgttgactcaaagcagacaacagatagtccaaaagatgattgagccttctgcaagtgcttaaggtgcttcctaaaactttcttaattagcatcggcttcttacttaattaatgtctttggccattcaaaacacaagcacatggccacttcgccatcgataatatgatagtggtggggggtcagcatcatcatatcgccatcgataatggcatgaaacatttatcccacacggttgcccggtaaagaggccagcacaaataacgcatagaaaagtaggataacgacttaacgagtcataaaaaatagagaaagaaatgagaaaaagcagggaaagaagctttgcattgcacaccatattgtctcaaactcaaaggacacagcatacatatatgaatataggggcataggacacagcatatcggcacttataatctcttctctactattataaaaattaaagatgtttttgtcagtattttggtatgtcattcgtatttgagtcggtttttaagttcgtttgcttttgaaaatacagatctgtgtatgagtcggattttcagttcgtttgcttttggaaatacaaaagatgtcatataagaattttctttaaaaaacttgcacgctaacttgagatgaaagtcggactcctaattacagctcattattttctaaaaagaaattcgagagaattcccatggtgaatttcatcctagctaaaccgtataagaataataagattaaaatagcattcactcgttgcaaagcacatacattttttctagtaataatattgcaaccaaggattacttgcggatcagcccacaaaccatttataggccattaaatgggtcatagcccatctacgggtgtacgggctggcccacttatatccttattgcaacctggtccaaaatatttattactgtgtgtactaatcgtttgtactagaaaataaaggatcaaaattgcgtgagaagagtgaaagtcatcatcatataatacgtaggataaccaaggatcaaagtcgcagggcttatgtgaacttttatccgaatttttattttcggcccagcatatgttgggctgtttctttttttgctcgtgtctatttctctttcgggcttagtaggccttcttttagaataggccgaattcaggcagatgggcctcactgcccatgcacatgtttttttctcaaaaaaaaagtttttttttcaatttatataacacagagtttgtatgttatttgtatatgtacaacttttgtacgtattttttctttctcaaaatgttttttcaatttgtagatacaaaacttttacacatatatgtataaaattccgatgtatttttttttcatatgtatgtgcaaagcttatatatatgaattatatatataacgttatatgtataaattttctgtgcataacaattttgggccagtccaataattaagcgtaagaaaaaaaagaacatgagagatgggaggaaacagggacgaccgagagaagtgggtctctgaggcgacatgtgccgctcccgcgcgcgtgacccactgtgtattagcgctgcctaaataaaagaaaagaaaagaaactgaggaactctaactgaggaatcaattcatcctaaaataagttaactaaaataagttaactttgtacaatatataacacatcataatactaaaaatttagattggattaacttattttaagacggagggagtacgttgtttttttttccattccacacaaatggaccaaacggtttataagtgattatatttcagctcccatacaacctatagtgtgctaacgtaaccttgaattttagctcagtggcttgtcgttttctcgttttctgataagtaatatcaggattacgttctgtatgaactctttttttttttaagtaaagctgggcgaaagccttttctccaaaatatcaggattacgtctcagctcaccacaaagcccacaaatcatcggattcatatttccgtctctttcagagcaggatttcagttatccaggtgtgttctccaaacatccaaagatctagacagaccaggttacaaagaacagtgccaacaatggtgtaaatttctatctccatcctttatttatcggcaatacacacaatatttgtagtatatatcattatcttttcatacatatttagctgaaaatatattaagtatacattcctagatgaaagcatagatggacattctccagctaacacaccagctcggaaaaattgtttcgtgccgatgaacagagccgaacataactgaactctcactaacatttgacttgagtgtatttgattgatggagtgacatcagcatctagcagtgttttaaatagcagactaagatattttgtggtagattatctcaaacggtaaataacagctaaaatgcatatgagagtaaatagctagatcattttcgaatagctagctacaattatagcccgagatttaaaacctttggtatctaggcggagtagagctgagggttggagagcctcggcgtgggcacggcgaccagcggcgtggccttcttcatcacgatgccgaaccgctcggcgaggtccagccgctcgccggccggcagctcccagtcgaacgcctgcaccagcatcgccagcgagtaggccaccatccgctccgccatggcgacgccggcgcagatcctcctcccggacccgaacggcatgtactcctgctcgctcccggtgaagtccagcctccgccctccgccgccgtccgccggcaagaacctctccgggatgaagtgttccgggtccttccacaccgccgggtccctctggatcgcccacacgttgacgaacacccgggcgcccgccgggacgcggtggccgcccaccgtggcgtcctcgccggggcagtgcggcaccatcagcggcagcgccgggtgcagccggagcgtctccttgaccaccagattcaggtagtgcagcttcgggaggtggctctcctccaccacgccgtcgcgccccaccaccgcgtcgagctcctcccgcaccttgcgcagcgtccccctgttctggagcatctccgccatgccccattccacggtgttcgacgtcgtctccgtccccccgatcaccatgtcctgcagccaaatcacacagccatgaatggtggtgtcgtcgtctccgacgccggcagtgcagtgactgagcagtgagcacttaccatgagcagggccttgacgttggtcatggtgaaggcggtcttcccgtcgccgccttccttctccagcttgagcatgtactcgaggaagtccgacgccgtctcgccggcggcggcggcatggtcggactcggtcctcttctggatgatcctggcgaagatgtcgtcgaagcggtccttgagcaggtcggacttgttgcggatgccctggatgtcgagcggcgccagcgccgggaagaagtcggacacgttgggcgcgccgagcaactcggtgatgtcggcgacgagctcccggaactccttccccaccgtcgtccgctcgctctcgctgccgacgttgccgccccacagcgcgccggtcaccacgttcatcacggtgaggaacatctgcgcgccgacgttgacgggctcgccggaccgcgcgcgcaggtggtggagcgtggccatgaactcccggcggcggaggccgtggaggctgtcgaggccggcggggccgatcatctcgtggacgcagatgcggcggaggaggcgccacgtggggccgaccgggttccacacgatgttctgcccgccgccgtaggagatggagcacgcggcgtcgggcgtgtcgcggttggagaagacgaggtcgtggtcgcgcagcacctcccgcgccagcgccggcgaggtgacgacgacgccgagcttggagccgaggcggatagagaagatggggccgtacctggcggcgaggccggcgaagtaggtgtgcagctccgggtcgagggacagcaagctgccgacgagcggcagccccgtcggacccggcggcaggccggcgccgcggccgcgccggaccgcgacggcgaggtacagcagcgccgccgcgaacagggcggcgtagagcagcatcgctggggtggatgtcacctccatgactgccaagcaatcgagatattaatgcactcttaggtggaaaatggagctaatccatcaacctatttagggtgtattcggcaccctcttttctcaacccctctctctcaatttttcacgcgcacactttttaaactgctaaatgatacgttttttgcaaaaatataaaaaatttctttaaaaatcaaattaatctatttttgaaaaaaaatagatataattaatcacgcgctaaatggatcgctccgttttccataattacaactcccttcgtattttaatggatgacgccgttgactttttaactaacgtttgacctttcgtcttattcaaaaaatttatataattatcatttattttattgtgactttatttatcatcaaatattttttaagcatgatataagtatttttatatttacataaaaaattgaataaaatgaatggttaaacattagttaaaaagtcaacggcgtcatatattcaaatacggaggaagtattccggatgggaaccaggatacccgaacacagccttatagtataaatagattaatatggttttcaagcaatttttctataattgtattttcaaaacacaatcgtttaactgtttgagaattggcttattcgaaaaacgaatggatagaagttaggaaagggaagaaaataacatgccctaagctaagctagctgcaaatccacatatataaatcctcttgatcaaatgcaatcccaaccaaacacggcaagacgacgaggatttcatggattgctccgccggaaggatcagtgcgagtggacggaagcgcgcggtggatggcacgatggagatgccgagtttgtttcgttctcgatcgacttctcgcgccaaaaacaaggagggacgtaggaggaagagaaatggacagggggcactggccagtgacatctactctctccgttttataatataagtcattttaacatttttcatattcatgttaatgttaataaatctagacatatctatctatctggatttattaacattaatataaatatagaaaatactagaatgtgtaacggaggaagtactaccaatctagaagaatcttgttatgttttctcacagcctcatctggatatttttgttcaaggaaattataccatgattgctgacgaataaacgaaaatgggggtaaattattgtgggttgccctgtcatgtcaggtactcaggtgtagtgtagctcgtgcatgccctcgtgcgaataaacaagtcatggaatcaggcacttaaaccaagagtaatccatccgtctcaatataaatacaacatccgttatattttaaatacaaccatgagttttcgtgtttaactttgatcgtcccttttatttaaatttcttttatgattagtatttgtattgttattagagcaagtataatagtagggtataagctggctaaatgctgagtcggaggagaaaagagaggagaaacgagctgtaaatttacagccggcttggatacaagaaccaagaaactctgtgagagagacaagtggattctgtattaattgtaaagagctaactattagagaagtttaatagtatagcccactacaagctctaattcatctataaccgatctaatagccaattcatacaatagttgcttactatactattaatatgtggtccaacttgtcatacacacattgtgtcttggagtccgtgctgcagctggctacaaatctatagcccgctgctcttctctctcatcttttatctcgttaaaatatatttatagttggctaatagtctgctattgtacctgcttctatgggtagactgagaaaagactacaaagaaccttatatccaataggttgtctgtattattagccttgctcttaaataataaaacatgaacaatactttaggcatgacttgttttttaaatttttttttaaaaaaatattttaaataagacggacgattaaaattgaacacgaaaactcgtgactgcactcaaaatcggacgaaacgagtgtagaatatactcatctgaaatcatctgaagattgcatatccttgaccattcaatctcagggaggggaggtcaggtcacatgggctgtcttggctgggatcgttacttgtgtttggaagcaaatcaccctcccacactaaaaacggagtgacctattaacacatgattaattaagtattagctaatttttttaaaaaaaataaatttatttatttattttaagaaacttttgtatataattctttttaaaaaatcacatcatttagccatttgaaaagcgtgcgcgtagaaaaagaggggagtgagtttgctacgggtagtacctagtttcaatgattcggctatggccatatatctctatcttgttgacacgaatcgataacaaaagtactaaattttcatatatattccaattaaattgttgttaaaatattgacatactaaaattttgataacaaaagtacaacaaatttcatatctattcatataaaaatgttattaaattttcactaatttgtagaaaatataccgtttaacagtttgaaaaatgtgctaaaaaaacgagatagaatccacatgttaataaaaaagcggaggtaatgcagactttagcacttgatggtggtcgagtcattaacattttagacagtgttttattcactgtttccaacttcacccactcatttttcacacgtacgttaccaaactattaaacataacttaaaaaaatcatattaatatatttatttaaaaaacaagtaatatcaattaattatgtactaataagtagttccgttttacatttgcgagaatgagttcccaagtcagtttgccgaactcagcctagtgctgttaatctcagtctctttgcccgtgttccgggggggaggggaggagggacacacacatccacgggcctgtctggtgcccatgagtaaaaggaaaatactttagcttacctaaattggtgacaaggcaccactgatattaaaattattagctattacttcttttgggatatgtccaaatttataatattatgatatgtcaaatttctcaaaatcccttatattttaggacggacggagtaacaagtttaatggtagaataaatattagctattagctcatattaaacctaatatgtagtataatatataagtttatctctatatttttcttatatcttttttcatccatacatttatcttagagtacatgactatatgagccaacattctttttttctataagttctcttaccttcatgtaaatttatagttactcgagtttgagtagtttataggcacttgctccaatttgagttgcggttcccaccaacatgtgaggaagacactgatcactgtgttagtcacttcagctctctctctgtctgtaccacaaagtggagccgggtggattaggcagataagcacagatacaggacagcaaatcagctgtgttaaattcagcccattttgctacagaaaaacggcccaaaaaaataagttgaccctttaaggcccatatggccgtacacagctcatccagattccagaacactgatccctccggcctttgcagcccataaaagcccattattctctctctccagtctgcaacactaaatgtttctacactaacttgacagtcttgaatgactaccacttttcatataggtcacactccctaatagcaatagggagtactcccttcactaagttgtttagactttttattagttaaacttatttaattttgatcaactttacgtagaaatatagtaccatttctaacacaaaacaaacatattatcaaaatatattcaatgatagatttaataaaactaagttggtgttttagatactgctatttttttctataaatttgatcaaacttaaaagaatctaaataaaaaaaagtcaaaacaacttttaatataaaacggagggagtagtataaatttgatcaaacttaaaagaatctaaataaaaaaagttaaaacaacttataatataaaacggaaggagctgtagaaattaagcaagtaatcgacattgggaggtaccaggatagcaacctgcctcctgtttcagtcatatcaaatacagtaataatttataaaagaaaaacatagtcgtaagtcgtatcatatcattatgatacttcatcatcattacagctttcttaatctgtgataaactagggcagcttggatctccctgcaccattgatcagtatgtgcagtcatcactcttgatcagaatctgaagtcatgcatacgaaatcttcagtgtttaattccaccattgatgagggattaaacaaatgtgtgataaagatcacccaaccttcaaaacattatctaattccattacgcatgcatgaatttgtttgtgagggctagctttcatcgcgtcgactttgttgcaagctcaagaaaatatctgacagtgatggagccgtcagggtggtagaaagaaagcaagtcaatttgcaaagcagttctttctgacaggtagccatcctgcaacgagttatgagttctaatcctctcattgttgctcgttaccttagttaccttattagcacaacccaaatttatttttttaaacggggtttgtgggttttatttcactgtactatattctttaagcattggcttataaatcactaataacacagatataaagttattttttttaccatgaattatgtttgtaacttcgttccattttctgcagaagataaacgcaaataagatagcgtagaattgatcatttgtaagtttagtatagatatattgcatctttctataacatcagcagtgcgaacagctgacgttgtcctagcttactgacccccaatacatgataaatctttgtcaggaagacggagaaaacagtgcatcgttccaactctgaatgtacaaaatccgagttggtcagtttcaataaaactgatctaccgtgcaattgtcgttatcgcttaccaaatccatgttaactttattaagcaatttgctcttgtagtagcatcaacataatccattaaaatgcattaagtataacagaaccccccaaaaagtatcaagcaaacaacgtttattcatatacatgtatggtggtgaatggctagtagttcttgtgagctactgctactaaccggtggagagattctccataggaaaatgccttatcaagagaaaaaaaaaagtagtttacactgccatctatttggatatcagagtgccacgtcacctggagaatggagatgacctctcatatttctgaacagaagcatgtatacatgcaaacgtgtctataagggtttctagttctacaacctttcatctatgagaaatataggttctataaacacaaagcccttggttttaagggtggaacatcactattctatgttctgaatatatcttgtgcttgtgtctgtcaaggcacctgggagaactggtcttgttatcatccacagcttgggacacagtgcaccttgctctcttttcacaatcttctgcacctaccagccatgcacaatttgtatgccccttcagtctaaaagttcaatccatctgaattctgaacccttgcaccatcaatcaagctcgaatcgtccatgctgaagtcttggtagtcaagcagccagtctgttgtgcttccatcccatgctgactgcttaacgatgccactgaagtcatcttcattgctgctagtaaaatttagccatggctcgtcagctggaagctctgcctccaacagccagttcaccaatgggtccaggccatgactgctggtgttcctgcttgactgctccatcgagtctgtgggcactgacatgtccctgctgcagcctccctcgggatcgaacggatatgccataccatttgacttggctgattcggttgtggcagtggacagcgtggaggttcttgtttggctaaccaccttggtgttgggcagaggctgatgtgtggctgggtcgatgcccatcttgatgagcttcttcttgatgtgcgtgttccaatggttcttgatctcgttgtctgttctccctggtaatttggcggcgatcttggaccatctgtgtacggatacaaggtatcaagaatcaagagtaatgaaaatggtaatgttattccagtaaaaaaatatggtaatgttatcttctttgtgcaaggaaccgaaagggtgaaaaagacaagccattcgaccaatttcaagtattttcccagtttgctaatgatagcagtgtattcgatatcatgtttcaacattttttgcactaagctaggttgattacgacatgattggtgctatcacttttactttgtagcctttgaattgttctatttctttctctctctggttcatctacataacatatggaggttacatcaacataacatttgtcggtttagagggcaataacaaaaacaagcattactattccattattcttttgagtcacattagcatcattgtaatgaccaaaggcacggaacaataaatcaacaacagaggttacagagaagaagataataaaaggaacaagaatcactcattcaggacctagtgaaataatgacatgcaaaacccacgggttaattaactgtcaaaaatgtcgaacgctgatacagttgcacttagacagctaacagtaagtttttagaagatatgaggtcctattatcagcaatttcctttccagatagattattctaagcagttccaacaaaaatgttaaccaagggtagcttactctcagtatataaggacttgtttcattctaaacaaagtactaatagtttttagataagcttgtagtgattaatagtcatggaggcagactggaggtttgagatttgacaaggataccgtgtgcatatgactttgacgctcttggttaaattcagctggttgagtattgggcacatatagtcatttgctaattagttgtatacaaaaataatctcaattattttgttgggacgccaatactgatattagatagcaatctgtcatactatctatgctcctttactttcagctttagaaattgatatgatctgtagcacacaccttcgaccatcattttttctcaatcaagatttcaagtataattatacgaagaagttacatgaaaaattaaaaatctagtaatctcattttgaaataacaaatccaaacagtttgatgcatattagtggtcaaagctttatgagtttgatccataaaagaaacagagggagtgatgtatcactatgcatcttgtaataattaataaatgcatgcatgcatacatcatgttttttgttcatatacatagtaaacatactacaagttaagtgctcatacgatctttagaaacacaaatgcactgcttctaaagcataccaagagattgatatgtaactacacactgctacatacacgatgcacacactaactgcatgcaatttggtttttgagaagcattgtggcaccactgctcattaccatgaagttttgctttacctatattccgtttttcctggatgcttctaaacttaatcaaaaggaattcactcatgggttcatgcccaggaatgcatgcagatagcattttctagcatagcaggaggcagatggatcaacatatgagatgccctatatgcaagcttataagcgtgctacaatatatcatatcatatcatgagatatccatgcaagtaggcgtacctgttaccaagcttggcatggaggtccacaacaagctgctcctcgtctgcggtgaggaggccacgcttgaggtcagggcggagatagttggtccaccgcaacgggcagctcttgccacagcgcagcagccctgccaacttaggcactgctcgccagcagcagcggccatgtgtcaggatgaaactgatgagcttcttgtcctcttctgccgtccatggccccctcttcaccttcttcttgtcacagcacggctgcctccccatttgctagttactgcagacttgcaccagatagatggaatcctgtataaaatgaacacttataaatttctagtgcttgcacatgtccagtgagctgcaaaactcctgtgcacaagcgtcagatgaaagggtggtgacagctctgttgcaactgcaattggtgtctgtgcttgcatatttataggtcagctcctcacttcctcagtttctcgaaaaaaatgtgtctttcatgaattttgtgtggtggtgatgatgatttggcttaatttagtgtgcttagaaagcaaggcctcaatccgtgctacagtagacttgcacccaaaaatccacatatatgcattgctgcaacgtggtgcatctacagtttagttgttgatcgaatttacaaattaagtataaaaaatatgtactattttattagcacagcagcaatttggtcgcacatgatgctacaggaaactcagatgtgattttctctggaatgaagttgcattttaactagtatttttaaagcttttgctgctttcatttcccacaaggctacacatttatgctgcctttgctacccacctatgtagccatttcgtcatcagctgtgaactatagctaactgctaaccaaagtaccaaaccatttgaggagcccccctaacttcatgtgattgctgtgagctgtaactcatcgtatggaccagaataatgactttgagcacatggtggtgtatattttgctacagtaatatgtagaaaaataatcacgatcagtgactccagtggtgaaaattgtcatacaagatacaggcaatttaggatgtcatagcactgaattcatgacatcagctttcagtaggcaagaactcaaccaagtgatttcttctggcatacatgtacaggtgcaaattgtttttctagggcttgttcggttaataccgaagaggaagggattggaggggattaattccacacctcaataggtgtggaacaaatcccctctaattccccttcaatccccttctaagagggattaactgagcaaagccttaaggaaccaatgctaagtctgttggggaaaaaaattacaagtatacctggggctgggacatactttgtcaatagcaacactgaagatggaaagagtcacaaacataaaaatatcaaccatgtcatatatcagcttcctcgaatatgcaattactcatttactttacgatcaaccagaaaaggctagcctccaatagctctgccgatatctaggcattaaagcatatcaggaaaaacagtaactaattgatttgagttgagaaaacagtgcccaccatcagtaactttcaagtaccctgttccatcaaacaactgattcaatgtgcaagataactgattattttgtagcaggatacaaaatggaaaactagtgaactatgaactgtatgatctaggcatctaaccacactcttcagatcctactcaccacaggaacgggaaaagaaatggataattgtaccttcacccagaaatgacagcaagggatagcttattatctgtgggcacacaacagaatctgccgacatgaagaagaaaatgaccttgtgctgtaacaagataacaatgtcagcttggtgatacatactttggagtattgatgtaagaaggggacattcaatcaatcaatcagcaagcttgtaaccaagctatctattagtagatgtaagatttacatgtgtacttagaatgttgaaaccaagctcattgtgtattttctggaagtcatactccagatttcaagaagtgatatataaaactacaaaaagtgagaacaaactcttgagaaaacatatgcttaggaaacaaacactctgtaaggaatgcatctgttgtatatttacacccagtgccgttgcatgtttctgagatgaaacagtaaataaacgtagcttttagaagaaggaaactcccatcatcatgggagtaattttctttctagtcggttggtctattccatcctgccttccactatctgtagtctgtactagttagaatcaatggactgcatttctagatgagaagatttagctgacatcatccagttggtattatcatgcaaaattggtcctgaaaaaaactaaacaggagggattatctgggaatagtaacttcaacatttttctcttgtttttccccctcttatgtgagaggggtagttgattattcagtgcccaacttcaagcaagcttgtacagtaggacttagtgggaggtctgtgtgtcctttcagtataacttctggctgcttccctgaagctctgactataccttgacaggataggaagatattactaaaagaacaagtgacattatctatatatgaggtcatttaataataaaaacccttcaaaattacatgtgcatgtaagtgagactaccaatatttaggctcctcagtcctcaccaacccatctgagttacagctttcaagtaaaagacctgacactttcaagtccgtaccatgattctccaatggttgagctagtcaatgttatagataagatcacatagaagtaaccactgagctaccatctcgtgtttgtgcagtaaccactaaccaacaggctcatgattccattaaaatgcaaggttttagacagattacatggatttggtatacattcgatggatatggttagttgattactgctcatgtaacggaggtggctagcttttaaaatgcatgaaaaagagaatgggtctagtatttccatcactacatcagctaaatgcactgaataacaacctggattaccaaccttccagctaagaaaacgcgtaatcgatgccgcttaacattaaaggtactcttgattagagggtaatttatatatttaggttttgaatattgatcttcatggagactttgcgttttgaactaaggtaccctcagtaaggtatccctcttgctttatttagcaattagcacaatgactttctgaaaaggttgaaagaaatgactgggcttaaaggaaaatgttgtgcctgcctcttcagacaaaaatataattaaaaaatgctaggaagtgtagcttgtctacctacaaaatcatccaagattgatcactctatctgacagataatgagagcatggaattagttctagcaggctgtaccaacggcatatgcatgacaaattggcaatgctaatagtaagctaacaattagaactggaatgctcctcttgttcattcattggcatcgttcccgaatacgacccaacgcagcatggagatcttgtgtgcattcctcgattcagtctcaagctatattgttgccgatgctgaattacatgagcacacggaagtattggtcttccaagatatcatcataagacaaaagtaccagaagaagggactagactgtacaaaacctacaccctcatgggtccttgctgcaaccaaactctacgacttcgcgtatctgctcatgtcattgcagaggactactactgaaggttgcaaggtgtttcacatattgtcattcacatataacaacacttcactaaaaactagtgtgagaggagacacatgcctctaaatttggcctacatcaaagttgttcttccacccccaaaatcaacatgcatcgatcggttcatctcatggggggacaagacaagggcgacgcattcagatattgcgaccatgtgtgtcagtaagacaagcaagtatacccaccaagatcgcggcaagatcggaaagctagggcacggatcgcagcgaggagatgtgtacaggagactagaaagcgaagcgagcaaaagtgcagtggaatctttggttggtaatggacggaacgggcgcacactgaccgagcggaggcgcggacttcgccgaggtggcggtgacggcgacctcgcaccctttcccttcccccaccaccggaggaggaaggggagggcgccgtcggaggggagggcgtacggcccgcgcttggaaggggacgccattgacgagggcgcaacacaacagtgcgttggatggcgatggctggagggcgaactcctgtctttttcagaaagttcagattgttttttgtagaaaacaataaggatttgtttggaatgaactccctccatccttttttatatgtaacgttggttaatttaaaaataaatataaaagcgtcaaatatgaaaatacagagggaatatgaatttcgtagtcaattccaccttaaatcccttcgaaattcctatgttttttttaagaggcctaaactcttttaaaggtacacatttttttattcaattgttatggactgaccgggtaaataaaaaaatgaattcttggaatttttcctatgttgacttcgttatatatgaaagagatgcatccgaatgaaaaataaaaattgttcatgtagcaaaagtaaaaaaaaagagcaaaataagggtggtgatttgttttaaagcggaaaagatatactttgacaccctcgactatggtatcaactatggtatgagtaattcatattcgaacacacaaataccggatatattgatttctccaactattaaaacgagcataaacggtgaccctgattgatttggaaaacagttttggctgacgtagcatctacgtggcggtgttgatctactatctgtcccatgtggtgtttatgtggcattagaataaaaacaaaaacaagaaaaatatgtgagacccatatatcattcacccaaaaaaaaagatgggacccattgacataagatgcacatgtcatcatttgtctgattgtctcctttcctttttcctctttcctcactccccatctttttcctctttccttttcccccttgctactgttcgaagctcgtccaactcccttgtcagcatcttgttctccttccttgtctgctccaccgtcatcattgtatcctccttttgcgcctcggtagcgctcgtcaccgccgtcgatgttggcgatggccacttctcgaccattacctcgccaagaactaagaatgacagcctctgcatcgccagcgcagacgcgcccttctccctgccggtggtcatctcaacaggtattgtcaacacttaccggacgcgcaccactaccgtatcgcctcacaccgggatggcgctcctcatcgtcacctccgaatccgatgtagcaaccgcggtgggggtcgacatcatcggcgccaagccacctcagttagcgggagagtcaaaccgcttgtgcacgacaaagtcacccaacaatggcttgaggatgagcgagaaggacatggtatcggcggttttaacctcgataatcacagtgatggctaaggtagcggtgccgaagataaagaggacgagaagggacaaccgccagggctagagctacgtgggacgaagactaaatcaacaccaccccatcagccaatactgcttcccaaatcaccaaggggcaccagttttgatagttgatatagttggttttgtgttggagggcatgaattatactcgggccatcgttgagggagtcaaagtatactgttttccttttaaagctcatccatcaatccccttagccagcccatgcacaacaggtcattcaccagcccaacacaccgtaccgaatgggattcggcgctaccgtgcggccgtagcagatgggccggaacgggattcacgtcaggcccgtactatatgggctgtaactcacgtgcgggccgtatcgcgtcaaataacgtgggtg

SEQ ID NO: 48993 - DNA, 950 bp, Oryza sativa
actagcgagttggttgttctggtcagctaatggattttgtaaccccaaaaccacaccatgactctatgaccaaagcataaaaacattttttttctggctaaagttttattagtattgacggagcttggggctcctcaccgggagaccgcgcaggcctccctttgccggttcggccgggggctctgggtgaggttctaagctcctagcctgtggaaagttcgcgagagtggaaacacacaagacacgagcgatgtatacaggttcgggccgctgagaagcgtaataccctactcctgtgttttggtggatctgtgtatgaagaagctacaaaagagctggagaaccagagagctcttactctctccctctctgatcgttctggatccgaaaatttccccttctaagtgggcaaggtcctccttttatacctcaaggggataccacatgcaccatctctatcttttttgtggggacttatcctatcttttcataaacagacggagacttgtatggttgccgtccgaatgaccttctgatgggacggcccatacctacctccacttccgccggaagcaggcgcgacgtgggaacatggctgtctgctgacgacatgaccagtgtcagaccggtcacaaatcggtcattcttgtccaccacgcgtcagtttatcaatctgcatgttcgcccctcttcatacaatgtcttgtttgtaatggttaggatgaagcctggtatatatctgaccgggaccaacgtgccatctccaggagctaacacgccggctccggctagggacgagtgcttggaggctctcatcctgacgggatggggcgaggcgtgcgtcagaccgcctgtcgccacctaacccacgatctgatcggtctgtgactggtcactgaccggataaacgagcgcgctgcactgcgttacatgcggcgtgacgcgctcgt

SEQ ID NO: 48994 - DNA, 11402 bp, Oryza sativa
  unsure (1)..(11402): unsure at all n locations
gtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcccggttgctttgtcaccgctgtaaaggcgcctcatctccttatcttggccactgcttcatctcctctgtagtcttcgccgcagttagatgaatgctactctcatcactagtgcatccagtggtctggaatagtatgtttcgatgccaattctgtctctcatggcgacgacctttgctgctgcttggtgatgatggagggtttaattgattgattgtggagtcctaatttggacactaatccgatctgggacccacccagatgagctttagtgatcccatggttgatcaaagcgtgctgcatctgctaatctctgatgtgaagcagattggctgaagaagacttagatatcctttcttctttttttcccttgatagtactccctccgtcccttaatataagggattttgagtttttcttacattaaccactcgtcttgtttaaaaaaattgtggaattattatttatttttttacttgcttaattatccaaattactttaagcacaattttttattttttatatttgcacaaatttttttaataaaacgagcggtcaaacaatgtaaacaaaaactcaaaatgccttgtattatgggatcaagggagtatgtattagctggagtaattatattcagtgctgatagagtaataattgtagcttctactaactgccagtcatgattctaaaaaaatagaaatgtagagtagtatatatctgaatcttagcaaaatattattgtatgatcagatcgaccaattaaggcaagcccctcgtatgctgcttgttcgcaggtgaagctgacggtatgctgacagtagatttacttccttcatctataaatataagtatttttaatgttcagaatttggttatagatataagcatttctcaagtactactttttcaattgtcgtatcgctgagtgtgaactttttcaagtaatctctcagtggtattaaagtaatattattttaagtttattttttctaaactctaaaaataattatatttataaacagaaggactaataattaattaagtgaataataaaggttgattaagtagggtggtacttgcacttccctttccgttgctcgacttgctccaaggggagggtgggtcccaggtgacatgcgagtgggtgatggttggttggttggtaaagtgtgcgtgagcgtgtggggccgaggggccccaccatagaacggcgaggtgagccttatccgaaatggggaaaaaagggtgggctctcttgttgaatcggcaaaaaaaaaaaaactcgaaaaacatttttatttttagtttttggtttttgatttgtcaactgagacggagagagacaagttggttgtcacggtttctcttttcggcgaagcttaggccaatgggagcggtggtgtgtgtgggcgtgtgccacccgcaccaacatggaggcacaagtggtccacgggatcatcatgctttccgttgatccttctcttcctcgagtggcaactggcaacatttgttgtcggggatcttttgttaataagaaaatattttaattacatgcgagttatcgtttactctatccgttatagaatacaacaacctaaaatccgttaccgaataaaataagatgaaacgtatctaaaatcatccagattcatattattaggatatgccccatctaattctagattgcaatgtcctgtaatggagagagcatgtatgccatggtatgaattttttttaatgacctttctgatattcgagctacgagtgataagttaagaaacataagccaactaaaaataacttataaataattttttttatatctatgttactagtgatttaaaattcagtgttggaaagtagactacaagagagcgaaataaactttaaaattcagttttaaaatttaatattttattgtgattggtaagctaacggttagcaaagtaagtgtagctcaactgatttggtttattgtagtaaaaccagtcctgtgtttcctaaaataaaaactgatataccttttttcttacgtgaaacaacagaagaggtcctactgtgctatattatattaaagaaaaactgatatacctcacactactaaaaggagcagtagaacaaatgagcagtagaacaaaaaagcatgggctccagacacaagacgagaagttggcccagatccccgcgacggagagcagcggcccgcactagctcatagtactattcttcgttactgtctacaaccaacaggcaacagatatattcatacataaaaggagacccactgagtggcgactgacacgatgagcatcgcatcagtgttgtgcagcatcacaaagcatataggatgaggatttactccaggtaggctgatcagcagatagccatatacacttcaggtgaaccaaacagctctgcgttcctctcaaacaagaacagaaaagaaacaacacatgctaagagagattatgctgtgctgaatcatgatgatcaggtcaagtttctttcggggcgcccttcttcgcggacatcgcggcagccttctctgcttaaatctgagccacgtactcgtcgatctcaggctcctacagctcgcggaggccatccttgtgtgtcatcaccgcaatcttgatgttattgccaccgctctcgacaacctggagacatcaacccattactcaaatttaagatatttgttgcatataaaatgccaagcatcaaatgatatagctatgatggagaaaccaactcagcaaaaaacactgaataaacaaaggtcaaaggccaatgagttcgtcatgaaaaaaaaaaagcaaagcaagcaggcatctctgtctacagacaagtaaaaaaggatgacatttgttgcactaaaagagctcatcagaaaattctacatgtgcaacagactgacaaaatgcttaattacctatcaaatggcagtagtaatgtcattataaagaaataagtaccatggactcaatagttaatatgcatatgtgataaccatttgaagccaccaatgaatgtataagcagagtaagaaattgatttcggatatcatgaactgtgcatatgtgataaccaatggcattggtggagccagaatattcttaatgaggggttcagaatctgacctaagtggcatgattattagaatatagtgacatttaccagtaaattatcaaattggttcatatatggtatatagattcatgaaagttcaaatctaataaaataagtgactcttcattcccttgaatagctagttttcttatttgagtataaattgtatatgtttatgtatagtgtggttggttagcaaagagtttggggtacacatgtacccccatgtacccatctacctctgccactgaccaatggaaaaaaggtcaatgagtttgtcatatgtggcaactggcaaagcatgaaacaaagtactaacatactactttgtcttccaacaacgaaaaaaagcaagatatttcactaaaagaggtacagacatatacgtatatgacaaaatgtgcaagagacgtgcattttcacggtctgtatgagcaacagattgcaaaaatgatcaactgcttaccattagctagcataaactcaatggtggctgtgcatatgtgttaaccatttgaagccaccaataaacgaatatataaccagatgcaggctaagaacttgatttgaagtatttagctatgaactatgtgtccttgaggaacataaccatttgcagttagagacttacagtaatgaaaaaaggacatttagacttaggccttctttgtttaggcttataagctagcttatgagccaaaaagcctaagcctaaacaaacaagcagcttatttgtttgccctttttaaagccacaagccactcttacactgttaagccaaaagctaggttggagaaaccattttgttggattatatgaagtggaggtatgactcaaccattgaacttaggatttcaaatccaccggtttataaaacatataagccaataagctgacttaaaatctcaagccaataagtctaagcctaaacaaagatgaccttaatttgatatgtatttttgtaatggtgtatatacattttttttacctagacagtaaatacaatgaactaggcatccgtgcctatatctaagcagcaacatactaaagcggcagcagagttgacaaaatacatgcaagttgcagcttctacagtgcaatagaagagaactacaggtgcagattatcaataacagaaaaacaaaagtttatatgccactaatcaaacaactttaataacttttgaagagaaaaatgtactcacataagaatgcctttaaaaacttttgaaaccgtgcttaacacttaaaatatgagatgcagatgacaatcaaaatacacaaatgattaaatagctagagacgatttactacggataaagagttaaagacctatagccaacactacaacaataaaatttgaggtgcagatgaaaaccaatatacaaatgctgaaatagctggagatgatttatgagattacagatccaagccataccaattgctatgatcactccaggcaccaataagtatcatctttaagatggaagcaaacacaataaaaccaatcccatccatcccactctattttaggttcatgactgcatttatagtctcagccgattgtaacaaagattcagggaactattaatctttgcaccaaattgagtcatatggaacttaacgaagataacgatgttcaatcgtaggcgggcatcttacaaattactgaaccagtcaacataagcaacacaaattagtgaattacttttgagtatctgtcttcagaagcacagttactgattcagtggtagtggatcaaagctagaggtagttttaactagtaaaattattcagtgtgaagtgtatatatatacctcaaggagggctcggatggcaagcttgatggtctccttgccggaggtgtccttgtaattcttctcgaggaactcgcgcatggagttggagttgcggccggtggcgttggccttccaggcggagaaggtgccggatgggtcggtctggtagagggcgggcttctcggtgtaggggtcgaagccgacgatgagggtggagaggccgaaggggcgcaccccgccgctctgggtgtacttctgctgcagtccggcgatgtagcgcgtgatgtactcgacggtgacggggtcctcgacggtgaggcggtggctctggcactcgacgcgcgcccggttgatgagcacgcgggcgtccgccttgagccccgcgcaggcaagcgcgatgtgggtgtcgaggctggcgatcttgcgcatggacctggatttgggggggagatcgatccgcgggtgagatccggcgaaggggagggggcgggttgaaggatttacctggagtcctggagcttgggggtggatttcttctcgacgccgaggacgacggtgtcggtgccgcggacgccgacggcggcgttgcccttgcggacggcctcgagggcgtactccacctggaagaggtggccgtcgggggagaagacggtgatcgcgcggtcgtaccgggccatccctgcctgctggtggtggtggtgtcgccgccggcgaggttttcctgctctcgctttgcttttccttgtcggttgcgccgccgcctccgccttttctcgttgctgctcctgctccgccttttctttcttgcaagaaaagaagacgacgacgacgaagacgaagacgaaacggactcccattggcccatgggccggatcgtattccggcatggggctcgcgttatgaagcccactaagaaaaggccagaaagcccatggtttcttgctcacgaaggttactgcaggctgcatcccatgggcccatggttaagagggatcgaaattttattctccgttccccctttgattcgaggaaaaaaaatcgattttggctatatcttactcgaaaattttttttcttatctttcactcgattttctcacttaaacttacagtgcattttcttgtaagttacagtgcattttcttgtaagttacagtgtaatttatgaaacttacattgtaacttttgttttttaagctacaacgtaatttttaaatctttacatgtaagttttgaaatttgtattggatttagtctttttcttgaagatatggtaatttagtgtccattatagtgtttcttagttgctttttgccttttactgtgtctatcgaattttaatccaaagattaaaaattgcgtgatactcataaaaatctttcgaaaaatgcataggtactctaaaaaaataatggtttgtgtgtgtgtatatgcggtttatgtacctatagactacgtgtattgactgcctaggaaaaaaatataacagtatatcaaacaaaatgttttatcaatagttttgctgcatcataagttcataattttggccatgtcaatatatattgcctcacatgggcataaatttaatttgcaggcatcgagcagtcaccaattatccatgtctccccatcaaaatttgccaatgtcaaaactagagtcaaaccaacactggaatactaggagcccttgtctaaaaatgctttaatttctaaacggatggatttgagagaataaaaaaaagtaagcatgaactagctaattgaatttgtcgacatcatcagggcttgcaaacccatttaaaatctgaattgggcctttcatctatctcctcaaaagggaccaaatctgactcaaacttgaaaacttgttggatgcacttgtggcgtagtggagcttccgctatcttccccctcaaaaaatcatacctgcaaatcataggtagtgtttagttcgtgtgccaaatttttttaagtatacggacacacatttaaagtattaaatgtagactaataacaaaataaattacatattccgcctaaactgcgagacgaaactattaagactatttaatccattattagcaaatgtttactgtaacaccacattgtcaaatcatggcgtaattaggctcaaaagatttgtctcacgatttacatgcaaactatataattttttttttcgtccatatttaatgctctatgcatatgtctaaatatttgatgtgacggtaaagttggaagtttgaaaaaaatattttgaatctaaacacggccatagtatgaattaacaaacacatacctgtaaggctcctttgggttatatgattctcatatgaaaaattgcaatccataggaaattttactataaatgccatttggaacaaaggatttgaagtaaagccctgtttagatttcaacgtttttcttcaaactttcaactttcccgtcacatcgaactttcctacacacaaaaaattttaacttttccgtcacatcgttctaatttcttcaaacttttcaattttagtgtggaactaaacacagcctaaataaattcctgtggattgagttcctaacttcctatacaccaattccgtaggaaacaaacaatgagctcaaacttgtctctctactctctctatagaatccaccaaattctcatgttttttttttcctttcaaccatccaaacaatacacatttcatattcctatatgttttgcctgtttctgtatttttagaatcttgcgttccaaagagtaaaactactactgtttagctaattatttgcaaattgatttagatatgtgtaaaacggaagaagcaattattaagtatatacagttagcttaattaccacagcactctgtagacgctgttgaagaatgcaacgtcagatgcgtagagatctctgagtatgaatgagttgccttcctccattgccagcctcgtcaagctcgccgtcatcttcttctcccacctctcctgcctgtagccggccagcacccagacctcgacctcctcgtcgaccaccaccaccaggcacagcttcccctccaccgccgccaccttcttccgcgcccacctcttctcggtggtggcctccggcggcaggccgatgaggcgccacgtctcggtcttcacgtcgaacgcgaagatgtcctcggcgccgccgctcagcctgtcgggccaccggagccagtgcatggcgccgtgcgccctcaccgccggggcggcctccacgagcgactccggccacaccgcgacgtccgccgaccgccgccacgccatcccccgcgagtcgaacacctcgcagcggaggcagttcctgagcgtggggacggagaagcggacgatcttgaagtccgccgcgccaccgccgccgccgccggggcgcgccagcatcgcggtggcggccgtgcggtagcgcaacctcgggttaggcagcgcgcgccactgcctagtcgccggcttgcagacgtagtaggacgacgccggcttgcgcggcgtggcggcgtcggcgtcggcgtcgacgcagcagacgagcccccggtgcggcgagacggcctcgacgcggacgtgcggggaggggaggaagtcgagggacacgaggtcggccggcggcggcgaggggtgcatggaggagacgaaggtggcgtggtagcggttgcgcgcgacggtctggacgaggtagccggagacggcgtcggcgcggcggcagtggagcggcgcgaaggcgggctcgtaggtgaggcggcgccagcgggtggagacctggcggcaggcggcgaggtcgtcgagcgagacgcgtgtgagcatctcgaacacctggtcctccggcaggctgatgacgtcgcactgctccgacgaagacgaagacatcatggagaagagaagagaagacaagttggggcagaggcaggtactaggtgaggatctagtaattcagaactcgatgtgtgctagctgcattgcattgcaggcttgcagggcaagaaatgttggaattaatgaatgggccttagcccactcgaagattaattctttggaaaatcacaaaagcccacctcatgggatggcatgcatgtggagtttagtaccatcttgcttattctaggagagggggacctccttaaaagggaggatgtcctcctagccacttgaagcatgtgtggtggagagaagaggggaaacacacgcgcgcgctcgctcgcctggcctggcaggcggcgcgcgtgcacgacgtacgcgtcgaatggtccgaaaaattggctcctcacccttgcgcagatgcagcctccttttgcagttttgttttgctgcaaattcggattcgtttttgtgttggaaacgttccgaaaaatccggtgcgtgcaaacggcgtggagtccggataagttacgcgcgacttatccggttcggttacgcgcagtagagatcgtgcgggcgccctgatcaagcgacccttctctatataaaccgacccgccgtcttcatgcaatatatacgcaaaatcaatctagggtttgcctcctactctgtactgcgccgtcgctcgtagcctactccatcccgctcgccggcgtgcaccagcgatcgggagagcaggtctccggaacctctgcctttgacgtcctgcaccgggagaaggcggcaataaggtttttgggaagcgcttcgcgcgactgctccctgttcgttcgcgacggctcgccttcctcttcgctcgcgtgtttcgtgccttcgtagacacctgcgaaaagtttcgaccaagcagccggtcttttcgtcacctcggtacgtgttcaatatgttgcgcatatttgatctgttcatgttatactgtgtagtttacatgtgtagatctaatgatgcgttcatgctagttttcatctgtaatgtcatgatttatttatggaatagattaaatcattatatgtctataatctcaacaatccaaaaaccttattataggcactgtgattttactatggctggttttgccgatgcactgaggccggataaattcaccggtgtgcattttaagagatggcagatcagggtcactctgtggctgacagctatgaaatgcttctgggtgagtactggcaaacctgaaggagttcttactgctgaacagcagaagcaattcgaggaagccactactctctttgtgggatgcattcttagtgttcttggcgatcgtctggtcgaggtgtatatgcatatgaccgacgctaaggagttgtgggatgcactgaatactaaattcggtgctactgatgctagcaatgatctgtatatcatggagcagtttcatgactacaaaatggctgacaaccgttctgtagtcgaacaggctcatgagatacaaaccatggctaaggaactcgaactccttaagtgtgtcttacccgacaaatttgtggccgggtgcattattgcaaaactacctccatcttggaggagtttcggtactgcactcaaacacaagagacaggaatactccgttgaggggttgattgcgtctcttgatgttgaggagaaagctcgggaaaaagatgccgcgtctaagggcgatggtgggcagtccagtgccaatgttgtgcacaaggcccagaacaagagcaaggggaaatacaaagctcagcagaccaccaacttcaagaagcagaagaagaacaacaacaatcctaatcaggatgagaggacttgctttgtgtgtggccaagttggtcatctggctaggaagtgtccacagcgcaaggggatgaaggcacctgcagggcagacttctaagtctgctaatgtgaccattggcaacactggagatggaagcgggtatggtaatttacctactgttttttcagttaatcaatctactaattggtgggttgatactggggccaatgtacatgtttgtgctgacatctcattgttttcttcttatcaggtcgcacggggttccaccgtcctaatggggaatgggtcacatgcttctgttcatggtgttggcacggtagatctgaagtttacttcgggaaagatcgtgcagctgaagaacgtgcagcatgtcccttctatcgacaggaatcttgttagtggctcccgtctgactagagacggatttaagttggtttttgagtctaataaagtagtcgtgtctaaacatggatattttattggtaaaggttatgagtgcggaggcctgttccgctttttcctttctgatttctgcaataagtctgtgaaccatatttgtggcagtgtggatgatgaggctaatgtttggcattcacgtttatgtcatattaattttg

SEQ ID NO: 48995 - DNA, 3240 bp, Oryza sativa
atgtgtttaattcctaagttttccattgtcaaaggttctaagtgctatagttgtgtgcaatcgaagcaacctcgcaagcctcacaaggctgccgaggagagaaacttggcaccactagaactcctacattcagatctttgtgaaatgaatggggtgttgacgaagggtggaaaacgatatttcatgacattgattgatgatgctactagattttgctatgtgtacttgttgaaaacgaaagacgaggctctagactattttaaaatttataaggcagaagttgaaaatcaacttgacagaaagataaaaaggcttaggtctgatcgtggtggagagtttttctcgaacgagtttgacttattctgtgaggaacatggcatcatacatgagaggacgcctccctattctcccgagtctaatgggattgctgaaaggaagaaccgcacactgactgacttggtgaatgccatgttggacaccgcgggactgcctaaggcatggtggggggaggcattgttgacctcaaatcatgtgttaaacagagttcctaacagaaataaggacaaaacaccatatgagatatggattggtagaaaaccatcactttcttatttgcgcacatggggttgcttggcgaaagtcaatgtaccaataacaaagaagcgcaaacttggacctaagactgtggactgtgtttttctgggatatgctcatcatagcattgcctatagatttttaatagttaaatccgaggtaccggacatgcatgttggtacaattatggagtctcgtgatgctaccttctttgagagctttttcccaatgaaggatacacatagtggttcgaaccaaccctctgaaataattcccagttcaatcacaccaccagaacaaactgaacatacacatgaacttgtctctgaggaggatgtcagtgaagctcctcgaaggagtaagagacaaaggacggctaagtcttttggtgatgatttcactgtgtacctcgtggatgacactcctaagtcaatttcagaagcatatgcatctcctgatgcagactactggaaggaggctgtccgtagtgaaatggattccattatcgctaacgggacttgggaggtgacagagcgaccctatgggtgtaaacctgtggggtgcaagtgggtgttcaagaagaagcttaggcctgacggtactattgaaaagtacaaggctcggcttgttgctaagggctatactcagaaagaaggcgaagatttctttgacacttactcacctgttgctagattgaccacaattcgtgtgctactttccctagcagcctcacatggtcttctcgttcatcaaatggacgttaagacagcttttcttaatggagagctggatgaggagatctatatggatcaacctgatgggtttgtagttgaaggtcaagaaggcaaagtgtgcaaattgttgaagtctttgtatggtctgaaacaagctcctaagcaatggcatgagaaatttgacaaaacattgacatctgcaggctttgcagtcaatgaggcagataaatgtgtgtactatcgccatggtgggggtgagggagttattttgtgcttgtatgttgatgacatactgatatttgggacaaaccttgaggtgataaatgaggttaaatcattcttgtctcaaaattttgatatgaaagatttgggagtagctgatgttatcttaaacattaagctaattagaggtgagaatgggattacactcttgcagtcccattatgtggagaaaatcttgaatcgctttggctacattgatagtaagccttctccaacaccttatgatcctagcttgttgcttcgcaagaacaagagaattgctaggaatcaactggaatactcccaaatcattggctcgttgatgtacctggctagtgcaactaggcctgatatctcctttgctgtgagcaagttgagccgatttacctctaatccgggagatgatcactggcgtgcgcttgagcgagtaatgcgctatctgaaaggtactgtggaattggggcttcactatactgggtatcctgcggtactggagggttatagtgattctaactggatctctgatgtggatgagatcaaagccactagtggatatgttttcacactgggtggtggtgctgtttcatggaggtcttgcaaacagaccattttgacgaggtcaaccatggaagcagagctaacggcactggatactgctactgttgaggcagaatggctgcgtgatctattaatggatctgcctgttgttgaaaaaccggtgccggctatccttatgaactgtgacaatcaaacggtaattgtcaaagtgaatagttctaaggataatatgaaatcgtctagacatgtgaaaagacgattgaagtctgtcaggaaattaagaaactccggagttataacgttgaattacatccaaacagcgagaaacctggcagatcccttcacgaagggactatcacgaaatgtgataaacaatgcatcgaaggagatgggtttgagacccatgtgagttatactatggtggtaacccagtctatgtgatcggagatcccgtgaattagatcctgggaagaacaaaccattagtaaactagaggagagtatcaatatatataccctctccaagtgaagatgcatgtactctcgtgagctgcaaggcaggttggctatgccttaatgagttctgttggctttaattagcgaagatgttgtcctgcagagcattcttgaaagaactcacctttgtgagcttgactgttggtcgcagtctatgaagattttgggtgaatcttctaggaagcttactaaagacctaggagtatgacctatacgctccacccgaggggtagtctacagacggtctagtaccagataagactttgagtgaaacttgcttgcacaagacttgcaattcaaggcgtagtccattgttcaagttgtgagtaagtgtagcttggagttctaggtggatgttcaaccttaattggtctccatcgaaccgctggtatataaacagtacattggaaaaggcaaatctcagtgggattttgagatttggtgggggattgttggaattaatgaatgggccttagcccactcgaagattaattctttggaaaatcacaaaagcccacctcatgggatggcatgcatgtggagtttagtaccatcttgcttattctaggagaggggga

SEQ ID NO: 48996 - DNA, 6618 bp, Oryza sativa
cggtcttttcgtcacctcggtacgtgttcaatatgttgcgcatatttgatctgttcatgttatactgtgtagtttacatgtgtagatctaatgatgcgttcatgctagttttcatctgtaatgtcatgatttatttatggaatagattaaatcattatatgtctataatctcaacaagaaatccgattaattggatcggcagctagaacagttaataataaggcgagaaaaatcctcgccgcacgcggagagccgaatcgtgaaagaaaaatgcagcgagcacgtaactccatgggttggaaacgataacgaggtgaagaaacgcgtatactatcttctcaacgataacgagatgcaacgatagtcaagcatgtcaggatatcaggactggagctttgggcatgccgcttccgtagcggccaagcctaccagggtgtgtttagttctagggtgtaaaaattcaaaagtatacagacacacatttgaagtattaaacgtagactaaaaacaaaacaaattacagattccgcatgtaaactataatatcattattagccgattggtttctactggattatattgttatttattacgttatcatcagccgaatgtctctagatcattatttacttaagtatcagaatatatatatagccgattgctcaaaaccctatcgacataggctagtattggcatcgtctgaaagtactccatcatcttgtcagctgatcggctctttggtgatcaatatatttatctatcttgtcagttgcaagattaaactgactggcagatccacatctcatcaagttttagatctacactggagctaagcagatcttccagactgttgtgttcgtcgacttagttcgcgcaaacacagttccgacaccatcaaccgagcgcggatttttaatgaaaagatatccccaaaagaagagtctgttcactttgatgccaaaaaaaaccttaccaaaatttggcattgccaaaattttgacaggatttcttatatagttaccaaaatttggcagtaaactaaatgtagctacttttttagcaactttaccaaaatttggtaaggttgaaaatgacatcaaagtgaacaggcccgaagcaagctgtacggcccaatccagcccattgggaggagtagagtagcccagttatttttttcttgacctggcccggcccaaaattgatttgctgtcttctctctccaggtgttagttcatccatgatccatctgtcgttcgttacagccaagaaagaagggatcgaatatttgcttgagtcggcggcatgatgcattgcatgcgactttgagcgcgatatcgtcatgactcatgagttgatgtctgctgatcgatcgagacgccctgaaaccgtgctttccctgacggttcagaattggcttcaggttaacctcagatcggggagtttcatcattactcactgacgatattaattaattcttctagattagatgtggaaatagtagtaggagttattttaatataatgatctttcctctaaaaaaagaaatagtagtaggagtagatcatttccttgaaattttctcatgctagtaaattgacatttttcacaggctgctttagtaaggattctgtcacatcttatctgaatcagcactagtatttcgttactgcttccttcactgaatggttcatctgtcactaagaagaaaataaatcaacaatttgttcagaggtttgaaaaaaagataagcacttgaaagttacaccctctctgaatttaccctcttgtttctttccccttcatagaagatgagatcatctcttgcggggacttgttcttcacgctgtcactgttatgtaagatggggcttcttcctcacctcttgcataaaaatcaaggaactcatgtgatgatggccgttggccgacacaaaatggccacctgaagcataaccatatgaaagcagagatccaggctcataagccctttccctttacagggcattttcttcaggtgtgtgctagcttaacactaaggttatcacataccaaagtaggttcaatattctgcttttcattgtcattgatgagcacaactcacatcttttgcctatgcctcccccttttgccttcaccacattcagaattccttttgcatcttgtttcttcagagttcagacaccctttcattgcagatcagaatgattgattggttggttaattataccaacaaaccctcaaaattcttatcaggtatacatctgagacaaacaggatctgtattactcttcccagtttacctccaaagtgattcttatcctctctataaagacaagagagaatctcagattgtgctacttgctgtgcgtcttgctcaaactttcagaaagaaaaaaaaaaggagcttaccagatcagaatatcagatcatatgctcttctcgtttagattcaaagcagtgcatctggagtccacattgatcaggacccccaaaaaattaagcacagcaaagaatgtaactagaatagcaaggttttctgaaaggcaaataaagcaaagcaaacacttaagctgagcagcaactacaactgccaaacttgaggttgaggacgcctgcattctctatccacaaacaaaaagtcctaaagaatgtgctctccacgtctcccccttttgatcactcctactaccgatcaagaatccttctcacttgctactagctgaataatacgggatgctcctgctgggcaagcaggatcaccactgcaattgccaaggcagattggaaagctaaggatgccggccatgatgccgcagttgcagccatccccgcgccactgctggccttcaagctcgccagccacaccgcatcttcgagctgctcgtggctcggtctccgtgatccgttctttgaattcccactgcaaacataccaaattcatgaaacagttaatcaacctgaaactgatgatgagaatttgctgttgcaagttccttccatgcctactaggaaattgcaactttccagtcaaggccagcttaggtacaatgtgagtgaagtggggacgaatcaaaggagaaaaagattgctcctccttttcttagcctaactctatcacatcctcaatgaacctttactttccccaattcatgttccacatcgaaatccccaattttagcccaaaatctcaatgtgctgcaatcagtccactatacaattctatcatacacataaaaatctcatactggtaatcgaaatctcaatgcaatggattcgctgcgattgatttgaagtgtacaaacctggatggagtggatcgggggcagaaggtgatggtgtaatcggtgtggttgcaggtgaaggtggaggtggcgtcgtcgtaggcgtagctgtaggatttagggcacgccgacttgaagagctgcgagtactgggaagggtggcaggtgtccgggttgccgtaggcgccattgcagcagtactcaggtcggccgaacgcctcgcaggcgctgcggcaagcgcggccatcgtcggcgcggagctcggaggggcagcgctcgttgaggtcgacgaggcagccggtgtcggggcagtcgggggcggaggcctggacgagcatggggaggttgtagccgtcgacgaggctgacgtcgtagaagtccttgccgtcggcgccgttgagggtgaactcggcgagcgtggcgggcggggaggcgcccgcgccgcggcactccacctggccggagccgcagtcccccgtggcgcaggagcccttgccggagtcgtcgaattcgcagccggagcgcgcccagaagcggcccgaccaccccgacggcgcgtagagggagcgcgacccccccggcgagagcgcgaagccggtggtctccagcggcggcgtgccggagcccgacagcacccccggccacaccgtgtccgtgcaccggttggtgaaggtgaaggtgattgcgccgacgccgaccgagcctgcgcgcgcggaggaagaggaatcgaatcccccaaaccccaagaaagaatcaagtcaagctccaaatcgcgagctccagtagatagtaacccagcaatggaagtgactgaccttggaagaaggagaggaggagaacggcgagcgatgtcggggagccgagcagctgcatcagcatcagcagcatccgtgaatccatctcgaaaatcgaatcaagaacgactcacacggttgattgaatgattgagcttgggggatctggtgttcgacaagatttgctcgctcgctcgtttggattgcttaaatcgcggcggcggcggcgatggcgggggagtgggcacgatcgatgcccataaccccgaatccgcggacgcgcagctgagctgaggtcgcgcgttgcgtggtggagtggaagggggaggtggtgctcgtgctcgtgctcgtggccgtgtaaacctctgggcgatggcggctgctggctttataaccagaggaggccgttgcttgctccgcaaattcgcgatgcttttctttcttgcaatcaatcttgcgacttgcgtccgctttgtgtactttttgctcgaatcatctctcaatcagcacgcgagtcaaatgcagcgaccgcgagattagtactccattttacagtgaagaattctgaattggaatccatctggtagcgcactgctaaattggtactccatccgtctcaaaatataatattattcaactttaacataatctttgatgtgctactttaaccaccataattaagatttttaaataaaaagagttgcatattatagtttgttcaatgataaatctactaacatcaattttatatgattgatcatttttattttttttactattaataacaaaagttaaaaatatttgatttagcactactttaaaaatatttatattttgggaagtattgaatacttttatgaacgtaattctagcaccggtcgcctgcttaattccggcttcggtgagccagcagctcgcaaatgcacaccgaactcaaaattcgagccggttcgttttggtaggattcgatgaaatttccagtgatttgcgacggggttcatgttctgaccagtttgaattttgtgaacgttgaggtagtgggacaaaatttttgttgtttgttttgttggtaagcgagtggcttttgttctgtttttttgcttgtcacgttgtgggcacagtgtttggacggtttggatcggcccagcgacgtccatcagacctccgcttttgcggcacaaaacgataggagaaaggggagcatgcaacatgccgtccgaattttcagccccagagaaaccgaaagctcttaataattatcggatccattctgatcaccgatctatacctgacataagattttcttattcagtgaaaaccagcatgttgtcatgttgttccaaggttgatgctcccttttctcccaatgatttcatcaccgtaaacgttgaatggatcacacacgtcttgagtagatgagtggatgacacatttcttgagtatatgaatggatcacgttgaatggatcatatataaatttattataatttctttttaaaaacaagttttcagctttttaatagttaatctgttcgtttatatttttcatcattctattacattcatcacaaaatcattcatctattcatcgttccattctattaaaaaagagcatactcaatcaaactttattcagctcgatcacactgtacctgtgtatacaatacagtactgtgcgtgtaggctaactcatagttcttggcgaattcttcgcacgtaagcaaacaaacgactgatcacgcagcatgcactaccatgcttctggtgtgcaagtgctactctagtactactacactgagtggagtaatcaagagaatcattaggcactaagtcttttaaaaaagagggatattaggcacttgccaggttaccaccgctgcagcctgcagatcactctcagcttcaaccttttctgaattaccactactttttagtactacgtgataacctttctcattcttctttcctaaaaagaagaaaggaatgcagatcagatgaagagatcgctgatcagtagccttagtccacatcgaggactggtttagttcccaactttttcttcaaactttcaactttttcatcgcgtcaaaatttttctatacacatgaactttcaacttttccaacacatcgttccaatttcaatcaaacttttaattttggcgtgaactaaacacaccccgagttaaaatgttgcttttctgaaatctgaatccgaacaaacgaaactattgcaaattaattggttcagatttcagactgttactagtactccagcctagtttagtttccaattttttcttcaaacttttaacttttctatcacattaaaactttcttatacacaaacttttaacttttccgtcatatcgttctaatttcaatcaatcttttaattttggcggtgagcgtgagacaggccagctccatggcgaagtcaagctgtgaaacgcaagcaggagctgtctgtttcagccgacgtgcaatctgacacgctgaagaatcagcatcgatgtgacggccggccatggcctgagggccatct

SEQ ID NO: 48997 - DNA, 8236 bp, Oryza sativa
cacaaacctttaacttttccgtcatatcgttctaatttcaatcaatcttttaattttggcggtgagcgtgagacaggccagctccatggcgaagtcaagctgtgaaacgcaagcaggagctgtctgtttcagccgacgtgcaatctgacacgctgaagaatcagcatcgatgtgacggccggccatggcctgagggccatctcatattagtagctgcccggttgatcgatcgaccagcctgtaattgatgcaaatgctgttctgtaattgatgcgtactatgctgttgtgctctgcttcagtttccttgtggttatacgtcactgttgagttcggctaatcctcatcgatctgaaagctactgctactgatcatctatctgaatctgatcgagataatttagctctctactcagctagaatatccatctctaaccatccaaccctgacaaaccatggcatctgcctacactgcttttcttgctcatctgataatctttcatgcttattagtagctcaaaagaaagcaaaagatctgtctttttcttttctttttcattcgcaaagcctggctgctaattaacaggtgacatctgctgctgatagctttcagtaaagggaagcccacgtttcatttggctgcatcattagcgtacgactcatagccataggcatcatagctgtagaatccctgtaagatctgaacaggagacagggaaccgatagatcagaatctgaacatggattcctgtggattcagaagaatcttgatccatgataagataggaccatgcaagttgcaacgaggataagatacgccttctgatcttcagatcccgttcatctttcgtcaagttcggtggtcacaggctaggctagtgaatcttgtcaaaatctttacagagatcatatcatctcagcttttttctgcatgagatttagagtctgaagctcaactgatgccagaactgatcgaccacctgtagtcaatcacccttacagaatactcctagctagaagtaatacagtagatgaattaccaagttttgcgagttttcatcttgtcacgttcttgcaatcacggaaagaggggaaaacctttcaaattcaaaccaccaaactcaaaacgaatgcattttaactgggttgattcaaatcacccagcaacgacatgttgggcgtgggcctcatgtttttgggccggttcgtagcaagtaggtgaaattgcatttgaactgggccgattgctaagttaatcttccttatcatgggcctgaaaccgactgctatttggcccacaagtactatgggccggcccacccactcgcctccttcctccatacgcttccatccaatcggatttcagcaactccactctactccgtcgccgccttctcgcgacgcctcctcctctactccggcgacggcgaggcggcaatgcatccgcctcctccgacgccgcgttcctcggttagctccttcaccggattccttatcccacgccctctattctgcggtcctaggtttcgtagttcctcggttagtcggctgctgttcgatcgtgaggaatcgctgtggcgcgggagggaggaaccgccgccggacttctgttcgccgacgaagcatgtgttttccgttcgccgtaatcctccctcccatcaccggcagtagccagctcgggtgtaaattatttttgtttttgaattttttgattggtcactgactcaagcgcaaacttgctttgcagcttaacttaattgtcgattagttcaacatgttttttgtagattggattggtatttcaggggatatactgttaaccatctgccagtttagttaattgtagggtataatcggctgatgccttttatttttaacaacagattcacagttgtactagtattaattgggttctgagtgtattctatcagttggttttacaggttcaggttggtgaatggggaattcgcacagctgtagtgttgttgcttgagcacttctcagaaaaagcatcccaacaaagcttcgagccgattacaagacagtgggcaccaaggttgcctattgctttatgatcagcaatgcagagaatgtgctcaagctaagatgaactttctgaaccttgcaggtttcatctcactttatgcgttgtgtaatatgtaattgttgcatgacactcttgctctttgccttactaaattcacctggccgtgtacatcctaagcagaagagaatgctggacgaaccattgatcagtccataattacccatgaatgctataggcagagcaaagtaactcgtgttggtgctgtgtcaatggtctgtctggtaagttgcctatcacacaaattgattctcatttatcaacaatgcaaattctacatgtcctcttagttgtgaaatacaaattctagcatttgttcgcatcatgtctatttcctagtacgatccttgcatatatcaatgtctgtgtacagtttttgtgctaatgttgctgaaataaacatgattttgttcatgtagaattttattgctagttctatgtgcaatccttttgggtgttcacgaaaattgctttacattagtgtcccttgaatatagtgttgtactatatgtcataccactcggttctcacccagtaaactggtatatagatatttgctgagagatacaatgcattggccaatcatatgaattgcgcaaattagtcaaataaaataattggcattaaccaacctgctataaaccgtctttgcttggattggagcaaactaaagtattctggaggcaagatcttgataacttctcctgaagtctaggacagacaggattgcattaggaaccaaacattggagttatttacacactggcacatgtagaccaggtttggtgcctcaatttaaattgacattgcagattgcatcagttcctgacagtgactagtgactacatggtctgtacatgcagctagtactactttgatagactagaggcgtcaaatgggccaatttgctgttgcggacattgtatcggtatcttacttggatactccctccgtcccaaaataaatgcagttttacactatttatgttcaacgtttgaccgttcgtcttatttaaaaattgtttatgattagtatttttattgctattagatgataaaacatgaatagtactttatgtgtgactaaatatttttaaatttttcataaatttttcaaataagacagatggtcaaacgttgggcacggatatccacggctgcacttattttgggacggaggtagtacaaggtaagatgataactacatgtcacagtgtcactgccaggttaaaatgatgtgttagaagaaatgtcaaaccaagatagtggcaagtttattccatcttagaaatcaataaggagggttagtaatctatatttcaagtactccgtgatgggcctcatacaagcaagaaagttcaagtagtttccttaggggaagaattcggtcagaatgatgattgacaatataatattctaggtctctgggatttttttttttgttgagaactattcaataaggatgactagcaatagaatgctgtgtgataaaattgaattctagatggacatcctgcaagcaatgaagcaagaaagttccaactttccaagtgtttaactacaggacatatgatccaaaagagctgaacatatacaaagttaacttgtcaagcacaacaaaaataaaacgcaggcatcaaatttgagaatcttccagtaaatgattgaactttttaatatacatcaagtatcagggtgaaatgagagtacaagatgctaaactccaaaggccaaagctatacatgcaaaccagtcatcattagtcaccaccaagggatacatacgtcaacaaggaacaccaacccccctacaaaaaccatttgatgcccgggacaaaatcaatctcttccaaccaaacatggaatccaactgattgcatcaacaattcaattcaagtcaaccaaaaaacacctgaatatatatacagtagtcagctggttgatgcaacgaagacgacgacgaagaagaagaagccggtccatcatcttggtagtatcatcctacatgtgcctctttctgcatcaaaaccgtgcatctcagtagtaaccttttgcccctctggattggtagagctccattctaatcttggcctccagcaacaagttctcgatcaatggatcttgcaccatggccgcttgctttgatgcccactcgagcaaggtgaggatctccgcttgcgcgagctcctcgttgtcggggacgttgtgcgcaatgtagcacacgaggaggagcgcggcgatctggacggcctgctcggcgaagtagacgagctggacgaggtgcttggcgccgccatggtggatgatcgccttggagtggtcgacatggaggtagttctccgtgcaggcgaacttggtgagcgcggcggccgcctcccggctgacgtcggcttccctctcgtcgaggaggttcaccaatggcccgatgatccgggtctcggtcgcccggaaggttctggaaaaggcagccgagcgaaatgatgcatgggatgaggagctcgtcgtagtcggccttgtggacgacgcggaggagctggtcgacgacggcgcgggcggcgggggatgtcggcttgaatgccgatcgccggaggtcggcgtttctgctcggcgaccaggcagatctccatgagcgccatggccgagttgtaccgcacgtcgtcgacgcctttctcgaggaggacggagaggcagagcagcgccctggactcggtgatgttcttgcacacggccgcgttgcccatggcgagctgccacagcgccttggcggcgttggccttgaggtaggctttcgttccgggtcctcgaactcccgcgccttggtgctcgtcccggacagcgacgcgttgtgctgcttcgtcccggcgacggtgccgccgacgctgacgctgctgctcgaggtcgtcccggttcctgctgatcctgcgcctgcgccgctcgagctggcggcgccgcctccggtgggcttggccgccatggcggtggtggtggtggtggtggcggcggcgtggtcgacggcgtctagcgcgtcgtggtggtgcgaggaggaggtggagccgttgttcttcttgtccatgaggacggtgtgtatggacatcttggaggcgacggcgtacttggagtgctcctggacggtctcgaaggcgaggtgggagacgaggaggcggatgacgttgctctggaggaaggcgtcctggcatttggggtggttggtggcgagctcggagacggcccagtgcgaccattccctatgcactcttcatggtgtgcgatcctgtgaggtatcttggtcgataggcggtcgcatgactgccgtgcgaggcaccatcgagtctcgtacgactactctgggagctcgtcggcgctgaggggtaggcctgtatggcgtaggggcaggcggtctcctggccctcggaggagccctccttgatgaggcggagcagcggggggacgccgtcctcctcgatgatgagcctgccgtagcggtcgttgtcgcgggcgagggagacgatgctggcggcggcgtcggcgcgcgcctccgggttgccggtgtagaggacggcgatctgctcccagatgaggaagaggatgggctcgttctgggcgatgggggggagtccgatgtggtcgtcgtcgaggtcgtcggcgttggagtagttggagacgcggaggatccaggagaggtcgccgagggagttgtcgagctggttggaggtcttcttgaaggagcccgcggggatgatggtgaagacgcggcggatgaggccgtggccgcggcagcggtcgaggagggcggcggccttgtcgagggccttgccggtgtcgtcgaggatgcggcgggcggggcgctcgtagaggtcggcgcgggcggcctggcggaggagggaggcgaggcgctccaccttggccttgaggtcgaggcactcctgccggcacgtctgcgcctcctccgcccacttgatcacctgctccgccaactggatcggccgcgccaagatcgccttcaggtcgtccatctatgatgatccccgccgacgatcagcaatggcggcgagacaggaggaggaggagcacctcctcggcttgggggggattccggccgtgctcctccggcggcggcggcggagaaaccggcgggcggtgggggtgggatcgctaattgggggaaggggagcggcatgtgcatgtgaggcgagcgccgcgcgagatgtggatgccctgccatggattgccgccttcggatggaaagggaagacgagaggtttccacgcttttcggggtttgtatttccgatgccgttggatcccccacctcctcactatctcctacctccgctcttctaattactagcattttagagtatattcccattggtagttatactagaaattaaggattttttttcctgaattttagatatagattgtaccaaggttttttttagcatgttttttataaaagccaatcattggttttagtaagaaaacgtttttaaaaatgttgttgtaaaaatactaccaccgtttcaggttataagactttctagcattattcatattcatatatatgttaatgaatctaggtatataataatttataacctgaaacggaggaagtatcaaatagatttattttttttaaattataataattaaaactcaacaaattatgtgttaatggttttctcattttacgtgatcttacttgatacagtctccatctcttgcgaaccgggcttattgaaacggattattttctccatgcttcagaaaaaatatgtttttcctttagaactttttacttgtttcttaaaatatttaatttttcctataataaagtagataatcgtcttgataatctaaataaaatggctccgagtaattttacatgtagttagatttccagacactatacctcatagatacgagcacgactcttaacttttggtttcatggatacaattggatttgatgttacaaataattcatacaatcgtattttctatacaatagatttttaaagtttacttacatcttgtatacaattgtgagctttatatccatggaaacatgtattccttcatctacaattgtgtaaatcattttttgcctttcaaatttgataatttctagatcctcaagagcgaacaatgacattcattttcgataacagatccaacaaatgcttgctacaattgctctttcatttgttgtctttctcgtaggttagtagccaaggcatgtctaacgtgagatatcatgtcctactcttttctcctatttaattaactctatgcaaatcaatagaaacctatcctacatctacatggcagcaaaataactatacataaacactatcctatccgtgtgacatcgaagcaaagtggatcccgcttttctccaccatactgtatacggtgtaattttcataagaactttctgcacgtgaattttctataaaactattttcataaacaattaacaatgtgatttcatttggccaccgccatcgacacggattgagacggctccctcctcttcttgttcgacttcgaccactgctatcggtgtagatctgggtgactccctcctcgtccgctgcccatgtcggcggtggcatcttcccgatgatggcctccaagttcctctattctgatctctccaaattgtcatcctttcttccaacttgttggactacacgaattggtttctctctcctagagccaccgcttcttctgcaagctcttctgacacactgcaaaaccactcctcccctccatgatggcatccaaaccttacgtggaggctgagaccccacgttggacatggcctaacaagtcgttctcgtccacaggaaaacgcccatggatgtatcaatgcatcatgcacgatcactctctttaaaccttgtgatccaaaaaggagaaaaaaagatcgtgtcatgttgacttgaatcacacccaagtactgtatattgaaactacaagttggcgttctatctgagttgccgcagaagggaacagaaatacagaatcactgaagaagatagaaatacagaatcaccgaatataattatacagtagattggttcatgtcaaccaatctactactccatccgtctcacaatataagggattttg

SEQ ID NO: 48998 - DNA, 7449 bp, Oryza sativa
gtcaacataacactgtgggtgtgtttcaataatgggaaatggagggtgagattgagattaggaaatgaatgaaaggttaggattaaatagatgagggagaatgaatggttaggatttaaagatgtgttggaaatcatttccctttcccatttgccaaacaccacctataagaataagattctctaaagattcttcagggcagacagtgtagtgttacgttttctgaatggttgcctgccctgcccggaagaacatcaacacagacaggttgatgtttttccatggaacacaagcttaagacaatttgaaggcgccatcgtaatattcatattgttgttccctcaaaaaaaatatttatatttttgcagactttccaggccttccatccaccaatcggcgatgttccctgtgttcgctgccgttgaataaaacaactcgtctgcctcgtcgtcatccagccatccacgttctagaacaaaaagctagccaaagtcgtcggcatatctcgccagaatggaaagaacgatacgaatcgaacacaagaagaagaagaataagcagaggcagggcatgcattttccttcaaacctcgcgtcaaaacacgctagtacaatacagtagtaagtacatattcacagtacatgatgatgattgggttaagtctggattcctaatacgctacctagtctcaattttgcattttacattcatacacaagggatcgatgcgaggaggaagattttactttttttttacataggcaggcatgggtgatcaccgtaactaaaaatttgtgaggtgagcggccatggccgtgaagagacagaaatcgcgtgtgtgcgctaccagcactggtcggtctcccaggtgcggcgtgggcggcggccgtaccagcgcggcgcggcggcgggagccgccatcgtccggtggtgcgcgccgcgcgccatggaggcgacggcgacgacgtcgcggtcgtagcgcgcgcggctgtcggggtcggagagcgtggcgtaggcgtcgtggagcctgacgaagtcgtcggccccggcgctggcggccacgtcggggtgccgctcccgcgcgaggcgccggtacgccgccttgatctcccgcaccgtggcgccggcacgcagccccagcacgtcgtacagcgtccccgccggcgccggcgcaggagccacggccaccgcgcaccggaccttccttgcccggtacgacccaaccgccgctgccggtggcggcttgggcgcgaaggcgatccccacagaaggcgcagaaatcatgagaaggaaggaagagaggaatggtgggcaagaagcagatctgggaagacggagaggggaattgggaagcttttatctaatacaagatgtggaaaaaggaaggagaggaggcaggtgagacgtcgttgggtggcacccgcggattgtgttggatttcggggtggaatcgccggtggtttagtggtattttaaggcgggtttggcgataggatcgttgcttgggtggtagtcagcatccggttgcgtcgacttgggtagtagtgctcttttctttgagcatgaaatgaaaatgaaggttaagatttttagaacaattaattaagatttaattattatagacttaaaatagattaatatgatattttagaacaatttttatatagaaaattttcgtatgaaatacgcagtttgaaaagcgtgtgttgtgaaaattattatcttcgtccaaggcttgatgaagaaatgaaggagacattggtgcatgcgtcgctgtccgcttccaaatcccaaattgagcatttttttttctccggtggattctgtgggtgcaggctgcgtccgactctgggcgtctggccccccggttgatgggaggattcggattctttgcattatttccttcctgccccccacggtttgtttggcgcgcgcacgctgattccgcccgccgtctctctctgtcgctgctctccaagtccgacatgacccgcgcgccgcggccgaccaccaccttcactcgctccttgcaagttgctgtagctctcggacagctcgccccatcagcacaaaagtcagctactactaaacttctactactactggtttcttccttttttgatagggagaagtttagcaggccgggccgcacttcgttcacgcgggctggtgatataggaccgaacaagtatggttgtattgtaccaaatgtcactcttcagagccactgcattgttcagtcaggcccaacagatagcacaagtatgttaagtgcaccgttaaaatgggctattttagttttttttttttgcctttgcttcgaataagttacaacagattattacagagtttattggtcaaaacgactgcgttttttcataaataaatacagtctaatgaaagcaagaaaattaactggaaataggctaaattttgagatgacaacctactgctaagggcttattcgtttcaaaggaattgcaaaggaaaagcataggaataggaatgtgttttaaaataccatatcataggaatgcaccataggaaaactttaggaaagttttccattcctccatatttgaaggaaaagcataggaaaaaataatccactctaacctaatgtttgcattcctttggttggtttgctcaaccaacataggaaaaatttctgtgtttttcaatccataggtttgcacatgtattcctatagtattcttacattttttatattcctacgttttgaaaatcctgtgaaccgaacgagccctaaatctttatctatagtcgacgaaaatctacatataatcggatatcgcgcactgcgcacatcgaactgaagcggacgatgctacaaaaagtgtcaacgagaagtaggtgaacttcacagcacgttacaattcgttgcggtaacagtatatgctacaccgttcaaacgtgctcatctgcacctgcctgttctgtctaggacaacgaaatttctttccaagacagtgcggtcttctagaagatgctacagtaagtgccaacaaaaatgttgccatccaaacatcaaagtatggaacttatagaaaaaaaattgaaaatatacttttatttttcatattttgcatttatatacatgtctgagattaatttgcaaaaatatacccaatccacatgatggttgcgtgagagcgccggtcccgcaggccggggatgcgataccgcaccggtcccgcaggataggcgaacggcaccacgggttgtttgcgtcacggtgcggacccgccgagctagagcgctcccgcatattggatgcacgggaccgccgctcccgcacccacatcgtttcctaaattgtgaatacatgtcccgcacggaaaacggaacagtacatcagcacatgattaattaattattagttatttttttttcaaaaatggatcaatatgatttttttagcaactttcgtatataaacttttttaaaaaaagccctatttaactgtttaaaaagcgtgcgcacgaaaaacaaaggagatgagttggaaaaattaggggaataaactcacgtaaccggagcactcccgcatagcggatgtgcgggaccggcccctctcccgtattccgaatgcgcgggaccgccgctccctcatggatgttgtttcctaaattgtgaatacatgtcccgcacggaaaacggagcaataaattagcacgtgattaattaattattagttgattttttttaaaaaaaatggatcagtatgatttgtttgagcaactttcatatagaaacttttttgcaaaaaatgcaccgtttagtcatttgaaaagcgtgcgtgcgaaaaacaaaagagatgatttggaaaaattaggaaataagacacggaaccggagtgaccacgggaccggcttcggtaccgcgcgttggagccgtgggaccacgccgttctgcggtactgccgcgctccgcggtaacgactcggtcccgcagtccagctatgcgggcccggctcagttgctcatccagttccgcgcgaccggctcaagtatgtggttcgccctcgctcccgcataaccaatccgcgggttaggtatatttttgcaaattaatctcagacgtgtatataaatgtaaaatatgaaaaagaaagagtatattttcaaaattttttcggaacttataggctacaacaggcctcaggccaccaggagactataaattaattgctttgaatttgaatgatgcaaccatgtaataactatttcacatctaatcaaatcatacatgggcgacaatgagcgtcttaaccacgacccaatgtagcggcatggcaaaggaagcacacaagtacagagacctgaacaatccaccagctcctgatgcttccatttcaccgatgacagaaagtatcaagctgccgctacttcttttaaattatacgcccataatggctacaatatgtagtgatgtcatgcccgggtgtcctgtgaagtaggaacttcagcactgcacatagggcatacctgcaaagcaatcaaggaaatttatcacctttcggaaatgaaaatgctttctccaataaacctaaactgctcccgttattgggtgcattgaacatgccaaatgatgtatcttcatagtcaggtggcaaaagaaaaacattgattcaatatctgacaaggaatagggatgtagggttcataagccgttgctttcattcatcaaggggttggtggatatgaagactggagatgctgttaattatataccttatttaattgcagccattggtttatgcattcagaatggtatgaatgcttgcaaggaagtgcaaccaatgattcaccttcctcaaattccacacggcaaataacacatctgcaaattagtttcatttatcagtacagtgccggttacttctaaaaaaggggggagatattaacatactgttccatgttgccgtcttgcttatcttgtgctcgataagttattgaaggtaatgaagcaagtgtatcagcagagaggcctctgctttccgtaccaactacttcacccaatgcaaccagctcctaagaacaccaacattaaattttagtagcagatcctgaagctttagatgtgtaccaaatgcagacagtaccggtcttttttaagggaacaaacaacttacctcataagaatattcatctggatcaacatcttcccatgcatcctaaagtcagaagtaaataaaaaagtcagacaatagctttattattggaagacttcaggaaaacaagaccacggcattaagaaaagtgcaaattgctcctagttgggtacattttaagccattacctcccccccccccccacacacacacacaccccatcccaattctcacatacaggaattggcattaaatttccattttcaaatgaacaatagtatacttatttgcaagcatcagaatctgatcagcaaaagcagcaggaaaagtcagttcccaaattataatttgagtatctagaaatggaaatggacggacaaaggtgataccgtgccattgagttcaacaaacctgtatcgcttttaacataagtagcacagcttctaacttctatataccaggaaaagaatgtagtatatatgccattaccatattagttcgatatgcacctaaaatattcacctacccattctgaagaatgggactacatacagatgggtatacttgaatttctcccataataatccaaaagttaccctccctttctccttgtctctcggaatccaaattattcattgaatggttgcatgataagcatggaacaatgaattggagatatcgtgcattccaaactcatgaaatggaagaaaatgtcacctgtggatcatccccgtcttcatcttcatcatcatcatcatcatcatcatcctcatcatcatcatcatcaacatcgtcatcatcatggtccatcactcgccctacaaaacaacaacaacaacaacaacaacaactgtaagctacacacaaaaatgaaataaaactatgaaaggaagaaaaaaaaaggatgggggataaaattctcccttgtgcactcacaatcactgaggcccgcgagcgccatgaggcggccggcgacctcgcgctcctcggcgtcctgcagcgcccgcgcgaaggcctcgtcgtcctcgtaccgcgcggggtccaactcagccgggtcaccggcggcgtctgcgtctgcgtcggccacctcctcgtcctcatccagcgcctccccgtcgccgtccccgtccccatcctcgtcctcaaaatcgctcccctccccttcctcgtcaaactcgtagctcccaccatcggaggccgcgtagtcgccgccgtggtgcgcgctgagcatcatgtacgcccgctcctgcgccgacaaaaaaaaaaaaaaaaaaaaacacggataagccaaacccccccgaccgtggtgaagcagcgagatcccgaggcggcggcgtacggcttttacctgctcctggaggacgcgggcgagggcgaggtcggcctcctcctgggtgaggctggtgaagggccgtctccccgccgccgccgccgccgcggagtcatcgggtggagctgcggcggtgggagggttgggggtagggttttggtcggcggcggcggcggtggtatccttggcggcgtccatgggaggagggatcggagaaggggggaagtggtggtgggagacaaggagaaatggtggagaaggaaaagcgaggcggtggcggcgtggcgtgggtgaacgttaagcaagcgaagcgcacacacgcggtggtggtgggctgggatggtttcagtaaaagaggaaaaggacgaggcgaacagaggtaaccgtttccgtgtttcagctttggaacggcagtccagcaccccgaatctacctgacctcagtttaggatgtaaacgcagccagcatgggcatggcaggtcggttccgtttgggtcccacaggtcagcctctttggtgaacttctcttacaaacggcccatcatcgtggaaataagcaaaacggcataattacaaatgaaaaataatttatgaataaaacttttatatacatgtttttggtgatctaataaaagtaaaggctgaaaaataaacttccataaaaaaaacctcaaaatcaggttcaaatcaaattcaagattaaaaattcaaattttgactgataagtataagtataaacgaaaagatgagatacgaagactccttttggtgaacttatgtaggttcattttggattattttaggagggtaacaaatcagcaattttgtttggagtctcatgaataactctgtttcgtttctaactctaccctaccaaaaatgacattttggtagtgcaaggcataagaaaaaaaaaagaacagcccgtaatccagctttgcttatgcccatatgtattggcaaaccatataaaagtttcatatggag

SEQ ID NO: 48999 - DNA, 5072 bp, Oryza sativa
aaatagctcacggaacggaacgcaatagaagttgttgaataggaattctatgttgcttagccggtgggcgaagagagaagcaggcggcatgatcacggcaagcaaggcatgctgctgcggcggcggccaacctcgtttcttctttcttgcacggatgcggcgtgtgccatagatgctttttcttgaggtgttccaagtgaaatgttaaaggtacagtagagaacaaactatacgtgcaaagtcttccatggcctgccttgctgcttcacccaatgttcgtatgcaattgcaatttgcttgactgattcagcctctagcacaaatgggccaacagtagttgctgtttcctagtttttgtatggtctctgatgtcacgtgggtttgcttctggcccatcatagatgctgactagagagttctgctagataaacaaactttgcacaccaacagcaggaggtgatcaataacgagatccaaattaggggaactatcttggtctatctattggggcctgcgacaactgatcgtatgataaaagctaagtagttaaaaactagtctctagatttcatcacggtctctggtaggtacatttttcacatgagcaatttgtaactgaaaaaaattatcaagcaaacaaggctctggtatccgacgatgtactaaacgtgcacaaagcccataacatgttgcatcctgctgcatttttacaccactccagacggaagtcgaaggacaagttgcccaccaaaaacactgcagcaaaagatcactggttagccaatcttcacaattttgccttgatgacggtaaaaggtagatttatgtacctcttcacatagtagtagcagaaatcagcaaggatgaacgtctgaacgatttcagagagaagcaccatcgaaggccagagaccatagcccagagcagtcaacaagcgaccacgggtatccaaaacctgcagattagatcacagcaaattgatttagatgggcttgctaaaaaaaatcctattctgtttacagattagatcactactaatcatgcatcagaagtaacagatttctcaagaatatatacagcttaaaatgcagacatttacatccaatatgcaacggagtagaacagtgtattccctatgatatgatgcatcaggaataagcatgaatgacgatgatacaacaggaaatacatatcaattcaaagatgttaagttccgcattgcttccagaaaatctactagctgcattgcagtgagagtctagatactcctgcgtaataaactagaacaagcaatcagaggcgttgtttatttttctaactgcacatttcgcttttcccccctgtttggtcgatctgaggagtctggagtgtcagctctcaacctcccatgttaatgttacatactgtaactggtctgaacaccatttgcattggttctatggtccaaattcaaaactacaacaacacttaaggaggaaggaggctgagaaaagaaccttgaaggacccagtgtgcgcagctaagaaaccttgcaacacccaatgcaaacacataatgagctgtaaatggttccacaatctgcaccccaaaaagaaacaaagtaagaaattcagccactggactgtgcattgaagatcatatgtatgtatctttaagatttacctttgtgttttgcatcaaacgcaactgtggcagcactgaaacagcttccaaataaacacagaaagcccaggagatcctgttgatgatgttatgcgatgttgaaggatgaaccaggagagctaggccagcacaaggtaacacctggaatgtaacgtctagtaagatagcatgtctagcaataagaagggggctaacaagatgaatgatcaaaacaagtacataagcatgtctggcaaaaaatagttagcacccagaataggtgtacagatcattgcattggtaatgaatactagtaaacacatgcaactgcaatatacaagcaggttatgatcttggcggtgggaacctggaaatttcaagtgcttgaactatgtctttagtctagatcaagcaggggaacatttatagaatttgtgttttgagcagctccaacagttatagttcacacaatgaagtcagaaagtttacacaaaacagagggcaccacaaactttatgtttaatagattcgaagagttttttagtctagactctagaagctgatattgcacttaccacgtagtacaatgcaaaattgtccttgtccagcatataagttgacctcagtttgaaccgaatcatgtagatgacaaagagagtagctgctagtgtagctgtatcaagtatggtatggatgtcatactccataacaaaactgcagtacagcctaacagccagaaatagtgctgttaaatcctgagacttgagtgagagtcctgcagtaatttagaaggtttaaacaaattagagcatgagttacataaatgtaggaattaaatgaagagagtaacaaaagggacaattaaaaaggtcccagagttgggggagggggtatgaggggtgagaggaaattcatcttgcaattgtaattttcaacatgcgattctataccagtctactccctgtcattcaagcagttaattcatcttattttattttttgagaaagggaggcacctccgttttcattaacgaaaacaccaacattacagaagtccttaaactgcatgcagttaattcattttgatgcatattaaataaaataattggtctatcctcaataaaaactgggaagtgaatgcagcatccactatctaaaaaaattacctgattaccatacaatttccactttcaaacaagtgattttacagcttgctaatgcatgcagataaacagctgtactgatgtagtgaaaaccagttcggttaaaaacttagaatacaatagaccaattgggattttgctattctctttccactcaagaagcaagaacaaccaagttgccacagagcaatcataaattccaagcaattatgcttttggaaagcaatggaattatgagatggaccatatcttggtaagttaattgcctaatattttaatgtcagaatcaccatctttatacccccttctaaattcttcatttgcacaaccaagcactcagacataatatgttttcagaaagtaaagcacgaaaggagatggaaaacaacaagttccatgacagagaaaggcgttctagtagggactgaagcagcaccaccaatctaaacaccataatctatgcgccgtccaccaggagatgacatactccctccaacaaacacttcaatcagctacctgacagaccagtactgctcaaaacaaactctgctagtgctaccctacaacacatctacatatagaatgtccacctcattactagaaaacctgtagttgcatacacagatgcagtaagaattgcgaccgagcaaggtgattggattgaacaagcaaaaagctgcttcctcaatttgagtttagaatcacccagcaatatcaccacatgacaatctcaccatgccaacctcagtgtgaacatatagtgtaaacttaccactaacatagcaatatacaagtcagcacaagttgcaggcagtattaaagtgtggaaacaaaacagtaaattccaaacctctctcggctctcgctaaatataacccaaattacccatctccgtaaacaaatcaagtcgaaaatatataaaaaaaattaaatacctccacgcgaacagtgaggaaattagcagtaaataaggtgcgtaataaataatcttatcggagcggaaacacatccaacacacaaacgcaaaacaagtcacaaaattatttctaaaaaatagggatccggagggggtggaatccagggagttgtgtggatcgaggggatgacgtcgggagggaagaaggggggaggatttttaccggcgcaggtcttctccttggtgagcttgtagatgaggactccgaggccgagcgcgtgggcggcctcggcggcgacgaagaggttgtcgtggtcgtggacgatgaagcggatgaagacgagcgcggccatcccggcgaccacggcgaggaacgccttgaccttgggcggctgcctccgcacccagctcagcaccacggccaccggcctcctcgaccccctcatctccggctcctcctcctcctcctactctccggagcctctccggccaccctagcgccgcccggcgacggcgagcaccaccaccgatcggggcgaggcgaggcgagcgcgttgtgttgcggcgtgcagtgcgcgtgagtgcgtgggggttctagttggggaggagacggaggaggtgaagagcagttaaggccgtatcgggtcgggttgggttggtgcaccagtctgcccgcgtggctaacgctgtggatttccttccgtttcagctcggatcacggtagattacgataatcaaagtgaggtttagtggtttatactatttttatactgtactgtagtatatgccaacttgctaagggtctctgattgtttctttttttttcatttagtttttgacaaggtatgtgatatggaagagattttttttaaccactcgcatgatacggtgcgatgttctgttgatagagcatgaaaaaattttgatagagcatgaaaaaattataagattacaaccatataaggtcgtaaccaggataaaaaaaataccaccacccacataccgacagcaccaacacacaggtccgggagaaccagagaagcctatcaccgtaccagccgccgctaagcgtgaccgaccaccgctagactaacaaaggaacacagaagagatcgccaaaaaaacgctcttacaaccaacacaaagcctaactttatcctaaagcgtccttgcaccaatttttatattgttatatacgtgttcaacgattatacttgtcggtgacatgggaccgggagtatcatgacttagagacttgaggcagacacgatcacccacgtggcctaacaccctcggggggggggggtcgggcccgaggtgatacggccgcccttctctttgtctccccgagggg

SEQ ID NO: 49000 - DNA, 866 bp, Oryza sativa
cagagagggagagagtaagagctctctggttctccagctcttttgtagcttcttcatacacagatccaccaaaacacaggagtagggtattacgcttctcagcggcccgaacctgtatacatcgctcgtgtcttgtgtgtttccactctcgcgaactttccacaggctaggagcttagaacctcacccagagcccccggccgaaccggcaaagggaggcctgcgcggtctcccggtgaggagccccaagctccgtcaatactaataaaactttagccagaaaaaaaatgtttttatgctttggtcatagagtcatggtgtggttttggggttacaaaatccattagctgaccagaacaaccaactcgctagtgttcgtgtagataggtacaagttgacgaactgacgagcgtttagatgtgtggtaggccggggcaagccatctgatctgctgattctctaataatctctactgtattgcctaatcaaggtctccggtatttgaccggcccggcacgtatcgtttattaatgcgcctcgtggagtggagaacggtgcgtgaccgcgcaggccacgacgacgacttgtgtgagaaacaacgtatcgcccggggcctcttgaccttgggtaatgggttccagcgagaggagagaaaaaaaaaaacgaaattccggcagcgagaatcacgcctgcacgccgccgggatggctcgccgtacgtcgccggcggcccccgccgcaaaatatatgacccgtttcgatctgggccgttcagatgagatcgagcggtccacactgggcgtcgtcgctgggcaagacgtgcggggctgtgggccccagtttttatgtgcagcgagggggtgcgtgg

SEQ ID NO: 49001 - DNA, 5559 bp, Oryza sativa
  unsure (1)..(5559): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctggcgtggaacatggattatgctattcttctcccagttctttaacatttccagatgtactagcataatagattatattgatcagtgtcactttcccggtcgttaaaagaaaacattctgatcgctctcaaacaatctaaaaacattccaaccctgacactccagatttcagaaaaaaccagcagatgagcaatcaaacatcaccacagaattctagtagtcaccttattttttttcttcagccatttttgcctgtgctgaatcgataaagtctcgtctttgttgaagtttcagatcatcttttttattgaattgtttggtgcaggatacctggtaaaatgtctactctataacaattttcttcagaggagataatgacagttcaatatccttcaaaatactcctaaagaaaaagataatgacagttgatgatgcgccagacaagcactgtagactgtactagtcgattttgcttaggccttaaacaataagattagcgaaccgcaaaagcttcagatctgcgtaaagctcaaaagcaatgcgtgataaccccttcaccatccaaggcaatgtattactgtttgatggcaaaatttatttaatcatgtcgttgataccatccaagaaaaaaaaatgtcatttagatctgaaagatacattgacacgatgccctggatggcagagaccagagatctaaactatttttattatttaaaaatatgattatatcttctaatcgttgaattaatggttaagaagatgtgatgaggattcatatgacgacgagttctgcctctctgcttgtgtcagaaaatctggcatgttccaaccgtttcctgacgcacacatttgatctagttcatgctgctaattaagctcaagagatctgttcagcaaaataggttacatggttagcagcttggttacaatgatttaggttgttttagtggagcttaagtccaaattaagtcatcctaataaagcatgcaattggtaggctgaccatgctgccatccatgcagaaaattagaaggccctaccgtttggtcagagcaattggtatacaatcaccaccagatctgcttaatgagtagcaagcaattaggcaatgagcactgtttgggcattgctacagatctagtacttgcaaacactgtccttcttgctatctatattccctctggctgttatgactctctaatggtacttgatctccaaccacatgacacagcaatgcctgaattgtgcagtagcccaatgcactcaaactcaactgatgattgcttcttggctcattgcctgtacatcattcatcagctctgcaaaccaaacagcaactgcactggcctgatcccatccataattcctctcccatgctgtctgaaattaacttcaggtcgagaccagcaactaagtaagctctagcaaggacaataatggctcacatttggtgctcaaaccatgtgcagctataccatgcatatgcatgcactatcccctaattatccgttgatgatagtagcagcacacattgcgtagggtagttaggagtactaatccacactaatgttcagaacagaaaaacagattggaacgtggtgctacagtatgcgtgtgtataatcattagagagagctagagcaaagattctgaagaaaaagaaaagttcaggaaaatctctctctgatcaagaaggtaggaaggaatgctatgcttgtggacagtggacgtggtgactccaccccaggttcgccaaaccgggtcagtggtttttcacgaaaactgtttgaaaaccgttactccggacaaaatccagtcagattgtgttgaaagatgaattttagtttgaaaaacatgattgtaaaatcgagcagtttgtgttgtcgagccagtccggaaagtcaggttttgcaaaaaaccggccggttttcgtcgattttggaaaaccctctgctccatccatccacaagccttctgtctgtcggcgaggctgtctgttttattagcaggttcttgaatggaacagatatggtggtcatcgcagtgacacgagaactgcccggcacgttggggaagacacctttcatgatttgttggctctgtctccttgaccactgctcattatgttttccttgttgttttctcgttaatttgcagctaattgcacattgatcactcacctgcacgacggtatgctcctgaattgaagctgaagctctgaatttaaccagatctggaagttaacttcagtatttgacagtataactctgaggaaaatggcaagtcagagcgtactggtagcacaaactgctagtccatattaggggcaattgtgttcttgtcaatcaggaaaatccaatgtaaaacacagatattttattggttcctgaattacctattacctcattgagctgcacctttcgctgattaatttcactcttgctgagtaaagaactctataggttgcgtaaagctgaacaaaatttgcttgaatgctgttgctttctgacagctagacttcgaaacagacagggtttcatggaattatccacccacgccatgcacgcctagaggattgtagtttagcgcttaattaggatgttagtatcttggacctagcttattccctctgttaatccaaaatacttctagaatgcgtgcaaatcagaattttcatgcattgaccattaatacatgtaactttatatggtttgatttcataaaaaagataatactatcctgcaatatacttccatataatgttgatccggtcagaattatgtattgtagatttagaaaaggtcaaaaacaacctacattttcgtagtgtaagtaactccattatttcccccccccctacacgtatgagatgacacagatagcgacggtgcttaattatgtctggtactaacaacattttaacataattgaacaacccaattagccatggaccattgcatctattgctacctgccagatgacactacgcacagtgcagcaggcaggccgcacggacctctcatccccttgaatttttgagccaatttttaattaccagaaagtgactgaacatgcccctgattttcccattctgtttgaacttcagtttcaagtgcttaattatcaacaccaccaaaccctgcacatgaagtactatgcagacggccggccagccgtttattgcaagcacggcttcatcgttagctcttcaatttatcagtcatgattaaaatttaaattctagacttgattttaataaatttctatcgtactttatttttttcattggtttttaagacgttaagaaaatacatatataagagttttattcaataattttttcactaataagtattccagcttataataagaccctgtttagttcccaaaacaaaaaatttcacgtcgtcacatcgaatgtttggatatatgcgtggagtattaaatgtagacgaaaaaaactaattgcacagattgcgcgtaaattgcgagatgaatctttcaagcctaattgcgccatgatttgataatatggtgccacagtaaacatctgctaataacgaattaattaggcttaattaatttatctcgtagttttctggcggaatctgtaattgttttgttattagattacgtttaatactttaaatgtgtcgaatatttgatgtgacaatcaaacttaaaatttttccccaacttaatcagacctaagctagctgtagataaaacgatgagaatggatagagcccagacggccggttggccgtcagggtcgtactaggattaatttcttttcgtgttttgtcaaacagagatattaatgccccgatcagtgaccgacaacacctgcgttgcagcgttgaagaaaggtgtggtttgtcccctttttttttgctgcgtgcacgtacatcatggaatgcagttgtcttaattaattagggactgtttagttcgtgaacgaaaatttttggcatgtcacatcagatatacgatcatatatttaaaatattaaatgtagactaataacaaaacaaattacatattccgcctgaaaactgcgagacaaatttattaagactaattaatccgtcattagcaaatgtttactatagcaccacattgtcaaatcatggtgtaattaggcttaaaagattcgtcttacaatttacacgcaatctgaatagttaaattttttttatctatatttaatactttatacatgtattcaaacattcaatattgacatagtgaaaattttttctttgagaacaaaacagcgccttaatttgtcttcaaaaacagttgttaaagttttaaaggccgcggcggccggccgcctgcctgccgggaacgcacggaaggcaggcgcgtgccggcgaatccggcggctgtgttaactccggcgaccgtaccgtgcggttggttgccggagacgtgccgtgccaccgccgccgacggctgcgtttttcttgtggagatgggcctcacaaagtggagagcccatcaggccaggcccattagtgttcagtattgggccgaattttatctgggatgaacgagcgtgtatggcccagcccatcccagcaggccagcacgcacaaaggatcgatcgatcggctatgaatttgtaactcgaatgatgatgatgatgatttgccttaaaaacgaacaaataataataataataataataataataataataataataataataataataataataataataataataataataataataataataatcgaatgatcggatgagcactgatgaaaagacagtattaaatgtcgtaaacctagattattgatgcatggcacagtactggcaacgtaaaaatatcgtagacctagatcactgataaataatgcacgctggtgttaattatatgcagtgcaggatagcagtgtacgtactagaaacataaaggagtaaataaactccaaggataatatccggtgtacaaaattaaagctgagattgtggttgggtcagtcaggaaattagcatatgcttctggctcgatctggttgtgcactgaatcttcagaactggactgcctgtaatttacgcaggaggggagagaggcgacaggaagacgatcgactacaatattcatgttctttttttaatatatatatatatatatatatatatatatatatatatatatatatatatatatatattcatgattgagtaaccgagagttgtactactatactcagtagcattagatttcatgcggcgctgaaaattatatccctcgcaataatt

SEQ ID NO: 49002 - DNA, 800 bp, Oryza sativa
tacagtctctttatcaatatactgcttcttttacacattcaatccataacatccttttcaatccaaaatcaagaataattaggatttctaaaaaaaaaagaaaaaatcaaaggtctactcataggaaaaccagcttttccctacatcaggcactaatctatttttaacgtctaattagatcagggagttcttccaattaagaagttaagctcgttgctttttgttttaccagaattggagccaggctctatccatttattcattagacccagaaaatcagaatttttttattccattccaaaaatccaaaataagaaattgattttattacgacatgctattttttccattcattacccttgaggatcagtcgcggtcttatagactctaccaagagtctggacgaattttttgcttcatccaaatgtgtaaaagatcatagtcgcacttaaaagccgagtactctaccattgagttagcaacccagataactaggatcttagatacgatcgaaatccaaaaatcaatggaattacaccgcacacccctgtcaaaatcttaaaatagcaagacattaaaagaaagattttatcaccattgaaaacactcagataccaaaaggaacgggtctgggtaaatttcactaaggtaaaagtgggcaccatcacgatcgtaaaatgtcatttttttagcatttttatttaaataaataaataaatcttgtatgagagtacaaacaagagggacaaccctaccatttggcaaagtgtaggcaaaaaccctaatagggagtggggata

SEQ ID NO: 49003 - DNA, 3817 bp, Oryza sativa
  unsure (1)..(3817): unsure at all n locations
tacaaaaccagtgcaaactaggtccctcggcggttttgagtccggcttttgtctgatgtggcaattgactcatcatagaacccacgtgggccccacgcgtcagcctcttttcaaccccccctctgcacctttcttcctctccttcttcacgggcgccggcggccggagcatttgcacgggcggcagctagcgggcgcagccggcagggggagaagccacgcacggtcgccggccggtggtcggtgaagtggcgcacggccggacgacggagcggctctcgancggcggcgnaaggcgnaacancggagcggcgctcgggcggagacaaggcagaaggnaaggctgncgccagcgggagcacgggggagatcgaagttcgaagaggacgacctcaagcacggcagcgagtagagtggggtgacggcgaggcggagcggatcggcggtgacaggagcaactcacctagggcgccgtcagcttcgcaagggtagcacgacgacagacgcacgaagggagatgggaatccaacgaaggatgtcggggtcgtcggcggcggcggcggtgacccaaacgggaagcatggggacggcgccgctgagggagccgtggaagtggagcgtgacatgaaggcagctgctgccaccgcctccgcagtcggtgtcgtcgcccatgcagcggttgccgcttcaccgtcctcccgcgcgccacttcgccacctgagcgccgctctgtcgttcgcccactgcccacgcatggcttctccccccccccccccccccgcgagcgccgtgaagaggagagaggaagagaggtggagaggggaggggaagagaggctgacgtgtagggcctacgtgggtcctacgctgagtcggctgccacatcagataaaaccagagtcaaaaccgtcgagggatctattttgcactggtttcataagttgaaggatgccggatatctcgtattgtggttgggggatgattttgtaactcgatgacaagttgagggaccttcggagtactttttcctttttttttctgtccagattgatacatcgcccaacgcggcagtggggctgggctcgattcaaccaagtatggttatgaaggttatgtttggtgtatgggccattttggtttggtgccaattattgccctaccaattctttaatagttttgaatagtgcatattagcattttggattgaagccaatttttgccacatcaaaagagtggagtcaaatctattctatcaaaaatttggtggtaccaaaatttgcccaaggtttggtactaccagtattttggtagtgtttcaaaccaaacaagccctaactctatctctactattataaaaattgaagatgtttctgcggtccgtcatccgtatttgagtcggttataaaaattgaagatgtttccgcggttcgtcatccgtgtttgagtgggttataaaaattgaagacgtttttgccggtattttggtacgtcatccttgtatgtgtcagtttttaagttcgtttgcttttggaaatatatatttgtatttgagtcagtttttaagatcgttcacctttgataatacataaggaatcatataagaaatctgtttaatatatatatatatatatatatatatatatatatatatatatatatatatatatatatatatccaagcgaactcacacagtaaatttcatcttaactaaacaatatctctactacttaaaaaatacgaggtgcttccatcgtccgtaaaaaaaccgtgggagaaaaaaaccgtgcgaaaaaaatcgggcgaaaaaaaaactatgtccaataaaaaaaggacaaaacaaaaaaaaatccgcggacgaaaaaaaccaaagtccgataaaagggcgaaagaagggaaaaaccggaaaaaaagaaaaaaaaagtccgatccaaaaaaaagtaggggcgaaataaaggaaaaaaaagaaactaatctgactcggtctacacggtaaaaaagggcgaaaaaaggaaaaaaaattaaacaaatccgactctgtcgacacggtaaaaaaaaagggccaaaaagaaaaaagtatatgtccgataccaaagaaaatcgaatcctattatatgtgacatggcgtggtaaaaaaaatcgaatccgattccatcgacgcggtaaaaaacaagcgtaaaatttttttctgtgcgattccaaaaaaaaagttgcgaaaaaagttttccgtttctctttctctatctctatctctactacttaaaaattaaaaagtgtttctgttgtccatccgtgaaaaaaagcgtgaaaaagaaatcagcgaaaaaaatcgaatctaattatatgtgatgcggtaaaaaaattaaagacgtttctgacatccgtagtaacgaaaaaagggcgaaaaaaatgaaaaaaaaggaaagtccgattcaatatctatgtatacctaattaaaaaaatttgtatggcttgtgggttatagaaattccatcacacgtgcgatcgatcccgctttaatccctctccgatggcaaaaaaataaaaaaagaaaagaaaaaaaaaatgagagactgcatcaaatttggacctaaattctaaagaaaacactactacaagaatacaagatcagattcaagaacaccaagaaaacgccgacgccggaaggggagggtgtcgccatcgctgctgaaccgccaccgccgtcgtagggatgtcggtatgtcaggctgccgccacattgttttgagagagaggggggaggggaaatgattttagggttagggtttgggctgttgaacttttatataggtcgggatgaccgtctatcagatcggacggctctggcttctcccgcgtcaggccgaacgccattcccaggccgcccacacggaataagttcactttaggttgtttaagttgttcctccccgattctattcccaggccacccacactattgggccgcctcatggaccatgtgtactctccgtatggaacaagttcactttaggtcactttagctgaacttttttatttcattataaatatattttcttaaagagctcatatcatgtaaaactaaaccttaatcatataatatttttatatttgttataattttaattacccatcacaacgcacaggcattttttctatgttaaaaaaaagaccacgacatacgagtgagagatatataccacacacacccgcaggctcatctttaactgaactagcaacagattttcaattacaggtctaattgttttatttaggtgattaaatttgttttcatttatataattagtttgctctatttaagctttttgaaaattgctaaaatttgagaataactttcctacttcgtattatattatttttagctaatggaattaatggaaaattaattatatatttttatctttttgaccaaaggtcactgcaattttatttcattaataataatattattattatgattcctttattttttttcccatcagtatacatgattaaaattacctttacccgttgcaacacacgggcatcattgctagtaacaataataagattaaaatagacttcacatgttgtaacacacgagtattttttttttagtattatcaaaatcagactaccaaactttagttcaaaacacacctattataattatatgtaagtttgacttttcttagtaataaaatattttgaacacaaaataaacatgttatcaatatatatacaatgttagatatagataattttttatataaaattaatcaaacttagagagatttaactaagaaaaatcaaagcgatata

SEQ ID NO: 49004 - DNA, 2772 bp, Oryza sativa
  unsure (1)..(2772): unsure at all n locations
gggcgaattcgagctcggtacccctggggttttgcaactatttattggtccttctggatctcggagaaaccctccattcgtttgctcgtctctgaccaccattgggtatgttgcttccattgccaaactgttcccttttacccataggctgattgatcttggctgtgtgattttttgcttgggtttttgagctgattcagcggcgcttgcagcctcttgatcgtggtcttggctcgcccatttcttgcgattctttggtgggtcgtcagctgaatcttgcaggagtttttgctgacatgttcttgggtttactgctttcggtaaatctgaaccaagaggggggtttctgctgcagtttagtgggtttactatgagcggattcggggtttcgaggaaaaccggcaaaaaacctcaaatcctcgacctttagttttgctgccacgttgctccgccccattgcagagttctttttgcccccaaatttttttttacttggtgcagtaagaatcgcgcctcagtgattttctcgactcgtagtccgttgatactgtgtcttgcttatcacttgttctgcttaatcttttttgcttcctgaggaatgtcttggtgcctgtcggtggatggcgaaccaaaaatgaagggttttttttttttgaactgagaaaaatctttgggtttttggttggattctttcatggagtcgcgaccttccgtattcttctctttgatctccccgcttgcggattcataatattcggaacttcatgttggctctgcttaatctgtagccaaatcttcatatctccagggatctttcgctctgtcctatcggatttaggaattaggatctaactggtgctaatactaaagggtaatttggaaccatgccattataattttgcaaagtttgagatatgccatcggtatctcaatgatacttactaaaacccaacaaatccatttgataaagctggttcttttatccctttgaaaacattgtcagagtatattggttcaggttgatttattttgaatcagtactcgcactctgcttcgtaaaccatagatgctttcagttgtgtagatgaaacagctgtttttagttatgttttgatcttccaatgcttttgtgtgatgttattagtgttgatttagcatggctttcctgttcagagatagtcttgcaatgcttagtgatggctgttgactaattattcttgtgcaagtgagtggttttggtacgtgttgctaagtgtaacctttctttgcagttcctgaaattgagtcatggctgccaagctagctcgcctccacagtctccgcgaacgcctcggtgccaccttctcgtctcatcccaatgagttgattgcactcttctctaggtgaagatctcaatataatatcttgtgtcttcttggaacctgctactaattgttttgagttttcaatgattttatccatacagttggttagttcttagtcaacccagatgtgaaacgataacatgttagtatgttacaaattcttagctgacaaggttatgcatctctttagttttaatgatggtatctataataatctgtgatgagctctaacatttctgtcttgagtcatgaatcttaaatgatgttgaaatattgtttgttcatagctagattaagtacagatcatgtggtcttaaaaataagaagtaaaaatcaggtttatgtggtagtgccattaacatagttcagccgcagaaaggatgtgagatctaagcattggttctatttcttaaatatcactctatgcaggtatgttaaccagggaaagggaatgctccagcgtcaccagctgcttgcggagttcgatgccttgatcgaagctgacaaagagaaatatgctccctttgaagacattctccgggctgctcaggtaaatttggcaatgagccaggatggttatgatagtcaactcaaagtcaaataccagtctttctaacttacttccttgactgtatgtaggaagccattgtgctgccgccctgggttgcactggccatcaggccaaggcctggtgtctgggactacattcgggtgaatgtaagtgagttggcagtggaagagctgagtgtttctgagtacttggcattcaaggaacagcttgttgatggacagtaagtaccagaacgacgatttgcagattataactgaagcaaaataacagtgactgaattttacttctgtttttcttaaacagcaccaacagcaactttgttcttgagcttgattttgagcccttcaatgcctccttcccgcgcccgtccatgtccaagtccatcggaaatggggtgcagttccttaaccgtcacctgtcgtccaagttgttccaggacaaggagagcctctaccccttgctgaacttcctgaaagcccataaccacaagggcacggtaagcttccaatttgtggaacataccaaatgcttttatactagatgttttttcttgtgtgaattgctttaaatgttagtcctttagaaacccacttgacattctctgtaagttccaccaaatgacgggatccgaattttctattacagacaatgatgctgaatgacagaattcagagccttcgtgggctccaatcatcccttagaaaggcagaagaatatctgatgggcattcctcaagacacgccctactcggagttcaaccacaggtgattactttattatttctccttatcatatagcccatgttnnnnnnnnnnnnnnnnnnnnnnnnnnnnnnnn

SEQ ID NO: 49005 - DNA, 3587 bp, Oryza sativa
tctaaagagcagtagaatattgctgcgttgtgccaacacctaaacgggtatctgatgtttgtttcctctgtttcttcagcaaggacactgtggggcagtatgaatcacacattgcattcacccttcctgggctttaccgagttgtgcatggcatagatgtttttgatcccaagttcaacattgtctctcctggagctgacatgagtgtctacttcccgtacaccgaggctgacaagaggctcactgctttccaccctgaaattgaggagcttctctacagtgaagtcgagaacgatgaacacaagtgagtactgaactgctggttccgtccctgttattcacctaccatgtaacaaataattaaacactgatttgtgtgtttggtctagctttggctcttcagtctactaagtgccatgcactagaactttgtagatttgaactgcaattcttaattttctcactccttagtagaccacaataataattattgtgtctgacccagctagtttacaatagtgacttcaatgcttgttttttccccttgaacaattgtttactttctagcagtggagtttggcatctaaacttgaatacacgctgttcttttttgtgtataaaatgtttatttaatgttctgcaggtttgtattgaaggacaagaacaagccaatcatcttctccatggctcgtcttgaccgagtgaagaacatgacaggtctggttgagatgtatggtaagaatgcacatctcagggatttggcaaaccttgtgattgtttgtggtgaccacggcaatcagtccaaggacagggaggagcaggctgagttcaagaagatgtacggtctcattgaccagtacaagttgaaggggcatatccgctggatctcagctcagatgaaccgtgttcgtaacggggagttgtaccgatacatttgtgacaccaagggagtctttgtccaggtatatacatacgctgtcatattctactgctatatttctattctgagcttccagtagcaaatgatttctactatttgtaaagaacagccttgtgcttgagactaaaactgcttttaaaattgttttttagcctgcattctatgaagcgtttggtctgactgtcatcgaagccatgacatgtggtttgccaacaatcgcaacatgccatggtggccctgctgagattattgttgatggggtgtctggtctgcacattgatccttaccacagtgacaaggctgctgatatcttggtcaacttctttgagaagtgcaagcaggattcaacctactgggacaatatttcacagggaggtctgcagaggatttacgagaagtatgtatttcatgatctgcaaatatataacattttttttttacgattgacatataactgtagaaatcatgtgtccaatctatattgatcctacaaatttggacttgtcaggtacacctggaagctgtactctgagaggctgatgaccttgactggtgtatacggattctggaagtacgtaagcaaccttgagaggcgcgagactcgccgttacattgagatgttctatgctctgaaataccgcagcctggtaagttactctcgctgttcaacagcttgttaatttcagtattattgcactgagcatatctctgaattctgttgctacatttctttgttgaatccaggccagcgccgtcccattggctgtcgatggagagagcacatccaagtaatggaggggaaaatatgcatcttcagcaggagaagccgtcagctgcattcgaatttgataattttctgtagttgtcatttggcatccatgtttgccatggatgtgtactatgtctaaggtttcagtacttttgcgagattttgggcagtgcttgcctcaaataaacgccggttcctggtgtttatcgttcagaattcaatgcaatgttttattgccgcgcttcctcaatctgtcatgttgaatgaccactccctagtgccctactgttaaaaaaggttggttcaaagccatggatgaacccaacatttttgttaccttgttcttttcagaatttccttaagagttgtgatagtaggcccagtgcgaccaaaatgttgggttccttgagttttcagtataaaatttctgatattaaatgcagatcttggctcagtacagagtcttgcaaaccatgtggttgcatcttttctactgctgtagtagatgaaactgaagatactacttattactctttagacaaagtttcatcatattcccaaaatcttggtctaggattgggagacatcaagaagatataaacttcacactcaagccctgtttagcaaccctgaataattttcttttgtgtaatgcaaatgcacctgtaaatttgggtgacccaaagatgccagtgaaatataaatcccatgtagccaaactgtttgttagaagaactagaacactcagtagaggttttagctaattacagttcattgctgatcaaggttgcatcagacatagaagtcagaccgaaacatcaatttggagctataatacaaaattcgataaaccaatacgaaattcaaataaaataacattgttcatcaaaatttctggccagaaccatccaagagcagttgtaagcgagagctcgataattcccatggtccacaaaaaattgtgcagaagatcaaatgaccaaaatctaagaacacgatgatttgcaccgcacaattcaaaatctaccagattttcctgttctcttctacttttatatcactatctctactattataaaaattaaaaatgtttttgccgctactttggtaagtcatccgtgttttagtcggttttaatcttactcctcaaaatccgcaatttagaaaaggacgaaaagaatcacgcggaaaagaaaacgcaccataaaaaaacaaaaaaaagtccaattcgtaccggaacgaaaaaaaattggcaataaatgctgggtaaaaaaaaaagccgatcgaccattaaaaaaataaaaaaatcgccaactgtaaaaaaaataaaaaaaaagtaaaaacctttccttttattcatccgttttttttctgtccctatttttttgttcgtattttcttttgcatgcggaagggtgtgtgtacatggtgaggatttttttaatctacacggttttttagtcgtcaggtcgaatcctagctccaccgccacatcgatcaacctcctcatgctttcccttctccgattaattgtaaaaatcaattctccactactccatcgtcattttccacataatttttcttttcagttcctctttaattcactagatttaatctctatttagaaatcaccgtttatatcccacagttttgtggattagctccaattttaataaaaatgaaaagaggagattgagtgaatcaaaagccctcaaccaattttgggagatcgaggaagattcgaccggatttgatgggaggatcagttcttgcatcgttctacacggactatcttccagaggttgaagatgccaatcgactatgtgagctagacctatagttctacttgtgagctggggtcaaagagaagcatatggc

SEQ ID NO: 49006 - DNA, 2882 bp, Oryza sativa
  unsure (1)..(2882): unsure at all n locations
tatgagtctaagtgctcttgtattttttttgctgtgtatatcctttgtggatatagatacgggattaataaaaatcattatctaaaaaacttcccatctcagtctgaatgatcgttcctatcctgaggccatggccgccgatccggcgactatcctggcaaggatcctgctgagttgcacgctcgttggcctgaaacaaacacgccacacacgcatccataggccaggaaaatgtaattaactcaatttttttttcactttggatggcgtagcaattattaaaaaaaagttatatcagctttgctaaaattatgttgatatatttcttagctaaatacagttagtttgtgatctgttatctatcttcatggttcgcgcaaagtgcatctggataagcccatagaacaacatgccccctaataaggtgacgactcctttttgctttgcatgacacgtgctagtcatcagtgaattatttaatcaatttacattgtaattacatatataattacaaattacactatagttttttttagataatgaaaatggattatatctccggcttctgtcataagacacacagccataagtataatagtaataaaaggtaaaataaaagtaaatcaaaatgagaaataaggtgatgggacaaatccccaactcccctttattattgactagcgttaaaccacataaaattttttagctaacaattcttatggaactacgccacctatagtggaataagagacccttggctaccgattccaagagtgtagcaccattgcgtatagtatcctgctccttctgtggtagcattgtagaccaaaagtggagccagtaggaagacatgaagataacctgcatagggttagataattgtttaccattaaaaactttatcattgcgacaacgccaaattgaccaacatacagcactagctccaattagaatcatcttcttgatggacctagatacccctctaagccaattaccgaaaatgtttttggcgttacggggtgggggatatttaaaagcaaaaaaaacacacatctccaaacaaactgagcgacaggacactaaataaaagatgttggattgtctcttgtgcatagcagaaagaacaatgtttgtctcccccccatttttttttagccaggttatctttcattagaattactttcttgtaaagaaaccacataaataccttgatctttagtggaatttttaagtcccacaaaattttttttatccgaacattacagttcatgatcgcggcatatatagatttgacggaaaattgaccattcttatggagtgaccgtacaaagcagtccttttcatttgacagagttatattagctagcctgaggatcaaatcgttccactcgattagcttttggccaacaatagctcttctaaaagagatattaagcggcgttgtgctcatgacctctgccacaactttttaattacaccgtaacttttattgtattttgactgtaaaaatttgttgatagtttttctagataaaagttaattttgttgtgtattttaaccaatttacttttatttttttagtttacaatagcatattagtgatttatgttgtctttggttcatccgtaacttacccatcttttttttaatcatgtgatctcaaatccgactatgcggagcatagatttgtggcgctattattatagatagtcccatgttatatttggatggtgtagcaactacaagataatgttacatttggatggcgtagcaactatttataggccaagatgcagttactctatattctgaactttagtgtaactcctgtcttactagaagcaaatgccttccatactaggcagcaatagtggatcaaattaaagatagtacaatttcctctttatacataagtcgggctgaggaggaagagaagggatgtgtgatccaaaatatatttcgaaccagctgaagggagcacacacaacttcacctcaagttctgttggccacacaatctaaactctagccatgattgcaggattgggattgggatgcattaggaaacacttgaatggcaaaagtgatggctagtcctagctcattcccatattattctattgcacttacaaatttggcacaatcttatctccatttgcacagctggtattggtcaaactgtagtaattttagttgaacaaactatatagatgcatacaccataattttaatttcagttgaggataaagagaaactaaacatagagagagttgatacagtgagactatgagagatacttcaactgaacaaacctttgagagtttatcatttgtccacactagctcaaaaggtattggggcataaatcagcgtaatacccaattaattaaacaaagaaagaatacactgtacgagtggttggaaacttggattggatgaacagctgggccggatcaagttgcgaaatcatctaacaaaaactataattgatttgttcctaatatgcagccaacggattgaattcaagctatttatcaatttggcatgatcatttcggctcactattcattagggcccattcaatcagttcatgacaagccataaattaatacatggatttatactcgtctccttggatctcgccactcatcgccggaaggtgtcgttcgttgcaccatcacctttcaccacatagatgataccgtcaaatcggagaatacagggtattgcgaggggatgatcggatgctggaatacatggacataaatagactaggtggagtgtggacaaaacagtaaaaaaaatgtgtgggcgcctgaggggtggagagagggcgaggggtgaggggagggannnnnnnnnnnnnnnnnnnnnnnnnnnnnnn

SEQ ID NO: 49007 - DNA, 1352 bp, Oryza sativa
cccataactttaaacactgcaatcatcatacagtgagtgaacatagtacagtagtgatcatacagggagaattgcaaggtgaagatagaagtaggaatcagaggcatttggaaatgcaacgaaggataagatggctcagagccacgttgatcctgtgatagctgaggaagaagctctggatgcaaatcagagtcgtttcctgattgcaaactggcctgatgaaactgctttctcatctgctgagctactcactgattctaatgaatgggatctgattgtgtcatttggggcattcatcagtgtgatgcatcacagattaccaggtttcagggtgaatgccgaaatactgaagtccaaacatgtggtttttgcatgatgcagtttccctgaactgaaatgtgtctcactaaaccaccaggtgcttaacatttgttttttgtaccttccaatttcatacttattggctcctaattagcagatcaaactcagatagcaccctctgttaattgcatataaagatggaccgaggaggaagagaaggatatgcattctcctgcatatgagcggtgcggaccagcatggagggaggaggccgtaaatctcatgcatcgtcggataaactaatatgaaacttgatttgacttggtttgctaacccagttcaaaatctagcctgcatatatgtaattaaatcctacgccaaagactgaaaactatctcaatcgcacacacatactccgtatttcacattcccactaattttcaagttctgggattatataatgattccatcgttgagctatctgctgtacgaattggagatcagtgctctgaatccatgtctgaactctgaagtttgaacagagccagtagattagtttcatgacttcatccatctatggtagggtgaagatactgtgattgaaaggcatgagagggaaaaaaaatcaaggagatgggtctgccatggacgaacccgggggaaaaaaaatcaaggatggttccaaatctttggcgaaggagaaatactgtgcatcaacgaagggtgggcatggtgaggcgccggtaccgccaggtactcgattcatgacagccgtccgatcatcctagatcaacggcctaaatttagtaccggcgtgcactgctggatggtaaaaactctcctccaacattttgtagataccaaataaattgaggggagataggagaggaagaagatgaagagaggatatagagatgcatatcaagttatcaacacacgttcttgtggacaacctcatctgaagtttcattggcttcaatagttcaattatttccttgcaaattgcgggaccaggactgggatgcattagg

SEQ ID NO: 49008 - DNA, 1112 bp, Oryza sativa
aaaaccaacagaagaaacgaaatcttttaaaaactatcacatcaatcacactgtctccacatacgtcgcggtacttgggcttctcggggaggttggcgacgcggccggaccgccggagcggggcatcctcgccggcgcccggcagcgcacgcgccttcctcttccgctgcttcacctgcacccaccggcaaccgcccagatcaggaagagacccacaaacaaaacaaccagagagaatcaaagaccgagaaaaaccaggggaaatccaaaaagaaaagaaatggtgaggggaatctgaccggcgacggcttggaggcggattcgcggacggcggcggagaggtggtggaggcggagctcctccagcttccgcttgttcgcctccacctgccgcctccgctgctcctcgtacgatgccgcctccgccatttggctttccgcttcgatcattggaaggtgaagtgaagtgagcagagagatggaaggaaggagataaaaatcgaacctttggatggcaaagagcgatttttttacgtggacatggtgtatggaccatgagggctaatgcgttggtggtggatactatgggtgtatggactgggtgtacggagtgtgagatgagaagccgaaagattcaaactttcaaacagtccagctccccttagcttttttcctccgagaaacaagggagggtttcctttatttgaaagtacttagtgggcccacttgtcagtgagacaacgaatctgaaagagagagaaagaatcgccttgtgggctactaaaaggcttgggccatctctgtaagaatcttttttaggcccaacccattcgaaacatgtgttcgggagattttgggtctgtttagaggaggttctagcaacgcttctcacaaaatctccagctccccctaaacagattatattgttacccagattttgagaatatatagttgtagaatccaaaaaataatctagaagctagaagctggaaaacccaacttcttcaaattctcagaacctggctttcaactagtagatttttagaatcttaagttcactcaaacaggtcatttacatcggcttggttatctaaccaagataactaacactag

SEQ ID NO: 49009 - DNA, 2636 bp, Oryza sativa
cggaggaggtattctttgaacacgtgttaaatttatcatcctatacatagtataatactcctgtattcaagggtacaatgttcttctagcgctcaagagatcaaccttacattaagactacgatgttcttctagcgctcaggagatcaacttgcgacaaaaacactagtaacaattcaattattgggatattaaatatgtgaaggaatataccaaatatatgaatgggatgtaagttgagctatcaaaaggacaataccttattaaatcaagttgatcaattatttgtactagcacagtagcagcaactaatggtccagcagaccagcaccaagtggtggtgtgtgatggcccgcgaattgtttcttggcagaaatgtcatgtccaaatggtcacaaattgatcgacgagttgatggcacgcctcaccaatctccactctggagtgaagcaaaaagatcacaaaaaggttggctgtcccatggaaaaagtgcagatgcgtcacacaagctgctgcaactaacacaaaacacacgcattactaaactccaggttgtatgtacttgttggttattctgcaggcaaaaatcaatacctttcgcagctgcatagtgtgtatgtatatatgcaccaatcgaattggttttcagtgcttgttactctcaaagttgtcgaacctgaaatatgccatttcaacagacatgtttcatggtttggctgctaccatattgcggaataacctttattctgatttctgaatgagaattacagtgatgtagtaatcaattatgaactcaatttaattaccggtcaaaagctgagacagtatccaggtctaggcctgtcttaggtgttgactgtgatgagagagttgaggcaagacaatttaacacattgacattatggtttcagtcattgaactttggcactcacctaattcaggaggaatttgaaggtagctatgcccaaaaaagtttgatgtttggcacatacttgccctttttgacatgttgaggaaaattgctgactttgtaaagatgcacacaacaaatttaatttgtgagcatatggactattccttatcagaaagtttgctttgctaatctagcatatactcccaagtatatgaaaaatttggtaagataaatttcatatttttacaagctttactccctaagatttctcatcaataactaaatggaaagctttcccatttaatcatctgaaattcttacctaattaggagctaaaactcaagcaagtaaagaagtgtcgtcaggacaatctcattttgtcatctctcatttagagcaggtacaatagcatactataagccagttataaatatttttttaagaagataaaagaggagagataatagcagcaggctacagatttatagcccattgcagcacggattccaagacgcaggtgggaccagatattgattgtgtagcatatgtttatagataactattgtataaattagctattaagttgattatagatgatttgaagccagcagttggctatactattaaacttgctcttagacgacaaaaagcctaaaatgactggtggaatcttcttttgagaccatatatacacccaagggacaaaaatagtaagacaatctagagaacattttaatacgattgttgccgtgactttgtaaccccaagtttagtgttttagttgcctttatcaatgatattgcgtgcgttgaacacatgccagtaataacagccgtctctccttttcagattaaaaaaaagaagtgtacacccttctttctccatggtcgtcaaaggcttttcaaaactctttttttttttctaaacaaatatgctcccttcgttcttaaaataattggcactattaactactgctatatcatttttaacttttactgtagatgactagattataataaataaaagatttatgattatattcgtaatgctacataatttgatatgatatgtttttatattttatttgtcaaaagataggttattaaagttttaaaactgaatatatcgtgaagtgagcgtaacacaactggttagtttcttgtggtggatccagcccatattgataaacgacgtcctcactgataacgagatatccatgacgatgtgtgtggctaacccatgaactcacttatagaacaaaataagtaaccgtttattttagcctataggtaagtttgcgggttagcaacttaccactaatctgagccgtcaatctcgcatcagaaggtctccacctgtcccacgtggaccaatcacactcagccagctggccacctcccctaaccaccatcatatttaagccccaaatggccaaatcctcctcactctctgtaaaaccaagcaaacaaagaaagaaaagcatcacaaatctcacgcactgtctctcgttcgcgcaaagcacgctgcttttctccgctttgcgagcaccatagcctagcccaccatgtgcggcggcgccatcctctccgacctcatcccgccgccgcggcgggtcaccgccggcgacctctggctggagaagaccaagaagcagcagcagcagaagaagaagaacaagggcgcgaggaggctgccactgcgccaagaggaggaggatgatttcg

SEQ ID NO: 49010 - DNA, 6064 bp, Oryza sativa
acaccgatcttgttccttgctccaggtggattgaaaaacactactgttgctggtgctgatgggcctgcagcaaggtctgctaaaaggaagagaaagaaccaattcaggggtatccgccagcggccatggggcaaatgggctgcggaaatcagagatcctcgcaaaggtgtccgcgtctggcttggcactttcaactctcctaaggaagctgccagagcttataatgctaaagcacgaagaattcgaggcaagaaggccaaggtcaatttcccagatagggctccagtggcttctcagagaagtcatgttgagccctcctccatgaacatgcctgctttcagcatcaaaaagaagccggccgtcatgtcagcaggcaacaaacccatgtacaacccaaatgcttatgcctaccctgctgttgagtaccccttacaggagccatttgtgcagattcagaatgtctcatttgttcctgcaatgaacgcgattgaggatactttcgtgaacctgtcctctgatcaagggagcaactcctttggttgctcggactttagccaggagaatgatatcaagacccctgacataacttccatgcttgccccgaccatgacaggtgttgatgactccgcattcctccagaacaatgccagtgatgcaatggtacctcctgtgatggggaatgctagcattgatcttgctgacctggagccgtacatgaaatttctgatcgatggtggttcggatgagtcgattgacacccttctgagctctgatggatctcaggatgtggccagtagcatggacctttggagcttcgatgacatgcccgtgtcggccgagttctactgaggggtttggggtgtagcaactggtgcctgtatatataaggacaaatggtaagcatcagcaatgtgaaaacggctaactctttgtgacatttcgatctccatttctctgatctttctccgcctctcgtttcaggaataaacattctggacatccaagaagcggcatgtgtctgtcgggcgctgcgaattcgagctatatagctatgttagtatgttagtatgtgctgtgtctagcttagatgctgaagtctcaagtactatttggcagtgaaactatctatctgtaactgctatatgaggctggaacaagttacttagcttctaccttatctgtacttgctatagtggctgtgaaccttgtggatctgaactctgaagccaatgtttactatataatgtggttggttttataaactctagttgatttggacccctgtcaatggtcatgctatggctggggataagaaccattgatgatcatatttgactagaaacgctgcttccaaaatatcccataaagtaaagctgaacttgtactaatgttcttgcacaagttgcaataatgttgccttatggaaaaacagtttccggaccaagtggtatctgtacgaattgctattgtaggctaacaacttgtgctcaagtggaagatggtgagtatgaatcatctttccttcagttgcacttaaactccggacctacatatacattgactgataggccccagccaaaatcttgtcttctacataggaattctcgggtagtttcttattacttggtaatggttgttgcctaggaaaaattttggttgccactcagttttgattgttcttaggttggagaaaatttggccgttctttgaatttgttgtagatagtagagcatcatgttcgattgagaattttgaccgattacacttcatgaattgtacaaaattttttttatcgggctcctttctatgatttttttttacgcaagagttagaatccatgttggaatgagtttatttgagcctccaattctccaaactatggttatcaaatcttgataataaaaacatctgtgctgtgtatccaaccattgtgcactaatgcactatgatatttatgtatgtttggtttgctgctagtctaggatccttgctgcaatatgctaaaactctagtggagtattttacgttggttgttgctggtaataggcaccatcaatattgaccatatgggtatcattaccctcccaaaatatctcaaaagttaagcagtacataacaaattgcaaaggactatcttaagaaacaccgtcttataattggatttttgggcagcttcattgttgatttcgtgcagaaagtggtcttttagttcaggaagaaagtgaggggaaaccaaagagagaaataatcttccttcttcgtcgcactgctgtatgtactcggaatagacctgtcagtttgttgaaggtttacggccctctcctccatcacatttctgcagtctggtgtcgcatttcctggtgcctcctgttcctacaccatgggattcccgctaataggctgtccatcaggtttgcctccaaagaaggctcagaatgaaaggttgcatacatgaatgcaacactaataatggaagctttagtaatgtgttatatattgcctccaaggaagtatgtgttgtgttgtgtctagcttatcagctcaagtctcaagttctctctggcagtggagtatctatctgtaacaagttacatagctttccagtttattacacttcgtgaacaatacaaagttttttatcacagtcctttccatgtttctttctagacccacaaaagaactgaacatcatttaagcttcatttaaatgttggaataagtactttcgaacatcctgactatgctagtcttaactctaaaagtcacaatgatacgaagatgctatatatgaacttgagctagaaccaaggggccagaacatcacaatcctagccaagatcaaagaggaagctgtagcttgggtgaaggcaggagcatatagactccaagagtttggtattctaggagatatcacctaatgcctttttcctgggactgtcgtcttttgacaatccctgtgcataacctttgtatacttttattccttatctatcaatatactaggcaaatcttttgcctttctttcaaagaaaaaaaaggcataacattaagaaagatatttggtgccaattcattcttcgatgtctctcatccctaatgtagaatggttggatatatttcaattgcatcacaaagaactgtatcaagtgaatcaacttctctaaacttcatgctggtatcccttctccccatttataagaagagaggagcagcacaaatgtgcttggtctgaaatagcacaataaccatacgagtcatagttatgttttacttgccatattaagtccacatgacatgttcattgatcctcaattgtactagagtgtacattgtttggtgattttttgacagcgttgatgtagagtttcctgcaggatagagtcctctgtcatgattcatgagctcttcacctcagcttggaactcacgatgaaagattgtcttcactttgcagctagcatagttcgaagtgctttgtgcaagcccctctacatgtgcagtaggcttagtttcatttcaacataattttcccttgcgaggatttcaacagaaattttgttaacacatgtttacctctgaacatgcctagaactccaacctaaaatctagtgttttacatagaattctcgggcggattatacttttttcgaattatacttagtcctggcctttgggtagtagaacttttggcccgtcctcgattttgaagtagatcgtgtagcatattgtgttatctaattttgaatgttcatcatgccattactcacaagtttttatggggtttctttccatgcttttctagaaataccttcaagtaaggtacacggttgagggtatccttagatcaaaccataggggttagaacattggcaatgaggtttggtgccacttgcttctccgatgcctcccatccctagtgtacaacattataatggtatattccatgtcattgcaaagaagagtgtcaagtcagtcatctcttcttcagcttgtctgaaacatcaagggtggtatgccttctccttctctccatttataagaagagaagagaacacagatgtacttggtctaatctagtgcaacaattgtacaagccttaattatgatcattgatcaagtaaggtacatggttgagggtatccttagatcaaaccataggggttagaacattggcaatgaggtttggtgccacttgcttctccgatgcctcccatccctagtgtacaacagtataacggttgagtatattccatggcattgcaaagaagagtgtcaagtcagttatctcttcttcagcttgtttgaaacatcaagggtggtatgccttctccttctctccatttataagaagagaagagcaacacaaatgtgcttggtctgatccagtgcaataatcgtacaagccttaattatgaccattaatcactcaattgacactggagtgtactttgtttagtggtttttttttgattgacttgatgcagagattgcttcaggacagagccctctgtcatttgctcatcatacaaatttgaaactcatgatataggaaggtgaatagctcattgagagtgtgctatgctataaagtaaagctgattgctgaacttgtaatagtgttcttgcacaatttgcaaaatgttgctatatggaaaaacagtttccggaccaagtggtgtcgtactaattgctattgcaggacaacaacttatgctacagaggaagatggttagtatgaatcatcccttcagttgcacttaactccgtagcccggacatactggtagaccctagctaaaatcttgtcttctacataggaattgtcgggtagtttcttattaattggtactggttcttgcataggagaaattttggttgctcctatgttttgatgattctttggtaggagaaaatttggtctgttttcaaatttgatggtttccactcctcggttcttcgatatctcccatccgtgatgtagaatggttggatatatttcaatgacatcacaaagaacagcatcaagccaatcaacttctctgaaacttgatgctggtatcccttctccccatttataaggagagaggagtagtgcaaatgtgcttgttctgaaacagtgcaataacaatacgtgtacgttgtttggtgattttttttatacagggttgatgtagagtttcctgcaggacagagttctctgtcatgactcataattatgttagcatgtgtttgacttcttggtgtttttgcccatcttagttacaacttgcacttgcttaccttcggacatgcctagaccccagcctaaaatctagcgttttacacaggaattctcacgtgaattctttttacttgatcctggccttcgggtagtagaacctttggtcactccttgattttgaagtagattgcagagcatcatatgttggtcaagaattttgaatgttcttccctcatacaaacgtccagttcttattaagtttctttctatgtttttttcccagaaatacaagaagaatcagcacaagtttgagtagatctttagctcaaaccataggggtcagaacgttgacaaggaggtttggtgccaattccttctttgatgcctcccatccctagtgtacatcagtataatggttgacatgttgagtgtatttccatggcatcccaaattatagtgtcaaggatggtatcaccttctctacatttataagaaggaagattaacgcaaatgtgcttggtctgatgcagtgcaacaaccatacggactttgctcattgatccccgaattgataatggagtgtactttgtttggtgattttattttgatcggcttgatgcggaggttcctgcaggacagagctatctgtcattagctcatcacaccaatatgaaactcatgattagaacttagaaggtatatagctcaatggaactgtgcagccaaattaacttagttgaaggatagcatctagcatagtgagaagcgcttgtgcaggaccctctatctgtgcatcaagctttttttcttcttgacataaattttgttaccatgtgcttacttatta

SEQ ID NO: 49011 - DNA, 1654 bp, Oryza sativa
gggcgaattcgagctcggtacccaatactccatatttttgaagagaatggaagagaacttgtgatccttgccaccagcccgccatgcctgaatcagcattagcccatcggtggctgtcgatacattttgacaaaaaaaaaagagagaataaaaaatgaaggataggcacacacgttttgctaaatgcttgaaagtaacaagagatttgcggatgtcaccaagtgaacagaacatgtagatctgcaactcttactccggaataagagccaatcttgaattaatcatcgccaacatgttacccagcttttcgggaaggttccgctctatatcatttccagatgcttcctattcttattttgtttaaatagttttcgtcaaaaagattaaaaaaaaaggtctgacgggagttctccatcagcattatgaaattatcagctcttctctgttctttctcacttacgttaggctgtttctgtgattctgcaccaccatctcttctcactcttaaattaatctgatgtttcttggtgaagggtactaatcatatatgtctcagagcagttctctcttctcgatatttttaaatatttaagatataaatgaacattcgtagctaactttgaccaactccaactctccgagaaatcagccacactacgacgctgttgtagtaccctgctctcaactctagcttgatcatggacatcagctcttctcctcccacattaccttagtctcaggatagcgcaacgttctaattagcttctcatgtgagccatctcatctggtaggtcccggacgaaatagattgcctgttgaaggtgtgctgctatctcctccagcataagttgtccctctgctgccgtatttcctagtacctcctattcctacttcctgcgccatataattcacactaatggactgtctgtccatcaggtttgccatgaaagaattttcagatgagtatctcttgctctcttcacttattttgttcaccttggttgagtctgttgtgatatatgtaatgatccaggagcatccgtttgttgtgataaccataaagaggctggttgcattgcaagcatgggggccaaatggttggcattgcaacaaggacaacttctgtaagaagtcagaactagtgtattctcaaggtggctctgccaactgctattttgttctccttgattgcctgacatgtgggcctgaatttctagagctttcctaacaccaagtgcgtgctcgttgaactacttgggtcatgagtgcaatgtgcaatcttttctaacttattagatcaaataaatactttccccgcaaaaaagagatcaaattaatacatttaaaacaaatacaatgtgtgttcaatcacaaggtggtgtttgtttgtaatgaagatgaaaattaagttagagcgcggaaaacaagaaagccactatcttttaattaattgagttaagtattataaatgttaaaaaatagatttatctaatattataaaggtacttctatatagaattttttttcacaaaatataccggttagcacaaaaagtacctgacccattttattccgattaagatgtaaattccacctagatttccattagcacgctttttaaactgttgaacgggccatttctttgattgatgga

SEQ ID NO: 49012 - DNA, 1128 bp, Oryza sativa
catggctggcaatggcaagtttgcaacagggccagctgctactttatcctccttggttgactggcatgtggggcgaatttcttagctttcatgagtcatgacgccaaccaaatgatcgttaaacactggtggagaaaccatctttggtcagtcagccaaaatcccacaatagtcccggttgcaataaaaaccggaactaaagattatctttagtcccggttcaaaaggttagagctacttttttatatttagtcccggttggtattctcaaccgggattaaagatctattttgagtcccggttggtaacactaaccggaaaaaaagatccctattatctttagtcctggttggtttctagtcccgattggtagcctaaaccggaataaaagatcggcatgcacgcatgcgtggcggagaggacgaggcgtgcgcgagatcgaggagttaataaattctattccttatctcttcctcctcacatctcttcctcttcctcctcctcctctccacattctattcctcccctctcttccgtcagcggccggacggcggtggcagtagggcgcgtcggcggggccctcgcgcagcggggcggaggtggcctcgcgccgcggcagccgagcggcggcggatccggaggggaggcggccggccgccgccggatctgaagggggaggtggtcggcgcggaggccggtgcggcggcaggcggtggagccggtgctgccgtggattttttttttctttttttccttaatgtgcgattcgatctgtgttgattgatacaatctgtgttgaatgcgtgatttgatttgtgttgttgttgtgaatgatttggggatgaactattgtgtgaatgatttgggatgaactattgctgtgaatgatttggatgaactatattgctgtgtgctgtgaatgtttgatatgagataatgctgtgaatgatttgctatgaatatttgatctgagatgatttgggcaaatagcaaaagaacagtgaaaaaaaagagaaaagaaaaaaaaaagaaaaaaaccatccaaccgggaccacatctttagtcccgggtatttgaaccgggactaaagatagcgatctggggatcctctagagtcgacctgcaggc

SEQ ID NO: 49013 - DNA, 1761 bp, Oryza sativa
tttagtgaccaaaagcaataaatatatatttgtgttttttaacttcatgagagcatggaagttgtttttcccttgttttgttttctttacctttaagagtttttttttaaaaaaataaaaaacttttttggaagttcttcctttcgtagtaacacggtagaaaaagaaataacttatacaagaattttttttataatcgaagaaaacttctgaccactgaagcaatgctctttaattgttggtgagtggtgacatacacaatgcaaacgatcgaaagacaaccttgccacaccacggctcactgaaaattagcccatcgtctggccgttaaataccttttgacaaaacaagacaaaaaaaattgaaggatgcgagcacaagttgtgctaaatgcttgaatgtaacatgagatcaagtgctgtcactaagtgaccagaacagcttggcctgccacacgtctgaactttcccggagtaagaatcagtcttgaactgaccatgacaaatatgttacccagctttgttggaaggttttgctctgtagcactttctgatgcttcctatccccactatctctatctacatagtttcatcaaaacgaaaaaaataatgacaggttttcatcggcattgtcgatctatgagctcttctcttttctcccttaagccacctcccatggtctaagctgggtcactccctgtctcttttcgcgaatgcgtaaaaaaatggcccgttaatatattagaagaaaagagtttttgatacataacgcaatgactagaagaccattattgccaggggacaaggaaaaaactgagaaaggttaaaaaactatgaaagaaacttaaagctgcgactcctatatagcgggagaagggcggtggaggaaacccgctatgctctcaataggcctccaaaagaagcggcaccagccaaagaccagagatggccctcctgaacgatgaactctaaaaccaccgaaactggtaagagagaggagctgaaaatcctggagttctgctctttccacagctgtcaggaaaccaagagaactagagagtcaaaacccctacgaagatgctcacgcaggcaggtcctaccagacagccactagtcttggagagagtagccacgagaaggagcgagacctagccaataagagggggacatgatatgatgctagacctagcgtgcgaacacacagtagaggaggatatggttcatcgtttcaagctcctgggcgcaaaaaggacaaaccgagtggctgtcgatgccgcgctttttcagtagatcagttgtctaacaacgctgctggaacacaagccagagaaatagattgcacttgacagggcctttagcctgccatagcagatcggcgcaagtaaaggagtgctagcctaggaagaaagcccggtaagctgagctagctgagtagagctggtcgcctgtcgaatgccggacaagacggtcctctgtgcccgaagagagctggacggaacagtcactccatgtcagatcccttaggcttgagtgtgaggttctacttggctaggtccagaacgagttctaagtttcgttgaaggtgcaaagccctctcctcaatttgatgtcctgattctgctgacagatttcctagtgcttcctattcctactcttcctacaccgtgtgttcgtgctaatggactgtccatcagcatgcctctaaagaagtttcagatgtgttgctctcttcacttccttcgttcacctcgggtgagtctgt

SEQ ID NO: 49014 - DNA, 829 bp, Oryza sativa
  unsure (1)..(829): unsure at all n locations
nnnnnnnnnnnnnnnnnnnnnnnnnnnnnnnnctttttgcagccaagttcataaagattatggatattctgatttggtactccattttcttacatgatatttatcccttccttttaaaattccatttgtagtagtagttcgattccagtgaaagtttttcaaaaatcatactatgtcccaaaatatagctaatttaaaaaattgaagtagaaagataactatactttgggacggcggactatatttcaaaggatacctcaaagtttgaactatattttggaaataaaattgtatttctacgatggcatacctaactacctaggaatttaaaaactttatcactgaaatcattttgcttgccattagtatcgaagggttgatactcgactacaataacgcatgggtgggagactagtacgaagatacgaacgaagaatacaaaacgcggaagatacgaggttatatatgttttgcctataagccatactactactactctcttatcttaatatgtgaaagcagcaaagctatctcagaggagaatgggccacatcatctaaaatacgagaaccgtcggatgaaactgataaagaaaaatacaccgttggatcatatataaggcatctattggactaatcaggaggcttccataacattcctccctattctttttagcaccatgtttgattaattaatcggttgacaaataaagaaaaaaaataaaagagacctcaacctttaattcataatggagttattaacctatgtgattatcattaataacatgatttattgcaagattaacaagagacagtttctttccctggac

SEQ ID NO: 49015 - DNA, 1163 bp, Oryza sativa
agacttattttccatatttgattgaacctttttttcatatagcgaaactcagtgcgacaatatttaagctctcgtctacaattttatttgtggagtctcaccaaaaaaatatctaagaatactccgaaagtatttaattttggtaaaaaccacattaatcgctcacactttatgaaaacatattgattcggttaagcatgtgtttactggggtggttttttcatcaaaacttaataggtgggtgggcatttgcaacaaaataacttatggggtgtaatgtcaaacttcaagtgatttatggggtggtttttgcaattttccctatttaatttgtacataggccatgaattcgtgcaacgaaacctcttctctatggaatggttgacgactaacccaattcttaatcaaataaattttgtcgtcgtcgatcgatcaattaattgacagaaatcacatccacaggaaaaataaggaaaacaaaaacagtggtcggatttgatcgatcgatccgttaatttcctgattaattagtcaatggggttcggttcattagccggattagctcgagctaatcccaaaagccacgattaattagcgcggcgaaattactgcctttccctcgccggggacgggcgggcgacgtggccagttgggtaaaaatttggcgcgaaattcacgcgcgcgccggtgcatggcatggcgcgcatgcaaaataagggccgtttagttactaaaaagttttttcaacatcacatcgaatctttgacacataaataaattattaaatatagataaaaagaaaaactaattgtacagttatgggagaaatcgcgagacgaatcttttaaacctaattagtccgtgattagcaataagtgctacggtaacccacatgtgttaatgacggcttaattagtctcaaaagattcgtctcacggttttccggcgagttctgaaattagtttttattcgtgtccgaaaaccctttccgacatccgatcaaacgtcaaaggtgacatccaaaaattttcttttcctcaactacacagggccttaaccgctttgtacgaattcaaagccgcgtggaatttggcacggcacgtcgcagttagatcgatccagctcacatcctcgctagctaaacctcttcaagcttataatct

SEQ ID NO: 49016 - DNA, 2252 bp, Oryza sativa
  unsure (1)..(2252): unsure at all n locations
ggcgaattcgagctcggtacccgacatgtggttccattcccacgacacctgcccgctctgccgcgcgcccgtggggcccgacgccggcggcgaggggctgccgcgcgtgccgcgggaggagccggctgccatggacttccccatgttccccaccaacgtcctcttctggggcaccgcccacgacgacgtcgccaacgccggtgaccgccacccgttccaccccccgccgccgccgncgtctttcatggccgcgccctccacgagctcctcggcgtccgcgcgcaggaaggagagcctcgtcatcgacatcccgtcgcgctctgccgccgccgccgaggcggacttcgtcacgtcgtcctccgcctcgacgccgctgtcggcgagcaggatggcggacgacatgaggtcgccggtgtcggcgcggctgcggtcgctgcgccgcctcctcagcaggggcaagcaggccgtggtcggaccgtccttcagcccgcgcggcggcggcgacatcgagcaggggctcgccggcgctccgccgaagacgcccaagacgccgccgccggcgaactgatccttctccccggagctccgagatgcattggctcgcctcgccgatcaccggagcgtacacatgtgttcattctttctttcctactattcttttctgatattttcttttacatttcaaaaaagaaaaaaaaagaagaaattttgatgagaaactctcatgtaaaaagaagatgacaacattactgtaagttgattcttggtgattgggggataaaattgatgaatttgttcaattgtccatgagattgttcaattgttcttactttcttacttatctttgcctagatgtgaaattgtctgaaaaggtttatgtgtttcagttaaacactgcttcttcttcttcttcttcagaagtcagcagtctgaattcctactgtcactgacaatctgatcccagaaacacgatattagaaatgaatgtatttggttaggagccgaaattcaaaagataattcctaaacaaacacatcagcaagagagaagaaaaagaaggctcaaaatggaattatgcctaacaaagtacatcaactgtacgttcggctagaatatgaagtgtgtaggagacaacctctgcgctttttaggcaaaagagttggtttctgctgatgaaaacttgttcatgtaggccccaatgaccccaactatacgatcattttcttttcagaaattttgatagctatattcagaaatatgcatcaagaaacgagagcacgaacaattgttcagtgcttaacatacatttgctgcaatgcagcggcctcactagttttcagtcgcttcaagtatcacctcatctaatcacagtttaagatatccagctgccttcatggataacacaaattccagcatccaaaatatgaaaaatatcaaacccttgacagtgcctgagagtttctttccgtgaagcgattattctgctcgtttcagcacaatggatttgccgatcaaacacgacacagtctcagtctcaccgtgtgtttgcacacaaaaaaaagtcgatgcgattcgatgcaaaaactttgacccttcctcactctgattaattttggcttacttttttccccctctttctgacacaagttgcacttgactatgctccattcgttttgtgcgtcactgcgtgtctctgaatttccaagcaaacgagctaagctagccgtcagtcaggtcagtcaacgacatgtgatcttatgtaacagtaacaatactacgtgtgcattttataaaattgttattaattagctttagctgcatgcggattaagtcgtggcgtccaatcgcctgcacgattaggatgtcagtacaggagaaaatgggggaagtttcttggatgcaagtaaagtactcggctggagtcagagacggttgaatgcgagaagaaacaggggaaggaggaatttctgagctaaggcaggacggacgttaggtcaggtgtcactttctttgccttgtggacatggctaatctttggtcatcaacgagcttcggttgctaatctcatcgacgtgagataccgtgagcgtgtgactgatcgaatcctttgtcacagagttattattagcaggaacagtgaatagtttaagtgtttctacgcagattgaccctgatcaattggcatgttggatatagcctggttgggtttgttgagataatttaatttacgtgcttgagattcagggatcgga

SEQ ID NO: 49017 - DNA, 2424 bp, Oryza sativa
acctaaacatttgcatttcacggagccctaaatttggagacggatggactagtccaaaacacctgcggcgcagtcgcgcaccacaccaccttccgagacgggcttgcacaaaaccgtcgtgaggtcaggtcaggtcgtctccggcttcccccaagccgaaccactttgactcgtcaagccgccgctgatatcatttgctagtcccacccccgcacgcggcacgcggctttccgctcccctttctttttctccgctctccccgcggctattccggggcgttgccagtgacatgacatcccggtgttggtgcggggtgcgaccgatcgagagatgtggcgcaaaagccccggcatttcgcggcggatgactggttgctgccgcccgcgtctcctgcttgctgcctcgtcccggtgccccgcctgtctcgtctcgtccctccaaatctgcgactttcccatcaaaagcgaagcatctgctgcgtacaacacccacctgcgctgcgtgtaacatccatcatcggtcgtaatttcctcgcccatgatggggcagtggcggaccgggtgagtccggtggtgacgtcatcgggtctcggtaggagtagtactagctacaggtggcctcttttggttgatactgcgtgtccccaacctcgtgcgcacaagacaatgcattattttttaaaaaaaaaaaagcactctcggtctgtgcatgtacagtggtatttgtgcgtgtgacgtctttcgtaaaattgggagaaaaagaaggaaaaaaaaaacgccgaagaatgaagcgaacgcccgccctcggaccaaccaacctcgccgcgacggcacggcggacggctacgggattattacctcgtcgcgtgatccgccgcgttcccgacgtgagaggcggacgaggccgcgattggtggtcgtgacagctaccgatatagggaagggttcgcgcgcgatggcgttgcggatctctgaacttgtcaattgtctgcgccccatgggcacgggacgatacgcgtttctcccaccaaaccaaaccaaagcgtttgggtttccaagtgaagtgacggggccaatatttcacaatttcccaccgttcccactgcgcgagcacttgagttggtcagatgaacatcaagtggaaattaattaagctcacccactcatacataaaggctgtaatttcgtccgcacgaaattaataatgtttctgttacggacgcagtacttcattcgttaaagaaaaaaacaaaagtaccacggaatgtaattcatcttaatactataaatatggacagaatatatcacatttgatattacgtttaatttttaaaaatcaaagggagtaatgatggtgcaatgattggaagtactgtgaaacaaagacgacaaagtagttacggcagtaactaagctagggtggtaggagtaattatcaaacaaagacgacgaagtaggagtaattaagcactatcgtgactattcgtcttaaaattataaattgagattatttttttataataaaacaaatcataataaaatacataatttttatataagatgaatgattaaaatttacgtgaaaagttaacgacatcatatattttaggacggatggagtacattttacgggtactctctccatccctaaatatcatattcagattcgtagtattagaatatacactattcaccaaaaaaccctttaatgtcgtgcattagtgacttgggacgacaactagaaatgtaaggatcaccatcacttgacgataaaatgtcaaggcaaaggccagtcttgtaccactcggaggccggtgcacgccggccggccggcaggcagatgaccccaaaatcatgaaccgatgcgtgcgatcggtactgcacaaggagaaattccaatctgccaaacgtatacaacaccatgaagcacggtgccaaaagattcaaatgtgtgtgattctggtctcttcggtgtccatcaagcgtgacatttcacatttccaagggagggtttcagactttcagggttgggatggactggtctatcttccattttctgctctaaaaaaacacacaccgccctgtacgtttgggactcatacaggatgcagctttagttgaattattcaaagttcaagtcaaacaaagaaattaaggaacaaaaacaaacgtgatcgtttattgttttgcaacatgatacagattgtctgatttgagcatccgatggttaatctaaggaggtgaccattttactcttcaaagaggtagtatgccaatgttgacctaattacctatttgagtcgcccactcctgttgtattcaaaataaggtcatattattgtgagtcacttccaccaaatttgaaagaatcaaattcaaatggacagagatcaatatcccacgttttttttttgaaatacaaata

SEQ ID NO: 49018 - DNA, 1881 bp, Oryza sativa
ccattcttacagccatgatgtctagaggcttgctcgggcggcggcgaggtggaggtaggaaggaggcggggtagcagcgagctggcgagtcaccgtccgtgtcgctccagccctaggattccttaccattttcttttgtttcatccaaaattatcactgtctaaaatttaaaataaaagtacaaagaaaggtgatacataactgattgacaatcacttagccacgcatgctagtcgagaaaaatcgaatgtaccttacgcacgaaaggctaacgactagcatcacacagatgtaactacctagtttttactaccctcttgtagtattacaatgtcgtgaatggactaataaacacagtaaattaaccaccggcaatccccaagtatttacaaaggtatatatatatttcctctctcagtgatatataaggctacgtaattacgtaagtcactgaatgtatattagagcgatgaaataataggacacacatatattatgaaggtgacaaattatcaaatatcccgattacggtcagtaagggtcttttgcagtactgcacagtagaaatgctcgctgacatgttggcccgtagaggatctggattgcatcctaagagcaagtataatagtaggctataagtcggctaaatgctgatgtggaggagagaagagaggagaagcgggctgtaaacttacagcggcttggacacaagaaccaagaaactctgtgagaaagacaagtaggccatgtaataattataaagagctaactattatataggtagactaaaagaagactataaagaactttatagaatacaggtcgacagtattattagccttgctctaatattcgtggacgattaattacactccggttgcaaattcagcatgctgcccacacacagtgtcctgtgtcctcccccgcccgccagttggatgcttcccggatcccggtgcccgccgtctcatccgatccaacgaagaaagaagagaaagaaagcccgcgagttcgagtcaaaccgggcgacccaaacgttgtcctctttccttgaacccaaccacttgttgacaaagtccatctcccgccacattccaccccggatcctctacatcttcaacaccgcaacaacggtgacacacgaaatggctccatcgttacagcatatttttgcaaatgaaatataatttgttaataaaagggcggttcagattgtagccaaaataaaaccttactaaactttggtaagttaacattatccaaattttggcaagattttttttatgtatttactaaagtttggtaaaagctaaatgtggacatatctttggtaactttgctagaaatatagtatggttgaaaatatcatcaatatgaaacagcccaaaaacttttatatacgtgttttagcaattaaaaaaggaaataaattatgttaaaaaaccttaaaattaaactcaaaatttaaatttaaggttaaaagttaaaattttacggatgataagcataagcgaaaagatgagaccggttggcttcgttgccacataagatccggctactctcccccacgtagccgcctcgcctcaccttcaaatacgagctgcctccactgcctcgcccaccattactacttcctctccttccttctcttcttgccaagctcaagctgatcaagccaagaagctagctagctatgtcgtcttcgccgccgacgagcgcgatggcggcgggaacgtcgtcgtcgtcgggaggcggatctgggccgttggtggtgagcaacggcgtgctgctcgccgcggtcatcttcctgttcatggtcgtcgtcttcgtcttcctcctctacctctacgccaagagatacctcggcgcgaacccgctgct

SEQ ID NO: 49019 - DNA, 1782 bp, Oryza sativa
atattaacttttacttttacatacttataataaaattttaacagatattaaatggttagacattatgaaaatcaacgatgtcatgtatttaaaaagaagatagtatatatgtactactacatctgtcttattacattataagtcgttttaacttttttttctaaatcaaattttgatcaatttatatagaaatatagcaatatttttaatataaatccattcaaaaaaatatttttaatatgaaaaagaaactatcaaaatatactgaaggttagatttaataaaattaatttagtgctataaatgttgctatattttttgataacttaactatacttttaagaagatttatttaaagagaatcagaactatttgaaacatgaaacggaggggaatactagttttagcagcagtactgcctgcctgggtcatataatggaactggacgggacgggttagggcggcccgatcgatcggagagtcgacgaagaaagaaacgagaaggcggcggcttgggttttcaattttcagctcgaccggcgaggcaaggcaatcgtggtgtacgtacgtacgtgtggtggagtggagactggagaggcgaagcgcagccgcgcgtacgtgttggcggccgttggtgtgcgacttgggtacgtacctgcgcgattctgcctgcggaataggcatagccgcgcggccgcgcgcgacgagacgaggcggcgaatcgctgcgggcgtgggtatcgtgcagcgtagcgcgggcgcgtacgtgttgctggtggtgtgggcgtgtgcgagtccgcgcgacgcgagcgcccagtttttatcgcctcgtatcggctggcggaccgccgtggcgcgcggtgggtggggtggatgtacgcgggattgggcacgcggccgcggtgcgtaagctaaaaagagctagggcctgtttacttgatgttatttttaaccttatcaaattttatttaagttgttaaaaaagtggctacatttattttgctgtcaaattttggtaactatgccaaaattttagtttgctacccttagagcctgttcactttgatgccaaaaaaaaaccttaccaaattttagcattgccaagttttggtaacttgctaaaattttagcaggatttcttatatagttaccaaaatttggcagcaaaataaatgtagccacttttttttgcaactttaccaaaatttggtaagttgaaaatggcatcaaagtgaacaggccctaagtccgtcttgactccctctgctagtagatgaatctgattcgtatccctaaatcacaatgccaatgtagtttgactctctcagcagtttcatatgacggtttcactgatgtgacgtatatatggttgtgtttagctgatttttgtcctacgtgatgttgacgtgatacttacatgatactccctccatccttaaatagacgccgttgactttttaaaacatatttgaccattcgttttattcaaaaacttgagtagtagtagtatatttaagagtaaagtccatcaccggtccctaaacttgtaccgatgtgtcatcccggtccctaaactcgcaaatcgaccgttcaggtccttaaacttgttcgactgtgtcatcccggtctctaaacttgcagatcactcgtttaggtcctccatcttgttcacttgtgtcaccccggtccttaagacggtctaaaaattttatatcaaaaaattattcataactttttcatgtgaactctaatgaagacaaactttatatcaaaattgtagccc

SEQ ID NO: 49020 - DNA, 965 bp, Oryza sativa
  unsure (1)..(965): unsure at all n locations
tacaagtttgatataaagtttgtcttcattagatttcacatgaaaaagttatgaattatttttaaatataaagtctttagaccatccgatttgacccatatgatattcaaatccaagtttagaccccggggtgactcaattgacaaagttaaaggatctaaatgagtgatctccaagttaagggcccaggatgatacagtcgagcaagtttgaggacctgaccagtcaattaacgaagtttagggacggganataacacagcggtacaagtttagagaccggcgatggactttactctatatttaataatgaatcaaatgataggaaaataattaataattacttaaatttgaataagacgaacggtgaaagatgttaaaaaaaatcaacggcatcaaatatttagatacggagagagtacccaaaatcccttatactatgggacggaaggagtattagaattaagaaaaaatatatgagactcatttttcacccacacacacaaaaaaaatatataagacccatttacacatgggaccccatgttatctctctctttttcttcttccttcctctttctctttctctttctctgctcttcccatgcggcattggcactctcacacgagctccaccgttgtaaaaactgtgtggtttaaaaactgaaaatattaccacatatgataactataataaccgcatggttttacaaatcctggccttcaccttcgcctccccgagttgtacgcacagtcgcttcagcttcgtgcgccgtagcggcaggctccagcttcgacggtccgaccacatcgttcaccaccgtctgccgactacctctgtattgtccgagtaaagatcgtgagcgaaaagccctcgtattttaaatggcaattttggaaggagatagatgctcactcgcttgcgaagaagggatggcttggcatcgatttgtaaaataatatgact

SEQ ID NO: 49021 - DNA, 2323 bp, Oryza sativa
cagctctaaaagaaaaagaaaatatgtgttccccatttattcctttcgccattttaccccgctagaccgccaaccaactagtgaaacctcccatagtagaaaacttaattacatattgcattcccagtcattttgtcccaacaattaatgtacattcaacgattttgtgcccacgatttcgcagcacaacttgaggttgctttagtcagttactctgaacttcagtgcagatcttgttgcagtacaacaagtgttaatttactgtgtgtgtagtgcagagctttcacacaatcacacatgattgcagtaccagatcaaattcaagatgctatttgtaccctctcttctttatatataactggggttggggaggaagagaagatacatgtttcagcataacataaataagctaattgaggaggaggaaggagctgaacagaggagagacacagagaggtgcataccaagatacattttgcacgcaacttaatcacaagttttaaccacatactataaacctaatggcaacattgcagggctaggactaggatgcatcaggaaatacagtgacaggattttgaggagttctagaccttcctcttgattctgtattgtgcagtttggctctaggtaatgacatcaaaagggctgaagcctgtccaaagctacaaaactaaaacactcacaaaagctttcactagtgaaaagtgaatcccaaaatacaatcagaatgagccacgtcattgtgagaacaatggctattggatgaagaaaaggacaaaatagagaggagagagttgggccgttggattactgatggaaaaaacagttactgtaaatttccggagccttctgactcaaagaaaaagaagtgcttgaatgaagagagaggaggtcaagagcatcggctatgagcctgtgagctgtccaaaaagactgaggatggctagtaacataagtgacctaatagctggtggataatatgttaacgccaatattttgaacattgttcatcatccaaaagactgaagatggtttcgcaatctccaattcaggttgatctaattcactagaaaacctgcaaagttttttgatcaagaaaacgagtcactaacatttcatcatgtatgatacatactaatattcaaattagtagaaaataagtcactaataagaacaatgcacatgcagcatctggtaatataaaaatatttcctctgttatggtaccttcatggagtcatggttatatgtcactcgtagcacgcaatactcaaactagaacagtaaaattggatgggtgagcatcagtcaatgaatattgactatacggccagcacatctacaacaaatataagagaggtggagtaggcaattcaaatactgaattactgattcctgcaatatggtagcctgtgatacatgggtaggaccaagtaatgacagaaatatttcatacagcatccaagacaaactgctcctacagagaacaactctatctgaccgtattccaagaattaataatatattactgtccagctcatgaaacatcgtaattaaacttaattacctaggctttacataagtccatcattaagagatttaattcaacttaggttaagtgagattgagaataccttgaacggtttaggtaagatcattttcatgcatgattcacaattataaaacttttagtgtccaagttggctggttcacatgttgcattctaaagccaatcgcgaaatgggagaaaggatggagcttatttagatatgttgactatctaaatatatcttttactagctaaaactacagtattttaggcgcagagggagtcaaacattgttaagtcattttattttgtcatagacaaaaaaaaaatagtgaaaccttccatagtagaaattactaattgcataatgattgcactcccagtcattttgtcccagcaattttgcagcacaacttgaggatgcagataggcagttaccctgaactttagtgcacctcctgtacaccaactgtttaccatgtgtgtagtgcagagctttcacacacatggtaacacatgattgcaataccggatcaaattcaagatgctattgctaccctctcttctttatatataacttggggttgaggaagagaagagatgtgtttcagcattccataaataggctaattgagagataggagctgaagagaggagagagatgcatatcaagatacattttgcacacaacttcacctgaagttttaaccacaccatataaacctgatggcacctctagccataccgcattgcaggactaggactaggatgc

SEQ ID NO: 49022 - DNA, 2069 bp, Oryza sativa
agtcatatcagccacaaataaaaattaatagcaattccccaaagcttcttcaaaatatagcttgtagtactaaggaaccatggtttgcatgcttactcaatttcttagctgggtgatattggtttaaagaccataacacttgaaggattgtgtactaggaaggatgcttgagagagaacacaaaatgtccatacaacaacatgctcaagtagacaagttaacataagatgaattgcttccctggtgtaaatgaaatcttgtagcctagtccacaaagcatgctaacttacaagaaatgactgaaatcaggaattcagacgcatcacataaggagtaatagtataaaaaagcatcctcagttaccaattgcaatgatatcccttacatagtgcagatttctgaactgtgcaagctcaaagtaaatctaacaacttagcctattagctggtaaattatatgccaatttaatacttctgacattgtttgccatcaaaagactgaggatggctagtccataagtaacctaatacgtagttaatattttgaacattgttcatcactcaaaagactgaagatggcctagcaatcccaattcaggtcaacctaattcactagaagacctgcaaagtaaagtgaccaattaacaaggaatcaagtcagtatcattacatcatgtatgatagataataatcaaattagaagaaaagaagagctgagcagtgggagaaaagacgaagctttgttagacagttttaaacgtactctgtatctatatatttttcattttaagattcttgtggtcgatttttaaaaactgatttggccataaattttactagcatatttcattaacagtaattccagaacaatacaccattgcatatatttatttaaattttataatcgtaataacacgtaattgctaaaacaaatataggcaaaagttatgcactcctgattgcatatctatcatcgcataaaactgcatatgtcacatcttccaagtgaaaactgcagaactcctgattgctaaaaaagggagtaattcacatcttcgaagtgaaaatggcaaagtcttatcaggctccaacagaagaccagtagtctagtagagctatcaatttgaacgatagattcaaattccaactacaacacatgccaaaaataacaagaacagcacacctgtgccccaatcacagatatttggagcctctacatcagtcgtcagtttcatagtaggaacttgctctgattatgtagacctgcaccattttgatacaagacaaaacattgtttgcactaatgtagatttctcctgggtaggccttataagaaccaacgtttcctgcacaatattttcctatatttagacacatacattacctggctaggctcaacaaattatagcaataacatgtgcaaacaatgaatgcttgaaaattgggataccatgagtcaatgacacattcattccagttatttatggtgaactggtgatgaactgtttttctgatttaagacatcaataaacctaacacatgattagtcggctactacaaatcaaccagaattatcatcaaccgtgcaaagattcaggagatcttcatataacattcgtgccgtgcccgaacaactccaaactcaccttgaacttcgtgcgctggataagttggaacaccaaacaatctccatcaactagcttatgagcaatggaaaaccccctccaccctccactgagccccctcttgttggcaagatagagggtgtcaaactcatcatcctcctcatccaccaaacggatagtctcgtcgcgcttcggcagatacttccggctgaaatgcgtcggcaggctctaccaatttcattcaccccaagaatcagctgcctcatccctacaacctacatgatgcaaagcaagatgagagtgaagttacaggcttaccagccagaaccctccagtgacatgggactgaagcatgggcttgacgaagattgggtagtcggagccgagctcctcttccagctcttgagcagcgttgatggcgtagtccctttgctcgtcggtcgcg

SEQ ID NO: 49023 - DNA, 3192 bp, Oryza sativa
  unsure (1)..(3192): unsure at all n locations
ccagcggcgtcagcacgcgcaccttcctgggccggccgaggcggccctacgcccgcgccgtcgtcatggactcctacctcggcccgctcgtcgaccgggccggctgggtcgagtggcccggcgccgagcccggccgcgccgagacggtgtacttcggtgagtatgggaatggcgggccgggcgccgccatggacggccgcgtcggatgggccgggttccatgatatgggctacgacgaggcggcccagttctccgtcgacaacctcatctccggcgaccagtggctcgccgccacctccttcccctacgacgacgacgtctaaccgtacgagcattgtcaccgacgaaatccatgtccaatcaatgcattgtagtattgcactattactacacctgtattaatgaattattaccacgcgtaaatctcaacaatgcagccgttaattaattaccgtgtttcagagtaaatccgtggaactgtaaactgcaaaaatgcagaattaccctgttttgtttacgacacaaaaatcctaacaaatttcagtaataatggttgtaaattatattaaaggggttgccaaaaacatagcgacatatatttcatttatatttgagttaatttttttcctacgtaattgcgctctctaccctatattttgaggaaaactacggagtatgtataagtatggttctacctctcttatctcctcttccaagttgacaatacactacttggaatattatttctattatatattgtctatttgaaaaattacagtgtaatttaaagtgtaaaaactaattggttgttttttaatgaaaatgtggcgttataaatatctatcttatgctaattcttgctacagattctgaagcttaataatggttgttcttgaagctgactattgatgatgacacgacacgctgtaaaagaatgttaatgggtagtacactctgaatgtctcgaaggatgtcaacattcagataactctgagccaccaacttcagagtttttttttttagataataccaacttcagagttacattcagataactctgaggcaccaacttcagagttcagactcacatgggcacatgagtctcactaattaactgccagtgggagccaatctcttcatctctattggagtttttcttaatcaaactcaccagctgatgatgctagcaatgattgaaatgatcgtgcacaaaagtgttattcccagcagaatgagaaatagccaaacaggtcagaatatctgttctgaatcttgattgcttcacaaggacaaatttacaagttctccatgaaccaatttactgtttttaaaagcacagaattctaaatctgaaaaattagccaaactatatatatatatatatatatatatatatatatatatatatatatatatagagagagagagagagagagagagagagagagagggtacagaactacatcagaactgcctcttcagtgtacttgaattccataccttgaaaattattcttacacatgagcatttctatacaactactgccttgcactacatgatcattgatcagttcttctcagatctgcctcttctgatcattcttgatctgaagaacatcggcatcttcgaagacccggaacgtcgccagctcaatgaaatcagtgatctgaacctccataggcctgttcttcagaggaacagaagcaagcatgatcattagacaaccaaaaccaaatcccatcagacaacaaaatcctcatcaggcaacatatgctaatcttctttctcctttcagcatgtcaggaaaaattcagtaaattcagatgttggcaattaccatgggaagcaggccttctccggcagccgcattccgagccttggaccttcatcatacccttcacagaccatctctcccttgtcatctctgtagcacacaatccctctcaactggtcctcaaacacctgaaaattccgacaagaaaattcagaagcaaagttaatcaagacaagatcactcatatactctccttgcttggaggaaaacatatactatatgtatgtatactttcttgatcataattaccttcttgttagcagttgctgcagcgatggaaagctgtgatgagctggtgccgccatgggcaggagctctgaaccttagggctgccttcctggtgccaattaatcttgggatgctggccatggaggaaggatggagggagctcctggctgccattttggtttgtgctgagaaggtttggtgttcagctttctgcagagactaaatatagtgggggaaggagtagggtagggtgttataatcatggaggaacaaaaggttttattattgcaggttacatccggttcgtcccaatgacctgtcactgttttatatttaaaatgctgcttattgtaggccatgctttctattaagcttataaagtcatatttctgtgtatgccaaatttgaattttgacatttcattttagaattaatttacgggtttcttttttgttttcgtcgctctgcgtgactggctaagagtatatgggtaatactatattgccttgactagattgtattattttcggaacagctaagaattattttatcgtaggttagagccgatccatatggacaattgaattgccctgttactgttttatactcttttaaaagaaaatatggacaattgaaaagaacacaggaagcacttcaatcattcaattctaaaggagtatttaaagttctgcttgtcataatttcttttaatgtttacaaagtcatgcttctgtgtatgcataagtgcatgcttaagccgttgcgaaatttgaattttaaaacttcactttagattttttttttgagcgggcaggggcggttatactaccttcatccaaaataataataatgcaattctgactaatgcacctgaatattagctgcattgtctttggattataataatagttgtagccaacaaaatgccttccaaaccgatccttgtaaaagtaaaataaaaaattatcgcctgtagtttttcgtgttttgatcggtaaccgcaagcaatgcgcatctaatggtcttatggctgaatctctccccaataggttgggggaccccgggccatttcctcatataagtgataagtcgcaaattnnnnnnnnnnnnnnnnnnnnnnnnnnnnnnnn

SEQ ID NO: 49024 - DNA, 1120 bp, Oryza sativa
gtagttagccatcatactatctaagagggtcgatgatttgtgcagtaatagtattggcaacgtacccaaattaagagggtcgatggtttgtgcagtaatagtattggtaatctgtacccaaattaaaccttgcttttgcaattctaattaagggtccgtaaccaaaataaaccttaccaaattttgatattttgataatttagcaatattactaagttttagcaggatttcttatgtatttaacagagtttgataaaaaactaaatggatgtatatatttgacaacataccaaaaatggtatggtttgaaatgacatcaatctgaataacccctaagtaaaccgatattttttttagaatacacagtacaacgtagacactcacaacgcacgcgcactcagccacaacgccgataaatcctgaaaaattcgctctcatgggagagtcgaacccaggacctcatgtgctactgaggctcttgtaactactaggttacatgccctttcgcttgtactgattgatattggtggaataaataatatgaattgatcaatatatataacattcacaaaaatattcaagtttaaggaccttatttctccagtaataactcgaaagcaagtttaaatttggctggatatttcgactcaatcaaacaagcggccaccggatgaaatggctggagtgggtttaaactgctggaattcatcgaaattactcgtgttggtgaccaaaacgttaggccgcttggcgtgtgcaattttggatgggggaacagttcgttccggccatttcaattgatatcggaacaaaattgacagtcttaattatgtatgtgctacattcacttttaaatataagcatttataattataaatatagacaaaacacttatccagatttataacgaaaatactcataattagtttagactcataacgaaaaacactcatttacctcttcaaggccggcgcctcaggtcgtttctcgtggtgtccacgtcggatagctatagtgcgtgttggaaattttataaaaaaaccctttagtttgtacgtaatttgatctaaatccctcactaacagttcctctatgttgatattttacatttaagccctta

SEQ ID NO: 49025 - DNA, 1148 bp, Oryza sativa
tacgaacaccatgacgacatcaatcacctggtgctggtgtacatcgtgccgtcacgctgttctccatggggttcttccgtcggactgcagccctgcactgctagctctccatggtacgtgtacatggttctagctcgcatcggcatgactgcgaaaacagaatggaagatgaagatggattactgaactttagcatcatttcattcgtcggacattaggatacagatctacacatcaaacacactaaccacagaagccatgatcagggatttgagatcaggagttcggcgccgctgtttttatggatgagccactgcacaggagtacgccggtgattacgaaagggcacgcatgccgtgaaacctggacgaagagtcgggctggcggcggcgcctgctctgctatttcaatggatggggttggatctgcctgcgcatcgcttagaaagacgggttgcgctagccaccatcgatgatggatcgacattgtcgtccggggaacgccactgccaccgccggctcatcacctggatgaatgcatatacccggtgttaaatcccagattaacgagtttgactagcccgaatataccgtgatcagtttttaatcgcaatttttttaacaccaaaaactaaaacgggtttgcctgctaaacccggtagcacacatgagattgggatggattaatcaccggtggatgggagagggagtacatactccctaggagtatagaaccattttcatatatatagatacacacatataaaaaggaggagttgtacccctccaatcctacaggccaaatcatccggatcaatccctaccgtccatcgctatcatccaacggctcaaaacgcccaggactggctatgcgtagcgcccgcggacgcgttgaccccaccgtgacgccacccaatcgctgcatccccatccgtcgtcggctttgctgcaggtcatcgtgttgccaccgttgctattccacttccatggtcgccgctgccgccgcatcgcgaggggactcccttggtgatgccccgatgcaatggagggcatgggtgccgccgccaccgccaccgccgcccacagttgatgcatccgccgcatcccctctgcctgctctcacgccctctgtagctcagccaccggtcg

SEQ ID NO: 49026 - DNA, 3856 bp, Oryza sativa
ctgtcactcaccaaaggaactcatggcgaaggtcagaattaggcatctacatggcaaagccagcatacatggcaatttgattttaaggtattgatcagattagatttgatgcaacctgtttggaagtcaggccccttcgactttgaggtgcaaattaatcttttgcttgtctcctagcttagaatcgcctatggattgttgttgtttataacttagaggttggccaaacaattagttttgtcccctatgcatcgaacctcgagacatctcatcacttgttcatgaagagtagattagttaaagccatccgggcaggaataagcctgtgcttgactgaagtttcttcagcaagccctccttcggcctgttcagtattggaatggtggtgccacaagatttcatcagaaaagatgcaacgcaaagggctcaggaccctcttcttgctgtggtctgctggccactgccgggaatttggatggagcgaaacaatagaaacttcaagaaagagggatggtcaattcagcacattgtcgacaaattctttttttacgagatcaatcagtgaagcagctgcagagcaaaaaggctggtacagttctctcgaagagagagagccgttttttgtagtttgtatagcctctggcttcggttctattttgttcgctcctatcaaaatatgcacaaaataggcagtcatgcccatgtttacaagtaccgataatgttggttactatatttttttacagttacataggagatatattttataaattttggttgaataaaatgtttttggtagatatagtttccaaacattcaatgtactcctatgatatattttatgaaaaacgtgcattgcacgtgcacgattactagtatatatacttaagtgtgagaggaaatggttgagcagaatcacaattcacagaaggaaaaacagcctaactgaagggtgaaaagaggagacctcatacttgcacgatactgatgaaatcctcccatcatttttttcttgtgaaaccatgtagacatggtagggctaggaagcatcaggaaatacaacagagcaaaacctgccagcaaagcttggtacagtttcaatcctggtccgatgaagactgattcttcttccggtaaacatcatccatgtggctgattaagatgttctggtcacttagtgacagctctgtcttatcgcatgcaagcacttagcacagcatggatcaaagtatctgcaagctttgattttctctcgtttcatgaaaaggtattgacaactagccggtggctaaaattgataaggcttgtggtgagtttttctttcaactgtgcaattgcattgacaatgttatgaataatgaaaggcattaattcagtacacatctatgaaaaaatgttttatgggtataaacataaaaatatagaaaaacaataaaaatgcagaaagaaaaacaagtttccaaaagaaccacactgccccaatagctctttaaaaatggcaacagcacttgcccatgtcctcctccttgattaagccagcattcattggcaagattgcatcctaagtaccagcctatctgtcgattagaaaaagggttagcgcatgagacctaaaagtggatggacaaagatttaaataggttcagaccctctcgataagaggtaataccctacttctgtttggggattgtatccgccggatgtatattgatctgattatctgacagtgctatatccttggagggctccctgcccaccttatataggttggaggggagcaaggttacaaagaggaaaacctagccagacatggtattagtttcctaatctattacatggtagtactcaatcgggactctaggtcctgccatagaacataaggcaacattgcgaaaaagtcctactctattacattacagatggattcgatccacttcctatctctagttggatatttaggctgtgtgggtccccggtactcatattcttcgtaatagcccctgagaccttcacggtcaagttgcagtcttctccgtggttcatgaccaattctgagtatttcaatcttccctgtgaaggcttcccaagtgcttgatgtggaaggcctaggctgaatgacacatagatgcactttgaacgccctttagcttgcctcacgggccacctcatactgtaggtccagattgacttctaagtttcgttgaaggtgcacaaccctctcctccagttgatgtcctaattctgctgacagattttctagtgcttcctattcctattctttctacaccatgcgtccgtgctaatggactgtccatcaggcatgccaccaaagaagtttcagatgtgtatctcttgctctcttcacttccttcgttcatctcagatgagtctgttgctatataatgatcttgaagcatctgtctttcatgataaccatcaatatgctgcaaatctgcaacagggacaactattgtaacatgttgcagaagtccagtgtattttgatggtggtacgctattatggtgaactgctatattctggccccatttgatagggctccaaactaccacttcgttgggagctggctcctgtggaagttagagaccaactgaaaagtgtttggctagatttaagctctaggtctgaaattaaaaaaaaatggaaaaaaatgcaatccccaatctctcgtgaagccctaggcaggttgttcatccctgcaagcgccgctcgtccccgtcagagtgccgccatcggccccaccacatgtgcacctgcctatgggcgagctgagggttacggaagggagggagagagatgtgaggaggtgagtttggggtagttaaaaaaatatgtataaatatgttaaaaaaatatgtgtaaatatgttaaaaaaatgagtttgaggtgagtttggcttttttttaaatatgttaaaaaaattaaagggtggtgggtcttttaggttggagtggagctatggagcagaaaaaaaaacccagctccaccctttgttctctttgactgcccgatatacagcttgaatttctagagcattcataacacaaacaagatgatcattgaactactttggtgcaatttgaagtcaatgccaacttatttgatcaaactaacacatttataaacaaacacgtgtgttcatggaatcacatttgaacagtttgtttgatcgacaaaagcggcatttgagacatgtgcctagcctcaagtagatgtggcaaaactctcatttcactatatttcccaatgcctatgcttaggacttagaccatcctgaaaattttaagggcgattttagggtcgttgaggaatgaggatatattaagagctataacatttattagcgtaaaatttgctattaatatctctttagagtctgaagtaaggaaaaagactaaattttacataattgtaaaagaataaagttacatgaaaattttacggatattcatattaagctaaatgacaacagccaacaacgttccaagctgccactactacaataccctatttttccggtcggtcgtatttattatcccgtgcggtcactcggcccgcctgcagctcctcatatgggaaaatcggtattttcacgtgcgggcgggctgaccgcacgggataatcgattattccatgcggtcgacttaacgtaaccgcacgaaaaaatcgattatcccgtgcgatcgtattaagtcgaccgcacatgataataggttatcctgtgcggttcagttacaccacccgcacgggaaaaaagcaaaaaaaaaatgaaatcgaaacaatcccgtcgtcgtcgctgtggtaatcgagaccaaccctgtcagtgccatgtgtggaa

SEQ ID NO: 49027 - DNA, 933 bp, Oryza sativa
aaatggttacgaactatgtaagagcattgtaggaaagagtggttaaaatttacaagggctcgtaagccgtcgagacactgcgcaactcggaaaaaggaaaaatgagaaaacattccaggcacgcatgctgttggtgcgatcgcaggctaggaccaaggaggcgagaacacacagggaatgaacatctacgactcaaacaaagctgttctgtagattctgtaaagagaggatatggttctacagattttaccatcaccaaagtgaagagagtccacagaagaatcgagttacgcaaaccttgggaaaactatacaaaaattaccccccggtatcacacttttatagcctctttttattttatttgtcagagttgcatcaggggcaaggccatcaccgcaccaaaaacagaaaacataaccagcatcatccagaagggcactcgcttcttctgcttctgctcgcctgcggcctccgccgcaggtttcgccttattggctactactgcagcctgttgttggaccgcaggagatggagctggggcagggttctcttgagtttctggttccgctacggtttgctccatctgtttctgttggttgtatttctcgacgtactctggaaacattttcctgaagtgagggcaatttttgctgtggaaacaagagcaaagtttgttagtgtcccatggcttcaaacaaggatgggttgatggcagcatgtgaataaaaaaacttagataagtatcatcagcacaagtaataaatgtcacctatctaacataattcatttcgcttgggaagagcattcccactaaattgagctgtttcttttatggcaagtatgttactccctaacaatatatgcttgctgcttttatcattttctacaaacctacatagatgtatgatgaaattaatattatcttactgagca

SEQ ID NO: 49028 - DNA, 5290 bp, Oryza sativa
tgtttaaagtactgtagataataaagtaagtcacaaataaaataaataataatttcaaaattttttgaataagacaagtggtcaaacgttgcaagtaaaaacttaaaatcgcttgtattgtgaaagggagggagtaataatttgaaggggatttggttcctgtgcagtacctgaactgggttgagaggtgacaaagacttaggctgcgttcttcggttctaagttcccagtctcactttctctcactttctcgtttaccgtgcgcgtggtttgcaaaaattttctatagaaacttccccaaatatgaccataagctagcagcaacataccagattttactttatatgcacattagataaaaccgcatagataatactcatgtacatcaaaggaaacactactacctaattagcatccggatgcaatacaaaaaaaacaaaagaatacacatcaactgatgtgcaacaggcacacaatagctatagactatagagtagattgtgtcataagcctgaattagtcagataacttcctatgttttatgaccccctggattggatttcacttcattcacaaaacctgcagtgtccagcacatttctgcagccgttgagttattatgtcttctgcagttgttccccccatatttttccgatttcattttttttttcatttttcaggagggattgcagcagcagcagccatgcctttctggttggatatggccgaagcgagagcaatgggcatcaggcagagacccttgttctgaagatactgcatcgcgctgatgatgctcgtttccatcagcttcactacctcttgctcaaaggcagagctgtcttctgagtctggcatgtctggtggcccttgtgaaatggttgaagctgatagagatggattactatggcactgcagaagttcaatgagtagatggttatttcagacatagtgagatccaggtgaattgtggccccatcagttattacatatttaagtaaactcaatgaaaaccagaggagcaaatctcggatataaattgggactacaatgcacagaaagattcttccagtaggctacaatattatggtagaactgatctaggatgtcgaaaacttgaaactggatatgcatatgttgcactacatataaataatatattatttataatgtagccaattaagatgccaacccaagaaagcacaagttttggttagttatcttattaatttaatcagaacacacaaaaaaaagttaagcagtattgattattgaagcataatggcacaatgcataagcagttttgatcacagaaggttttgttcccctcgtacacaagtgcaaaggtatatcttcgtttgtcctatcttgatgccaatggtcgcaataatgggcaattcaaaactaatctcacagagcaaataaattaataaaggcaagccaatgttcatatgaaatcatggaatggtcatgaatatttggactgatgttatttgttatgtatctaaatgtaatttaaggggaaaaaactgaggttaaaataaattgacttgtttccatagctctacaatcttttaacatagcacagcctacattcaactagtctttctaacaaggattctgtttggaaacataaagaaataggaaagctgcacacctcggtttgagattccctaagaaggggaagaactgctccaggagctcctagcctgctcatgctcaatacctacagaattcaagaagactgtcagccatcagaaaaggagctaacgcccccacctcatcccacacaccaaataaacctgactgcagatgtaccttgacctgaagctgaagaaatttcacataatcaattatttcatcaagcattgatgccttatctgcctgctcatacaaagaagggttaattgtcaggagttctaaaccaaaatttgtatacattttattctatactagctaaatacacttgctttgctacggattaaaataaattatacatgtgctaatattgcttggaaaaattattgtgatgtttttgggacaatttattccctgtagatgtctttgcataataaatttgtattttagagatgaaataaaatagaatcatatgtagaaaactattttgtaaaacacatgaaggggtatttagtaaaagcataaacaatactctatataatagaggtggggtggcagattcactgccaccaccattgttttctttgaaaaggagtatagatagatgccaataaaaaaataattgcattgaaggcagaatatatgtatcagcaacattataaatcccatccacctgaaacaaagacaacggtacatctaacgcccatgtgttggctgcaccaaaagatcaatacttggatctgatctatttgataatccaaaaaaatgcttgcttctgtttgtcccatttggtcaatttcccaacatacttaagtatgtatcctcccctagtatactcttagttgttatcaatcaacagttatgaatatgacagcaataacaacagggggagaagcggattgcatttttgtggtgactcagaacaaaaaaagcaccttattggagtttgggacaaggacttggagatttttcatcctttctgaaattttctctcggcgaagctgcagcacaatgagaaattatatttaagaccatgggtgcacacaaattaaaaaaaataatcgattattatgcaacagtttgatttgtttcaaagtgaactgatcttataaaagaactcacccgttcagcaatactgtgaggatcagttgcctgtccacggcgagcccttgtacgtggcttcgcattggcactatttccaggagctgaatttgcttggggttccacatcagaagaatggttaatagggtactcactattatggtcatggatcaatggtggtatctgaacattttcatacacaaaattcaactgttgaggtataaaattgaagagaaagaaagtgaaacactgtcaatgagaaatgcaaatagaacctttgaaggaagtggtggcccttgtgcatcagtacctgccaaatgactaccagatgtgaatgtagggagaggtatattccggatattttgctcctgcaatatgaaaattgattcatcagtacagttagaattgagtggatagtgagctgcggatgtgggaattgctgtttagtggtaaagcttgaaattgaaacctgttgagcagccttcaaaccacccgctcctagtgcctgcaggacagtaccaaacgaagggatggaaccaccattgagaaactctttgctatcctggattgccaaaagagcaaaaaataattcaatgaagcagataatatggcaattatgtatatgtggtgaattggtgatcattacatgtagtgatgctatggcagcattatcaaacagcgagggattcccatttggaagacttgttttgttcaacatagcaacattttgtgccccttggaaaccgaaagcatctagatttactggttccatgaaggaggaaacgttttggaatgctgaacacaacgtcggggctgaagaaacggcatgcacatcagcaagaaaagcagaaatgtcactaccattgctatcaattgaactggacaaagcatgaggcagttctgcaagaccaggtgtatccaatttcgcatcaaatgttccagatgttgaattgcactgaagaacccctgggggaattgaattgcttcgcagattgctgctgttctgtagctgttgaagatccagaagattgttagggagctcacccttaggtagaatctggccagataatggatgagcctgggtgttgtatggcaagcatccatttgcaagcatagtggggttcctttcattctccgtgatctttaaactgcgatctgatccagctcccatgaaatagcctgaaggtggtaggcttccttcttctgcatatgattccgacgaaccgtcaacaaaattatagttctcagaacctgaattgccaggccacatgtaggaaccagcagagtagtccatgatagcacgctacaaaattgatgctccaaagtgttacagagaatggcctctagaaacagaaagtgttcacagctgataatcctgtaccaacagcagttcctttttgtacgaaataccctctgacgctgaaagtaactttgttaaccctgtgcacaatatttaaaagatattgtcaaatgagaagatggtatatatacaatactataatagctactacttataaagttggttatcttatagcacgcgttaaccacatcaataaacaagtattaaaatattagtaggacaattcttgcttgatgcatacagttgacaaaagatcctcagctaaaacacactcgtgtcatattcatgtcagtttaatacacaaattatttaaataagggattttgaatttttccatggtccgcatttattttccttaacaaactgcagagatgtcacaaacagctaaaccaagcatagttgaaattatatctaatatttgtgatgaactaactaaaagaacataaggacagcaaatatagcatggatggtagtgcattatgaaaacttagatacaagacaagggtcgactctgcaggatccccttatacacaaaacagaacgtacatgaacattgaaaccacagctgctgtcctaagccaccatttgtacaaatggaatgattctaattcgattgattgcagatcattaggacttattttctgttttgttctacagcggcaactcattttctttgggaaatggaagcaaccaattcatagttccatacaatcaatttgtaacaagcaaatattcttccacctttcagtagaagaaacctgacctcttaactttatcatgtaactattgtcgattataattacacacattcaatattcaataccatcctctctttaaagctaggctatgaatgtaataaaaccgacatgcatcctccaactgttcaaatgctagttcacattctgctgcataccatgcttgtagtcagtttggactgttcttgtctaggcagtaacaagaaaatgtatacttatctaaaaaaaagaaaatgtatagtactatgtatctatcagcactgcaaagatttgtcaaaattcctaaatctattatcgtaaaaaaaagaagtaacaggctatcaatgagcaataaaaccaaagggaaaggctgaaagcacacaattttcacagtttgagactgctgattgcaaaaactaaaaatggtgccagtggataaatcattacatgcaaaaaaaaaa

SEQ ID NO: 49029 - DNA, 2330 bp, Oryza sativa
gactaaatattgtgtgaattgaagcatgagtttttgagtaggtcaactaatcttccggggggtccggagccggttacagtactaacttacaagcaaagtctacgcaactttcccatgaaaaaaacgtttatcagtaaagtatgcttgtctcatcctcatcaatcatcattcaaacctttgataaaagtcaaacatctttaatttaattaagtttgtagaaaaaaataatagcattttcaaccaaagacaaatatattataaaaatatatacaattaaagttttattaaaataatttgatattataaatattatactatatttatctataaactcagtcaaatttgaaaagtcaaaatatcttataatctaaaacggagggagtaaagtatttaaatgatcatattcatgcatgtcctagccctctgcctaaccactgaacccttggtttcaaaaagactttatttctatctcttaaaaattgtcaaaaagagtttgtttatccttttttccctactctcaagtctcaatccacaaatcaaagaaattttatttctcaaatattccattcctagcatttttcaatactactttatcattaataagataagtagtggataactttgtgagacggcgagtagtaataacttttatagtactttatcatctaatagttacaaataaaatctttgtgagacggcgagtagtaataactttgttagttccgtatacctaagggatgaaaacaacgatggaaattcttgatcggccaagtatcatttccataggagtgataatattttttttgaccattttcgattctagctagtatacataggatttcacttctaatttctattattagggttgtcattagatagtatgataaatatgtaaagaaaaatcccgagcaaaccgagaaccgtttcgttagaagtgatataatttccgactaaatctaatctgcctctggcatgtgggcatcgattgctcatcacttcatcagtgtgctgctatctgcttagatgaaagctttgcttgggcttcgttttgattgtttgacatgccattttgaatgggcctttttgggcctccagtatgcacagttaaaaattgggtaatttcctttcatatgggccagccctgccatgcagcttatcacctaggaataagttcacgggaggtccctcaaattaacagcggtggcggcgtccggtcctgcggggcccagccgcctttctcccgacgggacggcgctgtccgtcgtcgtgcacgacgccgtggccgcctcgaggctccgcggcggtggcagggcgatccaagttgtcatctggactttcggaggcaccttcgaaacgtgaacacggcagcttagtcgcggatgacggtggcgtcgttggcacgagagcggcacggtccacggcgaggatctcctcctccgccatgctgcaaggcacctggctgacgaacagccgcaacctctcgccgtcgccatcctccgcttcttcggccatcaccgcgatctctctctcttccccgtcttttttcctttttatcctctcctcgttcttgcctacgccttttgcctttctatatcagacgagcagtaaccactgattgattgatcagtatcagtgtcttgagtacaaattaattaatcgatgtgtagtatcaagtcttgatctcgagtagcagtgagccagtgaatgtaatcgaatcatctgattgcgcgaaaagcagcagcagcattgatgcctccgcctcaccgtccagcgcgacgacaatgtcgtgctcggcgtcggactccaggaaccgcgctctcgtggaccagcacccacacccgacgaggagacactagtcttccgcgtccgtccctgactcctctgtcggcagcgcgggacgaggcggttccgcgccgccggcgaccatcgcgtcgacctggtgtgggacctcacccgcgcgcgcttccctggctcgggttcgcccgagctttcttttgggtgcagccgacgagccgccatcgcgccgtggtgctgccccgcagccgcaacagctgtgtggatggaacggcggcgctggcctcttctcctcctcttcctcctccggtgcgtatagatggacggactacgtcgacgtcgtgcgtgcatgcatgctgcaatcttggcgtctcagtttcgtgcatggatcttacgaaggtcggggaaggacggtgatgatggcgtgccacgacgtcgagatgccgttcctgcgggggattgacatgaaccggccagcgctagtggcggagacgacgacggcgagggggggggggcgcagctgcagcgaggaggac

SEQ ID NO: 49030 - DNA, 1696 bp, Oryza sativa
gtagctcctttgactatgtcttcatcccacgtaacattgacgtggcagcaacgacgatgtcgcgatgatagtgttcaagctggagtgcatcctagaagaagcagtcgcaagtcgtcttggctcctctggcagcgacaatggttcgcccagctcgggctccggtggtgggggagggtgctaaggcctgcaggatgtggcacccgcggcggaggaggagcgacggcaacggcggagtccaaccgggagtcagcgcgatggtcgcggatgtgcaagcaacgatagctcaacgaggtggacgcaagtcgagcacctccactctagtgggatggtgctcgtgatgttgcacgagtgccgtcgcattagctagcgtcggtgggatgatgcccgtgttgttgttgtcgctgagcatgaggtcctacaacgcagggaggcgatcaagcgacgctaaaattgtgctggagatggcgttgatggagaggtcgagcgagacgagtccagggtgaagcccgtcagtgagttcggccatcctccctccccactccgcttgccgccctccccgcttggtccctttttgtgcatgccgacagagagaggagatagagccatagaggtagagagggtgaggtgaaggaagtggacccaccggcatgtgggtcatactatttttcatcttcttgtttgagtgatatatgggcccgtatattttttagttttcaatttttctccttttatttttttaatcaaattgccacgtaagctccacgtcaatgctacgtgggacgaagacctaatcaaaagagccatgtaggtaccacgttagctaaaactagggataatactgtcgagagatctcatttgtcagtggttttgtagattggggatggattgtatccggttttacggtatagggaaaaatttcagagtcgacgatgaattgtgggacctaaaatgaatattttttttcagctttgcttggatgctgaaatggtgaagcaagaaaaaagaagagagataacagaatatactactataagacaaaatagaaatactccagtattgtattaatcaagtgagctacacgcaatcaatttagtgtttagtccgatagcctaagtacctaaacaacgttgtttgcactgcacggaacgccagcttcattagattggagtctcggcaacaagagagtacgtacagaaaatgcaacttgtttatgacgacgaaactaatcaaattgtacaaggagtcagtggagagatctgagatcttttcacgatatttcagtactaaaatgtcagctattcgatccactacctgcggttggagcttggagcacgtatagcaccacctttttgcggctgagaacgtgattatcttcacccaatttttcttccttaatttccatgaaacaacaaattacgcgaaaaattaacacaacactaattctttctttcctctcgctgtcaatccaatccaatctaggttagagacaaatctctcagcgtcatgtgcccattgcagctaattacattgcctaatccatcaatcaatcgatcgacagtagtagcgatgatacaacgaatgatcgagctagctagctagccggctctgctgagctgagctggcactgggacttcctctgtttcacaatatgagttattttaatattttttctatttatattaatgttaataaatca

SEQ ID NO: 49031 - DNA, 3214 bp, Oryza sativa
  unsure (1)..(3214): unsure at all n locations
cgccgtcgccgttcgtcgttgcgcgtgtcggaggagccggcacgagcaaggacgtggaaggggacttcggccgcgccctctccttcctcttccccggcccaaggccggagagatttctcccgcgccgtcggcctctcgtcacagcgcccctcctcacctcggtgatgcctccctccgttcttcctccttgctccatctcccccccttagtttttggtggtagcacgagtagcctccccgtagctagccggcgccgccccaaccgttgccgtcgcccgccgtgtgctcgccgccgtcgccgctcgagctccgtagcacccgctcgtcgccagcctcgctcggcgtagctccgcccaatccaacgctagcatcggattcccgtggccgcgtaggtgctctcaccgccgagaatcggcccctcgtgacctcgtcgctgtttccctcttccctccccgccggttgccgacgccgcgattcgccgccgtcaagcttcctccagcgaatccgagccgttggctcgtctcccctcgtctcgtgcaaccacccggtgtgctcgttttcgccggtatcgccgtggtccgctccgccgctcgccgctgttgtccgccgtccgttccggccggcgtcgtcgtctacctcccgccagcccacgtggcagccacgtagacgccacatcagcgccagctcagccgaggtcgggacgggccgaccccggtcagcccctccagtgcgcgcgttccaccgcgagccgtgaggctgcgcgtgggcccgccgcattcgttcctccgcagaccgcgcgcgtgcaccgngttccttccccgcccgcgcgcgtgcgccgcgtgctccctccgcacggtaagccgagccgctaacaagcgggtcccacccgggaccgcgcacggtgagcccggtccaccggcccactctctcctcccctcccgcgcgcgcgcttgggccgtcttgggccggccggcccatttagctcagccggactgccccatctctctcgggccgcgccctagccggccgaggaaaagtctaatttccatccctcttttattttcttttcttttcttttccaaaaaggatttaattaaatccttttcctttagaccaaaaatccaataatcttagaaattcaatatcttcccaaccataaatccgtttgactccgttcaacttccaaaattcctcaaatctcgagatctatctaatggcacgcttagaggcattaatagggctttattttcgccgtttgttgagttgccccgtttcgcgtgtagtttcggagcccgaagacccgcagtgcgaggatttcgaggatcaagctccagatctcgagcaaggcaagccacctttgaacatcttgagcctatatttgaaatttaattatgttgcttgcaaaatattatgcattgataggattgcacttaatctgttgtcccgtttgcaaggcagattggcggacctacctaacttgttgcatttgatccttccattgttaattgctataccatgtccccttgtaaccatccagttgcgcctcgatattcgtgcactctgtgcgagtatcgacggtcgccttcaaacttaaaatctaagtaacaacttgggtaaaactggagttttacaaaagacttggaaaacccgacacctgggtcggcgcttgcgaactaaatgaatttccaaaactgcggaccggggaacgtaccgggtgtacggtttttcccgctctcgcacttaaggaccgattccttgaaatttcatccaaacataagacaagtacgaccacatgggtggaatgggacacccctggctgagtaactagcttatcaggggagccttgatgtcgagagacatgtggattcgccggggtggtgtcggggaggacccctgggcttcctggcacagtatggtctgggacctaacctgttgttggtctgggacccctctcgtcggcatatggtaaacctgtatcggctttggaaatgccttgtcatgaaagcttggaggtctctcgacgtggctgatccccacgagctgggtgatccgggttagtaatgtcgtgtgggtaaagtgtaccccctctgcagaggttaacaaactgttcgaacagccgtgcccacggtcatgggcggatgtgaggtgattcctagcgtagtttgtttgactactgcttgtgaaattgctgttgtggaaaggggttcgatgtttgaaaaatctgcagctgatgggatcagctaggcccgggtggccgtttgaaagttataggcccgggtggccgtttgaaaagctgttggccgggtgccaaccttgttttaaattttaaagactgatacattgcacatactccgaccggacgagacgcactgtctcatccgtgtcgtttgagaagcactcacttagttgtttttagaaaagagttcaactaaaatcaattgcaaaaacaacagcctttccttgaagcctgcattaaacacttatttcccatggcttgctgagtactcccgtactcacccttgctctatataaataatcccccccccccagttgctgaagaagatgaagcggatcctgctgatgaggagttcttccaggagcaagccggctacgatgagttttagggtttcggcctagttcccaagtcgcgcctatgttgtttggtccaagtcctgcttccgtttcccttttgtaatgcagttgtgagctcgggatctgtccgcagcccaacatgactgtactcctactctataataaagagaccgctgttgctgtgatattctgtctccctgtgataccagcactgtttcctgggactggtatcgatcaacaggttaatttggagcgtcacgggctagttccggtcggtactagttcggggcgtgacacttattaagtgtaattgtaaaccatgtgttggtgcagctacccctgatttgtacaattatgggaacagatccaattaaagcgcaaccaaatcttcatcatacatagaagagtagagatacctcaagaatcaagatatataccaaaggaaccaccagcttgcattaggggaggaaaaaggtacatacttcagagagattcatcatatatacataccaacacacaatgatcgatttcaataattcgatgcacgggttgatctatctgcaacttatctgctgatggaagttgcatgatgagtaggaatgtgatgtgtcaggaaattcagg

SEQ ID NO: 49032 - DNA, 3481 bp, Oryza sativa
ggatcagctccgccatcacccactcaagtgtcgtagccgatgtttcgctgccggcactgaagatgtcctgcatatggtacatttttgcgcgtaggtgtgtgaaatgattagcacgagacaaaaaaaatccgaccaaaataatttatggtaaaactttttttatccacattatttagtggtaaaaggtcaacattgtaaaacaggtgaaataacttaaaaggaaaatgtatgaattacccgctgaactatcgtagttgaccgaattatccctctgaacccaaaaatcagacattgcttatcctaaactttcaaactggacgaattaccccgtcgatccaatccaaagtggttttgtcctacgtggcgtatgcgcggcaatccagtcagctctatatttatatagaaaaatgtgggacccacctgtcataccgcctctatctctttctctcgggcacaagggcacatggcggcgcagggatgggcagtgggcggcggcgcgctggggtgcgtcatcggtcggcatgcacagcaacgcgcgaaggcgggcgggcggtgcgcacatacagtggcgcgcgcgggatgtggaggggagagggggattgcaggtggatgggaaagaggagaagatggagttgccagggggaggtcggcgcgctcgccggtgcccatgccgggcaagactgaagcgtgccgaacacccgcacggcgagcgaaggcgtcatcaaggcggggtcatggcaaagaggcatgtgacggccaaaggcgtaggcgcagcaggggcccccttgtcttccccttagatctccctcccattctccttcctccctcgtcttcccatctccatctcctcccccttttgtggcgctggcagccgccgtccgcgacggcgcatcttgtgcttgagagagagaggacaggtgggtctctttttttttataaataaaatgcttaggttgagcaatacctggtttttaggtgcaggggataattcggtcgactgcgatagttccggggagtaattcgtactattttctaacttaaaatataaactctgttttaacatttgtattttgagaaaaaaatattttactctcctgaactatttcaccagagcacatgaaggcctacattttttttagctcattttatagcccggattctggaaacggttcactttcttatccctatgtttttctctctctataagtgtcatattttcaagtgaaatttttggtatgatggatacattaaaatttactgtacgtcccaatatgttttttatttttttttcacttttcacatagttaggttgaaaacacttcaaactaatgatgtcaattattatcaagtttgatagaatatatccaatccaataatttatagtacggagggaatagccaaattaaagccatatgcaagcggcaatgcaaagatcggatcgggttttttttattacttctggaagccgaaggtacgactcccgttctcaaaaaaaaattaaagaaggtacgactcttattcccttattggtaaccaatcatgcatgcatgttcctaattaaactttgcactgtgtagcagctgatgtgcacgatgctatttttagaaaccagtcgtccagggtatacactaatacatcactaaatgtatgaaaagtgtcaagtcaaaaaaaatgaaaagtgcacattatataaatagatctagaagtagagaggagaatcgtacgcttgaagaagagaatgaaggagaaaggttgcccccccacatatgttgtatctatatttcttttctttgtaaacattatataacccttctgacctatacatgtagcaaagtaattgtataatactaatatctagttatttgtacttgcttgtacggttagaggtgttatttgtccagataactcgaaggcacctctattaggacatcataaattcataatccaaaaaaaatcttaactattaaactaaaggggcattaattttgcaatcttcaatatcaaaaccagttcaaacatctctccaagataaatcatccaggttttatttgtagtctcatgcttttgatattctaacaacacgatttttactaacattgcaaatgcttttaatttttgatataccattttttctaactgggttctgtacttctgtgcaagtatataaaaattgtgaactaaaaaataacagttttcaaaaatgattgggttgccttggagtgatatttgaccgtttcttaggttagtatattctaaccagttttagtagttcaaggtaaaaaatgtgtccacgttgatcagttattagtatattactgatagttggtggacgatttgccgttgataaagattccatttgaaaatgagttccatgatgtaccatatctcctatatgtagaattttgttccctttttattatccgcacttgctatttgtcctcgcaaacaataaaatattgtccgcattgctattttttctataatgccgaaaatacttccaaacgtgtctttgtttgctccaggatagctctattaacatttatattaacatttagtaatattacgacatttgtgcccctgttttctctccatgtctgtccgactacaactagttgttgagttctctaagctctaagtgaaaaaaaaaagtctcaggagaacgggtcgctttatgaaagtaaaatgacactctatagttcttaatactagctccatccaaaattctaagtactatttcttttttcaccaagactaagaagtcattaactcattcaccatgtgacaaaaccaatgaatatgcaaccaattaataagtactaaaatagcttcttggattctcatcaataatttaatttagcacataatgactacaaataagacttagattttttggaaaacccaaagaatgaaaatagaatgaaaataggtcttaaacttttggaaggagggagtatataacattgttgactttttagaatatatttaccgttcgtcttaattatttagaaatttacgtaattatcatttattttactgtgatttaatttatcattaaagatttttaaacatactaacttataattttttgtgtttccaaattactgtgaataatacgaatgatatcaactttaaatatatcaaattttgaataagaggctatagatgaatattactgctgatagtacttacaaagatgacttgtttgatggcgagcatgtcgaccggaaactccagcccgccctccttctgtatcctcagcagcacgtccagaaggtcctcgccgtcgccgtcgtcgtcaccggtgccgcagctgccgctactcgtcctctccatgtgctcctggatgatgccgtcgaggatgccgtacacggtgtcgtggcactcctcggcctcccgcacggcgccgccgaggcggcccgcgaggcgcgacgacagccacaggtccgccgggttgaacccggccgacagctcgatggtgcgc

SEQ ID NO: 49033 - DNA, 12343 bp, Oryza sativa
  unsure (1)..(12343): unsure at all n locations
nnnnnnnnnnnnnnnnnnnnnnnnnnnnnnnnnnnnnnnnnnnnnnnnnncgtgttcttgcaatgttttggtaagcattttgtagggtttcaatagctacaacttaatattcatgtaaaaaaaatatttcaacaatattgtgctttttcaagtatattgtatctctcgtattacttctctagtttcgcttgttggtactcaatgtttcatatatgtgggggaaaagtatgaattacccctcccccgaactatcgcgctctaccgaattaccccccaatccacaaaatcggacattcttcatcttgtaaaccggacaaataacccctccggctcaatccgcggtggttttgatcctacatggcagtctagtcagcaattcatttataaaaaaataggtggccccacctgtcagtttgtctctcctctatctctttcccaatctctcactccctctctctcttctttagggcgacggcggaggcagcggcgaggcaacacgagcgcggtggcgggggaggcattgcaaggcgaggctacggcgaggtgagcgtggtggagaaggaggcgagcacgagcgcaggtgagtggcgcaggggcaggcggtggtctgcggcgcaggacatgaaggctggacgtcggctgccatagccacggccgaggaggaggcggaaaaagaggaggagtgggtggaggcgggaagaagggatgaggaaccgttatgcttcccctggctgtgatcatataccttccggagaggagaggaagtgggacagcagtgttttacgcccctcttacctaagacagcctcacttgagcccgtccagtcacgtaactagttcccactcccacggccgccccctttttcatctttcttgccccatcctgagccctacatgaccgctgtggctatagcggtgctggaaggagagggtaggagcagcagtaggaggaggagtagtaagataggcgtaagcgggaggaggcctagaaatcctccaccaccgccactggccactttccccattaaagcctcatcattggccgccgcccttacctcgaaccccacctcctccagcaagttgtcgccgacgttgcccccatcatcctcctcggcatggcccatcggccgccgcgccctccccacgagcgctgccgctcgccgcctccagtgtcctcctcggtgccgcccgtcgcctccaccgttctcctcggctcggcccaccggctgccgtgccctccccgtgacaccgccgtccaccacggtcgtcgccgcacaaaatgcgagagagatgagagagagagagaaggatgaatcatggaagagagagagagagagagaaagggggtgagggggagagaagctgacatgtgggtccccccgattattttttttaaaaaataccgatcagactaccacatgtacaccacgtgggacgaaaaccacttcagaacaattagggggcggagaggaaggcgagccaacgcggacgaacagggagcagtcgcgcgaagtgcttcccaaaaaccttattgccgccttctcccggtgcagtacgtcgaaggcagaggttccggagacctactctcccgatcgccggtgcacgccggcgagcgggatggagtagtctacgagtgacggcgcagcacagagtaggaggcaaaccctagattgatttcgcatgtgagcgggatagagtaatctacgagcgacggcgcagcacaaagtaggaggcaaaccctagattgattttgtcgacgggtggtacccgtagaccggatatagagggtattggggtacgttggtacaaggatctacgtaatacgatatcaagcaacaaaagacgaggattatactggttcaggccccttggtaggtaatagccctaatccagttgatatgggattatatggtggaaaacacaggttacaaagggaacaatggaacttgtcggatccggcgagatcgtagtcaagttggttcgactagatctcgatggcttggctccttgcaggctccggcttcgtaggctgtgtgggttgtgttggctctgagattcgatgccttaagccctcaccggggggtcccttttatatcacagatctggaggtctccaagtagaactaggagatatcagaccctattcgatacgttaatgacccagtcttgtccgagtaggattcttcccatccgtagattccgtgaaggatttccatagaatatacaggaagtatctgtatgcgcgcgggtataccataccgatatgttacatatatcgaagggtaaagggtatgcctaacccgtaaccctgacagtagcccccgacttctgcttaaaaatgggctcgtgtaaccattcacgacttcgggtgtcgagactgttgtcattcctggagcgaggaccgcggagacaggccgtagccgagcatgccattcaaagcccaacggtcatgagcgaattttaaattgaagtccaaaaaaccgccgcgcataacggacccagaaatttccggcgggcatctctctctgtccttggaattcgcaccgtcggtagtgcgcctatttaaaggaattttggagatccattttgaagtctgccaaccgtgttgaaaacattccacctgaaaacattccacctgtaagcgttcatcaacctaggccctttctccggcgatcttgaatcagcaatcaacctcggcaagtcatcttccaccagtgcgtcgctgaagaagcttcaggaatacggcgcccttcctggccatggaaccatggagagggaaacaggaggtactaatccccagcccatcttgggtcgcatggttgcgatcgaagattatgttctctgcagtcttctcactccaccttccgagtttcttctcctggttttgaatttctatggtctttctcttctccatttgaaccccaattccattgcctttcttagcatctttgcccatctttgcgaggcctacattggggtagagccttttcttgatctctttcgctcttactatgaactgcgttggatggaatccaacagggtatctggttgcgtcgggttccgacttcgggaaggcctgaagtcgcgttatatccccttccagtgcccttcttctcgcagcaaatggcggaataggtggttctaccttgagatcaaagattcgaaccccgtctttgttgttcccaaagaacaaccggacaagatttcttcttggaccgcaaagccccccttgaccccctctcttcagtcgtttatcgacatcatcgatgatctccgagtacggggcttgtcggggtatgaagtcgttgcagacttcgttaataagcggatccagtcgctccaggctcgggcctatccagcttataactattccggaccggaggacgcgaccagggtttctcctcggggtatctttctcacatttatcctgacatgcttatgttcgcgttcctatcgactcatcgaaatttggttctcgattcacaggtctaaacatcgaggccgtggagtgccgtgtcggccaggtgatgatcagcggtccgacaacggcgagcaacatccccacgcccctctgtgaaaagggggcggctgagcgtgatgatgctatcaacataagtgcatccgataagcatcgcggattttttcttcgagatcaccttatgacttgattaagcgtatgctctttctctgactgacatcatcgagccactcatggaccatcaggtggcggcgtctctgaaagagaaggtcgccaaggaggcgtctgatgctgctgctgccaccactagtggtggcaatgttccgacaaaggggaggaagttctcctctgtaagcggacatcgtcgcaaggcgccgaccccctcggtaatttatcctatcgtcagattgtgcagccagaaggattttgccttactttgcattgaatgtctttcaggcctcggacacgtcacccccaccagcacgacgacaacatattgtgacgatcggcgagaagtaagtagatgaatttttagatttccgtgattctatacaagcgttgtgtgacccgtggtcgtcccgtagggaggcgcgggcaaaggctgcgcaagctaagtccggagggacttccagcgcgtcgcctgccgcggcctcgacggatgtcgtgcccgcagccgggagccgagaggcgacgcctagcggtccagtcagcgatcccgcggcaggtcatgatccaccagctgccatcctcacctgggaggagctccaagtcaagatgggcgcctcctcgaagcgggtgctcgcggcatcggctgcgagattgtggaggcgaggtcggaagcagcgctggcgaacgcgcgtgctgatcggctggtgcgcgagttggctgaagctcgtgaagacctcacgaagatgagggaattggtggccggcaacgagcgacaacggaaggggctcgaggaccgcatgtcggatctcgggaacaacctgtcggagatccggggctcgttgcgggtcacctacactggcctgcaccagctcgccggggagtgcggcatcaagtttacgatcccggtgaatcccgacgagttctcgctgacctcctcccttgcggaactggcgacggcgatgggggagatcccctccaagcatgcagccaggatcatggaggagacgtcgaacgggatctacaccggggcgtgtcatgtcctcgcgtgtgtaaagctgtcgcgtcctgaactcgatctgcgcgagatcttggatcatggggcggctagtgacacgcggagggaggtgatggaagaagtcggtgatttgggggagtctgttctccccctatttgaagagtaggacttcttgtacttccaaggcacaatttgtaaaacctgaattctgaccaccttcgtgcgggcaattatcatcctagtttacttttgtatgttgacctcgggaactcttgtcctttgtagagatgctgatgacgaggatgtccagcagcgcgggcagcccgagtcactggcgataattccggtactcgagtttgaaccacacgtgtcgcccgacaatgtggatcagacccttgatacggagacagggataacgacgacttccttaggttagtagtcccttcaccccttgatgccctcccgactagatcagccatgttctcgaaagaggcgtacagcttgacttagtggttatcaaattatgccgacctagagggtgcccttgctagccaagatcgtcgtatccaatactggaagatgaagtttgaagtggcggaactcgagagaaccatgctggccatgaagaaagagcaggctgtggaaacgctccgaggtcatgaggtgtggtttaactcgtacttgaagagttgctgcacatccatggccagagtctgtacagaacttcgagtggtccgcggagatcctgaggagtcggcggccgggtacatctcgtggcagaacggggcctgtgcccaactcgatggcatcggcaagcgtatcgacgaggccttgaagcaggagtgtcgtcgatcaagccgatacgccggagggcacgtgttggcttgcctacgagatcatcgcccgcgcttggacctcgaatttctccatgagggttttgctcgttctcggaggactccgacggagatagaccatctggcgaggtcgatgtcgccgttggccgagaagatcttccagtctatggactggcgttggccttcttggtagttttcgtaccctgtgacaaatatcttaggaaaaagatgtaatgtagaaaagatttgtgtaaaaactgtaagaagtattgtgtgaaatagtaaagaaatctatctttaacaaatgtctcttactctggatgtcgtgtgtaagagtgcgttctcagttaacgactttagtcagccgtttgagtcgcacactctccctagcccccagccttgtcgtcgaaggaattttctcggaggataaggctcttggacctttgacccgccttggttaaataagctctgatcctagcccccagccgtgaagttggaaagttgatttccgatttcacggcttggttaatacgcacggcgagaactcttacacgaccagatcttacatggtctttcgtctctacaggatctgacaagaccttatcggctctgggcgtccccagccgaagatcccttaggttcctcggaggccttgccaagacggcgtaaagggacataaggacaggtttcaacgctaggtgtcatcagggtaagggatcatcgggcgaaaacactttggttgtaatatgggcctaaaaataggcttcattgatactgtaagatgtcttacaggtatggatggtattgactcatacgtagaatttacgtagttggtcaatgttccaagaatttgctaactcgcgaccgtcgccgtctgcgattttgaatgcgcctagccgcaagacttgtgtgatcgtgtaaggtccttcccattttggtgagggtttgtttcgccctgcttggctttgaactcgtcggaggacgtagtcgccgatcgaaagtatgcgtgctcggatgtgcttctcgtggtaacggcggagggcctgttgatagctggctgctcggacggcaacccgttcacgatgctcctcgagaagatttacatcgatgtccccctgttccccctggtcctcgtcggagtgcttctgtactcatgtactctgatgtcgtagctcgccggggagcatagcctcagagccgtacacgaggaagaagggtgtttccttgttagacgttgtcggtgtggtgcgtatggcccatagtactgatggaatttcttcaacccattttttgtcgtgtgacatgagtctgtcgtaaacgtgggtttttatcccttgtagtactatgccgtttgccctctcgacttgtctgttgctttgagggtgagagaccgaggcgaagcatattttgacccccagcccgatgcagtaatcctggaaatcggcgctgatgaactgggagccgttgtcagttatgatgcggtgcggtagtccgtatctgcaaaatatccctttgatgaatttgatggcgttgtcggccttgatttcccccgtgggtactgcttcgatccatttggtgaacttgtcgatcgccacgaataggaatctgtagccgccctgccctcgtgggaatggcccaagtatatctagcccccagcacgagaacgaccaagttagagggatagtctggagcgcttgcgcgggtagctttgtgtgtttactgtggaattgacaggcttcgcatcgctggaccatgtcgcatgcatctttaagagcggttggccagaaaaagccttgtcgaaaagctttcccaaccaatgtccgaccggcggcgtgtgacccacatatgccttcatgtataccgaggaggaggtgtctgccgtcgtcggacgagacgcatttgagaagtaccccgtttggcgctttcttgtatagatcgttgccgaccatacagtagatctttggtttacgggttattttctcggcctctgtatcgtcctcgggcaactcctcgatgttgatgaatttgattagtggaatgcgccagtcgtctgtggtctcgatgtcgggggtgtccgggctaacttcgccgctaacctctttcactgatggcttcgtcaggatgtcgagaaaagtgccaggctcgagcgattctcgtctgaacgcacgttgtgctaggtcgtctggctcaatgttgtccttgcggtagacgtgtcggacctcgatcgcatcgaaccttttctctagcttcctgacttctgcaagatacttggataactcggggttagagcatttataatctttgtgcacctggttcgcgactagctcggagtcccctttgacgattagtcgcttgactccaagtgcagctgcagctcttatcccagcgagtagtccttcgtattctgctgtgttattggtcgccctgaagttgaggtggattgcatgcttgaattgatcttcagaaggagacgtcaagataaatcctgcccctgctccttggctgttgagtgcgccatcgaacgccattgtccatgtttcgttatcgacttggttgtctaacttgttatccggcatagtccaattggcaacgaaatcggcgagtatctgggacttgatggctgttcgtggcacaaagtggacatcaaactggctcagctcgactacccatttcgcaatgcggccgacaacatctttgtttctcacaactttgccaagagggaaaaaggagacaactgtgactctgtgggcttgaaagtagtggcgtagcttccttgatgtcatgatgaccgtgtaaagcagcttttggatctgtgggtatcttgtctttgcgtcgtggagagcttcgctaacgtaatagactggtcgttgtactttctctctctcgacaacaatgacggtgctaacggaatacggtgtggcggcaatatagaggaataattcttcattaggttggggagcaacaagtacagggggtttgataggtagcgcttgagtgcaacaaatgcctcgtcggcttcctgtgtccatacaaatttgtcttgtttcttcagcagagcgaagaaaggttgtcctcgttctcccatcctagcaacgaacctgctcagtgccgccatgcatccggttagcttttgtacctacttgagtcttgtgggcgacttcatgttctcgattgccttgatcttcttggggtttgcttctattcctctgccagaaacgaggaatccgagtagcttgcccgacggtactccgaacgtgcacttctctggattgagcatgaggcgatatcgtcggaggttgtcgaacgtttgccgcagattggcaatcaatgagtcgcatgtcttggttttgacaacgatgtcgtcgacgtatgcctcgacattgttgccaagctggtcgctaagtgcgccctggaccgtacgctggaaggtattccctacggttatcagtccgaacggcatcttaacgtagcataataccccaacgagcatgatgagtcctgtcttctcttcgtcctcttttgccatgttgatttggtggtagctagagtaagcgtcgaggaagctcaacaactcgcaaccggttgttgaatccaccagttgatctattcgagggagagggaagtgatccttggggcatgccttattgaggtcggtgaagtcaacacacattctccattttccattggccttccgcaccatgactggattggctagccactctggatgaagtacttctctgataaagccaactttgagaagtttgtcgagctcttctcgtatggcttgttttcggtctggtgcaaatctccgcagtctttgctttactggcttggcatcgggttgcaccatgagtttgtgctcaatcacctccctggggacccccggcatgtcggacggctgccaagcgaacacgtcagcattatcgcggaggaaggtgatgagcgtgagttcctatttctcgtttagtgtcgccccgatcttgacggtcttgtcggggttggcactggagagtggaacgatcttgatggtgccgtctggtttcggcgtcttgtttgtcttactcactttcttgggtggcgtagtcgtggcgagtgggctgggcgtttgctcgaccatgttgaggctccgcttgtcgcactgcaccgctagctttgcgttcccttgaatagtgattgttccattcagtcccggcatcttgagcacttgatacgcgtagtgagatgcggccatgaacttcgcaagtgcagttctcccgatgatggcattgtaagctgtgtcgaattcagcgacatcaaaggtgatctgctctgttcagaagttgttggcttggccgaaaatcacgggtaacgtaatcttgcccaatggtttggacgatgattggggagtaattccgtggaagggttgatcggttggtgtcaattcgctttgcggaattcctatcgcttccaaagtgctggcgaaaagaagattgattgagctgccaccgtcgatgaggactcgcgctaccttgatgttccgaatagtgggttcgaccacgatcggatatcgtcctgggatgatggcggtcttggggtggtcttcttccgagaactctatcttctgctcagaccacttcatcttgggtgcagccccctgccatgtcgaacaaacgtcacgttccactttcttgtattctcgctttgaggagtacgttgtggaagcgccaaagatgtgtgaaacgtggaggtcggagtctggatacgctggatccgattcgtgaggaacctcctcctcgttcttctcgaccacgcgtactcgcttgctttttcaaatgcgatgtgcttctcgagcgaatttttgaaaacaaggcaatcttccagggaatgtctgtccgtcttgtgtatggggcaccatgctttctttgtgtcgctactttgtgggtctgggcgcttgggagggttcacatattctgctgcgagaacttccacttgagctttccttttcccatttttgcgatttttctttttgcttgactcaaatccgtccgtggctggtttcttctctcccccggtcttcggcttatcgttcttgcgtcttagcgcatcatctgcgtgggcgcatcgctcaacaatctcgaacaatctccgagtggttgtgatgcgtcttgtcgccaactcctgtgtagtgtagcgatctctgacaccggatttgaaggcgcgaattacagaagcatcggtgatttcggggattgtatttctgcactcattgaagcgccgaagatattccctcaatgattcacccgagttctgagtcaacgcgtgtaggtcgtcttctatcgcgtggcgcttgtatgttccttggaaattggcgacgaactgttgccacaggtctgcccacgaagagattgagtagggaggaagatgcatcagccatgaacgtgcagaacctttcaacgcagttggtaaataattcgccaacgcgttgtcgtctgctccggcagcgtagagtactgtggagtagacttgaaggaactcctctgggtcggggctcccatcatacttttctattactctaggtcggaatctctcaagccatcggacatcacgtagggaacgaccgaaagccctacacccagcgttgggggcggtgggttgtcggcggttgtgtgtccttcgtggatgtctgtctgacgatgaggaggacgaggatgatgacgatgacgacaggtcgcttgcttccagcgtacgattacgaggatgtcggcctggatctcgggaatcctgtcgtcgtctcccactattgtctcggcgccgatctccgtcatcatcgtcgttatggcgacggcctcgacctgtattgtctcgcacccgtcgttcgcgatcgttgtgatcgtggtggttgtcctggtctcggtcctcgtttgagcggtctctttgatttccgttatcatggcgccgtgaagagacatgacgccgagaacgattcacattgtctcgtgtgcgtcgtgcctctcggcggccgttgatgtgatctcggagatcgccggtgccgcgaggtggaggggtagctcgttggggtgattccctccgttccaggtcttcaccattgacatcgtcagttggtggctgctccgggtgtgctgcgatagcggcttcttcgaacgtgttgctgaggttggtcactgattcccgtagtcgttctatcaaacgctcgaggtcatcgttcagaatgggatcgtatggagtttccctcagtatagcttgaatggcccttatggtgctgggctggagtagtcaattgtcctcctgcttctgcgttggcgtgcgctgacgtgccaacgtcatcgatagccaatacctcccacgacacactcgttttcgatgacccatagtcttcgagaaggtgtaagactgatggttcgtgaggatcgatatcgattaccccaacaaatcgatctgaaattgaagtcgctccttgttccttgtcgttatccctgatggggacgtatgacttaggagacggatctttcatggcgccaagaaagaccttgcagcttgagagcccgtgattctttgtcttgtgaataggacaatagacatcacgagttggagaaacacgctgaattccacgctctttgcaggcgtgaatttcagcgcggacgttgaggaaaacccagcaggcttgcaaagtgtgttttctggttttgtggatagaacaccaggaccttgtggcttcggaagtcatctttgtcggctcgcggttcatgtcggaagaacaaggtttggccgcatcagaatccttctcgagctcggatgtcgtcgatgctctgttctccgtctcagcgggagga

SEQ ID NO: 49034 - DNA, 6118 bp, Oryza sativa
cggagatatcagaccctattcgatacgtcaatgacccagtcttgtccgagtaggattcttcccatccgtagattccgggaaggatttccatagaatatacagaaagtatctgtatgcgcgcgggtataccataccgatatgtaacgtatatcgaaaggtaaagggtatgcctaacccggaaccctgacagaatttccgtgtgttgcgtgaaagcggcggcttggtttatatagagataggtcgcctgatcagggcactcgcgtaaaccgaacccgataagtcgcgcataacctatccggacctcacgccattttcacacaccggatttttgcactcgtgtaaaccggcggctcagttatatagagataggtcgcctgatcagggcactcgcgtaaaccgaaccggataagtcgcgcctaacctatccggactccacaccgttttcacgcaccggatttttgcactcgtgtaaaccgaaccggataagtcgcgcgtaacctatacggactccacgccgttttcacgcaccggattttttggaaatagaaacaaaacaaattcgaattaggcgggcattttttggaaaaagaaacaaagcgcgtaaacctatccggactccacgcaccggatttttttgaaacagaaacaaaacaaatccattcgaattaggcgggcattttttggaaaaagaaacaaagcgcgtaaacctatccggactccacgcaccggatttttttgaaacagaaacaaaacaaatccaaatttcgaattaggcgggcattttttggaaaaagaaacaaagcgcgtaaacctatccggactccacgcaccggatttttttgaaacagaaacaaaacaaatccaaatttcccgcagaccattcgacgtgtacgtcgtgcacgcgggccacctgcccaggctaggcgagcgagcgtgcgcgcgtttttcccctcttctctccaccacacatgcttcaagtggctaggagggcatcctcccttttaagaaggtccccctctcctagaataagcaaggtggtactaaactccacatgcatgccatcccatgaggtgggcctttgtgattttctaaagaattaattttcggatgagccttagcccatctattaattccaacactattttgttcgtggtaaatacgagcctacacaccatatcaaaaagtgtcaaataaccagatttttttttacaatttggttatttctaaaaacttattttacaatggcccctttctaaactttactatgaaagtggacccatagctcgcgcctaaggctattggcactgaagttaaatgtctcaataccaatacccaacccttatgccagttggtttggcactgagcatccatatctcatagtatttttcttctctcctcccatcccttttcaaaattttttgattttctgctaaattttagaaatatcatgattcatttccgctaatttatttcaatttataagaaacctaatttgaaatgagggtatggacgctcccgtccaccaacctctaaatcctattggttttccaaggaaattttgacaaattaaaatatcaagattcattttccataatttgttatttataggaaacttaatctaagatgagagttcctttctcctttgcccaacctatatgttgattttttgtgtaaaataaagtgggaaaattgacaatgtagaatttttttaatttatttctagaatttcagtaagtagtttttttttgaaaaacaaaatggtgattcactgtagtaatacttgtgataaagagataatttatcgtcatactatcatgatggaaaaaaaattaaaaatgactacatggaatctatttaaatttttctggaggtcttagttagaacgtgtactgtggtaaattttatttaccaaggcaagagagtcaccgatggcttagcatgaacaattactccctccgtctcacgatataatgaattttaagtttttgcttgtactgtttgatcacttgtcttattcaaaaaatttgtgcaaatataaaaaacgaaaagttgtgcttaaattactttaaataataaagtaagtaaaaaaataaataataatttcaaatttttttgaataagacgagtggttaaactgtgcaagcaaaaacttaaaatctcttatattattggtccgggggagtagttttttttttacaaacgtctcgagagggaggaaggagctagggtgatatattataaaagcatgtaagtagtgtaactcgtcctttagcggtacttcgtaatacgtacttgtactttcatttttgttaccataatcaaacctcctgttttgtactcattaattttagttgtaccaatgtacatttaattctttgtgaaaaacagaacacatctgattatgaaagactcttgtgtcttggtgctccatatagacgccattaaaaccaacacccaagaattgcgtatatatacgagtacatagagcctctcacttcccaacacagctgcagaagcatcgtcgtacaccacacacaaaaaatggcagatcttcacacctatctgtaccttggcctggcgctcgtttccctgctcgccgtgcaactcgccaggcgtaggcgctcgtcggcggcgcatggctctggcgcgctgcggctgccgccggggccatggcagctaccggtcataggcagcctgcaccacctcgtcggcaagctcccgcaccaagcgatgcgcgacctggcgcgtcgccacgggccggtcatgatgctccgcctgggcgaggtgcccacgctggtggtgtcgtcgccgaaagcggcgcgcgaggtgaccaagacccacgacgtgtcgttcgcgacgcggccgctgagctccaccacgcgcgtgttcagcaacggcggcagggacatcgtgttcgccccgtacggggactactggcgccagctccggaagatcaccgtgacggagctcctcagcgcgcgccgcgtcgcctccttccgcgccatccgcgaggaggaggtcgccgccatgctgcgcgccgtgggcggctacgcggcggccgggtgcgccgtcgagatacgaccgctgttggcggcgctcgtgtccgactccaccgtgcgcgccgtgatgggcgaccggttcccccaccgcgacgtgttcctccgcgagctcgaccgctccatcgagctcacggccgggttcaacccggcggacttgtggccatcgtcgcgcctcgccggctgtctcaccggcaccatacgccaggccaagaaatgctgggacacgatgtccagcgtcctcgaaagcaccatccaggagcacctccagaagaatgccagcagcggcggcggcgctggagccaccgacgaggacctcatcgatgttttgctaaggatacagaaggagggtgggctccagttcccgtttgacatggacgtcatcaagtctgtcatccatgtaagtgactacgccccccacgagttatcttagggcactgtttagcatagctccagcttcatctctcctgaagttggagcgcagccaaatagtttcagctccatcttaaaataggagcacagctaggtagagtgttcttaactcgataggtggagctggatttaaactgttccacaactccactttatacctaactcctacattaaatggaaaaattgaagctctatcagagcaagttcaatagtataactaactactaactccaattcatctatagccaatctaatagctaattcatacaatagttacatactacactattaatacctggtcccacatgtcatacgcacactgtatcttgggatccgtgctacagctggctataaatctgtagctcactgcctttctctcttcttatttatcttcataaaatatgtttgcagtacctgctcttaaacagacccttagatcattttccgtgtcatgttccaactgtcaacttgtcctccagcttgacactatggcatctggtcacatatggtttttaaccagaaagcagtacatagctttttagctggtaagcacggtcatcgctttgcttacgtcactacttcacaaaagtaaattgtgtcggatgggaaagccatatagctgccggatttttcactcggcatctaacagacgcactaatgaggagcgctatcgatagaccggcacctataaattgtacgatttgcgaaaagaaaagactcagctcaagtgagttgaaccgatgctccaaatccaacaaaaaaaatgaattgaaaggcacaataacacaagaatgctcataatagaatcaaacaagcattcatcatccaacatcccagaacaagcactagagcactagaacgggcgccgccgctcacccttgttgacgtcgaaggaaggagaagacagatgctgctcggggaccagcgcgggggccaaatccgatggaccccgaactcaggcctgctggacttggcatcggttccaccgccgtcaccgttgccactcgcgagggagaggatgtcgtcgtttctctcgagggagagggtgttgctgccgctcgcaaaggagaggatgttgccactactcgcgagggagagggtgccaccagtgctcgctggtggcgaggggaaaatgagagaacagtgggttagaggactcagcgtgaatggataagaatgagaggctcaacttagcttggtttttacggatacctgtgttttaattagccagcaactataatacattataggtgctggttcttttaaaaaatcaatatcaatagtattgctgctagtttttctctaaaaccagtacttatagttgttcaaaggtatcggttgtatacttttttggcccatggaggtgggaaatggtaataagtaccggttccaattgaatcggctactatgagccgagccctattagaagaagttctatagtagtgtgtataagctgttactgcttagaccaacaaaagataattatgataaaacttttatacatgagtttgttagtaaattaaaatcaaatattgaaagttaaactttaattaaaaaaaccacaaagagtgaaatgtaactcatatcaaatttcggctatagcttataagctgaaggttaaacgatgggagtgtacagagtgaagacatgatgaacatcataagaacactacaaaaccttagaggtgggccagttggctctcttcgtgttcattgctgcgtcttcaaggtagaatggagtggacatcctctcggtttgtgcatatcgtatataaagtcacaaacttttttcttaaaaaaaataaaagatagatctatggtacatcaccccacaaacatgctaaaaaaatatatttatataggtgtcaaatttaaacttacatgtttattaagtgatataccacatacgttaaatttgaacttacatatttgtgggctgatatacaatatattgttctatcttatcaaatttgtaattaactttttagataacactgcaccgttttttaatagatgatgttaacttttgatatgacatatgtccatttgtcttattttcaaaagaaaaatattaatattatttattttgttctaacttattttattattatataaatttaagtagggcttgtatctaactgttattctaaatgttattttaaaatttaatcacatcatctatttgaagaaaacgaagaacgaaggtagtatatatataaaaacatcacctgtagaaactaatagagacctcccccagtccccctcttccggaaattcctactatctgatctcattcctctgcttcttttcagcgcttctccctcatctatgcctctaattgtctgatttttttgtatcttgtatctcgggtttattagagtgagcctacggtacgaatttgatcgccattgaaagccatgaagtccaatctgttcgttctttcgtgatggtcagctacgcagcttcaataaaaatatgggaaagtaaaatcatccatcgaggagatatcccctcgtttcgtgcatatcacctaaatagtcataaaaaatatgaaaaaaattgacaacatagattattatgaaatatatcactccacaaacatgcaagtttaaattcaacttctacaagttg

SEQ ID NO: 49035 - DNA, 1956 bp, Oryza sativa
  unsure (1)..(1956): unsure at all n locations
cagtaagaaagtatgggtatagcaaccaatgaatataaaacattaaaaatacttggactgccttaattgaaaaggtcaaacaaccaaagtttcatacaaggacattcacacattgtccttaattagcaacttgaggggatacctccctgaaaaagaaagatgattttagcagcttattatggggttgtggtattaaaaaatttgaacaattattggtatcttgtgccactctgagacaagataaatgttggtcatcagttcatcaccacatgcaactgttcacaaataaacgaaggcccatacaaggtatattattgagatagtgttagcaagtctttatataaccgaacactttagactcatcatcggaccggacagaaaattaggggcctgaagtgttcgggtatactgcgccagaccaacttttacttgctcctgtggtccatgtcccaacacttagcattatttttcccaaccttgcctcctatttgcacgaatctcaaagcaaatccaacgatccaaaatttgaatgttttgccctcaagaaaacttccaacagatgaataacgatctattcgtgtataatacgactagttggatagctcgtgtatctgtatgggtcggtttatttaaaagtttaaagtctagcagtaaacttctttgaaaaggagattaaaataaaaaataaacttgtctttttctaaaagaaaaggaaaatctaggaatatgaagagaatagagataggaagagaatagagataggacattgagcatcaccaagagttttcatatcattccctatgagagaatttgagaatacttttttttaaaaaccaatttcaatagacttcctacctgcactcccaaccgatcaaactcccaaatccggatgattcgttttccacttcttatagggaagagattttgctcccaatccaccacacaccgcttttctgtgagtgcttggtgaaatattcccgtgcggctcatcttcggtaacatcggcgtggcggcgcacggccaccgcggcgagtcgggagccaagctcttggacgtgcaagcagagggtttttctcgtgaaggagatcgtcacactgctcccagtcgagaggggcatcgccacgacaaggttcatgcgtgcttggacttcgccgcaccgacatgatcctgcacgctggtgtggcgtggcgtggcgcgtgctgagacgacgcttgaggacctcctgatccccaacatcgatcggcaactttgtggagatgctcaacaacgtggactgcatacatggagcagatgctggagcagttcatcgatcgacgccgaacatgttggtgactgttcgccgcctcgccggacgccggagataaacgtcgacgaagcccagctggtcgacgcatgcatcaagcgagctcatgcagttagaacagtggccaagctcatcgacggatacctctcaacctctaggttctaaaccatctttggtcggtctggcaaaatcaacaatagtcccggttccaaaaagaaacagaacaaaaggttgcttttagtcctggttataaaaattttgatctttagtcccggttggtacaccaaccgggaagtaaagatggttcatagcctgtcagaggcatatcagggggtcgaggatctttaggccttgtttgtttcagcttaagattactgtaatctatattattgagacaaattactataagctgaattataataagccgacatagaataagttgttagctttttgtttctctggatcattagctggttgttaggtgttagcaacccaataatctaaaaaaagcacaattagagtggattactagattatagtaatttggcttatagattgtaataatctatcataataagctatatgtttatttcaatttactcctaataatccagattannnnnnnnnnnnnnnnnnnnnnnnnnnnnnnnnnn

SEQ ID NO: 49036 - DNA, 2420 bp, Oryza sativa
agggatgaaaattttaagaccctaaattctagttaggattcccataactcttggttatacagtattaccaatgcaagaaagaatggtaacaaaggagtaaaaaacacattaattgaaggtcaaacaaccaaagtttcatacaaggacattcacacatggtccttaccaacttgaggggatataccttcatgaaaaggaaaggtggctttagcagtttcttgagttttgataataaaaacctttaacaattattgggttcttctaacactcttgcacagtatacacgatggtcatcatcagttcatgattcatcaccacatgcaattattgctcatcaccggactgaaaaacgaaaaagtctattttgaccctctcaactattttcggaatcttatgtgtatcgctcaaccacaacattgggtatatcagaccccaagtattaaaaccaatacaaaatgactcccttggttattttcagggtggttttgtctggcgtgacgcactaaccttggttagactggctggttttagggctagtacttgaggaaaaaagagagagtaaaaatataccgggatccacatgtcagtgaagtacccctcctttcttcctcttatttagctgccctcttcctccttggcaagcggcaagcggcaagttgaacttcaggtagagagaggaaaggctagggagagagagaaaacgcgcgcaggtgggggatgctttggggcttgagaaagccgtggctgctcgtcatcgtcgtggtggatgactgcggaaaagaagcagcaacaatagctcgcaatcttttgcccctactgccagctccccttctaggatctagagactgttgtgcctccatttaggctccgcccaaagcgctgataactaacgggcgtggtggggtgcagcatgacgacatgggagatcttcatgttggtggagtcgtcgatgacgacaaaactgtacagaggggacactgaggtgagcaagacaggctacgcatctgctatagaggatgctggcatgaccgatggacacctcatccgtcgccaccgcggaagagatgatagagggaagaaagaagatgagatgcgggatttacatgtgggtttcattgctttttttgctttcatgatacccacgtaggataaagactagttcaacgtgccacttaagcaccacgtgacatgatcgatgtccaaactgcttggggagacaaattaaactggtattaatagtggagagatgcaatttacctgtttacagttgagggatacaaaacagattcagcttatagttgatggaatcaaaatggacttctcctaagaaactatgagtcgaaaggcccatactaagccttgtaataaatgacgcaaaatgagcccataaatggcccaccaggggcccacctatttccaacgtgtgcaaacgaatccaagccccataaatggcctacacgacacaaggccgtaaactgcgaacgcgattactcgacaggataaagcagagcaacgggagccatggttctgcaccaaccgaactaaaagagccgttcgttgctccacttatgatttcgcagattagtgatgaactgatgatattctaatttttggtttaggcgtgctttagccacagaaattagaaggcatggataaatgctaccggagtatatactccatttatctcgaaatacatcttatatcaatatttgtggtgatagctaggttgtgtctaatccagtagtaaggtactacatccgttttgctgctgacttttgggcacacgtttgaccattagttttatttaaaaattttatgtaattacaatttattttgttgtgttgttttatcactaataatagtttaagtatgatttatatcttatgcatttacataatttttttaataagacgaatggtcaaacatgtgttcaaaagttaatagcgtcatcaattaaaaaatggagggagtcctatattttgggatgaagggtatgttactttagaatgatgtctaattcgcatatctgaattctttctttttaagatattgatttcttaattgttataggacattgtacattgaagctttattaataaggttttgcctcatggagtggtttattattcgttgagctgatgaaatagtaaacgtcttctccaaaacaaatgacaatactgaaacttacgtacttgatggccacgtcattcatgtcgaactcgaacttatagataatcatcagtcatcagatctgcgcaaatttactccaaggtcaatatcacatttgtagttcaataggcctaatgtcaacttgaagttaccaataggcgtgtcaactaaaaaaaaagatgggctctagaaacccaaatagattaaagtagaacacagaaggttctcaacatcactaaacgcaagggtaa

SEQ ID NO: 49037 - DNA, 1900 bp, Oryza sativa
ccgtcaacctgagcgagctgctgtcggcgcacgccgccgactcgtcggtgcgcgccatcatgggcgatcggttcagggaccgcgacgcgttcttggcgatgctggagcgcggcctcaagctgttcgccaagcctgcactgccggatctctacccgtcgtcgcgcctcgccatgctcctcagtcgaatgccgcgtcggatgaagcagcatcaccgggacatggtcgcgttcctggacgccatcatccaggagcaccaagagaacagatcagccgccgccgacgacgacaacgacttgctcgacgtgctcttgaggatccagagggaaggcgacctgcagtttcccctgtccagtgaaagcatcaaggcaacaattggagtaaggaccttttaactacgaaataccacgtcactttctaggaaatgtaatactacttgcctcaatatatagcaatctagaaccgaatatgatacatcctaatgttataaatctgaataggcctatggtttgaaacggaggtagtaacgctaatgaatttggcttcgtgttatgtgtgtacaggacatgttggttgggggcagcgagaccgcagcaacgacgctgcattggatcatggcggagctcgtgaggaatccgaaagtgatgcagaaggcacaagatgaagtacgacgagagctcatcgggcatcgtaaagtgacagaagataccctatgtagactgaattacatgcatatggtcatcaaggaggcactccggctacacccaccgggatcattgctgctaccacgggaatgccgacgcacgtgccaagtcctaggatacgatatacccaagggagcaacggtgtttgttaacgtatcggctattggtagggatcccaagtactgggacgaagctgaagagtttattccagagaggtttgagcatagtgatgttgactttaaaggcacacattttgagtacacaccatttggagcaggtcggaggatgtgccctggcatggcgtttggtctagccaatgtggagctcacattagcgagcctcctgtaccatttcaactgggaactgccgagcgggatacacgctgagaacctagacatgacagaggagatgcgattcaccacgcggcggctccatgaccttgtccttattcctgtagtccacgtacccttgcctacaatataagctcatcatagcacactgatttttgtacaacacttaagcaatctttttgactggcaactcaaaggtgcaaccacctatggtgaagcttgaggctatatgtgaaaaataaattttcataagcggcttcttataagatttccacctacactaatcgtactttgatatgcaccttatcatgaaatgtatttggaagctttgcttgtttgatgtgattgttatgttaaactttttcttgtaatttctttgtggaaattttgtgacacatttggaattcctaagagctctcatgtttttcctatgatatacatatatctcaatgtctcatgtgtaatttcttatgcaaacctaatctaatgagaagatacaaccttcaagactatctcttttgtgaaacccatttagggctatcaacgaatcgagctcaaacgagcttgattacctaggctcaagcttgacaaatgctcaagtcaagcctacgtagttcatgcatctttgtacaagtgtgccggaaagatcaaaccaatagaactgctcatatcacagtagtcatagtatctattgaagacctcaaataggaaggcctataaattcccccatgcagcccaattccttggggagagcccacatatgcctgatgcatctggaaaagctcttgagctcgttggcgtgtgagcccaactagctgcacgaacaggctcctttctatttttggctat

SEQ ID NO: 49038 - DNA, 2870 bp, Oryza sativa
  unsure (1)..(2870): unsure at all n locations
cttatcgtggccccaggtttgccacaattgtagcaacctcctttctttttcttctaaggttatttctgagtaatctattcaactaggagcctgcgctataaaatagagataaaaggattaccatatgctcattcatcaaaaactatagagacatgaaaagaaaaatgatatttttatcaaatcaacagaaggaaagatcctttaccaggtttgaattccaccgtcctactggcttgcttctctcgtctatcctcccatcgattcttcctcatgttgtgtcatgcaccacctctaccaatctatggatgcttctcaaaagctcttactcctctcaatcgaggaactaaattagaagaaccagagaagagaagtaaaaagcatgcaagtgactacaagctaggtctactattgatacgccttgaggaaggaagtggtgagacccaatgacagatcaaagtcgaagtaagtgaaaagaaaagggaccctctgctgaccggaggaagcattttggaaaataaaaactcgatctatacctctataggtagcagagcagagggaatgtcgccctcgttcccgaggaataattctcttaatgaactacttccgaatatagaagtgaataccaattctactagttgttaggaagagctagggttgttttgctagagctcacgtgtacgggggtacgcatggagaaaaaggttctagaaggacaattttcaacacaaacccataatcttttacaaatttgagcccccccccccccacctaatgtaaaataagcatggaagaatatcttggtgacaattcttcgaggaaagaccactttgtcgaaagatctcaatacctagaggaaaggatggtacaattagccaagagagtgaaattttccgtaaccatcctgaaatcggttgaccattctggttctaatttgaaatcgtagtgagaatatctagcatacatctgcataagacaaccagtcaatccggagtttagtaaaacacgttgtctcatggcctattagtagaataatatatatgctaaagataatcccctactaagaaaattagattatagttaaccacattaatgaaagagaagaaaaagaaaacgtttagagtaactcgagacgatgccacgttgctacatgtagtttttttaacctatcgctatatattggcacttccgtgtgatgtggcaagattcatccatttaatgacatgttcatttgctaccgctcataagctcaatacacgattaatgacttgttcggtttggagcaaattccctcccttttgggatttaaccaaacaggatctaatggttccactacaatatataatagcaactactccctttatttttcaatagatgacactgttaacttttaaacacataacaattcatcttatttaaaatttttatgcaaatatataatatataaatcatgcttaaaatactgtgtgataaaacaactcacaaaataaattatatttacataattttctttaataatacgaaccatcaaacatttaaaaaaaatcaatggtttcatttactttaaaaaaacggaggtaatatattatagagagagtactaacgaaagcaagttggttggacgtatgtccgctagacgcctggcacagacacaaggaggcatgggcggagatggagatcggccttccgccgtgcagtgatgccgaacgcttctgtcatgtcgagcttggccgggtcggccaagccgggcaccttcccaatcaaagtggaaaagcaagctggcgagagggagctccacgttggcgagcccgaacgccatccctgggcacattcgccgcccagcaccaaacggcaggaactcgaagtcggttcccctgaagtccaccgccgccgtcgcctcaccgtcctcgaaccgctccggccggaactcctccggcgagccgccgggccagtaccgctcgtcgaggccgatcgcccaggcgttgaccagcacctgcgtgccgcgcgtcacgtcgtagccgagcacccggcacggctcccggcactcgcgtggcagcagcagcggcagcggagggtgtagccggagcgtctcacggatgacgagttgcaggtaccggagctcgccgagcgcgtcctctgacacggcgccggccgcggcgaaggcacggcgaacctcagccatcaccttgtgcatggccgtcgggttccggatcagctnnnnnnnnnnnnnnnnnnnnnncgtcgccgacgtctcgctgccggcgctgaagatgtcctgcgtgcacgcgacatcatcgtcaaaaatactctcgaggaatacaatgatcacaccacatcacttacaaagatgatggatttgatgtcgtccatggcgagcgggaactggagcccaccctccttctgtatccttagcagaacatcgacgaggtcctcgccgccggcgctagttctctcttggtgttcctggatgatgccgtcgaggattttgtacaccgagttgcggcactcctcggcgcggcgtacgacactgctcagccgaccggcgagacgcgacgactgttggaaataaacacgtcatggtgtattcctggcgtggttgagtcagtgtgtgtgtgtcgtgctgctgcatgtgtgcgtcgtatgcgttctgttagtttggttgagtcgtgatcacgagtgcatggctgctgcatggatgtttgcatggccgttgcagtgttgatcgagtcgtgggtgtgcatggtgtgcgtggcgtcagttcttgcggaggaagccgcgtcgtccgggcgagcgtgtggctcacggcgacgtcgagcgggttctgcggaacgtggcgcaatggccggcatggaggctagctcccggtgtgtcac

SEQ ID NO: 49039 - DNA, 1960 bp, Oryza sativa
  unsure (1)..(1960): unsure at all n locations
cggccacggcgaccgcgcgcagcagggcggcgacctcctcctcgcggatggagcggaaggagtggacgcggcgcgcgatgaggagctcggtgacggcgatcttccggacctggcgccagtagtccccgtacggcgcgaagacgaggtcccgtacgccgttggtgagcacgcgcagggtggcgctcagcggccgcatcgcgaacgccgtgtcgtgggtcttcgtcacctcgcgcgccgcgtccctggacgacacgacgagcgtgggcacctcgccgatccggagcagcatgacgggcccgtggcgacgagccaggtcacgcatcgcgcggtgcgggatctgccccacgaggtggtgcaggctacctatgatcggcagcgtccatggccccgccggcagccgtagcccgccgtcgccatgcgctgccggcggcggcgagcgcctgcgcctggcgagcagcacgacgaacagcgacacgagagccaagccgacgtagacgtagccatgagacgcgtcttccatttccctttcctttcgcaaaggatttatgtggcagtgtgggtgtacatatcgagacgacatttatatactacctcattactagtagtactatctaatcttggataaaccaagattatcaagaacaaaaccaagattatcttgtatgcacgaaggcgtccatggcgagagctgttccaagacgattgggttcattacatagattagtatggtatactaagttattgacatgcatgaagcgcgcacgcaagcatatatgcgacataaaaatgcccattgaggaaatcaagttgactttgttaaattaaattaataaggataaaattcagtagggaaaattaaatagggtaaggtttatcgtcttccgttaagaatgaacgaatacacaattcgatgtcggtccctcgacctcaacagcatgctcgtgcacctcatggcaacaattaataacaaccttcccgctgacttatctcaggctaccattagctccttcaaagctactcccccgtctcaaaataacttaatctaaaagaggatatgaccagaccactctaaagacaacgaatctcattccctcttaggttgagtttttttgagacgaagggagtaagtttcagtttccccctagtgaacaaggtatcgacaaggctgacacattggcaaggaaagcttctgaatcaagccggtagatccgcccttgtaaggccctgtttagttcatgaaatgagaatttttggatgccacatcaaatgtttgaccggatgtcaaaagaggtttttggatacgaataaaaaaaactaatttcataactcggctggaaaccgcgagacaaatctttcgaacctaattaagccgtcattagcacatgtggattactgtagcacttatggctaatcatagactaattaggctaaaaagattcgtttcacgatttccatgcaaactatgcactatttttgtttttatctatatttaatgctccatgtgtgtgtcaaaaattcgatgtgacgttgttgagaaaaaattttggaaactaaaccaggcctaaaggtggtgctaatctcgcaacccatctaccatctcacctccatcaggtttccaaagcggtgttagaggcgctagacaagctcaggagaaaattcctttgggctaggggagagaacttatcaggaggaaaatgtgaagtgaattaggaatggctttatcgctcgaaatagcttgggggactcggggtcctcgatctataatgcttcgcaaacatataaatttaaattcaacttatacaggtagaaataaaaataacaaatttaactatgaaaagaacatgtaattcactgccaaatttgtttttttaattatataaatcaaattttaactcgcatatttataaaaagatataccgtatatnnnnnnnnnnnnnnnnnnnnnnnnnnnnnnnnnnnn

SEQ ID NO: 49040 - DNA, 812 bp, Oryza sativa
caaggtaatgatccaacggatgctgaatctcagctccgcggaggcatccctcatcccccaaggagtcctccccctctgcagcgatccatatcgcgccaacatcctgaccatcatgcaagcggtcggggcgtcggaggagcgggctcctcgaggccacgatggctcgggcgggagccgcaggggggaacaatctaccccgggagggggtcgtgcttctgggccccgtgatgggggctcggggggcagccgccctgccgacgcccgagggaagagaaagcaagagggtacttcctccccatctcctccccgagggggcggggcggcgcgtgtcagcagcaggcgcccggagggggccgcgccgacgccgcagctcgagagggagcggaagaagaaacggctccgcaagatgggggggacagaaccatcccggggaaacctcatttcccctccaaggtggtcgtttaaccgaccccctcgcaggttcgtcccacgcccattgtggctgtattcattcttccaacacaagttttcattcacccatcttggttgacttctggcttttcttctgcttcagcgagatcccgtcgcgtccctcccgccattccaagtccggccagtctgaggccgaggacccggcgaccacagaggcccggaggcggaaatctgaccggcgagaagccgcggatcgccttcgggaagccgaggaggccgctcgggaggccgcccgggctcgccagaccgaggaagccgctcgggaggaggccggactctgccaggccgaggcgacgacatcctccgaggcgacccgtgaa

SEQ ID NO: 49041 - DNA, 2076 bp, Oryza sativa
cctcttcgaggcggctcttccccacaccttccgttgctccactgagcgcagaaccccttctgcaggccttggccgtcgcaaacaccacggtgttggacgggttaaatgcccaggtggaggccctgcaagcagagcgggcggagctcgacgccgcatgggcacgtgtcgaagaggggcgacgctcggtggaggccatggtggaggtgggccgcaaggcacaccgccggcacgtctcagagctcgaagcccgtcggaaggtgctgggggagatcgccaaggaggtggaggaggagcggggggctgccctcatcgccaccaccgtgatgaacgaggcgcaggacaccctccgccttcaatacgggagctgggaggtggagctagggaagaagctcgacgccgcccagggggtccttgacgctgccgctgcccgagaacggcgggcggcggagaccgaggtggcatcccggcggcgcgaagaagcccttgaggcccgtgccatggcgctggaagagcgtgcctgtgccgtggagagggacctagcggatcgcgaggctgccgttgccatccgggaggcaacgctgactgcgcacgaggccgcctgcgccgaagaggagtccgcgctccgcctccgcgaggacgcgctcaccgagcgggagcgagctctcaaggaggccgaggccgcggcgcaacggctggcggacagcctatccctccgcgaggcagtgcgggaggagcaggcgcgccgtaatctagaaggtgcccgcgccgagagggccgcgctgaatcagcgggccgctgagctcgaggcgcgggagagggagatggacgcgagggcgcgcagtggcggggcggccgcgggtgaaagcgacttaaccgcccgcctcgcagctactgaacacaccatcgccgatctgcagggcgcgctagactcgtccgccggggaggtcgaggccctccgcttggcaggcgaggtagggcccggcatgcttcgggacgccgtctcccgtctagaccgcgccggccggcaggcgggcctctggggcgggcggactgcgaagtacgccgccaaccaggggggcctcgcccagcgcctctcggagatagccgggactctccaacggcttcccgaggagctcgagaggacgattaagtcatcctcgagggacctcgcccgaggagcggtggagctcgtactggcgagttaccaagccagggatcccgacttctccccatggacggcgctggacgagttccctccctggaccgaggacggcgcgcgcgcgcaggtccgggacgccgccgaccatatcgtccacaacttcgagggttcggcccctcggctcgcgttcgccctcaactccgacgaggaggacgatgacggcggagtgggcgacaatggcgacgaggctggcgacccgggtgcatcggagtgagcccccaggcccccgccaatctttaaatagtttcttcttttcttcttccgaggccttcgggcccccttcttgtatagactaatttaatctgcaatcaaataaagaggaaaattttttgtgtcaattctatttgttgtgtgtatgagacgaggatggtctgtgccgcggtccttttgtgtcttggcttgaacaagggctcgtgcccaggtcctagtcctcaaatggctcgggtcggggctagtgcctggggagatccacatgtcgagactggccaggccgggagcgtgatgaccgagggttatgggtgacccgattgtgggtttttgccgattcccccccggagttcaccacgccccggggcacggctcggttctgggccccgtttggcgattttagccgacccgagcccccgagggcaggattgaacacgagtgacctatttcaagtcaagatccttcaaaaggaaacaacagcacagatacagcctttaggaaatcgaaaatacttttattgaaatacagatatcagagaaataagaatatgcatatgtggtagctaccggccaaccctgcacgcccgaggggggtgcggagttcgtccgagcccgaaacctgacacccgatccccctttaggggtagaagc

SEQ ID NO: 49042 - DNA, 3040 bp, Oryza sativa
gcgtaggacgagctcgtccccgcagagtgatcgggcccgaacgtggcgctgatggtagccccgcaggctcttctggtagcgaccggctcggaggaccgcgcgccgccttcgctcttccaagtagtcgaggtcatctctgcgaagctgatcttcatcagcctcgcagtacatggtggcccgaggggagctcagggtgagctcggatggaagaaccgcttccgcgccgtagacgaggaagaaaggcgtttccccggttgctcggcttggcgtggttcggttcgcccagagcaccgctggcaactcctcgatccacgaatcgccgtgcttcttgagaatgttgaaggtcttggttttaaggcctctgaggatttccgcattggcgcgctccacttggccgttgcttctggggtgggcaggtgaggcaaagcagagcttgatgcccatgtcttcgcagtagtcgccgaaaagttcactagtgaattgggtgccgttatccgtaataatacggttaggcactccaaaccgggctgtgatgcccttaatgaatttaagtgcggagtgcttatcgatcttgacgaccggataagcctcgggccacttagtgaacttgtcgatcgcgacatacagatactcaaacccgcccggggcccgcttaaacggtcccaggatatcgagcccccagacagcaaatggccatgaaagtggtatgatctgcagggcctgggccggctgatggatttgcttggcgtggaattgacacgctctgcatcgccggaccaggtcgaccgcatcattgagagctgtcggccaatagaaaccttgtcgaaaggctttgccaaccaaggtgcgcgaggcggagtgggatccgcattcgccttcatggatatcggcaagaagttcgacgccttgttcccgaggaatgcacttcaggagaattccgttagccgcgcgccgatagagggtcccttctaccagcacgtagcatttggagatgcgttggacgcgttcactcccttcgcggtcctcgggtagagtcttatctgtgaggtatgcttggatctcagcgatccaagcaatcaatctaagggagctgggagcgctcccctcgggtcccgaggcctggactccgacgggcatcgagggcctgtcaggcgcgtccgtctcccctaaggggttgggtcacgccgacggctgggcaagcctttcttcaaaggcgcccggtggggtctgggctcgcgaggaagcgagccgtgagagttcgtcggcaaccgtgttatcctgtctgggcacgtgccgaagctctatcccgtcaaaatggcgctccatacgccgtacttggcgcacgtaagcgtccatctgcgggtcagagcaccggtactccttacagacctggttaacgaccagctgggagtcgcctaacactagaaggcggcggatccccagtccagctgccaccctgagtcccgcaagaagtccctcgtactctgccatattattggtcgcccgaaagtcaaggcgaaccaaatatctgaggacgtctccgctcggcgaggtcaacgtgacccccgcaccggcgccctgaagagacagggagccgtcgaactgcatcacccagtgggcggtgtgaggcagctgtgaggggcccgagctggcctcggggactgagacgggctcgggagctggggtccactctgccacaaaatcgacgagggcctggctcttgatagcgtggcgtggttcaaagtgcaaatcaaactcagaaagttcgattgcccatttcaccacccgtccagtaccctctcgattatgcaagatttggccgagggggtaagacgtaatcaccgtgacccgatgcgcctggaaataatggcacagtttcctcgaagccatcagaatagcgtaaagcatcttctgggcctgagggtatcgggtcttggcgtcccggagggcctcactaacaaagtagacgggccgctgcacctttcggtggggccgatcctcttagctaggggccacatccctggggtgctctttgtccaagcggcctcgcggggtgcactcgtcttctgtgccgacgacctcggggtcggaggacgacaggggcggccttcccacagtggactcggggccgtcctgggggtcgggggctcctggcgtcgttggacaagcgggcaaagggccaactccggtcgtcaggggccttaggccaccgttcggctccgggggccttttctccctgctctctcccgggtcgagtcgtcacagagttagcctcggggtcagagggcgataggtgcggccttcccgcagtggccctcgggccatactgggggtcgggggcacctggcaccgtctgacaagcgggcagagtgcctgctccggtcgtcgggggccttgggccaccgttcggctcgggggcctctcctccatgctctctcccgggccaagccagcacagggtgggggtgcgcggaatgaggattgtcctcatcgcgctccacaaccaacgccgcactaaccacttgcggggtcgccgctaagtagagtaacaagggttcatttggctccggggcgaccagaactgggggagagctgagatacgccttcaactgagtgagggcacgttcagcttcctccgtccaagtaaacggcccggagcgtttgaggagcttaaataagggtagcgccttctctcccagcctcgatatgaaccgacttagggcggccatgcaaccggtgacgcattgcacatccctaagcttgctgggggggcgcatccgctctatagctcgtatcttctcggggttggcctcgatgcctcgggcagagaccaaaaacccgagaagcttgcccgcaggtacaccgaacacgcacttatcggggttcagttttatgcgggcggagcggagactctcaaaagtttccgctagatccgagagtaaggtctcttggttgcgcgtctttacaaccaagtcatcgacataagcctcaacattacgtcctatttggctacccaaagaaattcgagtagtacgttgcaa

SEQ ID NO: 49043 - DNA, 1127 bp, Oryza sativa
cgcgcgctgctccatacaagcaagcgcgactttgaggtcgccatggacagagatggggccaccggggcccggcatcttcatctggaggtaggcgtagtggactgccgccatgaacttcaccaacgcgggcctccctaggaccgcgttgtagggcagactgaggtccgccacatcaaagttcacccgctccgtgcggaagttggcggatccaccgaaggtgaccgggaggtcgatatgacctagcggccaagtgtgacccggcgtcacaccgataatcggctggaacggccggagcaccattcccggggccttgatagcgtcaaaggctgcgggggaaaggatgttgagggctgctcccccatcaatgaggacacgccccagcttcacgttgcaaacagtgggggaaaccaccattgcgatctgtcctccctgggcaacgcacggtgggtggtcggtctggtcgaaggtgagggcaaccttcgaccaccgcgcccggcgcgtcgcctcatgagtaggggccgcggccagaagctctcgcttcatggccttgaggctccggcgagaaacgtgagcacacgctcccccatcgacagtggaaatggtggccccaggctcttggaaacctaggtcatcatcgccgtcatcgatgtcctcggcgggggccttctgcttggcctcacttcgccgattgccggaaggaaccgccgaggacttgccctctcggcgctcctgcctcctctcctcctcccacttcctcgtccgctcagccaaacttttgactgcgcggcagtccgcgaggtcgtgaagggaggtgttgtggacgatgaaccacttgccggttgggcgctccctactgggagcgccggcctccttctttttgttgctcgcaggcctcccctttcgggtggcccgcgaagcgccctcgacggcgaggacatgaccctcgtcgtcggaatgggctgacctcttcttcctcctcctgtcacgccgccctgtccgagcagcggatccgggggcggccgaagctgccacaccggaaccggaggggttccaggtccatgcctcttccttacgagccactcggtccgcgagctgaaaaagctccgcggtagtctggggctctttgg

SEQ ID NO: 49044 - DNA, 4775 bp, Oryza sativa
cccttcagatctcatgcacgttcagcgtgtactatctgggggtacacctctcgcatggcctgctgtctgtcttgtcagttatcagccacaagcatatattttaatattaaattttgattctagaattgattttatatttttttaactttactttttagcattttcttttaaaccacaactattatcccataaatatttgtacggtttattctcatagcagtttgtatgctgcacagttttatggataattggatatacagtaggactttcatcgtctcataataagtttatttttagttcttttcatttgttttaaaataagtttatttgagctattgaagtttgtgaacttatgatatataaatgtacttagagtagatgaaatttaggaaaacaggagtattatagtcttttttttattggtatgtgtggaattattttagaattgagaaagtacaatgcagtaccgcatcatctatagtacgagcaactaacaaatgaggccgggcacgtatatcaatccctatttcgatccatcagctcctacaagtgtagaggcaatattggaaagaaccatgcctatataaatctgtgttttttctttttgtcaccatgtaatgacgcatgcaacaagatcctgaggtattcttgtgttcatgagactatcaaggcgtcaatcgaagttgcctgtctccttttggtgaagaacattaaggctatgtttagattcaaactttgaattcaaacttcagtcctttttcatcacatcaacctatcatacacataacttttcagtcacatcatctccaacttcaactaaaatccaaactttgccatctaactaaacacagcctaattggaatcctcctccaaagtgatttggggtctggaccaatcaggtattcaggtggagtactacatattttcgctgcaaggttgttgagctttgtgcttagtgatgtgactgaccttggccggccggcggaagccggcttaagaatttcttctcgttttctttttagggcatgttgaggttccaaataaaatttttcacgctgtcacatcgaatatttagacacatatatagagtattaaatgtagacgaaaataaattacacggttcgctaggaaattacgagacgaatcttttaagcataattacgccatgatttaacaatataatgctacagtaaacatttgctaataacgaattaattaggcttaataaatttgtctcgcagttttccggtggattctgtaatttattttgttattagattacgtttaatactttaaatgtgtatcaatatatccgatgtgacatgtaggggaaaatttttttgccaattaaacaagcccttagaaagggaagactctattaccagaaatgattgtgacattacaagccaaaaaaatattaataagtatatcaaataacagactattctttctttagataagtataacagactattctgaagtctaccagggacggcaactggtagtctggacaaagcgataggaaacagaagccgaatctgaacgaaagcaagaaacgattccgctgttgctgcttcacacacaatcgaacgaatgggacgtgctatttcacgctgcaaatcggacgcgggcgggcgagaggacggggttcgaagctctggaaatcggaagtactctctccttcacgaaaaaggcaaaccctagatttccttactaacgtttgactgtccgtcttatatgaaatttttttataattagtatttttattattgttagatgataaaacatgattaatactttatgcgcgacttattttttaaattttttttataatttttttaaataagacggacggtcaaacattgaacacggaaaccagggtttgtctttttttgaacggagggagtagtaggtaactggagggaggtaccactcgtttgctttactatacgagtacctgagtttcgattgacgcgtgtacgtacggtaaaaataaatgaagtaccaggcaaacccccccccccccccccggccctctcctatgtagcttcgcccttggtaggcagatgacgtaccaaacgaaccgacggaaacatttcatatgcgcatgtactctcgaatgtgtctgtcgctttaccgtacgatacggccatcttatctagcaactgacttttagaaccggtggtggaattggctaatggccggagctgaatgggagttggtcttctagtttttggtgatgtttgtttgaagggtagggtgaatgaggcagctaaaaagatgaaatattctctcaatattcacgatagagggattaggcttattttaccggattaagacatccaccatgtggatggctaaatggactgtccagccggggcatgaccagacccgagcctgagatcagttgggtcagcacgacttgacctgcatgtcgggccgggccatgcccacccatgggctgcaccaacaacccaaacacagtccaataagattcgggtcgtgccgagctggctcgaaggtacgaaagcccaccgtgctcctccttggaataagtctattttatgtccctcatatctttgggccgtgtcttatatggctggaataagtctattttgcattctttatctctttgggctgtgccttatatggctaaaataagtctatttctctccctcatctattttgcctccctaatcattggaacatgtcgtatcgggatggtccaccatgctgaggcagaggcccaagcacagcccaaaggttgggccaggccatgccatgcctgggccaggttgtctagcctcaggccttttggcaatctataatccaccttgtctagaatactaattagtgtatgattactaagtaggttaaattatgattaatgatattaaacatgtttgatattgattagtaattagcacgataaaactagtgtaaacaagtgctaatttgtattattaattgtatgacttactattattatagcacttctatatctgtacctaactaaaatattcgtattttccctttagtcacacttttttcgtccgtccgattccctccatctcagcacgtgcatgcgcagatttgaagagaaacagactcgaactataaagctagggtttctcttccaacatctatacgacgtggttttgttttgattcttgggaaaacagaaaggggagaagataaggatcaaaacccctcactcaatttctaattatctccatggatgtggactgatttcacggaggaggcggattcaggcgtcatcgggcagatgcggcaatacggacggaggtaggagacgacccggtagcactggcccacatgacagtaaaagaaggagcgagggaggctgattagacttgtagtgctttgctgggccggatgcgtacttgcgggccgaggaagaggggaggagaagggagaaaagtgggccggctaggctgcaggccgaggaaggaaacgggatgaaattggcgtagagagaatggagagtttttatttagatttttttaaaataaattcttaaatgatgtttgtattattaaagttagcaattgagatctgaaaatttcaagaaaattccagagagtgtaattaatcatggagaacttcattaaaaattaaatttagctatatcattttatttccacacttactttacttttaaattaatttaaacacctacctacttaaaaaatcaagtattccaggaaatgtgtatttaatttaattacataatgtaaatctttctcaaattctcctcaattttctcatcttttcttcccgttgcaacacacgggcattttttcgaggaagatattataattaagtttattgctttcatccaatccatcctcatcctaccaatcaaataagcttatcccatcctaaaaaaaacttagcttcatcctctaaaatatagatggctatattacatccaaccataaccttgaaccaaacataccctatccgattgatgaaacactagtgaccaaaggccaactcaagagactagaccacttgcacgacaacctaggacccaggttggtcgggggctatcactaaccaacctggagaacattgtcacctgccctcacgtccaactcgcatacggccacaccttacctcatcatgagttcatgactaagattatttaagttgtggtcttatgatcttctcatcttctgatttttgcatcaatttagcctaaaacttaggctaggattttgtttcactcttatttaatttacttcacaattttagatgtttatcatgttagtaattgttggtatttctcaatgtcacagctagaatccgcaagcgcacggatatactgatgtagcacttcccctacggagtattccaaaggtatcaaatccaagagaacgtgtatgattatctcctcgttaggttcatccaaggacacaaagctaatgtgggcagagggtagagaggatttcctaatgagaaacagtgtttaaggaaagcttaactttaatcctaacgcaatacttcaggcactggcaacccgctgttaccagatgtcgctctactacgtaaccggacagggagtacttaagtgctcttgagggctgtcaccacctctacacctacctcaaacgtactatgggatacgcagcaacaactgcagattaattatctagacaccgcatctacgcaattaataactactctagtgccgatcaaacactaaagcaatcactataaataaatagactatagtaaacaatgatcccgta

SEQ ID NO: 49045 - DNA, 837 bp, Oryza sativa
  unsure (1)..(837): unsure at all n locations
nnnnnnnnnnnnnnnnnnnnnnnnnnnnnnaaatctcttcctcggcgactttatacccttgccaacgctgtgcccggctcctcgtttctcgcgcccactatcttgccccctcgtttctcgcgcccacgcttccactaatcccattcgcccgtttgcggtgcatgaggtggatatgcggctgtggcagtcgagatggaacatctcgtgcgcgcgttaattacgctcgccgaccaaagcgccatcaccatatctccaggaaaaacgaaccggcttgtcccgatttttagaccggccccaccatgtcaccaggccttaggaagtggcgtcacgcccgaccgcttccctcgaggagggcgatcgccctggcataacgccgggggctactgtcggtgacatgggaccgggagtatcatgacttagagacttgaggcagacacgatcacccacgtggcctaaccccctcggggggggtcgggcccgagggtgatacggccgcccttctctttgtctccccgaggggtcggaccgctcccgtctcggccccgagggccgaggcgccccgaccccttgtgggttttgcgccgcgtatatggggtaggtgagcatagcggggctcacctaaccacatttattgcggtttggacgagcgcgtcacgccgcatgtaacgcagtgcagcgcgctcccgatcagatcgtgggttaggtggcgacaggcggtttgacgcacgcctcgccccatcccgtcaggatgagagcctccaagcactcgtccctagccggagccggcgtgttagctcctgaagatggcacgttggtcccggtcagatatatatacca

SEQ ID NO: 49046 - DNA, 3281 bp, Oryza sativa
  unsure (1)..(3281): unsure at all n locations
nnnnnnnnnnnnnnnnnnnnnnnnnnnnnnnnnnnnnttttgcgccgcgtatatggggtaggtgagcatagcggggctcacctaaccacatttattgcggtttggacgagcgcgtgactccgcatgtaacgcagtgcagcgcgctcgtttatccggtctgtgaccaatcacagacatatcagatcgtgggttaggtggcgataggcggtctgacgcacgcctcaccccatcccgtaaggatgagagcctccaagcactcgtccctagccggagccggcgtgttagctcctggagatggcacgttggtcccggtcagatatataccaggcttcatcctaaccattacaagcaagacattgtatgaagaggggcgaacatgcagattgataaactgacgcgtggtggacaagaatgaccgatttgtgaccggtctgacactgatcatgtcgtcagcagacagccatgttcccacgtcgcgcctgcttccggcgaaagtggaggtaggtatgggctgtcccatcagaaggtcattcagacggcaaccatacaagtctccgtctgtttatgaaaagataggataagtccccacaaaaaagagagagatggtgcatgtggtatccccttgaggtataaaaggaggaccttgcccacttagaagggggatggattttcggatccagaacgatcagagagggagagagtaagggctctctggttctccagctcttttgtagcttcttcatacatagatccacaaaaacacaggagtagggtattacgcttctcagcggcccgaacctgtatacatcgcccgtgtcttgtgtgtttccattctcgcgaaccttccacacacagactaggagcttagaatctcacccagggcccccggccgaaccggcaaaggggggcctgcgcggtctcccggtgaggagccccacgctccgtcagtggtggtggacaaagaagccgatggaggatggtagtatagagggttcgtcggcgagcctcgctggtgttggaggtgacgttagcgatgtgaataggcagcagtgagagggttggggggggaggatggcagcgccggcaactaggccattaagggcaatatatatatatgagaccatggatgtaatctaggtttttaggttgtgatccaatggtttaatatttgcaatatttgtctgcaaatttttctggcaaattatatacttttttgcaagattcatttttctttagaaaattcagttgaatatttgtttttcttccgattcatgtaggatctgtttataggtggcagcgagacggcggcgacgacgctgcaatgggcaatgtcagagctgttgaacaatccaaaggtgatgcagaaggcacaagacgagatacgacaagtgctttatggacaagaaagaataaccgaggagaccataagtagtctgcattacttacacttagtcatcaaggagacgcttcggctacaccctccaacgccactacttctaccaagggaatgtcgtgaaccatgccaaatattaggattcgacgtgtctaaaggggctatggtactcatcaatgcatggtctattggtagggacccaagcaactggcatgcacccgaaaaattcatgccagagaggttcgagcaaaacaacattgactttaaggaaacaagctttgagtacataccttttggagcaggacgaagaatctgcccaggcatgacgtttaggctagcaaacatcgagcttttactcgcaagccttctgtatcactttgactgggagcttccatatgggatgcaggcaggcgacctcgatatgactgaaactctggcggttaccgcacggcgaaaagccgacctgttggtagttccagttgtgcgtgtccccatcgtgggttaattagccatccacatttcagttgaccgttattcatatcgatcagtgtctcgctgtcctttgtccaaatgtcaaattaatcagccccaataatgatcatatatatgttttgtttgacttttagtttgttcgagcagcagtaagtagataggctaagctttgaacaaacattcaatgtcgttcatgaaatgtatctgcgagtgatctccaatggtatcttgacagtgatgttttccaacctgttcagacaatatttttcaacatgttcagacaatttttgtccctgcttagaaacttatcaagatcagaattcagattattagaaccaacttacaacaatgaacaaactgcaaatgatctgaagtccaaaaaaacaactatgcctatgctgaattagcaacgactgaatgagaacatgcaaagcgagagctcatctgctcaccttcctggatactcacacgtcgtatgcatccattctcctcccgtttcatccccccctcaaaaacttcttgtcaacatttggcagagcagcggtgatttcaccgtgccatgttttggaatttcgacatcctgtctcagtgtctccacacaaaatgtttttatttttgtttgtgttttgttttaaagaggccaaatgagtatcagctccacaacctcagggcagtaggacactctgtttggctgggctataacttttcagataaacagataattagttaagataatatagatgcttagatttgatttggtcaccacatgactaacactagtacatgccgataaaaatgctgctttgcaatatgagaacgataagtatcttgatatgaaattaaatactcctactaaaataacaagtaatatgaagaataaaaaagaaaagtattttttatgataacgaaaagaaatccggtctctatgttcacacacggccctttcagtgtagtatgctaaaaccttgtcaacggcccagaattaacgtcgtctgaatgtcaacatgaaagaactcatttgctcatgggcttcaccttcctgcacactcacgggtcagatatatccattctcctcccatttctttccaccctcgaaaattttgtcaacatttggcacagctgcagtgatttcactgtgccatgttctggaatgttggcatcctatctcactgttgtgtctggctgcttggctggccaatgaattgtcagatataatagactagtattagacaaaataatatagatagttagatttaatccattatctaaaagagcttagatttgatcaggtcatcacatggctaccactagtagatgtcagtatcactttggacatttggacaaacactttcttatcggcacagcttctgagctccttcagttcaatccacccatt

SEQ ID NO: 49047 - DNA, 1289 bp, Oryza sativa
gctgctgtcggcgtacgcctccgactcggcggtgcacgccatcatcggaagccggttcaaggacagggacaagtacctgatgctcctggagcgagggctcaagctgttcgccaggcacaccttgccggacctctacccgtcgtcgcgcctcgccatgtggctcagccgcatgccgcggcggatgatgcagcaccggcgggaggcgtacgcgttcacggacgccatcatccgggaacaccaagagaaccgagccgccggcgccggcgacggcgacggcgacgacaaggaggacttgctcgacgtgctcctgaggatccagagggaaggtgacctgcagttccctctgtccactgaaagaatcaagacaacggttggagtaagcactttaattaggccgtgttttagtgttctttctagcttatttaccaaatcatactccatattttttacaaaatattttatcttgaaaaaacatttttttcactacaataaaaacttgttttaaattattggttaagctaatttattaaaatatttaattcattcatataattaactagataatccgcgttaacaatatgctcaataatctaagtcaaacgaggcaccctaagaattatgatattactttgtcacatgtaacactaattaatctagatagatttatatgtttaaatttattaacatcaatatgaatatggaaaatgctagaacgacttacattgtgaaacggaggaagtatgatattactttgtcacatttaacactaatgaattttacttcctattatttgtacaggacatgtttgcgggaggcagcgagactgcggggacggcgttgcaatggatcatggccgagctcataagaaacccaagagtgatgcacaaggtacaagatgaggtacgacaaacacttgccggtcgtgacagagtaactgaagatgcaataagcaacttgaactacatgcaccttgtcatcaaggaggcgttgcggctgcatcctcctgtgcctctactactgccacgggagtgtagaaacacctgccaagtcttaggattcgatgtgcccaaaggagcaatggtgcttgtgaacgcgtgggcgattagcagggaccctcagtattgggatgaacccgaggaatttatccctgagaggtttgaggatagcaacattgatttcaaggggacaaactttgagtacacaccattcggggcaggacgaagaatgtgccctggcatcgcatttggtctggcaaatgtagagcttaggggatcctctagagtcgacct

SEQ ID NO: 49048 - DNA, 826 bp, Oryza sativa
atattgcatttgatctgggatgtatttgagttgtggtgtatttcttttaggatatgtgatgtattttttgtttgagaatctgtgatgcatttctttccagatctgtgatgttagtttggtttgtggataatttgaggatatgattgaggatatttagggatcagatcaatttgagaaaaaaaaaagaattacccgggactgctcctaccatctttagtcccggttattttacccgggactaaagatgggcatctttagtcccgcattcgtagtcccggttatacaaccgggagtataggggggttcccacccgcgagtaaagcccctttctccaccagtgtattatgcaacccctgtgctacatgtatagtacagaggggatgcataatgtataaaaaagtggagacataaaatataggggtaggacatactcttattcattcatccattgctcaagtgtacaatagtgagtttccaaccctctatttataagcataatgcatatataaaaagtaaggtgaagggtcttataagtatgttgggctgggtcttcatggtccaagcccaaatgtttcctaataagtgagacttattgcttggatgagcatatataatggtggttgcgttggataagcttatgtactgcgcgacatatggctgaggagttgtgacacctgtagtgcgcaacgagataatatttaaatgttcgacgaaacgtcggcgacctcggctagacgccgggcacgggcacgcggagtatggggcgaatgatgaggtcagccttccggcgaacaccgatgccgaacgcctcagtcatgtcgagctt

SEQ ID NO: 49049 - DNA, 2934 bp, Oryza sativa
tatgtattttcaaaaagagaacgacttttaaacccgactcatatacggatgacgtacctgtcatagttacgaataaggcatacttactatcctatgacatatgaaatatacagatccgacataccttcgtatgtacgatatacttccatatacaccaaggaaaatgacaagagactatgaaaattatcctcatggacaagtgaatagtagagccctaccttgaggattgggtttatattatatcgtgcagggtccgtagtctccgagttctacttggagactaaggtgattcacggtataaaagatacatcccctgagggatccagatcatcgaatcatagcgccaataccaccaccatagcctacaatccggaggacgtgaagcctactcaccgggagatctcgtcgaaatcatctcgacgaggggtctcgccgccaatcttgggattgattgttctctattctaatatgtagttttccatatcaatctcatataaactggactagagctattaccttatgaggggcctgagccagtataatacttgtcttcttgttttcttgatgtcgtatcgtgtaaattctcataccaacttaccacaataccctattcatccggtttatgagatttctcgttgacagtgctaaagtactggcaaaaagatattcaatttttataatagtagagataagttctttctctaattttcgccttttttaaaaaaaaatcgttgtgtacctccttttaggtccttgatattttttttgtacgttgccaatccctttactttaggttaggatcaagaagacattattttaggttaagaatcaagaagacataagcttcgctgcaaatcctgtaacgccccaatttccgtatacccttaaaaactatttaataaaattctatgttcaaaagtttggttatttgagtgtatctaggtttgagtaccaaagatctcaattaattcattcctttgtgaactcaaaatcttgaccaaaatattctatcctaaattaaatttctaagattcaaatttcgaggttcgagtcccctcctaaaccattcaaaaattcatacaagaactcatataaagtcgtagaatcattagagttccaaggtcctaagcaaagtccctcgaaatttcatttcctaaaattcctggaaattggaaaatattactattccggcacacctaacggaggaggaggaggaaggggaggatgaagagcggcagaagcaagatgaggtggtagagctgtacaacctccgccatggctggtgggttagcttggatcaaatcaaagcataaaggaatttgtatctaagcaatggagtttaaatgcttgcattttgcttgctgtttttgctcaataggtggctgattgttgggccttgtttaggggagccgcagatttgatattcttctgcttggtaaccaacttctgaaaatttagagacgctgggtttttcagcttttagatttttcattttctggattctacaactatggatttttagaaaaatttgggtaacaatatggaccgtttgaggagctgaagattccgggtgtgtttagatcctaaaatattttggctaaaaatatcacatcaaatgtttggacacatgcatggagcattaaatgtggacgaaaaaaaccaattgcacagtttgcatgtaaattgtgagataaatcttttgagcctaattacgccatgatttgacaatgtgatgctacagtaaacatttgctaatgatggattaattaggcttaataaatttgtctcacagtttacagacgaaatctataatttgttttggtattagtctatgtttaatacttcaaatgtgtgtccgtatactttaaaaaaatttggccaaagaactaaacacggcctctgtgagaagctatagctgctaaaagctcttccaaacaatcccttgttcttagtcagctctgcattctgcacccagctagttttttgaattagaaattattgccaaaaggaattatgaaaattaatggaatctttgtgtattctatccagtgtttcataaaaaaaacaatttgttgctagcgtttcgttggttatcagaaatttagaaacaatttaatgaaatttcgaatttaatttgttttaatttatccagattactcagcggtttcttgataggaaccggctaagataactgatggccacagtaaccaggtgatattttaactacttgatcattggatcgttattttgaggaatctaattatttactatgatagatggatgatactcattaattcggtatatggtgacttttatatccctcattgcactaacgagatggttgactaacctatatcggttcctgatttcctacaattaaacgaattgtaagaacaagtgatcaattaactaaggctatagctatagcctcgattattggtcagatctgcatcaacctaatgaattactttcaaagaaaactaatgtcatctctgtgtataataacagcctgatcactaagcatctaagccgccaaagtaaatagaaaaggcatgctgctaacattcgcatcccacgccatactcgcatcccgctaagctacgagctcatatatgatatatacaactagccaggcaactgcacgtacatgataaggattttctatacatggatgtcatgaaacccatcatttacgcgcgacttagatagttataggaaaaagtaacattaattgtgatgttataaatcgatacacaaacgtacaagattagattgatatacaactagagaaataacactactacacgaatgatttttcatggacgccgggcccttttgggcgggccatgagtggaaccgcacgggataatcgagcgaccggcatcgggcggacgcccacacgggaaaatcaattatcccgtgctggcatcttaa

SEQ ID NO: 49050 - DNA, 1098 bp, Oryza sativa
  unsure (1)..(1098): unsure at all n locations
nnnnnnnnnnnnnnnnnnnnnnnnnnnnnnnatcatgtgcaaacacagtagcaacagttctttagctagcttgagaaaattcattgcaatggcaacctctggctacacaactgcctccctaggctcccatcggatggcctaataagaaaaaaaaccaaattttaaattttcaaacttaattttgagaatgactttgagatattttcaacgtagatttttttagcattggcttttaaatcacaaagaacacatatataaaagttttacctacaaattcaatttttattttctaataagccgttttggcttattagaaaaaaagcgaaacgatggcgcccctaaagtccctatggtggagctttagctcgtgcttgtcgcagggtgactgtgaggcagagagaagttggggaaagaaagagagtggtgctaacaggtggcactcatattttggtggtgtttgtatctcctgaagattaagataaagataaagtgtttcaggtaaaataaggtgataataacgtatgattaattgagttttaattattataaacttaaaaaaatagattaatctattattttagaacaactttcgcatagaaagttttcgcacgaaacacatcgtttaacagtttgaaaagcgtgccacgaatattcaaaactttatccactctttgtggtggaaacgagacctttattttattttactgacagatgggcagtgcagatgttttctataattcagcatgaaaccagcaggggcggatcgaaatagtgctaaactgaagttgctgtaaagttttcgtacgaaacacaccgtttaccagtaatatagacaaaataatgtagatgaacttgcataataattcaaatatccagtaattaaacatccagtgatcgcatagtgctaaactgaagttactatcctgaaaaaacacaaactatatactttatactagatacatatgagcagaataaatagcaccccaagtatttttctttgcacaaacatgatattataaatgaatattaaaaagcttagaccaggtggacgtgcagtatccagccggctatacagtaccaaagaacaacactgaacgg

SEQ ID NO: 49051 - DNA, 1980 bp, Oryza sativa
ctccttgcggggtggccgggcccacgaaaccaccgtgatcgcagatacctcgcaccgcacgcggactaaccccctggtcgaatctccactctcggggagggatctccactccccactgtctgagggaccgccccctcgacaacaataactgaaggatacttcgtacttggttttattattgagggaggaaaaatcggagcgtgccaatccatagttaagggaggtagtatatatataggcattttccttaggaatatgtgaattgacaatgtgcctatttttttttaagaaatcgtgcgttctacttatcgtagagagtcaaaatacatattgcacgagtgatatatttgtagcttcagagctacgacaaggctattgagaacagcatgatttgcggatggtcccgtcaaagaagtctaaattacatctagatccaacaaataagaaaataaggactccgaaagaaaataaaaaagcaatccagtccttgagctcgctgcttcttcttcttccagagttccagtgtgttcaactcgatgcatatggcaatggatacagtagcgaggctagctacaggagaagatgacaagccacaaacccgataggggcctcccaaagttggatgttaaagcaagcaaggcaagaaaaagaaaactcagctaaaccttagaacttaacttcgttgctgcagacaaaggccctattcatttctccaacaaatgttagataaatttttcgatactcgtggcatactttttaaacggctaaacggtgtgtttcgtgggaaaactttatatatgaaacttgttctaaaatatcagattaatctatttttcaagttgtaataattaaaacttaattaatcacacgttattatcgtctcgttttgtatgaatcacttaatatttatctttatcttcatcttaagagatacaaacaccaccaaagaaacactagaggaatagcaggaacctcatcgaagaaagtttgattggccagtgcaacctcttcgaatcctactttcgcagcagatatgttgcttgcccttcaacaattgtaggtgtgagagcttaaccctacaaccgttggccagacaacgaagctagtgcaaacaccagctatttcgtcgatgagccatggttgccacgatgaggaagacagacacccgcatcttcaaactatgcaagagggagagggaaggaacaacaacaacaacaacggaacgagccgaactatgagataaacccaactgctcaccggccagactccccccaccccggccaccaacctgatagccaacggccaccagagacgtagatggaggggaaagggagtctcatgggaggaaaagctggtcgcgtttgggatcgcctctcaatctctcatgttagaataggtgtcgaatatactagtcctatatatgatcatagttggacttggagttgtaataggtggtaggggtggagataaagttggactctgtaacccggcaactctcttaaatagagagggggcaccacaatatagcgtagatacgcagggagatgatggcagcgtagccatggacttatagcggctaggagctatgttggttgaggagaagcgtccataatcagagccccggagatgtagccttcggctgaatttcgttaacaaatatagcatatctcgtatgatcaatgattgaatcgatcgagaaggttagtcgtcgttacgctatatcgactaacttttataacatctcatagccttaggatggatcgagagaggagcttagtttgtttttcttgtgtgacatatggtgacataggctgttacttcacagttatttttgttgggtgggaacgtggggtggggttcatggagtggttgaacattagcaaacatcttctgaaaacgttcgagatcgaacatgtgattaaaaaaggtgattccggtcatactcaaatgccggccgccagttctaaagtaatgtcgtcg

SEQ ID NO: 49052 - DNA, 2366 bp, Oryza sativa
  unsure (1)..(2366): unsure at all n locations
nnnnnnnnnnnnnnnnnnnnnnnnnnnnnnnnatgagaatttacacgatacgacatcaagaaaacaagaagacaagtattatactggctcaggcccctcataaggtaatagctctagtccaggttatatgagattgatatggaaaactacatattagaatagagaacaatcaatcccaagattggcggcgagacccctcgtcgagatgatttcgacgagatctcccggtgagtaggcttcacgtcctccggattgtaggctatggtggtggtattggcgctatgattcgatgatctggatccctcaggggatgtatcttttataccgtgaatcaccttagtctccaagtagaactcggagactacggaccctgcacgatataatataaacccaatcctcaaggtagggctctactattcacttgtccatgaggataattttcatagtctcttgtcattttccttgttgtatatggaagtatatcgtacatacgaaggtatgtcgtatctgtatatttcatatgtcataggatagtaagtatgccttattcgtaactatgacaggtacgtcatccgtatatgagtcgggtttaagttcgttctcttttgaaaatacatatccgtatttgagtcagtttttaaagttcgtttattttttaaaatatagaaggagtcgtataagaaatctatttaaaaaaattacatgctagcttgagacgatcggattcctaattgcagctcatgattttctaaaaaaaatatgtccaatcgaattcctatggcgaatttcaccttaactaaaccgtataataatattattattaaaataatcttcacccgttgcaacgcacaaatatttttttctagttatcaaataaataaaaggagttagactttgaaactagaccggctagcctatcatcttatggagctagctataaaacccctgaccgttccgcggattttctcaaactagaaaaacgttgctacgtactgttgtcgcacctagtgctagtcacgtgtagtacgttgcttagctggatttgtataaatgagggtattggcagttaacacctggcggaggatgcgagaatattagcagcgtacttcttatattaactatggaggcttagatgcttagtgatcacgatgttctatgcacaaagactagctacagtcttagttaattgaggcttagaattgtgatgcagattggatggagtattcaaaaaataatccattagttgatgcagatcgatctgaccaataatcgaggctagctacagtcttagttaattgatcacttgttcttataattcgtttaattaccaacaagttggtcaactaatctcgtccagtacaaggtataaaagtcaccctactgaattcatgaaataatctcgggaaagatatatcgttcgattctccaaacattacgatccaatgggcgatcaagtagttagaatcatttaagaaaaaaatagaaaagatggcctcttgggttgccttgcgtggggaggctccctagccctagcccgcctcctcatccgatctgctccgcctccaccatagccatcggcactggtgggcggcggatgtagatcggacatttaatgctccatgcatgtgtttaaatattcgatgtaatatttctggccaaatattttgagatctaaatacacccagaatcttcagttcctcaaacagtccatattattactcaaattttttttttagaattcagaaaatgaagaatccaaaagctgaaaaacccagcatctctaaattttctaagggactagcttaaaaaactgtcgagtgttttttgaggggaaaacttttaaatctaactatagtatataatttcactagaactatactataataataactggtacatatatgtattaaaataatatatacaactttatatctaatttatatagagataacaatatagttatagagtagttacactatagttacaatataattacaatgtaattatagtgtaactacaatgtaactagcatataactgaaatgcaatttagatgtaacatgaacaaatttaccatatacatgtgatgatgtggctagcttatgaaaagagggtttagatccggtagcaaaatatctcagcacaaatcttaaagcgaaatcgacggcctaaaaatttgtcgacagtcatttagcagtttcgattttctaaagttggttaccaaccagtaaaatatgaaatctgcggctcccctaaacagggcccaacaatcagccagctattgagcagcaacagcaagcaaaatgcaaacatttaaactccattgcttagatacaaaatcgtttgagctttgatttgatccaagct

SEQ ID NO: 49053 - DNA, 2839 bp, Oryza sativa
  unsure (1)..(2839): unsure at all n locations
nnnnnnnnnnnnnnnnnnnnnnnnnnnnnnnnnnntgatcggccacctccaccacctagccggggcgctcccgcaccgcgccatgcgcgacattgcgcggcgccacggcccactcgtgctgctccggctcggcgagctccccgtcgtcgtcgcctcctccgcggacgccgcgcgcgacgtcatgaagacgcacgacctcgccttcgcgacgcgccccatcacccgcatgatgcgcctcgtcttccccgagggctccgaggggatcatcttctcgccctacggcgagacgtggaggcagctccgcaagatctgcaccgtcgagctgctcagcgccaggcgcgtcaattccttccggtccgtccgcgaggaggaggtcaaccggctgctccgggcggtggcggcggccgcggcgtcggcaacctcgccggcgaagacggtgaacctcagcgagctgatgtcggcctacgccgccgactcgtctgtgcgcgccatgatcgggaggcggtgcaaggaccgggacaagttcttggcgatgctcgagcgagggatcaagctgttcgtgacgccgagcttgccggacctgtacccgtcgtcgcgcctcgccatggtcgtcagcaggatgcctcgccggatgaggcggcaccgcgaggaggtgttcgcgttcttggacgccattatcgcggagcaccaagaaaacagagcctccggggaagatgaggaggacttgctcgacgtgctcctgaggatccagagagaaggttgcatggagtccactgttatccaccgaatccatcaggacaacaattggaggaagtactcccatgaacacacaaataactcaaaaaaaagtacaatcgtaatttcacgcgaatagcaaatatcatcgccatctatagttatactctgtaatctctatctctactattacaaaaaattaaagatatttttgtcggtattttggtccgtcatctgtgtatgagttggttttcaagttcgttcgcttttaaaaatacagatccgtatttgagtcgggttttaagttagttcacttttggaaatacagaaagagtcgtataagaagtctttttaaaaagctcgcatgctaatttgagatgaccagatttctaattgcagcttatgattttctagaaaaatatatatcgaaacgaattctcacagtgaatttcaccttaactaaaccatataataataataagataaaaataatctttatccgttgcaacgtacgagcattttttttctagtaataacctgccactttgtaggacacacaaacgagagattttgcttatttcctaacccccacaaatcctaagagctctagctcaataggcacctaaaaagtaacagcaaaattaacataatcatatataatatattagataataaaaataatttgttatgggcttcaaaaaatatatacaatgagctatttttattaaaagaaatccgttgtaacttagtagtgttatgctagtaagaataacgcgtgaggactgaacctacacgtcaatgacacatatatactataattttgttttttgatacaatgatatttttcagcaccataatttttttacagggttaccaagcaaattagcaaaaagttaccatggcttttccacaaaatgtagttacctgaaaatttggcttcatggtacacaggacttgttcaatgggggcagtgagacgacagcgacgacgctacaatggattatggctaaactcatgagaaacccaagagttatgcaaaaagcacaagatgaggtccaacgagtattcattggtcagcacaaagtcacagaagaaaacctaagcaatttgagttacatgtacttggtcatcaaagaggcgctcgggctgcacccgccaagaccaccactgctgccacgagagtgtcgaactacttgccaagtgctagggttcgatgtgcctaaaggaacaatagtgctcgtgaatatgtgggctataaatagggatcttaagtactgggaccaatcagaagagtttatactagagagatttgagcatgttgatatcaatttcaaagggatgaactttgagtatatgccgtttggagcgggacgacgtatgtgccctgggatggcatttggtctagtgaatttagagctcgtactagcgagtctcttatatcactttgactggaagttatctgacaaaataagtcggtgacctagacatgacgcagaagaggggggccaccacacggcgactccatgatcttttgcttgtccctgtgattcgagtgccgttaccgttagactcgcgcagctagctaggtgctagataagtagcttgtgattttttatttcttgataaagcgaccaaatatattggttcactaatgtttacctatgttcaaaccttaacaattaaattattacaaaactacttcaactcactgtgcaattaattacatttgtacattccgatatgtattttaatatacagtttctctgtgctattcatcttttgttattgttatatttgcagatttatgtgtcatatttattagacgaaaagaagtagaattcaacacaccacatatgtccgacggcttctctggatagcaagaaaaattannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 49054 - DNA, 7246 bp, Oryza sativa
  unsure (1)..(7246): unsure at all n locations
aaaagagttgctacgtgtttaatgcaaggagtcaagtgctataactaattaaagccaaaatggaataggttttgtgtatcttggttatgcagaagtcgagagtattctcagtcagtggtatcacttttatataattagctaagttcaataaagcttccattatatgttaaagaaattggaatatgtcaatgactacagaaaaaaccacttagtttaaaaatccgagcaatagtcgtgtactattaatagccacaaacagcacattctactatattaattagctgagactatctagtcagaattcttgtcacgcaattgcttggataactctccttaatagttttagttttattggtatcaatcctttctgctgcataatttggagaagaatatcaggttcatctgctactgttcgcaagttcatttgtactggttcatctcctaagtaaccaactttgtttgatttgtactaggtatggctcattcgaagtcggatggcacgagcttttggtggcacgcaaaatgccagtaatatatgaataattaactgttataaacttacaaatgaatttgtttaattttagaaaagaaaaactttatatataaagctattacaagacgtatcgtgtaatagtttgggatacgcgctagggagaagaggagagtagagccaagctcatataaaggactagatctgtatggtggcaagcatacataatattaatcaccgcttcgagccggccggcaacatcagctagacgccagacacgagcacgggcacacgaagtgtggggcggagcgggaggtcggccttccggcgggcggtgataccaaatccctcagtcatgtcaaactcagcggggtcggccacgtcgggcgcctcccagtcgaagtggaatagcaggctagcgagcgcgagctccacgttggcgagcccgaacgccatcccggggcacatccgccggccaccgccgaacggcaggagctcgaagtcggcgcccttgaagtccaccgcggcggccgcctcgccgtcgccgaaccgctccggccggaactcctccggcgagccgccgggccagtaccgctcgtcgcggccgatcgcccaggcgttcaccagcacctgcgcgccgcgcggcacgtcgtagccgagcacccggcacggctcccggcactcgcgcgggagcagcagcggcagcggcgggtgcagccggagcgtctccctgacgacgaggcgaaggtacgggagctcgccgacggcgagcgcgctctctgacacggcgccggccgcctcgaagtcacggcgaacctcggccgtcgccttcttcatcgccgccgggttccggattagctccgcgaacgcccaccccagcgtcgtcgccgacgtctcgcagcctccgctgatgacatcctgcgtgtgtttcatcgtttttttttatgatatgaagctgcgtgatcgagcattcgagctggccatcatggcagagaaaaaagaacagcttggaaagacaccatgaaaccattgttcataagaaatgctgctagtcactcacaacgacgacgcatttgacggcgtccatgtcgagagggaactccagcccgccctccttatgtatcctcagtagcacgtctagaatgtcttcgccggcgccgccagtctcctccaggtgcgcctggatgatgccgtcgaggacgccgaacatcgtgtcacgacacctctcggcttggcgcacggcgccgctgagacggccggcgagacgcgacgacggccacaggtccgccacgttgagcccagcagcgagctcgatggcgcggtcgagctggcgaagaaacacgtcgaggcccgcgcaccgctcgcccaccacggcgcgcacggtgggagtcggccacgagcgcgcacagcgccgcccgcagctccacggtccgcccgtccgccgcggccgcggcgaccgcgcgcagcgtggcggcgacttcctcctcgcggatggggcgaaaggacaggacgcgtcgcgccgagaggagctccgtgacggcgatcttcctcagctggcgccagtagtccccgtacggcgcgaaggctatgtccctgcctcctttggtgaccgcgcgcacgttggcgctcagcggccgcgacgcgaacgccgcgtcgtgcgtccgcatcacctcccgcgccgcgtcccgcgacgacaccaccagcgtgggcacctctccaagccgtagcatcatgaccggcccgtggcggcgcgccaggtcgcgcatcgcggggtgcgggagcttgccggcgaggtggtgcaggctgccgatgaccggcagctgccatggccccggcggcaaccgcagcccggcgtcgccatgtgccgccgccgccgatcgcctgcgcctggcgaacagcacgacgagcaacgacacgagagctaagccgaggtagaagtaaccatctgccattgctgtgtcgcgcaggcaggatgctggggcgctcggctagtgtttgccagtgttggtgcgtacaaaatgtagtggaggagacggctcgtggatgaaggggatttggttcttaatctgtagtgatgtcgttttcagtatggagctccataatccggatgcgacgaaaatgcagttaatcttcgtgaggacaaatgaatgttatcttgtttatttctggtcatttataacgttaatcgtaaaatgagtataaattaaccggctaggtttctggaatctatttatccggatttaaattcttaagtgggcataagcacttgtctttatgactaattattatttcattaatagacaatgtgcctctcgatagcaagccgtcatatcacaacttcctgaatattaagatgtgtcggcccacctaatttgaaaatcaaatttaatgaagagagtactaaatattaaagtttaattgcatacctaatgccatttatagtgcgcgtgcttgacgttcggccccgaccatccacatcggggattccatgccacgcacacatctgcgctcccaacctgaagaccgtggaaccaaacaaagccaccggttcttcatcaaaatttggatagacatttgtcaaggcggaatgaggcacagggcgagcagcgtgttgggtgaggtgtggccccgtgcgacgcctccacacctcgtgcaaggcggcggaggtcgccagcgaggccaccatcacgagctgcgtcgtcgccaaagcggagctcgctaaatcctgtgaacccgaggtcggatctgcttagtggggtggtggtcgagtgaggagaagggaggatggttgcgacagaggaaaaggaggtggcaaactaaccttgttttcgttcccgttcagcgccgccaagctcgtcgtcgtccccgctccgaaccacctcggtctgcatcagcagcagcttgacggagagggagaggagctcgtcagtatccggccaagggaggaaagccaccagttggagtaggacatgagtgggggtctttgaagagctcccgccgtcccttgctcccacgctgccgatctcgccgtctcccgcagtccacgccgcccaagggaatagggccgccagttggggaaggaggatatataggaggggtggtgtgccggtggcgactgtatggtgaggagcgtgggtcgccgttgggggatgggaacgggagaggcgtcggtggcactggaagggcaacggggaaagtgaggaaggagggattttatatatgtttccgattttgagggtgttttgtgtaaaatttgaagtattctctaaattgacaaactacgagaactttaatgtaaaatgttaggggctgatatgaaaagttaaagccacaggtataactcctttgcattgtgggataaagagagagttgagacccgttgccccatgctacacgaggtttctcgtaacaaagtgatgcactgtggaataaagagagagttgagacccattaccccatcctacatgatgcttctcataataaagtggttctctgtgaatggctcgatagaattactgccaacatgccttaggtttcacgatgtttctagctccatcataagatccatataagcagtgagatatatattatgtggggattcttcgcaatcattactatactacaaaaattagcgtgtctattgacgcgttgtccctttagcatatatagatcatttctttattttccatttacccttctgcgaagatcgcacatttaaaaggataatttagtgggagtatcgcgtgttaatgacctgtaggtttttaacagagtgaaacaattgaggctaaagttagaacaaaccgataaattttgataaaaacaactacacttttcatttcaattatatttatttgtgctgctaaaattctagtatgtgtctgaacctgaaattgattatctttttctttcttccttcctgtttgtgctgtctcctaggccaattggatcgtttagcacttcaaagtgccaccaggcccatgcagacccagctgcccaagctgctgctcgtgcggtcgtgcccaagcaagccgtaggtcacgcagtgtgtgtgtgggtgcggctttcctgttcctacttccgtattcccgtcccttttcctgctacgtggcctactcctattcgcttcttgtttgcctggtggccccaccctttttcttcccaaatcaaaacagaaacgtataattttttcagccttcattactccattggtatattggattagttccgcttggacacttccacctccaatgatgccccgtagccgcaggtgatttcctcttggcagtttcttcgctaatcggatgtgtggcgcatctcaatagctttgattatgtctgcaagtttcaagatgtgctcaggtaacaccaaaaactgttactcgggtgcttcctatcatccatggatgaacatggagacaaaggtttttggaagttttgtccttttatgaatgtgtagcagttaatctgctaggagttcatttcaattttcatcggtggaagcctgtaagagagtacatactcacagagtcgcagacttgcacggttgcaccagaatgtatgaaaaaaataagaaacaaagaaaaggatggaaagaggcatcgccctagttgaaattgttatcaattaatgatcttctataacagtattgattttgttcttgcctcaagctagctaaggtttccgttttgtccctttgataccacacatgccattgatgcaaaagcacagtaatttgttcaggatggtttagggcaggcaacactagcaaggaagaatccaagaggacctctccaggtgatgagcatgcacccgataaccagcaaatcagcaaaagttgttcagacctgaacgatgtgaggatcagtctggaccctgtagggagagtgttggagactcgatttttgtttttccgatggatgggaaggaagtagggccaccggtgaaacaaaagcaaatggatgtacgccatgtagcggaaacagggacgggaatacggaagtagtaagtacaggaaagccgcatctgggggaggggggtgccacctatgtttccggatacggttttggactttttcttttcctggtaacttgaatttatcttagaaatccagcctattttcatactggcggacttgaaagcttctaaggaatcccttgaagtcttggacaaacagagaagagaagatagttcttgtgggcgggaaacgaaaccatcacaggagggaagtgcaaggtgaattggacgtggactttcctctctactgcctcgggaggtcttggcatcctgagtctcgaaaaattcgcaagggcccttcgattgcgatggctctggcatgaatggaagtcaccggaaaaggcttgggcgtggggtcagaaacaccttgtgataaaactgacaagctattgtttgaaacagcaactacaaaacaaattggagatggagcgaaagtgaagttctgggagttggcttggctccgggcaaagattgaaggatgtcacaccactagtccacgcggcctctaggaaaaagagcaggaccctcaaacatgctgctttggtagatcaatggctagagtcgaccttgctcttccaacaaacgaaggatggacaacggatctgattgaccagctcatcaccatttggagcgccgttcagaatgtacacttcacggaacatgaagaccagatcacctggaagctaaacaaccatggcgaatacacggccaccacagcttataaggtgcagctcctgggtacaacatcgtcaaatttcgacaccctaatatggaggccttggatgccgcacaagtgcaagtcctttgcctagctgatactccaatacagagagtggacatcagacagactagccaccagaggctggcccaacggatccacatgccctttatgtcgccagactcaagagacggctttgcacctgctagcggaatatagatacataaggagaatctggaatgaaatcgcgcagtggacaggcaacgaccatttaagaccttctagttggcaagtaactttgacagtatgagtggtgggaggcccccgtaagcatacgggaagcacacgctaaccttgcttgtgaaccggagatatggaatgaaaggaaccgaaggactttccagcacaaggagttgccagcgccaactctgctagccaagataaaggaggaagcaaaaacgtaggggctggcgggcgcaaaaaatctcatcgcctggttgacaatgtaattgccagtagttaggaccgtggccctggtttgtttcctgtacattctccctttttatacagtttcttctctattcaataaaattggtggcctagtcgattcgttcaaaaaaaaaattatcttacaaatcgaggtgccacatgaaccaatcagatgttgacataacagcattagaagtattggttgatggattgattggttgattaataagccctgggacgttgtacgtatttatcttttgtttcaggacgcacatgtcagtttctacagccattacagaagcagtattggtatactactttcttcaatgcagttgtgtgtttctgtgtacaacgtttaaccactgtcttatttgaaaaatatataaaaaaataaaaaatagtcacacataaagtattattcatgttttatcatctaataacaataaaaatactaatcgtaaatttttttcaaataaatcagatggtcaattgttggatataannnnnnnnnnnnnnnnnnnnnnnnnnnnnnnn

SEQ ID NO: 49055 - DNA, 1003 bp, Oryza sativa
atgccactgactttatcacaggtctatgatataccattgattttgttacgttttacaatatatcatcgacttttgcttaacttctacgatttaccatcgccatcgacttttgcttaacttttatgttcactgagttagtctccgttagtactgtacaaatttatcgaaatgaccaaaatacccctgggacagaaactttcaaaaattttgaaatatcggattttaagtttttgccaaattttggatatttacaatcttatgtttataatatgatattttagaatttttattcaaatttcggaagtttttttctaggagtattttggtcatttgggcaaaattgtacggtgctaatggaggataaccggacggcgatggtaaatcgtagaatttaagcaaaaatcggtggcatattgtagaatgtgataaagtcagtggcaactcatagatctgtaataaactcagtggcatataatagattctctctttccgaaattaccagaatttcggaaattttgaaactaaaattacaatccctgctccagggctgcattgttcataaggatgtagtacgtcgtagcatcttccactgcaagagtaaagacatgattcgaaagacaacaattagcgacgtgtccattttgcagctttatcggtctataaaattattaagggtgagtaatgctgtgaaaatcaaaattttatagtataaatgtatggacggattaactggtatgaacacgtcctcggccccaaggcccaacagcccaaggctaacattctgtcttggcccattacgcctactttccattgctgtcaagatattcttatggaacttgtcgagaaaacagaaagaaatcagtccagcaaacgcaacaggcagcattatatatcagccttgctaataataaacggcatcaattgtctctaattacagaaataccggctcgggttacaattatctatttatagccagcatcaattacgataattaacattatct

SEQ ID NO: 49056 - DNA, 4861 bp, Oryza sativa
  unsure (1)..(4861): unsure at all n locations
catctctcctcattaactttttagatacctcggtttttgttttacatgaaaatgcatttaacactataaaaattagatgagatggaacgttgagtgcccttagtttatctccacatatattgttaattgactttgtttcttttggtggaggtgaacttaatgattcgaaaaggatctcttagcatgaacacctaataaatcttatgcaaaatagggtagaacaaagggtggattattgaccagaattgttgatgccattaattgttcgtggttcaaaagcctctgttgatgtaggtgttagtgtagtgcagattcacctgcagcagaaaactcaacgcaaaaatggattagcactggtgcatgtggaccttaattaagatcgatggcgtatgtatatggttttgggggtggcttaaatcaaagtccaaacatctttttaattagtctcgagaatactgatcaatatatatacagaaaattccttaggttcctcggagttttcaattaaatttttcccctaaattttgtttcgttccttacgtgtctgagttcttgattattttggattccaatttccaatccgtgcattctaaacccttgaagcccagacaccttaaagcaccatatgaccgtcctatatacatctagctagtcgactgcgagttaaccgttagactcttttagaaataataattagcatacttcctctgttttatattataagactttctagcattgtctacattcatatagatgtttgctataaaagtcttataacctgatgaaacggagggagtagcttcaaggtgaaaaagattcgtttatgaaaagaaaaaaacaaatggagcagaccaaaaatttaatatttgtaaatatttttaaatgtttccactgaaatttaaacccaactgaaaaaaactttgccttttcagtttcttggtgaatcttttgtatgtgtttcatcaaattcgtaaaaaaaaactattttctatatttggggtcataattatgtccagtttgattttatcacaattctttttagattatgtttacaaagtagaaagcataagtacgtatgacatataagtcattttgaaaaaatctaacagtcaactaatagaatagatataaaggagataaaaaaaacgcaaggacatgtaaagataagataaaattcatgaatatagaagggattctttgagcaatttgtttctatattctttgtgcaagttccatttaaccatcattttcaccatagcatacatatgtgtctgtgctaatgatttaattattgttttgacgttgtaattaattaattaatatttaataggccggagcaatggtgacatgttgggagagaagatcaacataccacctgggccgctatgtgcaaagcgaccagacctctgcaagaactgctggtgttgtgaggtcagcgacgggcaatgctaccagagtctcgaggcctgccaggtcaactgcccattaccatcgccaccggccatttgatcagatctcgatcgatgcatcatatcgtttgtgtgataataagctgatcaatcaaccaataaagaaggcattaattaagtatcgtactctgttcgttttggaaataaaatgctgatgccatcaatggatgcatcatgcatgcatgaattaatgttctggaaaatatgtgataatcacatgtcgtgaaaacttgaaaacaaccttggataaaataaaaggacacctgatatttatccacgttatttagagtaaaaattttacttgcggatttaatcatgagtaaaaattttactattgatgacgtggataaatctcatacgttcatttttaaatccaacggtagctttcaggtttgtacgtgatatattttccttcttaataacgtttatagtgccagatatgggacaattgatcttttgtccatattttaaagtctaactataactatacacatttgaccctacatttttaactttgcttatttgatcttattttttttaaatcgaagttgttatttggccctattgtataggaatagatttagaagaaaataaaaaatgaatttagagagggaagaagacttaactgccccctgtgatttaccaaagcacatacgcgcggctagagttacatgggcgcggaggagaccaatctcatgagcacagagccaatctcggtcagcaaccaaattgtacacattctgatatgcaatacttatattattatagtctttagacttatctttgtcggctttagtttctgcttgttccttggatttacattcttcggaagtttcaataacggatccaccaatatctgatttagacagattattgtgtgctttggtgaagaattagtacttaactggcccccgcgtcatcctcccttacgggcgatacgggaggcagaaaccaccgccatcgtccgctccccctctttcctcctccgcctcgccgccgcccgagcggccgcaaggacggcggcggcagggcttcgtttctctcactcgccaacggtgggggaccgtgcgggatggtgaaggccgcccagatccgggccgtcgcagtcggatcttgcagggacacagccggcggcagggtagtgtgatgaggcggcggcggttggcaatggtggcggtggagtatgaaagtggtggcgatgaaggagaagagaggggatccgtcggcggcggggatgaagatggcggcgaggatggcgacagcgggcaggactcggtcacgccgaaagcggatcctgccccctgaggacggatctggtgcagggcgaggttgcagcggtagcggcgcggcggagctgcggcgacggtgtcggtcgcaacggcgcagacttcgtggtgacggtgacggtggcaacggcgtggagcttgtggcgatggtggcggcagcggttggacggcggcgacagcacggtggctggtcgacggaaacggcggctgccggcggctgtggcaacggggtgcactcacggtggtgatagcggcgcggagctcgtggcgacggtcgcggctggacggcggcgagggggctactgctagtcggcggcgaggtgttcgttggcagtagcggctgcggtggtggtgaccgtatctacggttggaggaggcatggcagtcttggacagctaaccgggggtgtggcagacgcccgcacctggccggcgtggaccgattgaggggcgagngcagctggtaaaaaaaaaaaaaaaaaggggcacaacccgatggcagtggaggccagtaaggcgcaanaggcgtggccgcgacgagaaggcccgcttggagcgaaaggcgttaccgatggcgggaggccgaactggcgcaagaggcgcgtccggtgttgaaggccggcgcagcacgatgaggtgcggccgccagtaaagaagccaaccacggtgcgatatgaagctcccgggggtgtggcgcggtcttgggtacacgaaggctggctgaagggggcaccggtgcagtggtcccacatgtcaccagaggttgagtggtggtaaagcattggtgcgacaaccatggacttgcaggtgatgagcggcgggtgaaaacccagcccggcctttgccggaccgacaacaatggttcattccccctcctaagggcgttgtcgtgccgtctcatcccttaagggtgtttgccgggcgaaagcccagtcttgactcttttgagtccttgacggacggcggcagtggttttccatcgcttctctccttgaagacatcgtttaggcatctccttgtcgaaaccactcgaacgattggtgcaagcacactctagatagagttaggctttgtgttggttgtaagggcgtttttgggcattttcgtctgtgttcctttgttggcctagcggcggtcggtcacgcttagcggcaaccggttcggtgctagtcttctctcggacctgtgtgttggtggtggtatattttttctctttttcctggttacgaccttctaggaatgtaatcttgtaatttttttttctgctttatcaatagaacttcgcatcgtctcgtgcgagtcgctcaaaaaaatatctactttagagaatcaggttcttaggccctgtttagtttgcgagacgaaaagttttggtgtgtcacatcggatatacgggaacacatttgaagtaataaacgtagactaattacaaaacatattacagattccgcttgtaaactgcatgacgaaattattaagcctaattaattcaccattagcaaatgtttattgtagcatcacattgtcaaatcatggagcaatgaggcttaaaagattcgtctcgcaatttatacgcaatctatgtaattagttttttatctatatttaataatccatgtatgcgtccaaacattcaatgtgatagagtgaaaagtttttgtttgggaactaaacagggccttattcatctgaaagcctgaaacttatgtcattatcagattgcaaatcataaaatggtactcacaccgtcccaaaatataagcatttttgaccttaaaacaatctttgagacgctactctgaccaataatatctataaaattaagtcgttttaaataaaaagatatatatattatgatattttgtttaatgataaatctagtagcatcaatttaaaatgatcttttttatttttttcactattaatggtcaaaattaaaattgtttgacttagcattattttaaaaatgcttatattttaggatgaagggagtagtattcttgaataccattatcaaatatcaattatttatgtggaaaaatatgtnnnnnnnnnnnnnnnnnnnnnnnnnnnnnnnnnnnnnnnnnnnnnnnnnnnnnnnnnnnnn

SEQ ID NO: 49057 - DNA, 4066 bp, Oryza sativa
gctcggtaccctttaggaaatatacaaaaatcctccaaaccttatttgacttttaactttgcacattttaattgttggaggctttcacatggattttacttattctatgcataattttgaggatgtattttagagtcgttttgggacgcgacacacaaactaagccttacccactagacatgtggaagtacggtagtgctttgcaacagaggcccgatgaccggtccttatatggccgaggtgctactgtcaaaaccatgcaccccgagcccagcctaaaaccattttgagggttttgaatagagggggaggtgtgaatccaattccacaataatccaaccattccatagtgtccaggtgatatgaatattcccaaagtctagagttgtaaaaccacctaatgttgcataattaaccagcgaagcatctacctaaaatcatactagtggtaccatgagtagagtgtccactagttggtgttttgtttattctagggtgaacaaggtaataataacaataacaataataataaggtcataacaaaggtaaataggcatggctaaataaaacagtgataacgcgggaatttaaacaaagcggtaatgcaataatttaaatcaaaataattttataaactgggattcaatatgttcaaggatgatgtgacttgccttgctcgctttcccaaacgtcggcttcaacttccacgaagagcggatcttccgaagctgcagcgtctacacgaccaacggaaaagaaaaggcttttactctaataaactccatataacaagcagaaacaaagcacaaaaatgggttcttgacttcttaaggaaaaattagagacttgaacggtccaattccgagttcaaatggccaagttatggctatttgaagtttatatgctctttaaatgaatatttgcgaatttcttcatttaaattttaatttaaaaagggtttattgcgtgagccgaggggagggggcgcgcggaccgggtccacgggagtggggcccacgcggcagcctcacggtccacggtggaccgggcgcacccgggctcgcaccggccagcgccgtgggtcccacgcgtcagccgcacctaagggcgtgggcggctgacggccgggccccacgcagcagccactcggcacgcccgagggcagccaagccggcgcagccggcgggaggcggcgcccgcgcccctaacctatactaaagtcaacacatataatagattagctataaggttacctataattttcttcttctatctctatctctcactcatacatttaatctatttgtcttggagcttgtgttaagttagctcttgcatgagagccaacaccattctcttttgtttatctctttcctccacataagcttatagtaagcttatagatcactattatactggctctcatcctcgcgtgcatatgctattaattcctagtatgatgggattggattttaatttttctcatggctaattattctttcgggtatagacagtatatacgggtgacaacaagacgtccctgacgactttgacaatctcaagatatatctgccaagtgtctcagaggtgcttacagaggtagtgaaacggccgcggaggccaagacgacgaggacgacggcaataagggggtgccatttccgcccctgattatcggctccgctttgatcaattggcagaaaattcatcgatatgatgatgatgtgctggatcgagtagtgtacgtgcttcgatcgtcagggctgtatatatgccttgtatttatacacataaattagtaacgcgtgagatatatttttatacaactaggtgtctatatgtgtatggttcagtgaacaaatggagtgaagttttgtcaggaagcatcgatgtctattctccgtgatttcaggcgctggtgcatgacacattgacaccaattatttatatgtactccgtatataccggagtaggaattaagtggttcaaggtgtgctgcatatataaagaacgtagtatagatgctgtgagtattactatctttttgtgtggtcctggcgcacagaaagtataaaaaaacaatagggcggtaaaccgatattcaatatctattggtcactttggcttgctagtaatgatgtagtcttaaatggctcaagtattaactctctcttgcaggttattttcagggtaacgcatcgggctcgccagtggtctttgcttcttaaagaaggtgatgagaaagctttaaagattgggtgcctaaaattgaaagttatcattatggaattctactcaaaatctaggtggaattgaagaggaagattgaattgtgttagataaaatcttttgttgtgagacttgttctggatgtctttgtcgtccattcgccttctacggcatcgttgccttttgaacctgtttgtagcctaagtgcttgatgatgtaatactatggttgtgtacatccctcaggatatagaggccaggttttatttaatccattatctaaaaaaataaaacgggttacaaaatcaatatagtggtagctaaacacgaaagaatgccatagaatatccaaacttgatacgatattaaggcataatattttataagagagttagcctatatctttagggcactaattacggatgctcatccctacgacaatagcattactgatcttcaaatgacaatagcatcactattcatgaaactataatagcccatcctctacatccacagagtggatgtgctcatgtgcatagccaatttagctttcatatatcggacatgttagttgaattttacctacctagctagggtgtaaccgtgtagctagattatcatcccctaaatatatggtgctatcatgttcagctggtaaacgcagcaaaatgcaaaatctggatggctttcaatttagggttactttgatccatgccattgcaaatttggctattcagaaaaatatcattacaattcgtctattcgtaactgtgccactggaattttacaaaaatagaaccgcgtcacggcagtggcggctccttctttctcgcatttcttccgagagccaagctggcaagctcagagtagtcagcagcgagacccaagcacgcgagatctcgcgcgggagcggtagcggcgatgccaccggcggtcgtccatccatccatggccgccgcgagcttcgacagcttcggtggtggagcaagcgtcggtggatctggcacggcatggcgcgagcaggcctgacggtggcgacgaagacttaaagacggtggagaggtgtcctgccgcttgcggcgctcgcggcaggcggcgaggaggcatttggagaggcctgcggacgaggagagcagggagaacaccgccgtgagggacagcggccggcgtgaggtgctcaccgacctggaggccaaagcgggagccgaggtcgagcagcgatggggaagaagagggtcacgccgccggtcactctcgacgcgcagcctaggcttccgccggttccgcccgacgccactatcgtccgacaccgccaccaccggattcgtcggtcgtgcccaccgctggatttgccagtcgcgcctgatagagcgagctatggcaggtggctcggctgagggagtcccatgaagagctgcgggagcgtgtcgagctgcttgcccgcaccctgcaggagaccaacgccaggatccgcgccacgctctaggttgggttcgttcaccttgccagcaagctccctctccggcttgactccgggaagatgatgggagaaggaaggaagaagccggaaaaggaagagaatggatggaaaatgtgacggcagtggcacggttttaattttgtaaaattccagtggcatggttatgaataggcgaattataatagtatttttctgaatagccaaatttacagtagcatagatcaaattgacccttcaatttaaagctatgtctttataacctttattattaaaatgaaaaaaaaaccaaagatgtgggctaacggtagggctgtcaacgagacgagctcgaatgagctcagaatgtgctaataagactc

SEQ ID NO: 49058 - DNA, 2229 bp, Oryza sativa
  unsure (1)..(2229): unsure at all n locations
nnnnnnnnnnnnnnnnnnnnnnnnnnnnnnnnnnnnnnnnnnnnnnnnnnnnnnnaatcggaggtgcctaaaaggtttgcaacttcatcctccaatgtttttttttgtcatactacatttgcacctatgttttgcacactttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatattaaataatagaaaacaaactaaaataaaaattaaaagaagttaaacacattaaaattagtttaaaactttacaaatagtttttaagaattatttggtgtaatattttatgatttttgtatgaataaagatatcttataattattgtatgactgtcattattgtaagaataattatttgtgtgcggtttttttgactcatgtagatggatcggcaatggatgtacgctgatcggcggtccaaagagtttattgacggcgtgcactattttttgagagtggccgaagctaacaggcaaaggggttttatttgttgtccatgcaataagtgtaagaatcagaaggagtattctgcatccaggactattcatttccacttgtttgagtcggggttcatgccaagctataattgttggacatcccacggagagcaaggtgttgaaatggaagaagatgaagtggaagacgacaatattccggactttgctcagtatgttggatttgaaggaaatcaaacgggcgaggaggaaatagctgctgatggtaacgacgttgcggatgatcttggtcagatgttgcaggatgccagggaagactgcgaaagtgaaaaggaggcccataaattggacaagatgttggaggaccacagaacttcgttgtacccaggttgcgagcaggggcacaaaaagttggataccactctggagttgttgcaatggaaggcaaaaaatggggttagtgacaaggcatttggcgatttattgaaactcgtcaagaacattcttccggggggaaacaaattgcccgagacaacgtacgaggctaagaagatagtctgcccgttaggactggaagttcataagattcacgcatgtccgaacgattgtatcctatatcgcggtgaggagtatgagaacctagaagcatgccctgtttgcaaagcactacgatacaagattagacgggacgatccaggagaagttgacgggcagctaacaaagaagagaattcctgctaaggtgatgtggtattttcctataataccacggctaaggcgtttgttcaggaacaaggggaatgctagaatgttgcgatggcacgctgaagagcgtcaacaggacgggatgctgagacaccccgccgatggttcgcagtggcgaaacatcgacagaaaatttaaagaatttggaaaggacgcacgaaacatacggtttggtttgagtacggatggcatgaatccttttggagagatgagcagcggccatagcacttggcccgttatgatgtgtatctacaacctccccccctggctatgcatgaagaggaagtacataatgatgccgattattattcaaggccccaagcaacctttgtacgacatcgacccgtacctaagaccactgggcgaagatcttaaacagttgtggaagaaggaaggtgtccccgtgtgggacgaggacaaacaggaggagtttaacctacgagcgctgctgttcgtaaccattaacgattggcctgcacttagcaacctatccggacagtccaacaaggggtacaaggcttgcactcactgtatggatgaaacagaaagtacgtatcttaagcattgtaggaaggttgtatacatgggtcatcgtcgattccttgcaacaaaccacccggtacggaagaaaggcaagcacttcgaacataaagccgaccaccctacgaatcctaaacatcgcagcgggaaaacagtgtttgctatggttaaagatcttaaagtagtgttcggaaaggggcctggaagccagcatatagagagcgaagatggtcacgcggcgatgtggaaaaagaactctatattttgggagttaccatattgggaattcttggacgtacgccacgcaatcgacgtgatgcacctcactaagaacctttgcgtaaaccttcttggcttcctaggtgtat

SEQ ID NO: 49059 - DNA, 2997 bp, Oryza sativa
  unsure (1)..(2997): unsure at all n locations
nnnnnnnnnnnnnnnnnnnnnnnnnnnnnnnnnnnnnnnnnnnnnnnnnnnnnnntcatcaacctgctgcagggatgggacaatgccaccattgcaggtaaaaaggttttacttcccgtgtcgtgctagattggttatttggttgagagtttgtgagtactaggaaatatgaacagctgtcaattttttcttaattatcagtgttggtgtaccttctaaatttttcagattaatagactgctttagatcagatgtttgttgagtgctaattatggtcttctagtaacatgtctggtgttgttgtttgagtcctaagagcaattggcacaattgtttatcagcaaactggatcgcatgatattaatagtctcttaatttttctagatctgtactaatcttattgaagaaagagatgttctaatcataattgttagctattgtgttgtctgttgaatcattactgtttgccattctttgttctgaacacctgtaaagattgttctatccaacaagaaagtgtaaatgttaacaaggcacaattattaaacttcttcaggtgctgtactatacataaagaaggaattcaagctagaaagtgagcccactgtggaggggctaatcgtggccatgtcactgattggtgcaaccatcatcacaacattctcagggccggtatcagactggatcggccggcgccctatgctcattctctcttcaattctctacttcctcagcagcctcatcatgctatggtccccgaatgtctatgtgttactgctcgcacgccttatagatggattcggcatcggcttggctgtcacacttgtacctttgtacatctcagagacagctccttcagagatcaggggtttgctgaatacactgccacagttcagtgggtcaggagggatgttcttgtcctactgcatggtgtttgggatgtcactgttgccgtcacctgactggagaattatgcttggtgttctcgcaatcccttcgttgtttttcttcggattgacaatattctatctgccagaatcaccaagatggcttgtcagcaaagggcggatggctgaggcaaagaaggtattacaaaaattacgtgggagagaggatgtctcaggtatgttttgctgaaaattttgatgttcatttcacccatatttccagctgaccagtttaaaaacaatttctcccagattctaaactcatggttaatactagaaaacatgtgtggcattggtaactgttaatttcttgacacgaacttaacatatgcagaaatagtgtatttttgaaaaaaaagggtaaaagaaatcaaaatctattaagcgccttctatcggtgctcttttgaaaaagcttatgaatcttcaagtaaaaattactaagtacacataactacactaattcattttccatagaaggcagaacatggaatgtacaatcgttatctcaccaggtagagcccaaatgaggtgtcccaactttttgctgagtcctaatctggagaaaaataatcaggtgatctagatagacatcgccctcttttttttttttttggtaagggtaactctagaatttggggggtgggacctgctggtataatgtggatgtgggccgacccacgggtccttatctactctagtttaactaaatgaactatattttgcttttgagattttaaaagtgaaattaagtccatctagttgacctagagtgggtcaaggagccccacagcggccatgcctaacaacagtgattgttcagaaacgttagtaatgatttatccttaagttcatgctttcctcaaactaattacataatacatgtgtcaacatcaaaataggcatatgctgttagcaagtggtttctctattttctcctctacaacagactaaatggacagtattcggttggctgagagcataatattgctgttattttaagttcatcgaacttcgctgtaagctggttgtccccagctgcactatgctagctttctattaaagctgggcccttatatttctgttatttgtttctggcacaccattcatatttatattgctgctttattcatagttactacttatttatgccaatgtttataccaatgtccaaataaaatcatgtaatctacgtgaaaaaataaagttgcataatcattcaaattatcaaattgcgcaggagaaatggctcttcttgttgaaggtttggaggttggagctgacacttccattgaagagtacatcatcggaccggctatagagccagctgatgagcatgttgttgatggcgataaggaccaaataacactgtacgggcctgaagagggccaatcatggattgctcgaccttccaagggacccagcattcttggaagtgtgctttctcttacatctcgtcatggcagcatggtgaaccagagcgtgccacttatggatcctatagtcacgcttttcggcagtgtccatgagaacatgcttcatgctggaggaagcatgcggagtacattgtttcccaactttggtagtatgtttagtgtgacagatcagcaccccaaggttgatcaatgggatgaggagaaccttcatagggatgatgaggaatacgcgtctgatggtgctggaggtgactatgaagacaatgtccacagcccgttgctgtcccgacagaccacgagcgcagaagggaaggacattgcacaccatgctcatcgtggaagtgctctgagtatgagaagaagaagcctcttggaagagggtggcgaggcggtgagcagcactggcattggtgggggatggcagcttgcatggaaatggtcagagcgagaaggcgaggatggtaagaaggaaggaggatttaaaaggatctacttgcaccaagaggaagtgccaggatcaagaaggggctcagttatttcacttcctggtggaggggacgctcctgaaggcagcgaattcatacatgctgccgctttggtaagccaaccagcact

SEQ ID NO: 49060 - DNA, 1523 bp, Oryza sativa
ctacagccaactttgacagaaaagttcagtatactgtcgatagcatactgtcgttgtaagcgtcaatagcttactggtttggggctttcccccaatccatctcgacagcatactgtcgttgtaagcttcaaaatgtaatgaaccccctcttctttcttaatgaaattggttgactgtatctttcggccgacccggcaaaagaaaagttcagtatatggtatccctgtttgattcatgtccacttattcagttcaggaggcaagctatctgtataactactgctgacagattaagatccattctaccatacatcattgccttaaaccatacttcacctgaagatctagctggggcaggatctcttggtttaggtcgcaagcttgatgactggccagctttcggcaatgtaagcttctggacacggttcaccgccctagtcctgcatgagaaatagcaagttacagataaccagtggaaataaatttcacattatacaaaacaagtttttttagataatgacattatacgaaacaagtatgcaataaagatgtcaaattcagaaaaaaaaaagagttagctagtataagaacaagattggaattactcacaaccgctctttcgcagcagtgttggatgttttctcttgctcttgatctgctacattgcttactgaactatcagcttctgcacccatggaaataccatccgaagcatcgcttaaccttccatccgagtcgacatccgcaaggccagaaatctcaggatcaacggagagcatggacccagcttcagattgcctgtcactggtgtcggagaagttatcaagatcagaagctgccccactgccaacacttgtgcccttccctagggatgtaatgcccggggaagaggacgaatgcttcaatacggaatcagcttgtctcgttggcttcaatctggtgctactattgagtaattgaagcctgtcgatttcctcatccttctttgaaatggtatctttcagaagtgaaagctgcaaggagaacattacaaaacaatagatgtaacagtatttttcatggtgaattactattccattgcttacatcacataatgttttgacattcccgaacaatattcttaaccttttgccatttcaatactgagaccattatgtcaagagaagtcagaagtgacttgatgattattgagaaatttggttacctgatccattaattctttgacatcttttccctccttcccctccttattgctcctagcaacaccaagttccaccccagacactcgttccgcaaatttcagagtacttaaagtctctgtgtaagatgaaacatctgggttgacctgcacaaacattagggtttttgcatgcccacctgcatatcaaactatgcatgtcaatacaactccgtgtatggcatgtaaaatagttctcaagtgaagcagaatacccagtgaagtctgcaggacttgtgtgagcttgctatttctgtatggtacatgagcattcttttgtgataaag

SEQ ID NO: 49061 - DNA, 1557 bp, Oryza sativa
acatgaatggtcacaacgctgcaaaaaaaatatgatctctagtaagaagggttagtcctacgacaaaaaaagaaaagagaaaaggcaagtaaattacctgtgagacctgctactcctctcattcaaagctgttgcactcatggctctattgtcatgccctgtttgcattagctcgattacatgagaagttgaggtgacaggacacattgttgcatcaggaacagcaagtccattgggttggatggtgttctggatccctagtgtgttggaagttaagaaaaaggaggatatttcttcacatcaattcagtctgcaaaaatcaatgtatggaacttctcaagcaagatgatcgcactagaatctgatgaaggatggccatcgtgtgtgtacacaataaaaaactgcaaattttattgcagatttaaattctatttggtgaaaggctacactaatgcaagtctgggggaaaagaatatttcttctgcacgccaccactgccaaggagatcacggatttgctcattgtagatctcaatcatctgaacaccaagttcgtaagtgattgtgtctctacggtcatgagaaatattgaaaaggtcatttaatgccctataattgactccccattccttctcagttgccttttcaggtcccatctgagaaattgatagaaacagatcgttgtaaacacatagtgactgtagagaaatcttctggcacgcaaactgaaataaacagaccaaatgtttttgccctgagcttcagcgtaccatagtgtatgtttttcctgatccagtttgcccatatgcgaaaatgcagacattgtagccatcaagaactgatctaattagtggctgtatgtccttgaagacagcatctattaacaaaataagagggataagagaattgatgtatatgacatacactattatgggatataattttttgaaggatttgttgaactaatttgatgcaatagcttcaatggaaacccaacagaagattaagttgtactgaccacttatcatgtaccttgtgtagtgatagggccaaaaactttgttaaatgtgaaatttttgcccccttccttcccttgttttgtagggtttgatagaactagttcaccattgtccccaatatattcaactgaactggacttgtcatcctccccaggtcgaaaaggtcttatccgacaatatactctgatgtttcctgctcagaaatactatgccaaggtgatatcttttgacctagataaccagacaaaatggactgatgattgtagttcacatgtaccttttagttcctggatctcattgaacaattttctgttttctgcaagagctccatgatacttttctgcagtatttgttaccaccttaaggctttttcctgttgaagattgcaactggtaatgttagttgcaatccatcgatgagaaaagaagtatttgtatatgaaacccacaagtaatcacaaggttaattcttaccaaggccagctagttcttcagaccacttgttttgacaatttaagatttcatgcctaacggaaaggg

SEQ ID NO: 49062 - DNA, 1147 bp, Oryza sativa
cggcggccacgctgaacgtgcggtcgtactggaccaactgctcgagcacctccttcatcgtcggccgcgacgccgggtcttcgccggtgcagatcatgccgagcaggaacaccgccacggcgtcctccaggaacgccgccctgtcctggatgctctcgtcgacaacatcgtgcagctcgccgccgaccttttacctccgccacgcccactccgccaggcaccagtctgcgccgccgtcgttcgccaccctcccgtcgtcagctccagcagcacgacactaaatttgtgatactggccttatcatgtgtagtactttattttgttttagattataagacgttttaggtttttgaatagattagtgcatagaatttatgtatagacttaatacatgtgtttaaaagttatataaatatcaatagatctagacgagaactggaaaagccaaaacattttagatggaacggagggaccgagggagtaggaaagagccaaggactcaagactgcaataggtcaaggtcttcgacaactaaggcgaatcttcttgggcctcttatttcaaatgaaatttgggactatttaggcccacatgtcttttggttcttaaaaataaatggactcttctgctagtggatcctcaggtcgatgccaaagaatactcaggctggacagtttatatatggaaaatggtctgatgttactcctgaatatactgaggctgtgtttagaggtccagggataaaaatttttgctgtgtcacatcggatatacagacatatttaaagtattaaacgtagtctaataacaaaacaaattacagaatccacccgtaaactgcgagacaaatttattaagcctaattaggcttaaaagatttatctcgtaatttacacgcaatctgtgcaattagaatttttttatctatatttaatactttatgtatgtgtccaaatattcgatgtgataggatgaaaaaacttgccaagggatcaccctgaactcattttcattttggaagaactacaacacaaaggtatatatgtaagggtctgaactctgatttccccgaagcaaacaattgtgtccgggccctcatgttccaagaaacgcaaggaaatagactacaattactaagattttacaaa

SEQ ID NO: 49063 - DNA, 5072 bp, Oryza sativa
acaatcacttctcaaatttctcaaattattagcacttaatccatcctataaatgctacatccattcttttttctattttaatataggaatatatcaaaatggttaccgtgtggttttctaaaactttataatcataaagctaggttatatgtcaagtgccaaaatacctaacatttcgtgcaacttgatgcataaataggtgggatttaatgaaatttactctagtaatcacccttaagagctcgggaagcgtttccgttaatctatgtgtccatttcttgaaaaaaaaagacggggtaaataataatacgagctgagatgaagatgtcaaaaatgataaactccgatcagatgacaacatcttgttatgatatcatggcttttgcattagttgtattgacggtaggtaataactaagataatatttgcattttttaggcagaggtatcaacaaaaaaatgacatatggtttcttcagatggccatacatacaacagcttcaaatttcgctccatgaatatctgtaaagcggatagtgacggcaacaacaaaacgcaaaaggttcagcaacagccattctgccgaatgcaaaactaacaagaaatctaatagaagcgtagtagcgtgcagtctgacgaaagaaataagctgtgttcccatcaccagaagcaactgacgctttttaatttggggtactgacatgacgaccaaacaccggcagaaaaacatacgtcaaaatctgacgccgattactcatacgagctaactctgtgtcaactgattctcccttgcaataatactaataaggaagccataatgagcaaacctctttgtcatcctatatatatatatatatatataaagttcatccccactaagtatagttaatgctaattctcttttctctcataaaatcacatcatctcaattgtttttagcctttggatgattcatcaagggtgtaaattacatctcttcacatcacctcaactgtttttaagtttttggatgattcataaaaggtataaatttcatttattccctccaaaagacacaccatacaacccaatcatttataacctatgtataattgataaaggtaaaaaaatataaacacatgaaagaaaaattatatagtaggtaagaaagaaaattttagaagtaatgggtgtgttcggtagcgctactagctggctgccttgcagccagcagccacagtcccaccacaagaaagatactagggaagcagcagcgctgcggctgtacaaccacagttcagcactaccgaacagacctaatatctactatattatcacataatttttgcgcaacaatacgcgaggtacccatctagttagtccaaaattaaaaccgcagtccgaaaattccctgtcatcagtcctccaaattgaaaggataatcggccaaattcttttgtcattagtccaaactgaaaactcaagaaagaacgtgcgtgctccaatcaggggctttcttgatccgagatattttcacaagagtttccagaattgtgaaagcaagctgttatacttttatataactaataagatacccgtatattactgttgcggacattaaattactattgcggggaattttgtgtgttcgcttgtgtgcatcttagttatgcagatatcacaaaaattgtattaccttaatgtaatcgattgagtttaataaaaactttaattatctaacaataattatttttataggccaatggcctatacgattggaaatgggttggtagcgtgatagagtaaaagcgtggttattcagttttttggggatatggttgcacgccatgtgagatgtgaaaggggatgagcggatgactccctttttaaggaagtataaggttttggttttatgattgagatcgtgaaggcaagttcaagcatttcagctaggagtagaagtgaagaaaaaaactgatcagtgagcactgtcctagtgcagtgcaactgaagcgcttagcctaggaaagaaaacctgcagacagaagtttcattttctgaaattattgcagggatcccataaaagaatcaatggaccagagagtgatttgtgatttgaaaacaacaacacaatgagggggccaggccatatcaagatctacattggccacaagatatgtcatcttgtcgtcaggtctctgcaataaataattcaatgatctggagttactgaaaaatagtggcagcatttccctctggaactccttcgagatctttccagctcacgaaccaaatctcctgctcctatttgaacaataattcaataaaatgatgctaagcagagacttgggagcacaagataacaagatctgaaattaatcaacaggtaattaagcaagcatgcatgagttcagcttctgcagcttaacatgtgctacctgttccatcacaaacaatattttcctggatcatggaccaaatcaaatggcacgcatcacaagaggaaaatcacgaccatgatcaatgatcgatagccatggagaccaaactcaactagtttactcccttcggtcccaaatttaaatatttgcatgattcaaatttgtacatgatataaatatttataggacaatgattatttcagtgcatggaaattctatcattttcgaccaaattatctatgttccaaaatataagtatttataggtttagcatagattgatgttgagaagaaaatagtttagtgcccctcaataaataataagatatggatagggtgggagggtagacggggtaagatggaaagaaatttgaagagaaagtgattaataagacaaatggtattatgaataatgctagaaatttttataatttgaaataagatttaattgctagaagttgttatatttagaaagagagagtacttatgaccataatttaagtaattcaaaatttaaaatttgactaaaaatgtaaataaggaaaatctttcgccctgtttttaatctttaaaaaattcttatagtaatatttatgaatggttggagtagcatattcttgagttattttgcttttgatggtgagttcgttcgaagataattagaaaaaaaatcctcgtctttcccacgcacgcctctgttttataaaaagtttagtgtttaatttattgcttaccttattttacttattttttcaatcctatttgttctcctgctctcagtcactgagctagttgcataaccatcgtttcgcggaataagcgaaatggcacatttgtaaaagaaaggtaatttgtgaataaaacttttatatacgtgttcttaacgatctaaaaagaaatgctgaaaaataaacttcgataaaaaaaaccttaaaatcagctccaaatctctaaatttaatgttgaaaatttcaaattttggttgataagcgcccttagcctgtgcgtgtagtgtatgccatgcattgggcttgaaaagatcagcagatcgtgtgacgtactacggccggtctgctgccaaaacaccgttctagggtcaccaataattggatggaatctggcactacgttacatcaaattattggccagatttttttcccctttctttctctcctcgctttcacggtcgacaacagccacggccatggtgctggctggacccgtcgtctcgtccctgtgacaggcctaggcgtcccggtcgccatgggatcctgtttggattctcatgacaagctgctcaacgccgcattttttttttttgcaatacttatgcgaattgtcctaagtattccctccatctctaaatatttaacgccgctgatttttctaaacatgtttgaccgttcgttttatttaaaaaatttaagtaattattaattattttcatataatttgattcattgttaaatatacttgtatgtatacatatagtttacatatttcataaaagtttttgaataatacgaacggtcaaacatatttaaaaaaagtcaatggcatcaaatatttagtagcggagggagtatttgacttcttgtgagaggttttgtccacccttttaggattttgatctccaatagttttctcaaatgcatagtttctttaaagaaaagtgttataataatattataaatttattatatttaatgatcttaaaatttcgaaagattaattgaattttgtcaacattaaatggttatgatcagagagagcagatgaaatttctaagcttaaattagaccctcgatgaatacccgaatgttaaaagtacgatttgacattttatttggtacaaaggtttatttaaagttgcctcggtcgtcatcatatattgttggagaatttctgaggagaccagcagcatattcatggaaagaaaaaagagaaatggaatttacatggccttgcatcttatttatacaaggttggcgaggcatacaagtctccacttgttatggatagttggactctagcgactttcagatctcatcttgtggtttaattttctcccaaaaatatctcatcttgcggtttgcttgctcctagttttggttttgtatatatcctccttcatacatttacacaaaccttgcaatttgctgctaaaatttccgtgaatttttttttagtagaggaagtattcgtgtttctgtacctgtaggtatattaagggtgaataaccgatacggtacgtagagttttgctctagtatcaatttagtttccgatgtttcaaattgcccaaacaaattctcaaaatgtggtacacatgaattcattggacgcacacacatgtgtatatttttcaaaaactggtgaacactatatcgactctagaattaattggaatctcagttgaactggatgcacgaccacacatagccaatttggccaggccagtttccaacttgtagtgttgtttgacgctatttctttcaattcattagatgataatttatttagtgcgagtgacttcaagcgctttattcttcctttttttaaaaaaatcttttcaatttcccaatgcaattacactgggcctaggcgcgagcagtgggcctaggcgagcaggtttttggtccagaagagatatgg

SEQ ID NO: 49064 - DNA, 1509 bp, Oryza sativa
ctcaactactaattttaataatacaaagaacatttcagtaattatttaaataataaattaatcattaaatgatcttgttttaatgttgttaaatacttagagtgtccaagtatgttcaagatttttcttgaaattatttgagcattggaaatatttttaacaattcaaagattatttcattggttaatttatttggagaagtaattaaaaatcctctctctttcttgggcctaatccacgaagtttacagcgccgaaagtccgtttcatgtccctacttcttctcctctcgggccagcctttttccccaaagtccacaccacgtcccagtcgctacagtgctgtcttcaacctctggccggagactgagcccgacccggcgccgctttctcctccaaatcctggctcccctttcgatcttttccaaaattggttaaggggaaatatttctcttatcctcctcttccgttttcctcaagaatcggatcttatcttgaagaaatcaacgcggaattgagctcgattcgagcttatctgtccaaaccgaatcctagtttttgtggacaaagcggaaggggacggtgacggacgaaaaaacgcgggtcaaaggatgcgacgagaggaataatatgaatcttttaattagttaagattaaaattgagtttaagatgtaaacgtagtgggggctttgtgtaaaacttcggatcgctaccaaatgtatcgactcgaatcaagggggctttgtgaaaatcgtatcagaagagaaatcgtggccgtcggatcatatgcgttgcgaagatcccccctcttccgcgtcagcgccggcgccgcctccgcgccgcgcacccctgaaacctccccgggggacgccggcgcctctcctccttccccccacccctagccacggattccatcgccgcggaggacgaggcgcgctcatcgatccgccgctccccgtcgacgacgaagcgacagcatcaagggttctaaccacctcttcccccgccgtcgccgtgagcgcctttttctcttcctccttctccggaagaattgggcgggggatttcgctctcatcacgaaggtatcgaaatttagtttactaccgcctgctgtctttgcttattaattgccttgataattctgaatattctgatatatatattccctggattcccaatatacagtagtaagctttagctgaagttttcctgtctccaatgcacaacattttcaccaaatttttttagctaaatgtatatgttatgcatggttgtatctggtttaatgaacatgtgttggcagcagcagaacaagcacagatatggtagtttaaggagtcctctaaaaataaaggaaaaaacaacatcctaggaagtaactatcattatacacagtatggtagtttagaggtgtaaagtttctggttttattgtttgaaaatgaaatctaaatactatcgataccactggaactggaacatcatatgttaactatttggaacatcgatta

SEQ ID NO: 49065 - DNA, 2456 bp, Oryza sativa
ttatactctgatcagaggtgtacatctttacccacaagacacatcttcctcacgtgtaaccacgtgccacataccaccacggtatacggacggaagacgtgacatagtttccaacccatcctagccacagacaagagtaccgacccaaccccacctacggccgggacctccgggacaggtaggcaggactgagcccctagcagcaggacaccagccctgtgccatgacatctcgactaccgggccgcagctcgtgtagccttcatttgtcctagagatgtccatcgacccccgacttcgtccatctccatccgtgtacttttgtttataaccagactgagccacaatgtcacgaccggaaataacccaacgggcgtaccttacgtgcgtgcattaatccttgtcccaggaggcaaggtacaccaaaagttgatacaattcagagtttaacaagcggaagcgtaaatagttaatttattacatgggcagcgaaggcccagcacacacaaagacaaacgagaaacagcggaagactagggcgacgaccacaggcacttgacggcaggcacgagctagacaccaaagccttcatcctccaggaactcctcttctgggtttgggaaaaattgagcaagactgagtacaaccaccgtactcaacaagacacacccacaagtgcagaataaatgcaagggagtacaaaggagttatactataaagggttaggggtgcagtagacagcatttaaagacattagttgctcagggctattttgcaaacacgattctagtactatacaatatttttttatcaaggccgtgaacccacacgaacctgccttaacccaacgcctacgatgattcagaccgaactggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaatagattatactctgatcagaggtgtacatctttacccacaagacacatcttcctcacgtgtaaccacgtgccacataccagcacggtatacagacgaaagacgtgacatagtttccaacccatcctagccatagacaagagtaccgacccaatcccacctacggccggaacccccgggacaggcaggcaggactgagcccctagcagcaggacaccggccctgtgccatgacatctcaactaccgggccgcagctcgtgtagccttcatttgtcctagagatgtccatcgacccccgacttcttccatctccatccgtgtacttttgtttatgactagactgagccacaaactaagccttacccactagacatgtggaagtacggtagtgctttgcaacagaggcccgaagaccggtccttatatggccgaggtgctactgtcaaaaccatgcaccccgagcccagcctaaaaccatttttggggattttgaatagaaggagcggtgtgaagccaattccacaataaccaaaccattccatggtgtccaggtgatatgaatattcccaaagtctagagttgtaaaaccgcctaatgttacctaattaaaagcgaagcatctacctaaaatcatactagtgataccatgagtagagtgtccactagttggggttttgtttattctagggtgaacaaggaaataataacaataacaataataataaggtcataacaaaggtaaataggcatggctaagtaaaacagtgatgacgcgggaatttaaataaagcgataatgcaataagttaaatcaacataattttacaaactgggattcaatatgttcaaagatgatgtgacttgccttgctcgctttcccaaacgtcggcttcaacctccacgaagagcggatcttccgaagctgcagcgtctacacgacaacggaaaagaaacggcttttactctactaaactccatataacaagcagaaacaaagcacaaaaatgggttcttggcttcttaaggaaaaattagagacttgaacggtccaattccgagttcaaatggccaagttatggccatttgaagtttatatgctctttaaatggatatttacgaatttcttcatttaaattttaatttaaaaacatatttattgcgtcagccgggagagaggagcgcgcggaccggttccacgggagtggggcccacgcggcagcctctcggtccacggtggaccgggtgcacgcggcttacgccggccggcgccgtgggtcccacgcgtcagccgcacccgagggcgcgggcggctgacggccgggccccacatggcagccgcggggcgcgcccgaaggcggcctcgccggcacagccgacgggaggcgacgcgcccgcgcccctatggtcgccggcggcggccataggcacggcggagcggc

SEQ ID NO: 49066 - DNA, 977 bp, Oryza sativa
  unsure (1)..(977): unsure at all n locations
nnnnnnnnnnnnnnnnnnnnnnnnnnnnnnnnnnnnnnnnnnnnnnnnnnnnnnnnnaatggttctgactttagcttcagcttctctcaagatatcagtcccgaacacttggctttccccaacttgatcccacaaaagcggtgtccggcatttgcgcccatacaacgcttcataaggtgccatttgaggctggcttgatagctgttattgtagagaactcggcataggggagactcttatcccaggtcttcccgaaatccaggacacatgcgcgaagcatatcttctaggatctgatttagacgctcggtctgcccatctgtctgcgggtggtatgcagtgctgaagtttagtcgggtacccagctcctcttggagcttcttccaaaagtgagaggtgaattggcttcccctatcagatacgattttcttgggaacgccatggagactcacgatcctagcgaagtagagctcggctagtttgttccctccataggtggtcttcacaggaatgaatcgagctaccttggttaatcgatccaccactacccatatagaatcatatccaccttgggtctttggaagtccggtgatgaaatccatcccaatttcatcccatttccattcatgtacttggagaggttggagaagtccgaccggtcgttggtgctctgccttgacacgctggcacacatcacaaagggccacgaactctgcaatttcccgcttcatactaacccaccagtatttctccttcaagtctaagtacatcttcgtactgccagggtggatggaataaggactttcgtgggcttcctgaagtatcagctgtttaagttctctgttatctggaacgcatactcgatttccgttccatagggttccgtgttcatcctctgtgaaaccagcggttttaccctgtttcatattcttgaggagtccatgtatgtccggatcgttcttctgagcctcgcggatt

SEQ ID NO: 49067 - DNA, 1126 bp, Oryza sativa
tctatgtatcttttgaaagatttttataatcatatcacacagatttttaatccttagattaaaatccaatagacacagtaaaaatgcaaaaaacaactaagaaacaccataatggatactatattaccatatcttcagaaaaaaaaagaccaaatccaatataaatttcaaaacttatatgcgaagattcaaaaattacactgtaacttacaaaagttaccgtgcaaatttcataaattatattgtaacttacaagaaaacacactgtaaatttgagtgagaaaatcgagtgagagataagaaaaaatctttcgagtgagatatagcaaaatcgatgttttaatatcaaatccaacattgtcagtagagaagtagagggaatagaaatacaggcaaaaacgctacgatttcatagaaacccttgtcttgttggtggattggagtcgtctgcattttcgttctcgcgttggtgaagtcgtctcgtctgcattttcattttgcacaggcacacagcaccaactgaaccagctgcagagaggagcaacacgagacaatggcaatttgcaaagctgctactgctcctctcctctgccaagaaagcccaaattttgccagccggtcgccacgtggacaagttaatctgcctccaatgcaatgtactactgcaacagtatacacgtcgtcctgtttggtcggtcacatcacaacctgatctcgattactcgtactactcagctcacgtgttgttctaccgatttgtagtatgctaaaggggtgtctacgtgtaaaattttagtgttacatcaattattatatatggtgtcatatagggtgtttagatactaataaaaaactaattatagtatccactagtaaactgcgagaccagtttattaatcctaattaatccgtcattaccatagtttactgtagcactacattatcaaatcatggagcaattatgcttaaaagattcgtctcgccaagtagtcccaatctatgcaattagttctttctaagcctatatttaatacttcatgtaggtgtttaaatgtttgatgtgacagggcgtaaaattttagggttggatcaacatgccctaaggtctcctttgaatcgcaaaaag

SEQ ID NO: 49068 - DNA, 2447 bp, Oryza sativa
gtaattttgcatgaagtttcaagcaaggttttgcatgatatctaagataactattttttccgcaaattgtgcaatgtgcctttttttttccatgggctcacttcacattctattttcagttgccaacagatgttacaaatttacaaaacaggaaataagaaaaagcaaaagataactccattgagaaagcaacatcaatgtgatcatgggagggagtcgtagatgcataactctattcactgggattcaaatattaatgttatcatttatttttgcagaggccaaaggtaagcatctttttggtttgttgctgcccaaaccaaccctaccaaacttggtaatacccaagtataaattttgttattaccaaaatttgataatattgattatgtttgattggtaggctttaccaaaatatgatagagattttaagagcgaaaaccttcgggacggccaacttttagtaagatagaaatgacaagaacatgtttgatttgttgcattatcaaatcttggtaataccaaaatgctaataccaaaatttggtacaggaacagaatggtcatgaaagttgcaacaatccaaacatgccctatttcttctattatctttgaagggcatttacaatataaaatgagtggtttcatgtttcaacattagatccgagctaccactatcagttgggagagtgatcctgttgagggtgcgcgcaccctattaaatgccttgaaaagtagactattgtgctgagaaatattaaactctctccattttataatatatgacgtcgttgatttttaatgtgacgtttgattatatgttctgtttaaaaagtttatataaatgctatttaattttttatgttttattttatcatataaaactctgacctttacttatatttttaaaaatttacgctaaatttttaataagacgaatagacaaacattatacgaacaaccaacaatgttatatatataaaaagcggaggtagtatttgaaaagagaggaagtatcacacaacataagacccctttctacataaaattctccaacaaaacaactctccattgcttgctccaagaatcaatgcattatgcatgccacacctgcatccctgcaattgtttacaggtgcaacgcaatgcaaggcaccgaaacaaacaaacaaacgaacccagagctagcgatgagtactctgatcccaactcacaagaaaggaagagaaaggcagctttcttgagccaacaacccgtcgtccgttggcatgccaacaaccaccaactcgggagccggcctcgcccgcgcgcaagaagaagaagaggaggaaatcatcaaagccaaagcaatgcaaagcaaagcaaagcatattttggtttggttgtcacctttgcttgcttgcttggccactgtaaccttttcagtgctctgctgcctctgcctctgcctggcctgcagtttttctgcactgcatatttgcatttgcatttgcatttgcccctgaatcctgatgaccctgacgacacacggatagacagacagggcaaccacaacagcaatgtgctcgcggcccaacgcaggcaggcacagaggccatgagagagagtagaaaggaatactagccgaataggaatagtagagtactacaggtctacagcagcggccaaaagagcaggatcctgcaaatcttctccgctgcacgcctaattatccccatcaccatctcattctcacccacctatggccttgtcgcttgctgttctgcctccataatcatcatcatcttcttgctaatactactctattactagctgatgagcttgttaatggcactttaattagtctaaagcaaaaccaccacattattagagcaagtttaatagtataacccactacttagtctaattcatctatagccgatctaatagtcaattcatacaatagttgcttactatactattaatatatggtcccacctatcatacatatattgtgtcttggagtccgtgctgcagctggctacagatctgtagcccactgcttttctttctcatttttatctcattaaaatatatttatagctagcttatgctattttaactgctccatctgccaccttttgagtgagaggaatatagagaaagagagagagagagaatgcagtaggcagcagaagcaaacacgaatctctctctatcagggcatgataggaggagtagcaggataggatgtcatgggcggcatctcagctcagctcaggctcagctagacgctactcgcatcggagcatcacattgccgtgtgccgttgctcgcattgcagctgcagctactactaccattcccacaccttttctagctctctgttccacacctctccctcttgcattgcagccaagacagcaaccagcagcagcagcagctcagctagctagtttctgctttcttg

SEQ ID NO: 49069 - DNA, 3303 bp, Oryza sativa
cctgatctgaatgtagactactacaatgtgtatgttttaatttgaacatcctttttccagagaaatagtttctgatgcataggtgatttaggatttgtacaaaaaacggaaattgaaaggtaataactatagctagtcagatactctattttgtagtttgatgtagttattctttgcaaaataatatatgataccatttctgaacttttcaaccttgaaaaatagtaactatagctagtcagatactctagttttagtttgctgtagttattatttgcaaaataatacaggagatcatttctgaacctttttcaacctgacaacctcgaaatgcagatctcctagtactcctgttgttggttggcctccggttcgaacattcagaagaaatctggctacatccagcaaagcatctcttgaactgcagaatggaaagaaggctgcaaaagcagaagagatcaagagagctccattcataaagataaacatggatggtgtccctattggtagaaagatcgatctgaatgcttttgatagctatgagaagctttctttagcggttgacaagctattccgaggccttcttgcaggtatatgaacctcaactctgttgttttgtaacacaattaaatcattcaattgcgactgcagtttatgatagagtatctgaagagttttccactgatactgaaccatggcactgcataaattatttccttattgttctttcgaaagttcgcaaattatttctttgttattttcagtattttgaaatttgaatggctgagttatcggattagtatctgatccaatgtgttcaatttccgtcgttgtatttaagcccaaagagaccccctcactgctggagcaaaggactgccagcaggaagatgtggcaatatctggcttgctagatggaactggggagtacactttggtttatgaggattatgaaggcgacaaggtgcttgttggaaatgtgccatgggggtgagtttttcgttttaccgttgcattttcagagagtagtaaacaaagttactacttttattggatgctgattatgcaaacagcaatgcttgaaaatgatatgcagtctattccctgtgttttttttaaaaaatttattgattatcaacctgggagaaaataattttaccatcaaactggaccatatgcctcctaactgatagtctgatactgcaattcatgcagaatgtttgtttcttcagttaaaagactgagagtactaaagacatctgacctctcttcatctgtcagtacctctttccaccttagttctattacatcaaactctgttatctccgcattattttgaaatttgttcacgccatgtaatccatgcagctaataacctctggacggaaaagaacagctgctgagtgttgaccttcttttttggagctgctttgacacattcagtgacctgctgtgaagaagaatatgatcttctgagcttgtatcatcgtctctttctctcaatgtcttgctgtgctgatcttttggggttttcctgttcctacttaaccaacttgcttccttctgtttaagacacttgtgtgaagtgagtacaatttgacatggccatcatgtaaatgttcagctaaatgctctacatttatgcagtttattctctggcagatgatatttggaatgttgctttgttgcatgagacccatttaatagttttgttctctgttactggacatgaaattgttgttgctaggaatcaatctatctatctattatatactaaaagtccattaaactttctataaacgttcctaagccgtcacgtggcactcctacaaatgttcctacgtcaccacatggcacagtctaatcttagcgtcgattttcacttaaattggtggacccattattttacactattagatcaaatctattattaaaaaataataacttccgcatgtttataatgtaccagcgctactactgtccgtacgtatgagtttgtacgttacaaatcctactgctgttctctccgtacgtatacaaacgtacatgattgtgaaaacaaaacgataaagtttcctgatcttcgctggaagaaaacaaatacatatacgtatacataagaaagacagaaaaaaacatacatacataataatcaacggtctttttaaaatatgattttctactatataaggataaaatatattacttcacaaatatcaatatgtttagttaaattaagatctataataaatattcaatcaatgttcttttaaaccatcttctaaacctatctatcaaaaaaattattagatctatttttttaaataaaatcttaagttaccttggggcacgtcctataaaaaaggggataatccttggaaattcttagaaaaaataaagcaccttgtcatcagctttcacttaaatcatttagaaaaattagaaaaataaaatctctacctcctcactctcacatctacacaacagtgttgtcccatccctattgttttatctatttttctaaataatgtttgatgtgtttttaaaaataaagtacaaacgcgggtgttcacaacgcacacactcagctctatgaactcacgcatgcacatacccctatgagtacttccgagagactaggctgacatattttgatattgatgaagtcactgtgtacttttcgctgtcgacgggtatgtcacctactactgaaagaatttgtcctagtcctttcgagagactaggctgacatattttgagattgataaagtcactatgcacttctcgctgtcaacgggtacgtcacctactacttaaaagaatttgtccaagtctaggacatgaacccaagtgggcaaattccatcacaatgaacctaaccagttgagctacgtttacttcgcaataatgttggatattaaaacaaccataatttttaagctacatttctggaatactcctatgccttttaaactggtggaatcactatttagaatagttagatctatcttatataagaaaaaacatatgtgtatacatggtacatcacatttcaaaaatattattattcaattatatttcgctttcatgttagcttgcgtagaacttctgacccactccacataaaatgttcataaatggatctcaaattacataaatcatattaggctatataaatcatatatttagtggagcttcatgtcccacccaattaatcctcgaataaaccatgataatatatatgtaattaaaaaaagtaaaataccttagttttattttacacttactttttattgacatgttt

SEQ ID NO: 49070 - DNA, 1609 bp, Oryza sativa
cagagaaatgtggccaaatttgtgcaaacgttgatcagggggcctaaactgaggctccaacgtgtgttgcaacttgcaaatggctcatccgatcagtggccaaagctcagatgtttcatgatgcttttatatgctttaattgggttagtaatttaatatagcacattcaattgttataaaacaaatcagagaagtgagttaaattagtttcaatggttaattggactcatgccattgtaatttcttcaattttgaaaaataccattactattcatctatttaaagacatgctgctataatttgaccaaaattagagatatgccactatgtacccctccaatgcaataagaatttacaccaaattatcccttctccttccttcacttccttcttccttctccctctcaataatctatgtcatctcttccaccggtccatccgtgatcccatcgagtccgctggctgcgccctttcaaacccccctctcaagggaggcccaacttctcaccgtccatccccataccatagagccgcgacctctccatcactagccatcccattgagctcgtggtagataatcgcggatctcgtcgtcctcttggatgacagtggtggcggcggggctgccccgatgaaaaccttggtaactgggatgaccatgtcgaggagcggtttgtggtagccccttcaagctcgaatcttgctgtcaccctttttggagctcccctggcggtggtaggggagaaagcaaagtagaggaggacacgagggggtggttcaccttcaacattagtgtgtgggtggcggaggttctagtgtaaggaagaagggggtgaatgaaggaggggtaatttggttcaaaattttttataagtgcattgaaggggtacgtagtggtatatctctaattttagtcaaattgtaatggcatttttaataagtgaatagtaatgtcatttttttttataaccgaagaagttacaatggcatggatccaatagtttcaatgcttaaacatcgacattatgtgagagaaaaagattcacgtttccaaataactgaacactctgtatttggttaaataattcatgcatctgaaagattataaacttatattacattcagctaggaaagacaatttgctagaaaaaatttactagagataagtataggcatgaagtatattaacaccaaataataataagttgaaactcaacctcatttgagagtactactcaccaaaaaattatcttttttctactaccaaataaagttgagttggccctactaggttatttttcttacaaaatatgggggagttctatacttctactagcacagtgctcgtgtgttgtaacggatgaagtcaattttgattttacatacatactctgcacatgcaagttagtggataaggagtcgaaagcgatgacacatcaaccgaaagcaactccactaaatcgaaccttgtattgtggtgcaacgaattgacactcactacactcatacctatttgattgttgctttaaatccagtcgatttatgattataagaaagatattgataccaccttgaaataaaattgctttttattgactcctatatttat

SEQ ID NO: 49071 - DNA, 2511 bp, Oryza sativa
gagtcgtggcccttaagaaaagagaattccgagagttgaagcaaggcaaccgctccgtgacggagtatttgcatgagttcaacaacctggcccgttacgccccggaggatgtgcgggaagatgaggagaagcaagagaagttcttggcaggaatggaccctgagctgtccgtccgtctagtctctggggactatccggatttccaacgtctggtggacaagagcatccgcttggaagccaagcacaaggaactggagtcgcacaagcgccgcttggcgaatttccgcaatcaacagggtgctaaccaaagggtccgctacaccaatccctatcagggggatcctcctcgcagcagcaacaacagcagcagcaacctcgctccgcgcctcgacctcaattcgtggtgcgcgtcccacagccgcagcagcagcagaatcaacaagggactcgtgcgccccgtcctcctacaccaactgtgcagcctggtcaaggccgcaaggacgctcaaggtccgcagcgtctgtgcttcaactgcttcgagcccgggcactttgcggataaatgcccaaagccgaggcgtcagcaaggccaagcgcctccccgctccaacaacggtgggaaggatgtcattcggggtcgggtgaaccacgtgacggccgaggacgtgctgacaactccagacgtcatcgttggtacgttcctcattcattccatccctgccaccattctgttcgactctggagcttcccactcgtttatatctgtgccattcgtggggagaaatcagttgggggtagaaaggcttaggaaccctctgctcatcaccacccctggaggggttatgacagcaaagtattatagccctgccgtccccatagaaattcaggggattccttttccctcggatctgattctgctagacaccaagaacttggatgtgatccttgggatgaattggttggctcaattccaaggagtagtggattgtgcgagacgcactgtcactctgtaccgagggccggaacaaccggttgttttctttgcacccccaacctctgtcagtagttcagaactccatcagataggactgttagaaatccccatcgtcagagagttcggagacgtgtttccgaaagaactacccggcatgccgcccaaacgagagattgagttccggatagatcttgctccaggaaccactcctctgtacaagcgaccctaccgtatggcagcaaatgaactggccgaagtcaagaaacagttggaagagttgaaagaaaaggggtatatacgtccgagtacttccccctggggtgctcctgtgatttttgtggagaagaaagacaagacgaagaggatgtgcgttgactacagagctctcaatgaagtcaccatcaaaaacaagtaccctcttccccggatcgatgatctgttcgatcagcttaaaggtgccactgtattctccaagatcgatcttcgttccggatatcaccaattacgtattcgtgatgaagatattccgaagaccgcattcaccacgcgatacggactgtatgaattcacggtgatgtcattcggtttaaccaatgctcctgccttcttcatgaacttaatgaacaaagtgttcatggaatacttggataagtttgttgtggttttcattgatgacattctgatatactcacaatccgaggaagaccatcagcaccatctccgtctggtattgggaaagttgcgggaacatcaattgtatgccaaacttagcaagtgtgagttctggttgtccgaagtcaaattcttagggcacgtgatatctgctaaaggagttgctgtggaccccgaaacagtgaccgccgtcactgattggaagcaacccaagacagtcactcaagtccgcagtttcttaggtttggcaggatactgccggaggttcatcgagaacttctccaaaatcgctcgacccatgacacagttgttgaagaaagaagagaaatttgtgtggagcccgcaatgcgagaaggcgttcaaacttctcaaagaaaagctggttgtctcgccagtgttaatcttgccggatactcgcaaggatttcatggtgtattgtgacgcttcgcgccaaggattggggtgcgtgctcatgcaggatggtcatgtggtggtgtatgcctcacgccagctacggcctcatgaaggcaactaccctacccatgatttggagttagctgcggtggttcatgctctaaaaatctggcggcactatctcattgggaatcgctgtgaaatatatactgatcataagagtttgaaatacatcttcactcagtcggacctgaatcttcggcaaaggagatggttagaactcatcaaggattatgatgtgggaattcactgtcatcctggtaaggccaacgtggtcgccgacgctctaagtcgaaaaagccattgcaacactcttaacgtccgtggcattccacccgaacttagtcaacagatggaagccctgaacctaag

SEQ ID NO: 49072 - DNA, 1810 bp, Oryza sativa
  unsure (1)..(1810): unsure at all n locations
atgttgcagaaaaattgtgagaaacatcaatcatatgatttttcctttgtttcaaatgggttctaaaatctatatttttgaacatgttaatttattcgaaattttcaagcactcatctctacaagtaaacataacttaaaacaatcacgttctgaaacaaaatttatttttacttctatgccttcggcaattggacacaaatatggtggacacacttttacccttacacaacccgtttgttccctgcacactctacagtagaagtacataatttacagcgaggtgtcacatcggttttaaaccggatgcgctatggcagcagcgacttgtgttggttccccttgccctaccccttctcttccctaaggccttatttggtttggagggaattaaagaggattgaaagagattgagggagaataatttcacaccacaataggtgtgaaataaatcccctctaattcctcccttatggagattatccgaacaaagcctaaagcagcggcggcaagtacccccgtcttgccgtctattccatctccagcggctctccaccaccaggtccacaaccgatcacggtgtcctaatcataagctctaatcatggccatgactccaaactcattgatcttcctttttccccttcccctcaacctcctcccataaccccctttttcactacgctgtacagtagaagtagaaaacgttacatccaactacataatttacagcgactcgtgtagttgccacgtcagcttaaactggatgcgccacgaaactgccgctttcctcgtcgccggggccggcgccccacattttcccggccgtcgttcccgccgacgagctcttccccttcccgtctttcttccccttcgataacgacggtgcgccgccggagtcatcgcggcaggcggccgccacgctggacgtacggtcgtactggaccagctgctcgagcacctccttcatcgtcggccgcgacgccgggtcgtcgccggtgcaaatcatgccgagcaggaacaccggcacggcgtcctccaggaacgccggcctgtcctggatggcctcgtcgacgacgtcgggcagcttcggcggccgggccctttggggttaaccccccgggggcccccgggcacgcccacttggcaggcaccagtccgggccggcggtgttcgccacccagccccgtcgtcagctccagcagcacgacgccgaacgcgtacacgtccaccttctcgttcaccttcgctctgcacccgtactctgcgaccgcgagacagacatatcgtcgaacacttgactctcatgagctagctcgatcgatggcgagcaaatcaaatcaaattaacgaacaacaatcttgtgatgaacctcacctggagccatgtagccgaaggtgccaccgatggcggagatggaattcggctcgccggacttggcgaggatcctggcgaggccgaagtcggcgatcttggcgcggaaggccgggtcgagcangatgttgctggacttgacgtcgcggtgcatgatcggctgcgcgcactcgtggtgcatgtagctgagccccctcgccgcgtcgatggcgatgcagagccgcgtcggccactggagcggcgccgtcggcgcgccgccgtcgtcgcggcggtgcagccaccggtcgaggctgccgttctccatgtactcgtagacgagcagctttgtgtcgtcgccggagatgcagcagaggaggtcgatgatgttgatgtggcttaccctccccgaggatcctcaccttcggcgcgaaactcttggtngctcttcgcgtccgactt

SEQ ID NO: 49073 - DNA, 944 bp, Oryza sativa
ccatggttgccgaggaagctacgatcgtaggcgccgttttgcagcgtctccgggacctcgccggagagctggttagaagaaaggttgagaaagttgagatggagattgctgaaatcttgaggtatgtcgccggtgagcccgttgtcggaaagaggtcaagaatgtagaggcccatccacccgactgcggcagggatctcaccggaaatctggtttctgctaaggttgagggaggtcagacttgtcaatgatttgatagacggcggaatcgagccggataactggttgccggcgaggttcaactcggtgaggttggcaagcctagacatgtcagctggcagttcaccggagaactggttgttctccgccgtgaaactcttcagaccgacggcggtcgacgggagggcaccggagaagcgattgttctccatctcaatcctcgagatgttaaatgatatctcactgggtagagtgccggtgaagttgttgttgtaaatcatgacattggtgagcaactcgaatgaccatatcttcttgggaaagtccccaacaaagtggttgttgtatgccatgatgttgttgatggttttgcaatccccaaggttcgtcgggaacacgccggagaagctattgttgaacaccacaatgtcaaagagcttcttattgaagcaaagtgtatccggtagctcaccagagaggttgttgttggacacctcaaaattccccaattctgaatgttttccaagctccgcgggtaggggcccagagagcttgttattgaagagacggatgtcggtgaggtccggcatcataccaacaccagccgggatgggtccagtgagattgttgtagtacaaatatagtaatctcaacttcttcaagtttgcaatgtcctctggtattgatccagagaacttgttcatggacaggtcaagctcctgcagg

SEQ ID NO: 49074 - DNA, 3205 bp, Oryza sativa
aaaattacggaacaaatcacacgacaatatctcctaaactctcaagatgacattctctcgttgtttagaagtcaactaaatagttatgaaaatttttttaaaaaaaattaacaagactgattattatgataaatcactctacaaatatacaagttaaaatttaacttctacaagttccaacagaaaaaacaaattaaactatgactagttaacgtatattcgtaattaatttttttattgcagaagttaaatttgaccatgtttatgaagtggtttatcatatattaatctatcttgttgaatttttttaaaaaaaatcataactaattgggtaacatgcaaacaccgagagaaaatcctgtcaagagtttaaaatagttttgcaatctctatcctttctatacgcaagctatctttgcgacgaatattagccatttagcattatcaaattttagtagggcagagaaccggaagttcgagatattcgcacgtctgcttcagctggttgtggacaaagaggtgactccgtgactccccgtcgtccgcttgtcctattgaagtattgatgatagagcttgatgactgatgagtgaacgacatcggctgaactcgcagaagaattctctaacgccgacgatccagtcataatcagtgcggaaactttaagctttctgctcttataacccactgtcgatctggccatttgtacaaacgaagggacgggtgtgtaaagttttggcattgtcacatcaggtattatgtaggatgtcgcatgagatgtttgggcactaataaaaaaactactccctccgtattttaatgtatgacaccgttgactttataaccaagatttgaccactcgtcttattcataatttttatgcaaatataaaaatacttatgtcatgcttaaagaacatttaatgataaatcaagtcacaataaaataaattataattacataaatttttttaataagacgaaagatcaaacgtttgtcaaaaagtcaacggcgtcatacatataatatggagggagtaattacagaatccgccagtaaaccccgagacgaatttattaaggctaattaatctattattagtaaatgtttattgtagcactacattgtcaaatctagagcaattaggcttaaaagattcgtctcgcaaattagtcgcaatctgtgcaattaattattttttagccaagactacctctatcccatattacttgttgcttggacttttttcttacaacatttgaccattcattttatttgaaaaattagtgcaagcacaaaaataataagtcaaactcacagtgcttttgataatagagcaagtcgcactcaaaataaataatacttccaaaatttttttgaataagacgaatgatcaaacactacaaacaaaaactcaaagcagcaaataatatgggacggaggtagtatttaatacttcatgcaggtattcaaacattcaatgtgacagggtaaaaaacgttcgatgcgatggggtgaaaatttttgggatgggatctaaggtgtgtttaggctgtgtttagttcctgaaattggagaaaagtttggggaaagttgagagtttatgtgtgtagaaaagttttggatgtgatgtgatgtgatgaaaaattgagagttgggggaagtttggtgtgaactaaacagggccttagtttacgccaaaattaaaagtttgattgaattagaacaatgtgacggagaagttggaagtttgtgcgtagtaaaattttaatataatagaaaagttgaaaagtttaaaaaaaaaagttgggactaaacgaggccctaagcagccccgaaaaagagagaacatctctctttatgtcagaaccatggtgcattcagcagcaatcttcctgagggcatgtgcatcactgattcactgtcaccggctggcatgcgtggtggctgtttcgcttgtgaggctgttcgtgtgccaaactttttttaaatatacgaatacaagtaataaatatagactaataataaaataaattacagattccgcctgtaaactgcgagatgaatttattaagtttaattaatttatcattagcaaatgtttattgtaacatcacattattaaattatggcgtaattaggctcaaacgattcgtctcgtaatttacagttaaactgttcaattgatttttttgtctacatttaatacttaatacatgtgttcaaacattcggggctactttggtttgtgacctaaattggccttaccaatttttggcaatgccaaattttggcaagttttgatacgaaaaattttgagaaggcaaagttgtgtttggattgaagccaaaatagcctaagttaactattgaaatagcctattttcttaggcatgccaaaatttagcttcaaatcaaatagacactaaatactattaaaattgtcaaattttggggttaaaaaaggggccaaattaggccttagaccaaaccagtccttgattttacggaaaagttgtgtgtagctgcctgcagtgcaagtgattggtttgtcagaagtcatcaagtcaaagtcttctccaccaataatgtaattgtcattgtcactgtaactgtagttgcagtggcccacctagactattccacttctagaaggatttattttagtgcttaatacttttatcgtaaataaacaaattaaacacgaaaagtaacacatcatgctactgtaagtttggataggctaatatgtgttacagtacatctgtattacatctgtgtttagttccacgctaaaattaaaagtttaaaaaaattagaatgatgtgacagaaaagttgaaagtttatgtgtgtagaaaagttcgatttaacggaaaaattagaagtttgaagaaaaaaaagttaaaatctgaacagagcctatgtttgttcattttaaagagagggagtattaattattgtttgttcattttaaaacagagagagtattgattattgtagggtctacttggaatacatacagcattacttctacttctatgtacagcatgggcaactggcattggtcaccattgacctatttttatattaataaagcactaaaataactagaaaaaaggtgatgctgcaaaaagtattgcccaatggtacataacggtccatatagattattacgaagtactagtggcccggcgaaaaacgaag

SEQ ID NO: 49075 - DNA, 5847 bp, Oryza sativa
  unsure (1)..(5847): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtagtgcttgtcaagccggcaagcaagttgcatgttctcatcctactaagagtatcatgtccacatctagaccattggagctcttgcatatggatttgtttggcccaacaacctataagagcattggtcgtaatagtcattgtcttgtgattgttgatgattattctcgctatacttgggtgttctttttgcatgataagtctattgttgccgagattttcaaaaagtttgcaaaaagggcccaaaatgaatttagttgcactcttgtgaaaattagaagtgacaatggttccgaatttaagaataccaatatcgaggactattgtgatgatcttggtatcaaacacgaactttccgctacctactcacctcaacaaaatggtgtagtggaaaggaaaaatcgtacattgattgagatggtaaggactatgctagatgaatatggtgtttccgattccttttgggcggaagccataaacaccgcttgccatgcaaccaataggctttatttgcatcgtctcttgaaaaagacttcctatgagctaattgctgggaggaagccaaatgtcgcctattttcgagtttttggttgcaagtgttatatttaccgaaagggtgttagactaaccaaatttgaaagtcggtgtgatgaagggtttcttctaggttatgcctcaaatagcaaggcataccgggtctacaacaagaacaaaggtattgtggaagaaaccgccgatgttcaatttgatgagactaatggctcccaagaggggcacgagaatttggatgatgtaggtgatgaaggcttgatgagagctatgaagaacatgtctattggagatgtcaagcctattgaagtggaagacaagccatccacctccactcaagaagagccatctacttccgcctcgtcaagtcaagctcaagttgaagtggaggaggagaaggcacaagatccacctatgcctccaagaatacacaccgctctttccaaggatcacccaattgaccaagtgttgggtgacattagtaagggtgttcaaactcgatctcgtgtcgcttcgatttgtgaacattactcgtttgtttcttgtcttgaaccaaaacatgtagatgaagctctttgtgatccggattggatgaatgctatgcatgaagagctcaacaactttgcaagaaacaagttgtggactttggttgaaagacctagagaccataatgtcatagggacaaaatggatctttaggaacaaacaagatgagaatggattgatggtgagaaacaaggcaaggttggtggcgcaaggtttcacacaagttgaaggtttggactttggtgaaacttttgcccccgtggcaagacttgaggctattcgcatccttcttgcatttgcatcatgctttgatataaaactatttcaaatggatgtgaaaagtgcttttctaaatggtgaaattgccgaacttgtctttgttgaacaacctcccggttttgaagatcctaaaaatcctaaccatgtttacaaactctcaaaagctctttatggtttaaaacaagctcctagggcttggtatgaaagattgagagattttcttttgtcaaaggatttcaaaattagaaaagttgacaccactcttttcacaaaaatcattggtgatgatttctttgtgtgtcaaatttatgttgatgacatcatattcggttctactaatgaggtattttgcaaggaatttggtgatatgatgtctagggaatttgagatgtccatgattggagagttgagcttcttccttggacttcaaatcaagcaactcaaggatgggacgttcgtgagccaaaccaagtacatcaaggatctactcaagaggtttggcttggaggatgcgaagcccatcaagacacctatggcaaccaacggacatcttgaccttgatgagggaggtaaaccggtagatttaaagctttatcgttccatgattggtagcttgctttaccttaccgcatctaggccggatatcatgtttagtgtttgcatgtgtgcacggtttcaagccgctcctaaggagtgtcacttagtggccgtgaaaatgattctaagatatttaaagcattcctctactattggcttgtggtacccaaaaggtgctaaatttaagcttgttggctattccgattcggattatgccggttgcaaagtggatagaaagagcacatccggtagttgccaaatgcttggtagatcccttgtgtcatggtcattcaagaaacaaaactccgtagccatctctaccgccgaggcggaatatgtttcggcgggtagttgttgtgcccaattgctttggatgaaacaaaccttgttggactatggtatatccttcaccaaaaccccactcctatgtgacaatgatagtgccataaaaatagccaataacccggtccaacattctagaaccaagcatattgacattcgccatcacttcctaagagaccatgttaccaagtgtgacatagtcattagccacataagaaccgaggatcaactagccgatatttttaccaagcctcttgatgaaacccgcttttgcaagttgaggaatgagttaaatgtcatagacttctctaatgtggcatgagatggtgcaccatggttgcttcttttgcaattgtatatttgctcctatttgctcttatgctttggacttattgccatttggttcttcattgcgaaaatggagcatgtcacattaagggggagttttggactcttgcatgtgctctacttccttttatatgtgagcaaatcaactaaaagtgctagtagtgttttcaaaatgcccaagtcaacataagtcaaaagttttgcaaaatcaatgaaatttgaaaactatctcttggaaaatgtttcaaaagggtccctatatgttttccaagcctcacattgctagaaaaatgatttttgaatgaaaaatgctattttggctctcttttgaagaatctagattcttgtttttggccaaaatgagattaaaccccaaaatgagtttgagaaggaatctgagaaaagtttcaaaacaaagttggtagagaggaggatttgaaatgtttttggtattcaaatcatattcaaaatccaaatatttcaaaagttgtttgaaaatcaaattcgcccaaaaacccctatagaccataaatggtcacctcctagcactcaagtaagttttgttgcaaatcttcataaatttcaaatattatgaatggttggcaatatttcaactcacacatttcaaaattgctccaaaattcaaatttttgttgaattttattgtatgggggtagccgaactgtgcaagggctatgcacagtcggctggggggccaggcggtctgaccggcgctatatgcgcggtctgaccggcctggtggtggcggtctgaccggcctctaggaaccggtctgaccggctgcatcctggcggtctgaccggccacgtatagccggtctgaccggccagggatggtgggcccaggactttgtcctttcttcctcctcctccttctacccgacccctcctcatcccatctcatctcttctcttctccaactcaaaaaaactcctcctctctcctctcccaaaccctagccacctccctccaccaaatccatccggttcaactgtcaaaatcactccggttacaccataagtaaatctcctcctcttcctctctctattccatggattgatttgagttcttattgagtttgtgatccatggcatggaaccctaggtgaaggaagaggtgttcatcgatttgcaccaatagagggtagtttcttggtgtgattcaactccttcaaccggtaaatccctctccctcttgtgcattgctctcaaatcggtctatttcaatctttagggttaagggtagttttcccattgcttcaatagacctacaccttgatgttctagttccaatcttgtgcaacactgttctagcaatttttagaatcatttgtgtggattgtggaaggatttgggtgtgctcgtgtcagtggcggtctgaccggacgcggtctgaccggccgagggccggcggtctgaccggccttgaaccgttggtctgaccggccgtggctctcggtctgaccgcccctgacaggcagcactcgcccttcctcccacttcactatgtggtttctaaaattgttgctcatccatcctttgctccttgtttttcagctatgcctccccgcactcggcatggtcgtcgtgctcccacgcccgatcccgttagtgagaatgaggaatcaagcggagatgagtatgttcaaagtgatgaggacaatatggaaaatgttgagggtgatgagatggaagtaagtgatgatggtgatgacaatgagagtgcaaatggtgaagatgatgaggcaagtgatgatgggagtcctctcgattcctcgatccaatttgtgcttaatttgaggaatgctcaacaatacactatcctccgtcatcatgatcaattccggaggcctaacgattgtaatgatccaagatttcatacacggttccaaaagtccgtgtatgtacaagtgtatgccaacaaagccttcgccgaacacaaatggatctcttggaggcacattggtgagacaccggagtttgagaatttgcaagagatgttccggaccattgggattgatagaattgtcaccatgaagcaaccttttgatgaagatctcatccggcaattctatgccaccgtatgggtgtccggcgattgtgatgcaatgaagtggatgtcggggaccctccgatgctctatcaaccgccgtgaattcaaggagctcttgcacattcgcttcaacaacggggatgaccttcatgatgagcacacccacaatctctttcccattgatcacttttctcagttttatgaagaagggggaaggcacacatatggaaaggtggcgggtttaagggctctcccaagtgtgatcaaccgcatagtaagggccaccatcctcccaagatacggcaacaatgatgacatacgcggagttgcttggcatgttattgatgccattatggatggtcgtcggtttgatgttatcaaccttatgatgaaggagattgccatctcaaaggggactattggacaaggaatctattatgctccctacataatgaggttgattcaaagcaagttgggacaaattggtcaaaatttaaaagaacataaggagtacaagcctcgtctccaactctcctcccctagagctcctcgtgtgcgccaaccaacttttgatcaaggtgcaagctaaagtgcagcccccctcctcctcaagggtatgatccaagtactttattccatccacaatatgcctactttggaatgcaaccaaatgacttctttaacccggtccttggggctattaataccctcagtgaaagcattcaacgcttatccaccgggcatgaaccattgcgtgaggatgttcgtggcttg

SEQ ID NO: 49076 - DNA, 2485 bp, Oryza sativa
  unsure (1)..(2485): unsure at all n locations
ggggcgcttttccaacggccgcatccccgttgactacatcggtacgcgccccccaccttttcgatcggcggcgccatggctgtggcccctttgctctctcgtgaatcctccccccccccgcttcaaaggttgcaggtggttctggaatcgtcgatccgatgctgctttgcctttcgtacgcctatggatgcagcatgttgtgggtttagtgtaatctgggttttgggtttctggtatacgaaggttttgcttagttgttggttcctatgaatttggggcatctgatctcatacatcgggggtatgtggatttttgcccaacaattgctgaagntgaagagtaatcagttcatagcactctcctacacagctgaccacctggatctcacatacatagactcctgcggcttcctctccttgatctcacatagcaatgttgtgggtttagtgtaatctgggtattcgggtctctcgcatgcgaggggcttgctcagttgttggttcgtctgtgggtttctgccgaacaattgctgaagctgaagagtaaccagttttgcagcacaaccaccacagtctgggcatcatttgatcctgctgttcttagcactcctgcagagctgaccacctggatctcacgtatctatatagaatcctgcggcttcctctccaaatcagtatccagtatccaccaccgttatcagccgttgaggcaatgcattggcagaatgccagaacattaagaagtgccatcataatgtacaccattagtccatgcatccagaaaacattgccagaatcctgcaatgtatccatttgatagtcctgagtcccgaccagttgtctacatgctccagtctctttgccaccacacactgttaaatctctcttgtccaatgtccaccacattctggacagtttcaaggtcctcacaggaagcacagctgcacaacctttgttaatgttgctttaagaaagtcatatctactcattagtttctttgggagagtaaggagggaaaaggcataggaaagaaacatttaactagggctactggctcactatgtgaaagatgtttcccttcaatttcatttagctggtgttctttatctcttttgcccgtctctgtcagtacttatgtttttcatgaatcaatagtatcttgttctttcttctgtttttaaattattttttccgtgatttcttaatcttaaacttttttgtgcatttgcagcaaaaaagctggggcttccttttgtgcctccataccttgaacagaacatgcgcatgggtgtcggcagtgtcgacctcagcaacattgatgggatgatacaaggtgtcaactatgcatccgcggcagctggcattctctccagcagtggttctgagctggttgtcctcctaacttcccaacaactctatttcacgcttataatctagcaggaatgtctttgtgagacccttctctagaggacgaatcagaaggagggtgtttcaacaacagactagaagcaatgactcttctcatagtgtctacatcctctctagttaggaagaatacttgctcaaccatttgaactaatgctgaaagattctcctgttcggctgctcccttccttccatgtgttccaactagtgtggattatcagggcatcaaattcccttcttagttcctaggaattcatgacttatatatgcttcctaccagatgtgagattgtctacacgagacgattgatatgctggtgctgatggggggtttatttatgctgctggccttgtccaagtttgcttgtgaagctacagtgctataagttgtatggttgttttattttcctgcacgcataaagcaaaaggagatatatgtagccatctactcaaagctaatttatcataatttttttattgtctgaaactaaaaaactgcatttgttctatactatggcttttgggatgatcaaggagttagtaagaatcactgatccggcaccaatgtgatgaaattgatgtatatcatcctgaacattccattttcatatcaatctttattcctgcttatgttgttgaatctccaatctttgtgcccaaaacaacaaaaacttgtggagctgcaaatgctaattttgtcattttcaataaaacatcatggtggtgtctaaagaggagaaatgtttacgtatgaacattgctgcaaagttttcctttatgtggctatatgttttaactttctataaaggattggagcctcttggttagagtcaagcttgttgatttgcataccttttcattattcttaaatgtacttgaaactaaatcgacatgatcattaactatataacaccagtctaaagaacaccaatctaaagaacacacttaatgcttctctatgaaggtttctcttttggtatgtaatacttgctcatcggatgtatccttttttgttactattttgtctcgtgaactatacatttgaagattattttgtggtgg

SEQ ID NO: 49077 - DNA, 4682 bp, Oryza sativa
tctcttgtgtatcaagccttcaggctaggggtgtaagtggctaacccgcgaaacccacttataggcgaaaataagccgcgaacccgtttattttgacctataagtgggttcgcggctgacccacttacagccctacttcaggcacatgaggatcaatcatttcatagtgtgactatttgtagttatctgtatggccgtaaataatggcctctatattgttctgtattggagtatctctctactatttttttctctgaagaagagcattcttttacctatttttggttttcataatttaatgtgatgcataatttgattctgttcttttttagataaaggaggctaatttgattctgttcttgcaattgtggatgcactgcagggaatgcatgtgtcgctgagccagcaggtgcagcaggttgaggacacatatgagcagctctctctggctctcggggaggcagcaacaactgaccttttcagaaagtccgtgttctttttctcaatcgggagcaacgacttcatccactattacctgcgcaatgtgtctggcgtccagatgcgttacctcccatgggagttcaaccagcttcttgtcaatgcaatgaggcaggaaatcaaggtgtggttattgttctccagtttattctctctgtgcaacatttcttgcctccttatgattccagttttagttttttgatcagtgtgttgcatattgcccaaaggctgtagtatcgtgcttagcagtggccaatgttgtgagtatgaatttgatccgtaatttacggcccgtaaatattctgtgcttgaaaggtatctgctctcagttccaccacccagatgtgaatagttctttgtactcctggttaggaatatgtttgagaaaaggaggagtgtggacctctggggactgcagatacatgaattatggaaaactagctatgaacattaatttttatgtttcaagggctagaaaattttcaaatgtttatagagaaacctgatatagtacactttttctgtaggttaaagttttcaaatggtggatgagtttaaaaccgtgtacagttttggactgaagcttctttgagttactgaaatcctcaggctgtacagtttttctgtagttatgaattaggttaaaaggataggagggtatttcatctgtacatttgtaatatgggaaagttaactgataaatacatggaattgattaactcaatggatatttatatcgttggctgttagcagttctgtggtgttatgtactttacattctccgtctaccgtaccttaatttcagatttgaggtagtacgttgcaacgttgctcaacaaggacatacttgttttttatatgttcattttgaattcttaacattttgatcagataaggcggccccaaatctgatagggactgatgtaaagtcgatactgaatattgtcttggactgaatactgtgtttgagtcccttagttcttggtctgcgcatacttccagagtggattgtactttgtactgcctcccatttggaagtgcaagctaaatgcgtgttacttttgctcaacttgtaggacaccatgcacactaccaatatgcccatgatcttaccatgatacaaacataattctcacatcatgcataaatgcataatgcacaatttgattttctccctaatttatcccctttccttttttgaacggataattttaatttgcaaaagaattggtaaaaatggccccaaatttctattcagtaaatctttggcagagcatgcgatgcacattgattgaggctgcatgcgccatgagtttatttgtactgtccaacatttgagagcagaaatttctgttaccattgtactcatccaagttgacttgagatgttgctttcttgtttcttaaccttagtaaatcagttacaatgatgcatttttttattatttagccatatgcagttcttgtcagattagattattaagctatttatatctatatataagagttctgtacttcctgcagaatttgtacaatatcaatgttcggaaggtcgtcatgatgggcctccctcctgttggctgcgcacctcactttctctgggagtacggcagtcaagacggggaatgcatcgactacatcaataacgtcgtgattcagttcaactatgccctgagatacatgtctagtgaattcatccgccagcacccaggctctatgatcagttactgtgatacttttgaggggtctgtggacatactgaagaatcgtgaccgctacggtgagcagatgtatcattgttactactgtcagattgcctttctggccttagggaagaactcacattacgatggaatcacattgtgcaggttttctgaccaccactgatgcctgctgtgggctggggaagtatgggggcctgttcatgtgtgttcttccacagatggcgtgcagcgacgcgtcgagccatgtctggtgggacgagttccaccccacggatgctgtgaaccgaatcctggctgataatgtgtggtctggtgagcataccaagatgtgctatcctgtggatttgcagcagatggtaaaactcaagtagaactgaaccaacccttaaactccattgtagttacttgctcagcttttgtgattttctgaccaaaaaatgaaaaacttaacaaggcggcacggagaagtgtatatcttgagagctagtaaaattttttcgtagatacagatttgtgtagaaataccatgttcatatgtgggcactgcactgtaaaggatctgtatggccaaactgcatgaggtgcttggtaggtgaacataaaacattgctgagaactcacctggtgtgcttaactccccaattctcacatgttttgtttaacttctgatacggttatagatttatggtgaaatgttattatgtgttgcagttttctgcttttctggtgaatccatatgggcaacatcaaaggtatttccaagaacacaagttttatggtactctggtactagctatgttctgttatcaactgatttatcctcttatagatcaaaacactgcttccactgcctcctactgcactaatcaacaagcagtaacatcttgtcctgctttacacggtcagtttacaaaatacagccttgcccataacagagagacaaattacaacctccatatcaacatgccccttaattacaatcaactcctcagctgaccaccttgtagcttgtttagattctgatttgcaatcctatccttccaagtgctgacagctggagctctctctgttgctgcaactagagaaactctgaattccaaagctctgtatctgaagtcctgatgctttagcaagctgagctatctctcttcccatggtttggccatactcataagagaaaaatataaggaagagcatggagagtagctgagtagccatggatgctacaactcttcatcatcaactccagagttgagaacaaaactggggaatgccattgttatgtccctgaacacgaaaatcgacaaggcaatacatcagaatttcatttatagttgaaagcaatgtaaaaggtaactacggtgaagagaaacctgaaaaattgtagatggtacttacttcaggtatgggagggtcatgttcttcagcaaagcagggtttttacttgcgaacgccttccattcatccgggtcgatcttcccgtcgctgtttaagtctgcttgcttgaacgtctgtcaaaaagtagcataaattcaaacttcagttatatggggaagaaataaattgagactagtattacatcttcatgtgctttacctgatccacaatctgctcaacagcgtcatcagaaaggagcagatctgattcattcagaatggcgagcaccatttcgtacaactgcttgattcataagggaaaaaaaaagaggtttcagtaactttaggattttctctgtcaaaatgaaaatgcagtacaaatattgttccgaaacaatactttgtatctccagttttccacgctcagcctctggatgttttaggatttaaacaagtctttaacagggttcaatacatatattcttcaccatttatacaaccattatttatgcatgttttctttgatatcgccaagaaaactggtgtaccatcgccatcagtactgaaggctagctatgcatggaaattacattatgttttgttatttctacaaaatatagccaattagtcatattctttagataatggaagctttattgaacccagccaattacacatcaaggtgttcaatggaaagaattaaggatattgtttagtaactcaatatacctcttcacgttcgatgtatccagttcctctcagatcatacaatctaaatgcaactgcaagagggaatactgtcagatgccaaaccaagaagtgatatatgaataaaatgaagattgatatgacatgaacagaagacaaaatttgactgcaaacaactccaggatgttgaaaagcaaatcatgacaaaagatgaagatgatcttggcttataccagaatactctgaccaactaactgacttatttctgcttctatcttttaaaaatccttgattaccagcaagtattgttttgaggtagttttaatattagcgactaagctatttcttaagacaactgagaaaagagggctgcagga

SEQ ID NO: 49078 - DNA, 1014 bp, Oryza sativa
tgatgctactttagcagcccaacttcacaccaaagcacatctttttccgcatcacgtgtcacttcggtctaggtctgttgccattggttaaacactcgattgttcctttccttctaaatcaaccaggtggctaaagtgacgatggtgtcgaatcctcggtgaagctacccgcttactttcttcttgcactcacaccaccatgagaggaagaaagtttttttttttgcaaagaagcatggatgcccgatggcgatcaggatcagctgccaaaattgatgagatacatgtttcgatgtgatcaattgtttcttcctgttgatcataaagcacacttaaggctgggtgaggcaaacctcgcttactcagccaatcggtcatccaacatcgtcagttagcaactaaccatgcaaagtactagcaacgctaggggcttttctctcccaaattaggaatgttgggaagttgacactctcaaagaacatcgcattgtaagcagatcacatcgagtagcatccagggctctcccgatgccaggtgaagaagtctggatgctcttggctcaagtcaatcgagaaaatcatcagccagaccttggtattctaggattgccggaattatttaatttctattgatactggcgcattagtgcattactacacaccggtagttccatctctcatacatatgtccttgcatgtgcaatcattcctccttatccatgtttactaaggtggcatacacgtgccaagtgtctttgcagaattttagtccataattaataatatataacttaatttttagagaacttttaaccaattttttttaaaaaaaactcaatatgtagaactatggacacaagctaaggtttatatcaacgttattaaaaaacacataacaaataactgtgcttggaataaggatggtaccaaaattaacacaagacaggtagactatttaggatgttaaagacgaaaaagaagcacatggaagataatttggtcaaattcatctcga

SEQ ID NO: 49079 - DNA, 18099 bp, Oryza sativa
gggaacaaccgcaagaagccgcggttcgacgcgggggaggaggaggaggaggagctcgcccggatgccgctcgccgacgccttcgtcggcgccggcagcagcggggacggggacggcgcggcggcgggggcggggggttgcgccgccgccccgagcgtggagctcctggacatcgtgcagcacccgctcccgggctacggggcgcccgtggcgcttagcttcagccccgacgaccgccgggtggccttcctgtacagccccgacggcacgcttcaccggaatgtgtacgccttcgaccccgcgcagcggcgccaggagctcctcttcgggccccccgacggcggcggcctcgaggaggggaacctctccgccgaggagcgcctccgccgcgagcgcgcacgggagcgcggcctcggcgtcacgcgctacgagtggcgcgcccgcctccccggcacccccgcctcccgcgccggcattgtcgtgccgctcccctctggggttcgtatctctcaaaccgcaaaccctttcccccatttagttcttccttgatttatattattaccaattcagttgagttagtaacttagtattagatgatacgcattgccctaatcaaattcggtagttttatacttttatccttgtgtattggaccactttctcggattaaggatttggtatgaggttgacattctgattttgctatcagcaactgcacatggataggcttaggctcattaatttccgtttcgagtgttgaattaatggaaggctggtattggttttgtggggcagtgttgggtgaccattattatggttctggtttggatgtcgcgggatgagccatatttgctctgtagtcgttagtgatggctatgaagttgagtttatcagtgcctgcaggtctgtgcttgagatcgcacttcctgcattcttggtatagtgctgcatcttgtattggtggattaggtagctgacatgttcctaaatagtgatctcgctactgattcaaagaaataaaactcctctgttgtgttgattattgtcatctatggttagttttgtgttgtcagcgtatcatggatattctttttctggtagtttttgatgtttcagataacctttgtaaattttcaaggatgctaaatatcatgagtttcatggaaatatatcttttctatttccataggtttacttccaggatttgtctggtgctgaacctgtactcaagctgcaaagttcagccacatcccccatcattgacccacatctgtctccagatgggagcatgattgcgtatgtgcgggatgatgagttgcatacagtggggttctctgatgggcaaactacccagttgacctatggtgcaagcgaaagtgggaaggtacttctttggagttctgttaatgatactcacattttaataggaatatgtgtgcattgtgttgtttgttatcataccaagtcttgttgagcaggttgcaaagaaaagtttcatgttgactttctagaagtttattagctttattcttggcatgtaacccaacatgactatcattggaactagcatgtaacccaacatgactatcattggaactaagcaatatattgattttttttgtcaacaatatattcaatgtgttatagttcaaatatttctttctacctcttggtagggattgttttttggttgaaccaaagtaagcttaatccatagccaaagtccaaacagtgggatatttaccttccaaagacacacagcagccgaaactattgcaggaggctggcggtgtttataaagactacaagttttataagttagtcttttaaccaaactttagagggtgttctagttaactgccgccattagtgctatggctcaaataagcttctaggataaacttgcctgctaaaagaactttatgttcccctttaccaataatatctcatagtttttattagcttacccatgtagcatgtatattatgctatcagtattcttctaacattcaaaacatgctgagttgtgcattagtagttgcatgatcaacagaaatatataccggggattaaataaagtatgcaagatcatacatcatgtgttgttactgcaacttcagaatctaacatttgtacttgtttctttttttcccagatccacggacttgctgagtatattgcacaggtgcacatgttgatccattaggattggtatggaatttgttttgatggctgctgcctaatattttgtatctcccattgtaggaagagatggaaaggaagatgggattctggtggtctcctgatagcaaacaccttgcatttactgaagttgactcatctgaaatcccactgtatagaattatgcaccagggtaaaagttcggttggtccagatgctcaagaagatcatgcttacccctttgcaggggctgctaatgtcaaagtgcgccttggagttgtttcttcccatggaggagaaataacttggatggatctcctatgtggagaaccaaatagtatccatggtgatgaagaatatcttgctagagtaaactggatgcataatagtgctattgctgttcaagttctcaatagaactcactcaaaacttaagctacttaagtttgacatcgcttcaggtaaaagggaggtcatactagaggaagagcatgatacgtggataacattgcacgattgttttactcctctggataaaggagtgaatagtaaacatccaggtggatttatttgggccagtgagaagacaggatttagacacctgtatcttcatgacaagaatggtgtgtgcttggggcccctcacacaaggtgattggatgatcgaccaaattgctggtgtcaatgagagttctggagttatatattttacaggcacattggatgggccattggagacaaatctttactccaccaacctatttccggattggagccttcccttgcaagtccccaagaggttgactcatggcacaggacgtcattcagtaattcttgaccatcagttgctgaggtttattgatgtgtatgactcaataaaatctccacctgtgatcctgctatgctctttgcttgatggaagtgtgataatgcctctatatgagcagcctctgactgttcagccgcttaaaaagtttcagcagctgtctccagagatagtacagattgaaggaaaggatgggactgctttatatggaactctttatctccctgatgagaaaaaatatggaccacccccatacaaaacactcgttaacgtttatggcggtcccagtgtccagcttgtaagtgactcatggataagtacagttgacatgagagctcagttcctgcgtagtaagggtatattagtttggaaggtaactattctttcctctatttttttttctttgctctttgtttaacaagatagattccgattgaggattttttttttctgttttcactttggtccataatgtcaccaatcttaaggtatgctgtgcaatgcattgcatgggtaaaattctaaactaaaaatgattttaaataaacttatggccaagatagcaccatttaatttctttttgtttaacaaggtatgctgtgcaatgcatggcatctcatccattaatttttccaaagcacatcagtatgtcattttgagagttaacatggactcaacctcagataatgcaatagtgcattcaagcataaaatttgcgttgagtcagaaatattagcaccactccactaagctaataagggttcctgcgtccacaactatgtctggaaaatattggcgcctgtaaccttcctgtcattaggaattagcaaaacattacaagtgtccaaaaaagccccatgtaattatcctaagtgacgtgtgggttgaaaagcccaatacaatccagcagccaatattttttattgtagtaatgtctgtcagttgcaagcaaacaattatactaccccctatccctagcgactatggcaagtggtaagattgatgatacaatccatcatgactaaccatattgcttcttgagcaaaaataatctaaagttttaaggtgggaattttgaagtggaagcaaaatgttttggaacggatgtttctataatcatatatttacatgagtttttttttttgcttagaattattcatatatgataaatttatgctggctgctatatgcctatatatttccgcatttgttgattgctcattatggagtataatcatatgcctatatatttccgcatttgtcactacatttatcattgggctcatgagccatggcaatacaagttgtttgtaacactgaatgactgactgtctcctggcagatggacaatcgaggaaccgcaagacgcggtttgcagtttgagggacagctcaaatacaacatcggtcgtgtcgatgctgaagatcagttagcaggtgccgagtggctaataaagaaaggcctagcaaaacccggacatataggtctctacggctggagctatggtggctttctctcggcaatgtgcctcgcgagatttcccgacacgttcagttgtgcagtttctggcgctccggtgacagcatgggatgggtatgacactttctataccgagaagtacatgggtctgccctcggagcagcgcgacgcttacagatacgggtcgatcatgcatcatgtgaagaacctccgagggaggctgctgctgatccacggtatgatagacgagaacgtgcatttcaggcacacggcgaggctcatcaactcgctgatggcggaggggaagccctacgatatcctcctcttccccgacgagaggcacatgccgcgccggttaggggaccggatctatatggaagagaggatctgggattttgtagagaggaacctgtgaatgtgaagagaggaagagagagagagaactacctgtggtgtataaatcttttgctcgctgtgggcatgacttgggatgttgttacagtatgttgaagctatttcatttccatcatcatcatctgtagttatccgcagactccagggatatgattcttttggctgtgataaggatggcagatagatgttaatttcacattgcctttctctttcacccacagcttggtgtgtgtgacgtggaatgtaattactgctgctctagaatgccggaattttgtggtatatttccagtaggaatcaagaaaatttttattacggcaggaaagcactagtacataacgttacaggttgcactggccaaaccaaaccttcggtgtcgattcatgctgatcgatctgtgccggtcgtaactcgtatccacgatttcaactagtcggtcgtcttcaatatttacgccaagacttaaactataaacatacttccaaccctaagtttatacttccaaccctaaaataagtttattcttcattcatctcacacgtaccaatacaaaaactaaaataccttcactttatcaaatctcaataaaattatttctccttttgtttactcccaatccatttatctcttaccttcataaacttcgatgtaatgattattaaaagataacttattttgtgacaaaccgaaggaggtagcctagtatcggatttgcctactattacgaatctggacatatcattcttcaaattcatggcattggcagtccaaaattgttatatattgggatggatagagtattttctagaattcttcacaggagcccaggaacatccatggcattggcagcagcttgactgcttgtcgttgttgtttcaagatcctttctgcgaacttgcttgttactttagtgtcttaaaatatatcaacttttagcatttaaaatttattctaaaatataataatttcaccacatatattccattatcaactaatcacaatctttcaccattcaaattcttcacctactttttcttcctaatcaattacaaatttctcccatttaatttatgtactttcttcaagcgctagcaaagaagaattaggctgtgttcttcccccacatttcccaactcacctcccacgtattccgcacgcatatttttcaaactgttaaactgtgtgtttttgtaaaagatttgtatatgaaagttgctttaaaaaatcatatcaatccattttttaaaaaaaatattaaatacttaattaatcataagaaaatgcgtcgctctgttttgcgtgtgtgggcctcacctctcgaacacaggcttagaaatcaatcgttgtaatatttgttttcttggtatataatccttgtttggggatcattgtgcaatggttgcattgtaaacatttcgatctacataatttataggcttataatatgacacctttggatgtatcatttgtaactccgaagtttcacaagattttttttaccattttcataggaaactattcaattattaccaatcggaaaaaacttcatgttcccttataacgcaattcttatatttccttttctatttatctagaattagaacccaacttgggttttcacttttcacaagcgcatgttatagagtaccaccgtcaagagcgttggagcatacccgagtttacttcctccattttcatattaaagtgttttaccgaaaataatatacaaacgaccggagcgtccgacttttggacaacgacgtacgcggcatcagcaacatgctatacgtcacatgaagcctcacgccatcatgtactgtgctgctttgccgtttcgattgtacaccgatcgaatgtagaagttgtacatatagcagggttcgtgttttacaaaaacttctaaagtatttgttattttcagaaaagatctactagcgattttgaaacgagcaatgtctaatgtcaactactctcttatttttcatattataagttattttgattattttcctatttaaatatagaaaaatttaacagcatctaaaacatgaaattagctttattaaaactaatatttaatataaaatatgtttgttttgtattaaaaatattactaaatttttctataaattttgtcaaacttaaataagtttaactagcagaaatagtcagcctataaaagctcataaaatttcaaattcgaaatacagtaggacctaatggccccagctcaccgttggcctgacttgcaagttgcaaccccgggtttctttttttgtaagtcattcattactggaaacaaacagacaattaattaattaataattataattaattaccggagttacttattctaaacagtaaccgactcctttccaacgtgttccccacgaagccggcaacccgaagccaaagccaccgccttccaactccaaatccaaatccaaatcctacttaagttaaaatcccactcccaccacggcaccacgctaagctaaacccacaccacctcgcccaattaaaccctcacccattctttttcttttcaacaattctctctctctctctctctctctcttccgaagggcggagcagttgatcggctccggccaccgccaatccgcgcctccgccgtcgtggtaagatgatccattcgttctccgattcactttccgcgatttctccctcccgcgggagcgatttggttcctgtgttattgatgggtaggatcgatgaggaagtggtgcgattttttggattcgggtttgtgtttctaacgcgtgttggcaatggcgatcgatcgtagactgcgcgacttcggaagcggaatctcgcgggggttcgcggcccgtcggaggccgaggcggaggcggaggcggagacggagaagggaggctgggaggcttcgtcttcgcgcctcctcggatccaatctgtttatatcaattccggtgaggggtctctctgttgcttgtgctgttcgaatcccctggccgaactcgagttcctactcgatttatatttttttcttctttttttttttttgaacttctacagatgctgtgctgctgcgccattggagtagtagcagagacgatcctgccgcctctgcacgattccttcggttcgggtgcgaaatgctcagattgttgctatgtggtttgctgaaattgctgctttgagtaccacgattgctcacctagggtttgatgatttgtttctcttgaatgtgcagggttgaacgcattgggggccaagaagggattataggcgcattggtgtcaagcggtggcccctagggtttccttgttgataggagaccctagggtttgttttttcatcaatgggtcacatccactaattcatagtgcaaatagctgcttctctagtgctggtggctgtgcacttgtgcttgttgcatcagtagctttggctgccttggctgtgttgcttgagatcagcaaagatgtcgtcagccggtatagccacactgagccccctgctggaccagttttgttttgcgccccatggcgagccccggttgcagcagctggattctattgtcatttttcttgccatgccaggggtggcacccatgccaatgcgtgtcctgcactcagactctgttgcctcggtcaagctccgcatccagcagttcaagggctttgtcactaccaagcagcggctggtgttcagtgggcatgagctgtcactaaacaactcccatgtcagggattatggacttaccgatggaaatgtgcttcatcttgtcgtgcggttggctgacctccgtgcgataagcattgagactgccaatgggaagaaatttcagttccaggtggagagttgctgcaatgttgggtatctcaaggacaagctctcagctgagagtggacagcaacttgggagtctcaaggaccaaaggcttgtgtttgacggtgaagagcttgaggataaccaattgattgcagatattagcaagaagggtgctgcagttatccacttgttcatccgcaggccagcaaaggttcagacacagcagggtgataaggaaactgttgttacagttgttactcccaaagacaatgataacctccaaacagatgctttgaaccttgcgaaaccagctaagggtaaacctgctccagttgagccaatcattgctaatggaaaggtgaaattgtctcctgctgtgatggaaatgatctactcaacaatttctggtatagaaaacgggtaccttcccgtgatgtcaacagagggttcagggggagtctatttcatgaaggactcttcaggtgaaagcaatgttgcagtattcaagcctattgatgaggaaccaatggcaaagaataatcccaggggccttcctttgtcaactgatggtgaggggttgaaaaggggaacgcgagtaggggaaggtgcattaagggaggttgcagcatatattcttgaccatccagtttatggatgtaaatcgtgtgatgttcctggattttctggtgtaccacccacagcgttggtccgttgtttccatatggggaagggatctaataaggttggatcattgcagctgtttgtagataacaatggcagttgtgaggatatgggccctcgagctttcccagttaaagaggttcagaagattgccatactggatattaggttggcaaatgctgatcgtcatgctgggaacatattagtgtgccaagatggagaagatcacttgaagttgattccaattgatcatgggtactgcctgccagagaaggtatttgatcattgctatcatgtgaaacaattgtatttatgttcactcgcttgaattggtaaacttaaactgctatttttgtccttagcatagtaattagagatccctagtaattatttagtgttgttggaagtttaaacaatgtcagtaatatcctcgtattttctcaatgtttttgtctatgttaatgtgacaatttcggcactgatccagtaaacaaggccgtgtgtccttaatattcatttgatttgaatcattgttagctggcattatttttgtacaagttaattccttgtatgctatcttgcttagttcaatcaatttttctgtaccagtttacgagtctttaccttttcccctttgcagtttgaagattgtacctttgagtggctctactggccccaagcccgcgaacccttcggtccagaaaccgcagcatacattggatcactagatgctgacaaagacattgcgcttctcaagttccacgggtgggcgctatctccccagtgtgcccgagttctgcgcatcagcacaatgcttttgaagaagggggcagagagaggcctaacgccttatgacatcggcagcatcttatgcaggcaaacagtcaaaaaagaatctgaaatcgaggccatcatagaggaagcagaggatgccatccttccaggaactagtgaggagacattcttggagaccatctcggagatcatggactttcaccttgataagcttgctgtgaagttaaagaagttctgaataactgatcgagttactcgaattgtgcccggttgtaagtatgtatcgtagtcactaaatgaaataacgagtttggccgttgaactcattaccgtggaacattttgtgaatataacaaggatcatccacttttttacctgtacttgtaatgtagactgtagttgcatcgagtgttctttctgcttggtaatttcagcaaaacctagcacctgagaagcttgtttggatcattgtcaatgtaaacctgtttaaagtgttggcattgccaaatcctgagaacaatgtttggatcattgtcaatgtaaacctgatgaaaatgtttggtgagggttgtttggtttgctgccaaaattccacttggaaatgtgttcacactacatttcaatttgcttaccaatattttggcaatgccaccttttttttttttgaaagggaatgccaattatttggcaacaaattaattggattgccaacttttttttttggtattattaagattgggtaagaaccaaacagctctagagattgcaatgtcttcttctatcatgctggactgaacatgaagagctaaagcatttgcttttatgcaaccgtaaccatttttctattctcgcaggcattgactggtatggttcctgtgttattttagaagatctgattcatgattgaactgtcccactatcttaaaattttctgtgatactatatatatatggaccaagcgttgagtagaagtataaataaaaccaaggaatcaaacgaaaaaaccgcttgtcatgagatctcgggagtgaaatggtcctgttaatgcgggtaaatctcagctcagcgtaaaattttggggcaaaggacaaacgttgcagttcggttttcaaccaacctagctcaaggctggtggtaatcataagcaacagtatgcctcaagatgtaacatattgttgcgacaaacattgaactttaacactattaccaccggagttttcaagtctccacaatcagaatacagtacacactcagcatgggaggagaccgcaaaattgcattagctagcgagtacacaacaatttcacataatgtttttcagtgttcgttttcaaaatttcctttcactggatgttccacttctgctcgagagcactgcatattcgattcaaacagcaggcagcactgagagggtaattgcaaactgcaagaacaatgtgcagaatatcaacacgagtcaaacgaaaccatctgaagacaatggatatcaacacaagtaaaaggaaaaaaaaatctgagactgtctatatttacataagtcacaaaggaaaaacatttttttacgaactaaagaaaacatctttgagacagtaaatgcacgcaacattccaggcatctcaggaaaggcaacagggcatttgtgttacagagctagattgtaaacctgtcttacaaatgagcgagcatatgataaatgcaacttgcttgaaacctttatgtaataatatttttaacagctacttcctccgtttcacaatgtaagactttctagcgttgttcgcattcatatagatgttaatgaatccaggcatatatatgtgtctagattcattaacatctatatgaatatgggcaatgctagaaagtcttacaatatgaaacggagggagtagacaataacaaaagaatgcagcaaatagatgatatcaccatgatcctgcaaactgtttgctctaactctaattttaattgaaggtaacttactttgtatgtaatcatctgagtattcgttgtcaatctttccatgagccatagcacctacctgaaatcatgtgcagactataagagatggaccaggaagaaagaatggaacaaaaaataaatcaactcgacggcatagcttaactcaccacaaacacaaggggtacatcgtcactggatttggcaacatagtcaaacaaattgactgacttctcagcactatatgaaagccttaagaataaaaaactcatggattaaccaccacccacagtggcccataccttgatgccttgatcaagaaaaatgtgctactaaatgtccattgggtcacgaattatactatttgacctagttaaaagtgcatcttggcaggtatattttacaaatactactttatggtgtgattttcataggaaaaaaatgagtagaaattttttacacaaaactagtaaacgaggttttggaaaattgtatgtcatgacattcagttctcaaaattttggtttctgtcatccaaatttaatcctagtctaaccaaagatgattttaggatgttactctagctagtttaaggaactctggatttacttatacctaagattaacactaccactaaaagaatatggattcttaccaatcttctttgctccaactggtagatagcgggtgactggatttttaatgacattaagaagcttctcccgctttccaactgctgtaatgctcaacttctgcaataattgtgctgcaatattgtagaaatacttcatcagcacagttcacagaaaacactaaaaacacaatatatgtgcaattacagccattattaacttacacattaaaccgcaaaaacgtttgaatgtacgtggcatgcggacgtaaggcttgatttcaaacaatactcccttttcagtcctaacataaacagcttgtaacctcccagctttagttagtgggctatcaaatattgcaagaagagcctgcaaaatattaagaatacaaattatgttggctttgagaaagcaggtataaaacaaatgagagaaatgaatgactggcttgaacaatttctttttcattaatcacttagatgttctttgtaaaatcaccacgaggctctttcaagaatgacttcattctggtgttatgtgcacagcaccaactacagaaatcagctactacttctgtcccaaaaagaatgcatttctaactatgcacctgataagagtatgtctagatgcatagccagaataacattctttttgggacggaggtagtatcctttaccagaggggccattctgtggttagcccccaaaagtgaggaggtaaatgccatggaatgtatatatcctcaataggggaagccaaaatagaacacagataatgatgtggtacggaatgatttcaaacagaaaattggatgtctgctttcgttcagtttcaaacaggggttgtacagatgtgagagaggacaggctttaatcatgtgccattaatccctgggagctccggaaatacaagaaattcgaaatacctggtgaatgatatcaggcctgtaatcagctggattcctgttttgcttcctcaaataattagcatggtcatccgagttcaggatttgcatagtctacacaaagagtcaaaagaatcgtcaaaaatatcattcgtgcagcttaagctcttcaatcatcagagctacagactgatatgttcagatacaatatagctaacaaagaattgtcaaaagtatcattcgtgtagcattaagctcctcaatcatcaggtatacagaatgatatgttcagatacaatacagctaactcgttaacaaagtatacagctgaattatcttctagcgcaaacaaatttatcaagataagcataagaacagaactaatccaactatccaaactgtacatccaaagccagaaacggattggtcgaaaaaaaggcgcaagaaaaaggtgtaataaatttgttggcgaagcttcgccccataccttgccgactttgccgacctcgaggcaggccctctcgagcacgaagatcgcgccgggccgccgcttcccgtccaccggccgtggcacgacgggtagcccatcagcaacctccccggccgccgccgccgccgccacgtcctcctccttcccctcctcctcctccaccccctccggcggcggcagctcctccgccgcctcttcgtcgaccgggggctcgcgggaggccccgccgtcgtcgagcttccgcttcttcttccgccccttcaccgcgtacggccgccccatcggtctcctccttcctctcgccgccgctcgcacgcgttgcagtggtgtggtggggtttcgagggggaggaaagctagggtttttggagagggtggcggcgatttcttcttcgtccggaggtaaatactgcgagtgatgtgagccactcatccaattaatggacagctgagactttttggcaaaataaatttgtataatatttagaaggagaaaactagaactaaatttgtataagtatttaggcttagggtgtgtttggttcacagtcaaggttggatgggatatgacgagccagttttttgtttggtagagtgaatatggcaatccagtcttttgtttggttccagggatgaagatggatttggtgatccatttttttgtttggttagaaggagtaggatggatgagtggttacaatcacctcatcattagaggtggtgagtataccccttcaaattcaccaaactaaaaattatcaatgtactgcaaaataaaaaatctaaagagaaataaaaggggaaaaaggagaaaaaaagaaaaaaagttggtccttcttgctcttcacgccggccgccgcctcaccttcttgcacgccggccgccgcctcgcccgctcctctcaacggccgccgccctgctcctctcgacggccgccgccccgccttctcgaccgctggcctccgccccacctccttccccaccggtctccgccacgctcgtctcacctctcctccagatccggttgtcgccgtcgtttccttctacaccggccgccaccccgtctccttccccaccggccgctgccccgtatcctccaaatctagtcgtcgccgtcgtctccgtccccaccggtcgtcacagtcgtccccgtctcctccggtcgtcgtcgtcgtctccgtccccccaccggtcgtcatcgtcgtcgtcgtctcctttcctcctcccgttgcagccgcctttgggcttgccgctgccgtcccctcatccttattccgttgccgccgccgtgcaccgggtcgctgccaccgccgcctccttcatcccgctgccatcgccgcttacccacatcgctgtttcgcatggtgagaagggtgacacgacccacgtcgtcgctcgccccgctcacccgagcgctcgggcggttccatccggccaaatcggcaagataccaccatccggcatctagagggaatattcccttccgggccgccctatcccacttccgcccaccaaccaaacacccacaaataatgggccgccatgtcctatccacccaaatccctccatccaaacacaccctaagctaaggctggcaacctttcgtactagcacataaatcgaaacgatccattaacgcataattaattaagtattagcttaataaacttaaaaaatcaattaatatggttttttaagcacttttctataaatattacttttaaaaaatgcattgtttaaccgtttggatagcgtgtgtatggaaaacattagagtcaagttaggcaattgttccgaacgtagccttagaaggaggtgactatattcaaactcccttcatccaaatttaatcattatatattaaaaaagctggatcttcacaatgttcaattgtcacatttgaattggtttcttattgcgtctttgatccaacatggtgaccctttcggttccatatgggattactccgctaccctctaaaggttggaccaatagaatttgacaaacaacttctaaattcctattatgttgtagcaacgcttttcttctccatgatttgtgtattaactgcaaccacctgcatgagatggacggtcgttttcatgtagaagacatgatggaagtgaagggaagtgggcaggtagacattctagggaaagggagtgccatggcgctgaggtgaacatgtatgattcctgtgatgttcgtgctgtgaagaattccttggcctgatgacacaaaagttcatgattcctatgttgttgtggatgttcaaggtagtgtttgtgaccgagagcgagatatatggtgcacatgagaaaaagcttcttctattgtcccaacatcgggtttgggagtttttatttccacctgatccctaagttgagcttaactccacatttgagcatgtctaatatagggttaaaggacccagcacattttgccatacttcttttgcgcaaatgtggtctaatgacttgccattatactctccatcccttttgatcttagagcatgtacctcgtcccttttacgagctactagctacttgttcaaaaataccacgcggtgcatggtactatattaacataaagtaagtatatagtatgctaaaacaaccacattagtaatatagtaattgatgaacaaccacgttaataatatagtaactgatgatcaggctacaggccgataatcatgaaaacaaatcctcaagtctacaaggatacaaatccacgatttacctccttgtagttcgttttaacttgccgatgctaccatcatagctatagcctttaaaaactagaggatgacgaggatgagacataatatttgataatatttgatgttagaggatatctatcacatgcatacataggatgtcacgagaaaaaagccaaagctttagagaattcgtatctactatatctgtctttataagtgtgctcatagtatagaaagcaaatattattgattactaattgaatttttatctatgaggaggaaaatatcagtttcactggtcttacactcatgtaaaatcatttttgttgtagaaatatagaaaaacatacagagggcgctatttcagccctctatttccagtacttgtggaagaatattccaccactatcttaacacatattttatatgaaatacggttgaaccatggattgaatatgaaacatcaagcttcaattactgaaacatcaacaaatccacaagaatcagagacaaattgaaacactataaaaaatcccactgcaacatttaatccaacacaaaaaaaaacatcaagatacattggctgaaacattaaaaaattcgcaaaatataccacccataaaaaatacattgtcttcttcctatcctgtagtgatggcagaggaggggtaggccaaactaaagagctctgaaacaactttgccactagcggaggacaaggctgaagaaacgacatcgctggcgacgaagcaggggcgacaaggctcgaggattcccgcccagcggtggcaggtgggagaaacgatgtcaatgccgacgaagcgggagcaatggcgctcggggtttcttggcggcaacgacggcagaccagagaaacaatgtcgatggagacgaaggttgggacgccgccgccctcctgtgtgagtgtgggagaaaggtaagggggtccaagagagagggagtcacaagtgtaagcgagttaatggaaaaaagcccgatatagatattttattatcacaatatggttagcgttctctaaaatatactccccatatgagatcgaaaaagaaaaaaaagagagccgttgatgcccaccatccaacggtgggaaaggacgcgctatcgtatcgccccttccacggtggagccgcgtcgtctcccctttctcggctcgactcgctcttgacgccctcccaccaaag

SEQ ID NO: 49080 - DNA, 12718 bp, Oryza sativa
  unsure (1)..(12718): unsure at all n locations
cacccccacttcgccgccgccgccgccaccgcccgctccccggcgtctttcgccggcgaccgcagaaccgaccccttccgttcccccgcgcccccctcccttgccgcggcctcggtctcccgcccctcgtcccccctgcctctccgcaccgccgggcaaccagatccgcccggtttccaggcatcccctcgtcgtggtaagccctagcttctgattgtttggttccgccgcgtgtgccccgctgagaaatggaatacttgttttgggatcccgtgcgattcgttgtcggagtgcgctgttggattggattagattggattggtcccccggatttgttcgatgctaggatgcaatccgtccgtagggttcgtggcagatatgttctgttttgggcgtgcggagggttcctgaatttcctatgatcctagcctcctagatgcatccgccagccccaagcggacaagctcgaggtagaaggcgaggcgagatcgggttacatggtgattgggttcttgtggagctgttttgacttgtaagctgggtatttttggcatgttggcagttggcatatgatgttaactaactgtaggggtttgatcttggtggttcgccgctagactctttcacccctataggaatctatacggtagttttttggtgtgtggcaatgcatctaacttttttgttttcatcggtctggttgttttagcatattgtattactgtatcaattttcctttcatgtgcatatcagatatgaaccatattggtagtcttaggggctctttggttgcctggatctaccctggctcgcatgggagatgcagacgcgtccgcttgtttggttaactgcatgccctttggagcctggctgagttcatgcaaaagtaggttagccaggcccgagagaaacggccgatttcttcttcgctcctcagcctggctcactcgatgcaaggtggatgcagcgcgggtgcaagcgttgcatcagtgcgtgcacgtgcgtggcaggggtctagcatccgctcacctcctccctctcattttcatcttcccattctcaattgctctcctcttcccctctctcccttgccgctgccgccaccaaatcccctgcggtcaccgctcgtttggcgtcttctccggtggtggactggcagctgacctcgagctccctcggccgaccccagtggagaagctactgccgctattacatcccttgccatctccatcgcgtcgatgcgctgcctctcttttctgtcgccacaactgccttctccgaccgccaggccaccagatccggtgaccatggtggcgttgagcagctgggagcgccgatgaagcaagtcaacgatgagattgagggtttttttttttgttttctctgttctattttctactgagagaagagcagaggagcgcgcatgtcagatcaggatgagaggccagcgaggagcatggtactggccggcgacagaggagctgggaacggctggcggcgatgaggcaagaactcatctcctcgacaacaaggaggaggacaaacgcttctctctctttttttttcttttttttttccagcgctttgctatcaaatggtggaggaagttttgttgactttttattttttgagaactcaagaaatttcacttttggtgcagagaatgccgggtgatttttgatgccaatattattctttgtatgtgaaaaattgtttatacctattgtctagatttgaaatttttgtaggtaacctcacccaactaaatgaagaggtaactagactcaaatctatccaaccaaccaaacaaaatcttttccaaaccgcatctctcatgcactcaaccaaacaaaatctcatcccaaccgggctaaactgatgcaaacaaccaaacagttgcatgtgtatctcttcatccaggctagactcaaccaggatgagagagatgagccaggctaggaaaatgcaagcaaccaaacacacccttaatgattcattgctgagctgttgatctatccttgctttatgcatttttggcataggatgtgagctcagaatgtaggccttccttggactgacttgctctccatgtttttaccaatgaataaattgtacttgtccaaaagtaagaattgaaattctttttgtttgcattgttcccatgcattcttaactcacaagagcaggacatcaaatgtgttatgaaatctgttggcaatggcaagcatccctgaaacacacaacatatgcagaataaacttaaagagcaagtgtttgatgacaagttttcaaatttttcaatgaaaaacccatcttaatgaatatgcacactgctgtacaagcctgtttgcaaaatttacacttaatatgctaggtccataattgcctacagctcaaagcacaaaaagatgtgatccatccctgaaatatcatgtgcagagagtatttccaacgagtgcacagttcaccaaaataaaatctaatgagatgaaaccttagctcttttaacctactagaaataactaaaccgttgaatatatatagcatgccatgtcacttttatttttatcaaaattggcaatattatgtcataaatatgattttcttactatctagcagactcactaaaacttggtagtttgaagcaaccgtttctagttgggcttggttttatattctaagcagtcttttgatgagaaatgttctttggtgccttagcgcctggctgctagtagagcatgacttgcatagtgcaccgtgctttggataatttgagatgcattttctttgctgcatctcgctattgtgcatgtgtgcaccttgtttgcctttggcagcactgctgctggagctggatgttctgtagtacaattttgtgaatatctcaaacagaagaacattgtgcgaggtgacctaaggtcaaatgataatctaagcatctgtggcaagttatatctaccacacactggttaccatagggaatctatcaaatggtaggttgttcgtgtccagtcactcttgatgtgctgttttctaatttttaattggagtatactgcattttctgattttcatatgttggattttgggatgtttgtgtcagtgtttttctgaagaattgttctaaaaacttcttacttaacttctgttatatatcatacaatttcattaacattttacatcttgttgtatctggttggttcaattaatttttaggtgcatatatatattgaaggcctgaaatggctgaacattgggcagaaggttcaaagcatgcttctgcacaagcatcgtattctagatatcaagcaacatctgcaagatctaggcaaaggtaattgtctacttaacatcatcatttagttttctgctagagaagttggtacaatcctatgagaaactaactgttacaattcaattgataaaatgtattctttcttttgattctgtgtttggaaccaatattgcatccatgtgcaatatttgacacagtaaaggtggaattatatctgcaaaccctcttgtgacttattaagtttgattagcaccctggccttatttatcttcttctactcttggtacagatttgttagcatacaaagcccttttaaaacaacatttgtgaaaagaacctcacatatttgttccagaaaatggaccaaagctatgggaatatattctgcatactgttacaccacttcacctagaggtcagctgtgttggattaagtgtcgtctccactggtagaaatgtcaaaaggtcaataccacatgaattagcattagtattttgataatgttatggcctattggactataacattagcattatgcctaaccaatttcagggtaacattcatcttgaatgtaatttgcaaaagctcctttgaccaacacattgttgttatcataatacttaagtactgcgggaatagcttaatggcaaatgcaactccctgatagagtagcaccatcagtgttaatgccaccattgagccattgtggtatccccatggccccctccaaaaataaaatgcatgaggggtcatcttctggataatataaaaccattttcagtaacctgttttctaatggcattataatatgagatcacttgttaaatatataacctttggtttgcccattattgtcaggaacatcttcgatctattagctcagcgagagatttcccctcgaacaaaacaccaagctaaaaaactttggagcaaatctccaggaaatgatgctgattccaatgaactaagatatgcagctacagatgctaaacatgatatatattcatggtacggggtcttactttaccaggatggtttaagcacaatttgtcatgtctgtagtaatgattgagttacatatattgtactttcgattttacacctaatatttctttggtaaatatttataaaccctatgaactattcttcattgtctattttaactgttgagttacatagttttgtactctcactcttatacctaacttttccctggaatgaaaccttttctgtatacagggcagaatcacagtccctgcatcactggtctgccaaatattgtcctcttttgccaccccccaggtctactatcgcagctgcattcagcccaaatgggaaaacacttgcatctacacagtaagtttattatttgcggaatataaggattaaagtgaaggcatgtggactaactccatctcttttgagcagtggtgatcatactgttaaaataattgactatcaaactgggaaatgtttgaaagtgctgagtggacatcggcgcacgccttgggtggtatgattatgaacactgtcatcatgttccagaatgtgtgctacaagctcttatagataaaggataaatcttaccctgtccctgctacaagtcactgcttttgttacctaccttcctacaagtaattttggtttattggcaccctcaaagtcgtttcagtctgtaataaccctgtccctcactgttgcctgtaatttcacgattcacttgaccaatttgttgggggatatttcatcaaatcgtcacaatcagctgttctgctatcatcatgtgttgcacgccacatgggtcctactaatttaccattaccacccgtagcgcaataaggggaagatagattggggggttggggggcactgttgtaggggatatagttgcacttttggatggtacaatgatttacagggggtgctgataaaccaaaatgacttggggttaagtcacaatgacctttaaataaacaactcaagtactgatatttttactaaccatcaggccttatatcagcatgtcatgtttgtacccatatccttatccaccacttggcagcttagtccatagggagcattttatatatgttttacataaaaatgcataaatgctgtttttgcagtcttatttgccacttattattttgagtttcttctgttctatttcaggttagataccatccattacttcctgatatccttgctagcggtagtttggatcaggaagtccgtctttgggacgctaaaacctcagactgtattggatctcaggacttccgtaatatatctaagcagatcctaatgagtatgtctccttccatgggtgaaatctgaatactaaccttttcagtgatgttctcttatttgatagatcggccaattgcatcaatagcatttcatgcaaggggggagattctggcagttgcatcaggtcacaaagtgagattatagtgttaaatttgaaaaaaaaaggaagtctttctgtgcttgttttatgaacaatgatcaaataacatatagtgctcaatgcaatgtattgtgccagctgtacatatggaactacaataaaagagatgaggctgctgctccaaccattatattaagaacccgccgctcactaagagctgtccattttcacccccatggtgctccatatcttcttactgcagaggtagaaataatatactccctcagtcccaaaatataacaacttctctacctacattctcttctcaaccaatcacaaccttcccacatttaattccacctgctttcttaatacccatgtccaaccctaaaactcattctgggacggaggtagtactgttttctgcattttttgctttctttgcataatttcatgtaccgattgatcttatgcagatattcaatttcaggttaataatcttgattctgcggactcaccattgacccttgcaacctcttcgggctattcaaactatccctcggctgtgttttttgcaaatattaattccagaaactgtccacatcatgaggctaattcatcatcaccttgcttgctttggcctgcatacctcagggatgatggaagtttatgtctgattcgcaatgacttggttagtagttcaaccaatgtgcatcagagaccatcatctttagctcaaaatccattggcatcagatgttgaaaatcaacagcctgaccaacttgtcacgcctatggatgtgtgccctggagaaccatctacttctcatgcttctgcatctggtttaagtggagttgaaatgcagattgacagggggcaacctagctccagattactgggcagtagctccactagtaatcatgagagttctactgctagagatgatgtgcaaatgccctccctgagcaacagcgtgccgattccagcaacatctcagccttcagaacatgatggccgtcatggtatgccaatgaattcgtttaccacttctagtggattagatgttcacatgatcctaagaaattcagagggtggaaatcatcatcatgatctcttcagtgactcgcgtagctgggagcttccctttttgcagggctggttcatggcccaaaatcatacaggtttgcaccctgcaccttccaaatgatgatgcctttgtactggaggcctaccttcttgtggtactggcactgctgagactgattaaactgtgtaattgaacttgcaggtgcttctccatctattccgattgatgtcggcagttctagaggatcaaatcgacatcatgcttctcgtcgtcatgttgtgggctcattacgtggggttgggagttcacttctaggcccccaaattgatgaagctgaggttcatgctgcatcattaggtgttggatctgaacttactacctcactgcttgctgctggagctgctgaattaccttgcacagtgaagcttagaatatggcggcatgatatcaaggatccatgtgttacattggaacccgaggcatgccggttgacaatttctcatgccgttctctgcaggtgcttcattgtacttttggttttcttgtattcacatttttcctgcacaacacaaacttttatttcctttctgttgtttcctgtattgctttgcctgaatatgtacataagtggataagttatggtgtgcagcaacaacaaaaacttactgttctgtttcacaatgtttgtccattaagaaaaccaagaatgtggttattacaatgttttcactcattaaatgctttgaaatgggtaaaatggttgcattttgctatgcatgtttttttctcgttaaatttttcttagattttgtacttccttggtttgagcgcatggggtgctgtggaaaaacattgttagacggagggagtatcttttagatgtttgacatgaagtgcgtattttatttttgacaaactgtgcagtggattgttgacccttctttgcttactctaaagttaataattattgcagtgaaatgggtgcccatttttccccttgtggacgatttctggtagcatgtgttgcctgtttgctgcctcaaactgaaggcgaccgtggtagccaattgcctgtgcagtatgattctgcaggggccggaacatcaccaactcgtcaccctctcccttctcaccgagttatttatgagctccgagtttactctcttgaggaggcaacgtaattttctcaacagtcttgttacatagtatgctcttttgctaggtttctcatttgtaaacgttctagttattttgaaattgtgaatgtattttccttacaggtttggcaaagttcttacatcaagagcgataagggcagctcattgcttaacttccatccaggttaacatctcatttgtttgtgtgtttgttggttttttagtgctgcaaaagataagcaggcatctctgctgccacccttctactgggagcagaaacatattatatacctcagataattgctgtcgaacttgtggcttgtgtctcaagcattgtccagtagcagcattataaagttgactggcttttgcatttttgacctaaacttgagaaatattgatatgaaattcaacaactttcttcatcagttaatttggtgagcacttgtttttctgcagttctcacccacttcagagcacatactattggcatatggtcgtcgtcataactctatgcttaggagcattgtgatggatggggaaactggaattcctgtatatactatcttggaggtacatatagttagattatgcataagcatatcagtgaaaatactggaaattctgtttttgctgcttattttaaatatttcagtctgaacaattttcttattatagtttgtaactcctagtgtccttttgtttctgtatgactaacaatatgatttaggcctgttctaaacttcaacttcctcattttccgttagcacgcttcccaaactgctatacggtgtattttttgcaaaatgtttttatataaaagtttctttaaaaattcaaatgaacccttttttcaaatttataatatttagttattaattaatcatgtgttaattgcttgctccggtttctgtgccacttacaagctcagttcttacttatgaatgaagccttaatctcattattcctattcatcacgttaggtctatagagtatcggacatggagctggtaagagttcttcctagtgctgaagatgaagtaaacgttgcatgctttcatccttcccctggaggtggtcttgtttatgggaccaaggtaaatagcaaattagatcaatcaacagtacacaacatatatttgctttgctaattcatgcactcacacatttgcatcaggaaggaaagctcaggatcttgcagcacaatggtgcagatatcacaagcacagggttgaattgctttatcgaggaaaatatgcttgaggtagtccttttttccccagttgtcatatccaaggttttgaatcctaaagactggcagtcgtattttgaattcaatttaattggcatgtgtaatgtgtaattttcatagatttgtcatataagatacgttaatacatcacaattagattgaaactgtcaaaattaaaactgtagtgacatgcatatttaatactacaatattccatattccttttgcacaatatatataaccaagatacctgtttcatctaacataacattttgaataccggtttcgaaaagaaaatactggtccctccagttatgggacatgtttgagtccaaatatttgaattccaaaaccggttggcacataaaatacatcaatgcatcacaatttgaccaaaatggtcaaaatgcaatcttttgtagtgaaatggtttgtatcaaatccaacagtctatattctttttgtgaaatatatgtataaccaagacatcggttgtatctaaccgtatgacggcaagaggcgttgattgaaaagggcttgagctgcagtgacgagtgatgggagtttcatattttatttcctattttcctcgttgaatgtgcctatttttttcctactctatcatataattcaaatgtacttacacatgtcactgcaagaaaatatacagtttgtattaaaattttgttttattctggctggtatgccagatacctgctagccagcagatcctgaacggttaccagctggttactgttgggattccgatctatgatggcaggtgacattgactagactgcctcgagctgcagaaacaagcaacaaggctctttttagatttcccctattgaatgcgtctctccttttcggttgttacacttctctgttacaaatgatgttgcaagaatatatacagttcgtatgatttataatttaaaattgaattattctggcctgtacgttggatactagctggtggctctggagcggtaactgtgctggttatcgccgggattccgatccctggtcataccttgttaattatctggtttacttagtcttatattgtaccaccacagccatattttatgcatttctcgtggcccatgtgtctggtggtggtttcattctctacactggaagtttagtggatgtttaaccagcatttacatttctaaatgtaggaattctggatttaactatcatgggttatgtctggatgaaagtatgaactagttgctattatgcatggactcgttcaatgctggctctgggctttaagaaatttacaaagcacgaatcatgttgtcttcacaaataaactagttgctttatcttggttgttgagcctaagataatcagtttgagtggcactttgccatatggatgcagatttttttaaactagttatgtggtttttgatttatcaaggtcaatcactttttttttataagtaactataggttcaaatatgcaaagctaagacaagatagtccatgttattatgggttgtttggtttgatcagaattcggtccatcgtaagatcgttcctcaaatttggttcaatgactagtattcctcatttttcccacttagtatatatgatgaccacatttcattccgcaaaccaaacttatttaggatcaagtggtcaattgacaatctcattcggccattcctcaaaccaaacagccctttagagttttactgggtctgtgtccgagctccaacccactaaggggcatgtgttaccaagtccatgctatcagcgagtttccactttacagtaatctggtacgaaataaagttggaactaaacagcatgacaattggccgaaatttaacaatgggccgaaatttaacaacggggatgttttctgaacaagtcataaatgatgcaacagttcactccgattttcatgataactctaatatatctttaagcacacgataatggagtacagaaattggcattatccatcacaaataggtcaaaattgtcttacctcattatttccagggaactgtaaataaattattgaccatggattttcagttgggcaatcatcactttttggagtcttctattcatgttaatagttaagacttttgtcgtggacatttagccaccacaaacttagttttacttgataacctgtatgatttgctacttaatacatttgaagccaatggtgggcccagttatggttgctagatcttttgcaattttaatcagattgtatgcatttggctcacttctgctgaaactagcaagattctcataaattagtgtcctatctcatattttattaatatggtatctattaatagggcaaacttaggggcagcaaccagacacctgtgacctgtccagatacaagccttgttaggagtttatttatttccgtgaaaatctttccttttgcttgtacctcatttaatttaatgctattgtgtcaacaggtttgataatgatagtgctgctattatgtgctcatattcggtctaataaatcgatataacggtatgttcctttctttgttgtagattcagagatatgcgctggaaggctgaacgattggttgccatgtgttatgtgtacttctccaggtaattaccatttatcaacatctcaattttttttctgtgtctgttgcattcctggcctcaaacgttatccagttcactggttggagggacactttgctgtttctgttccttttggtcatgaagtataatcaaactttctgtctataggtgatactatgaccaaatatgccttttctggttggcttgctggtgactgaaatcatgattggttgtcactacaggaattttcctctgcaaagtttatcattgtacaagtgagcctcaaggaaatcatcagatttcagcaaagtcatggcagattctcaaatgagtttgctagagtgccttggggataggtatggaactgttgcgtaatttggtttggtgacagtctaagattacccatcttgttttgttccactaaacccaccgacattgatatcatcaaaagatccctattgctccttaataccattccatccaagccttctttttaccaaaagcaattatgttagatgaaataacattcattggcatcttggctttccctcctatcttcagtgcagatggacattgaaacacaaacataccacacattactcattgttagcaatgtgcagtgccactgtgtgctagaaagcttgagtttctggagctgctcgatctctatgcacagtgaggcgatgaacataccacacattactcattagtcggagtaatggcgatggtgtgcttggtggtgggtcttcatgcgggatgcctacttttcatggctgcagcgaggtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 49081 - DNA, 944 bp, Oryza sativa
tcagttttcaacaactctccataatatgcggtcatgatgttgtcttgatcaagattggtgcgagagcccatgttggagaagtggggtttcagctattgcaagagtgatcattcctatcgaagtcgccaacaaattcatgatcgggaccctgtcatggttagcacgcgccagtttgccttatgctcggtagaccagctaggatgtcctcgagctagccatagtgccgagaaggggacgacacatacatagatacataccgatgtagtcgatggggatgtgactgttggagaagcgccccgtgttgtggcgagtgtcgaactcaaggccgtacaactcgcggtcggcgcgggtgagttatccgaggtagtttttggtgccgacatcagccgtggagtcgccgatcacgaagagaaccgggacgagtggcgtgcgtgcgaccaccgtggacggggacagggacaatggttgcgaagaggaatgggccatggagcagcagtagaggggagcggagagtgggatgacgaacagggcaagggcgaggaggaggaggggggaggcgagatttggcttggcgcacggcacgcttgggtgagagatgctaagacaatgccactgaactaccaatacgaggctcgggtggagcggaggtggggattgcacgtgtgggatggctgggtgcatgtagcacagtaacatgcaattgttgggctggttcaattgctttatgggcttttatgatgagcctaatccaccattgctaggtaagaatctgcagtatttggaaaactttagattctaagagaagttactagaagctcctcaaacaagacctaagttgctgatggagtgttgcgtgaggaagaaatataggaatttcctcaatgtgcataccaccattttcgttccgtatactattcgtattagaattattcgaaattagaaac

SEQ ID NO: 49082 - DNA, 2202 bp, Oryza sativa
  unsure (1)..(2202): unsure at all n locations
ttccgggtgaaaaatgttgagggatcgaacaaactccccgaaatcaataacaccattgcgcttaagatcaaagagatcaaatatctgcttgaaatgagaagactctgtcagtctttcacacatctggaattgttctataatttaacggaaaccataaaattgtgcttaattagctcagaaaagcttttgcagtgagacagcaaaatactcagaaattcaaaaaaggcaaaccgacccgatcggcgaaaaggttcttcttgttgctgttcctgaagagtgctagctggaactcctcctgttcaagaaaatggcagttcagaattgacaaaataccagaatttcaataccaaatggtcacttttgtcaaaaagatggcctccattaaaaatgaaattcaagagagttaaccttgtgaataagcccatctttgaatatggaatggcttatcttcttgaacagctcatacagggcctccacctacctcacagaaactacaagacgtaaatacacaggagaaagcataattaatcactctccattcctgaactgaagaatggtgtaattcagtgagttcttacatgtggtctcttttgccgggatagcaggatcctcatgctctgcggctcgtttgaactgctttgatgatatgcagcccatacaaaccacacctttatcttgttgttaagaaacggctttcctgcataaagtgataacagtcacctcaaagaacaggataaagaggctgctaacaaaaaaaagtgaagtgacatgaaaaagttaagtgaaacattaaaaacacaagaaacacagccaaacaacaagacctcctttggaacagaggaattagactaaatcggatgaaaatcccataaaaattcctgcgttccaaaggagccctgaatcgacaaacacagaagaattaatctcacctagggaagaaacagaggtgcctttgaacttctggacatcaagaagaagaagttgatgagcaaaatagagggggggggggggggggggggantntnnnnnnntngtgtgnnnnaaatacntncaagcttattggagatacaatggacatagaagaagaagatggcacatatatttatatatgcacatgcatagcaagcatctgggctccacagtgtggcacagccccagctgtgccgaccgtgtgtagcaagagttgacttgaaatggttccctgttacacgatctgcaacattaaattattactactgttttatattgctcaagttcagcatctgtcattgctgaaaaataatcagcaatggcgggaatagattaatactagtagtttacagtgtgtatctagcctagatgtagcaatatatacttgttgagtaatggaccataagaacgacggttttgttcttagttaagtgatgttaactaggccgtaccaaagatacatgcatccaaaacgggcgtattgtgattgatgtttaacgaaaaatgtcaacgtcgccttgtagctatcaagcgtggttttttttatatatatggaaggagggatccaaaggtgacgcatgctcttccgcttaacaagggatggagcgcctgttcatcaaggacctaattttggcgttattttctcccgtctaccgggaggtactagtactgggaggtacaaaatcaaatctgaccatctatcgtgagagggtacaattgagaaacacagaagagaagcgaaaccatctccggtgtcgcgccaccgctttctcatctgtttaaagggttcgctcttctcatctgttcagaagaattcggtaaaattgtaaagaaattgaatggcacaatttcctgagtgccttgtagttgcagacagcagcagaatgtatagtaagcagaactaagtgttcactgttcagggcttcagacaggcgcttaggcagccatagtgtagtggtgcaagcgcgcgtttataagaaatgtgtgtatgcacgcgtatatgagtgcctacattatattatttaaataataataataaacgtctggaacagatatcgttcaccattatgttacatttagggggacatatatgtgaaaacaagctagggggacatatatgtggaaacgagttaagtgttggaaactcatgaaaatcatacctaaaagttttgtaaattcataaaaaaaactaggaataggtgtagatatgaaatacattctcattaaatctca

SEQ ID NO: 49083 - DNA, 1648 bp, Oryza sativa
accatgctcttagagcaagtttaatagtataaccaactactacctccaatttatctatagccattctaatagctcgttcatacaatagctacatactatactattaatacacggtcccacctgtcgtgtcttgaagtccgtgctacagctggctataaatctgtagcccgctgcccttctctcttctcatttatcttcttaaaatatgtttgtagctggcttatagcatgctattgtacctgctcttagctagtcactcagttagagagacaggagggggagagaaatggccctggcggcacggtggcgtgctgatgtacgaaccatatataggtgtagtagactaagcacaaggttcaaattaaatttgaattagttaccccggtaaaagcttgttaaaagtacctacagaaaatcagcgtaagtctaagggtaaatcaatggagaaaaaaaaacagcatatataaatcgtgcaggatttcgcatgaacagagtgtcaggcacgcgcatcagaaaccatatcgacaatgacgagctagccgacgacagcgattgcctggctgccaactaggatatatataatgtaacaagaaaattaattaattgggtgagatcgatacgtgaaacatgctgattaattatcttttaatttggtccacttgtagtaagtttgttgtgaaaaccaatgatttctaattatcaggggaaagtgaatatattaacattgcccgtggaactcgaatcttgcaaaatatttggcagggaaagccaatcagatgctaaattcaacccacaccaagctaccatgttgtttatgtacacttggctgcagatgatagtgatatactataggctgattgtatccagacatcttatactttttcagtaaagctgggcgtcagccttttgttctaaaattagggttgaaagtgattcgaataatttccatccgaccggaccttttttcggattcggatagtttcggtcggatatatctgaaaatttttgaattcggatttttttttcggatatgaaaacgaatatgatataggtgatatccgtcagatattatccgatattttccgtcggatatccgacttacacataaggctgccataatccataagccagcccaacccagaggagtcaaatcaaagttcttgaaaaaaatgaatttcgaattgaattttatgatactgaatgaactcatatgaaaaagttgtcaaaaacaaagttgtagaactcattaagatctaccaattttattttggtcatttctccatccgagtttcattgaactatataaaatttgaattttaaaatataagaaattcaaataattcttcgggtagtaaatgatttcaaatggaaaaattgtcaaaaacaaagttgtataacttaccaagatctataacttttattttggtcattttcctatatgactttgtttgaacagtttgaatttgaatttgaaaatatgacaacttcaaacaatattttcaaatactaaatgatttcaactgaaaaagtcatcaataacaaagttgtataaatcatcaagatctataacttttattttggtcatttcttcatccgataaagtgacagtaacattgttcacaaaatttacatatctctcatttggttt

SEQ ID NO: 49084 - DNA, 1455 bp, Oryza sativa
atgaagaaatgaccaaaataaaagttctatgtcttgatgagttctacaacttttatgttttatttactgcttcaaaatatcatttgaagttttgaaattcaaatttttaattgataaaacaaagtcacaagaaaaaatggccaaaataatagtagtaaaaacacaataacatgatagagcatgattttagaaacatttaggaaaaagaatcatccaatttggagttcttatgagtgagataaactagtttcaaatttttaaaatttattttcgcatacggctcattaacgtctgtatttttccatgcggtctcttaagtggtccgcatgcaaaaatgggctcattttggcatcttaaggagtagtatgcgaaaataccaatgcggcaagttgtggtccgtttgcaaaaatcatagggtcttgtacacaaaaatcgtttgtgtagtattgaggggtttttatatttcgattaatattcatcaccgtattcgcttcgcttcgtattcactccatatttgtattcgataatattcgatttcgttttcatatttgggtttccgattccgattttgattccgaaaaaattatgaaaacgaatataatagagctagtttccgaccgtattcgatccgttttcatccctatctaaaatatagtataggctgataaaataagatgggtcgtaactgtcgacgtttgatagtcacgactagggaatttgaatagtatgggatcgttggtaccagggtatatgcgagattgaggtaaaagagatgcagacagtgatttttatacaggttcgagccccttatctgataggtaatagccctacatcctgttggccgaagccggtgctgctctttattcatctggatcacacaaatacaataattgggataatctatctatccatcgtcgacttggcggctatataaccaactcgtagtcgatgacagggtaatcttcctcctcgaatctgtactcggcgagaacagagatggcgctagatacctcttgccggcccatgtaggtgccggatagggcatggctaggctaatctctgatgttgatatacaacggcgtattggcttgtattggcttgtggctttgtagattgtggtgggtgtgtcccctctcctcctagggggcttgtatttatacccacaggtgaccccttgtccaagtagaactagggagataaatatggatacgatctgagtagtgagtagtccttgtcgtttctatgtagaactcttcttctccttccttatccggaactccttctatatacgaggttttttttccgtataagacatggcatgtggtgggccttgccgagcttagtcgattactattgggtatccataaccctgacagtaaaaacttcttaacaatgcatgcaaaaatgtattcttgagtaattaaaggtctatatttaaagaatatgacaaaatta

SEQ ID NO: 49085 - DNA, 1441 bp, Oryza sativa
ttgattgactagggagaggacacacacacatatatattttatcaacgcttagaccattcgtgttattcaaaatttttgtgtaaatataaaaatatttaaatcatgcttaaataatatttgatgataaattaagtcacaataaaataaataataattacataattttgttgaataagacgaatgcaaacgtataaaaaaaatcaacggtcatacattgaaaacggagggagtagcgaaagagcttgtagcctagtggttagagcctcagtagcaccttaggtcctgggtttgactccccataggagtgaattttctaggatttaatggctttgtgctttcagtggtagatgacgtacccgtcaacagcgaagcgtctgtgttaacttcgtcaatttccataatttgccggcccagtcttcgaagatgctcataggggtgagtgtgcgtgcattgtgagtgtctgtgttgtactgtgtaatttttttttttaaaaaaacggagggagtatataccaatcacctattcaaccacgatctagctagatcaccatctaaatataacaactcataattttactcttttattacttaagcaattccacttgtgaatattttttttactcaagccgtttggcagttggcaccaatgtactcacaattttactctttttacaatatctatttacatattaacactaatgtaaatcatactcaagttgttattgtgcataaaataaaaccacatataaaaccgcacatgagttatttaaactggtttcagtacttcatgggtagaatatgcagtttcatacttggggtagcagaccaacctcaatcggtagtactacatttataaaaaaagtatatgtttcttatattatatcgcagctagcgcactgtataccttatagaatgttatgatgtgcgggaatgaaattttacgtgctatgtatttgtgtactttgtatataaatgtgagtaaaaagttttactcacaacatgtggtttagcccaagcggtttttatattatgcgactttagatgatagtttgtttgaataaatttaggcagttgaaaaagagcaaaaccttgaagttctgtaatcttgtttgataaaactgcttttagaccttgtgagatgcttttctttttcatttatgttgccactaaaccatgatattgttccatcctgaaaacataaaacaattggagaagaattgacaaccacacatatattggagaaagccgaaagacgagtctttattacaagaaacataaaaagcaaaaggctaggaacacacaccaccgttgggacgacgaccggccaggcttaaacccaccaccactcaaattaagacgcaaaatatagttaagctggtcaccattatttataactcctcaataatacaaaagattaatgatttctcgaacttaatcgaaat

SEQ ID NO: 49086 - DNA, 1629 bp, Oryza sativa
cacttgatcatctccacaccgggtcattacttgttactcttggaggttgccgcctcctagacagcttgtggaggagttgcccggtgacctctccgagaagattgtggaggaggcccggcgccggtttgtgagtggtttagcttcaccaccttcggagtgaaggaagaactaccccgagtgatcgaggcttgggtagtcctctccgtgggccggctcccgccttgcccaccccttgacgaagggggcgtgcggtggcttcgtagttgagcggtggagttgggctcgcctcaacggggagtaggaaaccggcgagtttccgaacctcggtgaaaaatctcttgtctcatttgattgtcgcatttacatttgtgcaatttacttttctagagacacacttgagatcatatcaccctaggattgcaaaacatcgacataggagcgtgatttactttcctagagatatatttgagccactatcaccctaggtttgcaaaacataacttagttgcttagttagagttctccctcaccaagcctagcaacttaggttaaatttgattaggtattatttagttttaaatcgcctattcaccccccctctagtcgacatctcgatcctacagaatggcaaaagtttagtatgcatctaaactccaactagtagttttgcaataccaaaacttttgccaccaaaacttttgccatttgccatttgccattccaaatgcatctaaacaggccctaagttttgtatgtaattattgcttgtggatgatgaggtgacatgtttgcatgttaagctttaagatttgtggattataactttatagtaagataggtagccacatcttttatttcttctacacggaacacaaagatagatacgcacataatacacttatgtatgcatgcccataatcccctttaacatatgcaatatatatagagagaggctataaaatatataaatccataaaggcgtaaatctaactaaatttctagtcaccaaagatacgcttcctcatctcgcgtctacagccatgcattatggtggtgtttggatctagggactaaactttagtccctgtcatatctgatgaatttggagtattaaacatagactacttataaaactaatcacataaatgagagctaattcgcgtgataaattttttaagcctagttaatccataattagcacatgtttactgtagcatcacatagggtaatcatggattaattaggctcaatagattcgtctcgcgaattagtccatggttatagaatgggttttattaatagtctatatttaatatttataattagtatccaaacatccaatatgatagggactaaaaactagtcacatctaaacagggtctatattatcgatcgactaccacaatttatgcatgggaaactatgcatcagtcaacatatatatatatatatatatatatatatatatatatatagtgaccatagatactggtggtgacctgagacagatggaccgcaggtgaccatatgtagtagagcctccctcttcattctatctctcatgtactgtggaggctgtggagatcacacgaaactactgtgaaaatggatagctatcaaaggtgtcta

SEQ ID NO: 49087 - DNA, 3736 bp, Oryza sativa
tttgggggtgaaagcttttttcctagttggtttagactaaagagcctgctgactttaaggagcctggtgcttttccaatgtggggtctgaaaatctgtcaatcccatcgtttccttcccttgaacttctaatgctatcaggaaatatttggctgaaaacagtaacaattcttggtggttcgactggtggtgaaacgatgcagcatgcaagcagcagtagcagtagcagcaatggcacaacatgtcttagtggactcacctatataggtctttacagttgtgaggacctgcagaatcttgatcggtgcttgtccccggaatacttgccatccatcaagtccatagagatcgacagctccagcgatctaggactgtcaatgcctgtcgatagtttcgtgggattcaaatacctacaagatctgaaaatccactgcaaattgttatgcccgcagggaatggttttgccaccctcactccgacgactctctattgtgtctggccgtaaggttgacttcccggcctgcctacagagcctcacctctctcaacatcctgcatttgtctagctgcgatggcatggagtccattccgctgggcacaaatctttaggtcaaatgcctgcttctcgagcggtgctcggagctgtcatccattggaggatcacacgttctttcatccatgcagttcgtgagcatatcgatctgcccaaagctgcacgaagtagagcagccctttaaaaagtgcctgctgactaataaggacaagaaggaactgcttcaatttacctatcacttatatggataaagcatagctgatttctaaagacttccggggtatttttcttcacgctgcggcacccagagccttctgttgataattgagcgttggctggtttgggtgagccgtcgacgtgtgccttgagattgaaatggccgagaagaacaaagaaaagttcacaccatgtagagagttggagggtgagcggtggatgtggtttttgatgttagaaacgagtgcgaaagcgggagcaggtctggggttagccatggcgggatctgccgaggtgcatgagcagactttcttctgatactatgaagagattttcttctgttcagcaggtagcccggtaacaaatctctgcccttcgttctatccgatcagacgattggcaaggtgtggtacctccagatacatatttgcccatgaggtggtaccggcagtgttgagagaggtggaaggtgcttgaatcccctctgtccgatgagtggtaacagcggtggcttgtccatgggcaactgtggcggcgaggtggtggcggccgtggcggtgaggtggtgttggcggcggctggtgcgtgagcggccgtggcagcgaggtggtggcggccgcggtgttgaggtggtcatggagtcgttagagctggcgatgttgtggcagcggcgggggctttggcggctgcagtgacgaggtggtcgtggagcgaggtggtggtggccgcggtatcgtggtagtcatggagtcgttggagccggtgatgtggtggcggcggtggggactttggcagctgtcggcggccacagcggcatagtggtggtgctccagttgtcctctgaagctctaagacttttcgtttgctgttgctgcgatgccggtgatcaaggatattgccgatgcgtagtggtattacataagttgtacgctgaagtgtgttgataggtaagtttcattccaagcatatgtcatttttttagtggtaattcagtataaataaattttcttttaatttagtcatgcatgtcaatataacagtcctgtttttttaaggaggatgacactctgattggagtagatctggcatccaagagtacaaaagacattcaagcagctttggcacttgctggaacatgtcaatctgggtacactggtggagaaaccatctttggtccgtcggccgaaatccacaatagttccggttccactaaaaaccgagactaaagatgatctttagtatgaagctagagctggaaatggcggaccgtttttagacatggaaatttcactcaagaagttgtccaagcaggaaaaggagaccaatgacattagaaattggttcataggaataatagttctagctgtgctccttctcatgaaattatttgataatatgtactatgactaccgttgttgattttctggatgttaaaatggaaaaaaatttagtcatattgctagatgttattagctatgctaaatcacaacatattccccaacttacaatatcaatatcaatttttaactcaatgcataaagctgttcttgatgtcctcctgataacttaggtgtactccagtttgtcagtttgtttcatgttcttgtcacaggaagcaactaggacagttgcttgtgtggaaactgaatgacactaattttttgtgtagtctgttcaattttttgtgttcagttcttctcaccattagaaattaaataacaatatgaatgcaagtacctaatgacaatatgaatggctgtgaacttctttgaatgactgaaaagcaaattggcagcaatgataaattaatgaattccaatggaattgcatgttaataagtgcccatccatctgaaaacacctgcaggaaaatatttacatttatggaattgcagtcagaagatctcatgtgaataggaaaatattgacataactgaaagtttcagatgcaaatcagcaaatgtgtcaccatatggctcgtgacgccatgatccatgctaaatggcgaaccagaaaattcgatttgcctggcaccaaattctccaatcccaatacctactcaacaggttagcttgcatctgagatctgaccatctactgaaagtctgaaactaatactccatccaccactagtcttcactcctcagtcgcacccaatacattgcactaggtatttagcaaatgatataggcggaaacataaacagaggataaacaatcaaacccataatatgcaaacaataagaggacaaataattgaaacatatagacttaagaaacagcaggtgcatcaagtaaacagatgctgaagcctaaaggttccctggctacagaaagtgaagttgtgaattcttgcagtgcataacacaagattaagtcagggcatacacaaagcgcagctcatgaatggtgtcatacgcttaatggcattacatcaccctgatgccagctcgcacaatttcagagtattgacgagtctcgaagaaattgaatgccaacaatcaagctccaggaaaggtgagacatgtccgatgatgccccgtcggcccgtgcagttgcagcggagaggcgcacgtggctgcgactgccatcgacggccggctgcgtagcctccgaggatgtgggcgaccatccgcagccgccgcactactccacatctgccctccgcctgccgtcgtcggccggctgcatagcgccggggatgcggacggactaatccgagcgccggtgaggaaaagaacaaaggataagagcgtcattttatagcttacttattttttacggttttactacgtggggaatgctataaagtcttatattataaaacagagggagtacttgcatattttttttacggttttttaggcttaaaaactttcaaattgtagactgttagatcacatcaaaattcgtgcagatcggataataaaaattggcgcaaagtgcacaggagcaaagaatcaaacctacaa

SEQ ID NO: 49088 - DNA, 1801 bp, Oryza sativa
  unsure (1)..(1801): unsure at all n locations
ggctacagatatgtagcttgctgctcttctctcttatcttttatctcattaaaatatgtttgtagctggctaatagtctgctattgtacctgctcttaggattgacccagtctgggcctcttgggtccatataggaaggataagttcactctaggtccctcattttgtcgtcgagcctggaatttgtccttaatcgaaataccagatataatggatcccttaatttataaaatctgatcatccgatatcgtagacagtatcatgctcggcttttagctgacgtggcaagccgagtcaacgtgggacccatgcggggcccacatgtcagtggctaacactctcttctcccctctcttccctttcccctctcttctctctctcccctttgccctgtaaggtgacaactgtcgggaaggacggcatcacgagtggcggggaaaaggggcggcgcccaacggtcaacgggagaggagaaggacgtcactcgatagagagaaagatggcatggagaagtgtgtggtggcttgcggccttctctctggtgcctctacccgccgccctctccatcttgactccatccgcgtccccgtcagccgttgagcaaggtcattgtcgatgtcgggtctgtcggtagcacacttagctgcttgagctacgcacaccgagcttcttgacctccaccttgagcaacttgaggtacctgacggccttgtggaggacggtgggcgcgtccatcttgctgccgccaggatgatccccttgagtgtncgcataatattcttcatctgctccttcttcctttcatcacctccggcgccggccctaagcttccgaccaccactgtagtcagacctcgacgcgtagatgctcaccccgtacctggacaagcacgtggagtccacgaagcccccagctcggcaccctggcatgcgggccgtgctcagcatggcctctactccgtgctaatcagcgcgtctttcttgtccgtgatcagcatggactgtaactctatatagttggcttagactccactgctatttctttctggctctttgagacgtccctctcaggcattcggtgaacaccctccacgcgtaccatatggccccgaacctgacgagcgtgctcagcatggtgttcctgaggcagagaaccaagctcgggtgctcggcatccacatgcgcacaccctgcatcccaccgtcgaccgcgcggtgccattcgcggagccggaacagcgcgacgtaggcatcctcgtcgggcggctccgaggaggactcgaggagccagagcgcgcctgcgccagctggccatggctacagagcacccgcagtgtggtgctcctgtcgaagtaggtggcctccgcagaagcggtggctgtggcgatgcgctggcgaggttggaggagaatgtcatggtgaggttgttctcccagagatacgttccgagatcaacctttccgctgtgttcgtccatcagcttccgcacggtttccttctcctcgccggtgagctccagattgccagtacagctcctggacagtggttttccctaccgtatatacttggcacggccatgatgccgtccatggttttcccactgttaccgctccaacgcccaccctatcgcccattgccacaccactccggctgattgccagcgtcgcacaggcagctgcagtcgaaagggaagagaaagggcagagaaagagagagggagggagggaggaggaagaagtatatatggccaaaaggcccgaggcccgacggcccggcccatggcacggtattttggcccggccc

SEQ ID NO: 49089 - DNA, 819 bp, Oryza sativa
ataaatttgaaaaataatttgaatttttgataaattttgtacggtttgtcgcggttaccgcggttaccgtgcggtaaccgtgcttaccgccggggcgcggtacccgcggccccggcggtaaatgaaaccctgctctcgatctttccgtttgcaatgcatgccacgcgagcgcgagcctagatccgcggcgcgaccggcggtgtgtgtgctgctgctacgccgccgtcaccggctttccggcatccacgtggtggggggctgcgtacgacggtacgacgacgaacatgcagtgtttcggggcccagacggcggtggtcggcaggcaatggctttgcttttggctggcctgcgactgcgggagggagaggagggtaacatggggagcggcaggtgggcttggggaaagtatttacagctcggcgtatgggacgacgattactggtggccggtggctgctgctgtttactgctactacaactgcaacccttcgttgccttgtcgatttgtcatccgcgcgagagcgctccgggacaaatcgatggtgtcctcactgccgactctctctcaagaagtcttgggccgtgtttggtagggctataaacttcaactcctagctctaaattgctatttcagttggagctagctcctattagagttggagacccatccaaaagtgtttgacaagcttttagctcccgatctaaaaaatattgaaaaaaaggaatccctgctgccggccgtgcgccgcccaagcatcgtctccacgcacgccggcctcgcgctacttcccctgcaccacccatccgcccttgtcagcgt

SEQ ID NO: 49090 - DNA, 1172 bp, Oryza sativa
gctcgttaacaagctctatctcatttgtatcaccattataattttaaatttaccattttatcatatactaacatgataaaaaacactaattaataaaggaccttcatgttctatctgctattttacgttactccttgaattggacttgagggtacagaattgcgatcaaagtgcagcagtacacaaacactggatttatatcgaatccagaaacataaattcatcataaaagagctaattattacattcagaaatgtgcctctattgttcagctcagactcatcatcttgcatattaccatgtgctgaggtaaaaaaaaaagtcaaatagctgggtacactagaaattattcctgcaatatgatctgtaatgtggaacctagtccactacataggttttttcctacatctacctgggcaatgagtgccttcatacatcgagggcacaaaaaggtagccttgtagtttcttttaacaatgcaagcccattaagtatgaggcaaacgcaatgttcactatggattaacagaaacaagcaaaatcacaaatgttttctgatagtttaattcagtgtaaagaaacaccatatttacctgtaatcttccaaaggagcctgtggttcaggtcttacagactccagttctaacatgaatgcactagaacaagattctctcgggtaatcctttgagttgtagcaaccaagaacctttgattcgaaaatggatagaggatttagaaaccattagtccagtggtaatagtaaattctagataatttggacagaaaaatgcataccattttccatggagcatgtgtactttggtcgcaaatattgatgtctttggcagagatggatagcttagaaacaaaaatatccccatctggatacatattgaactggatattgagcgcagacataataaactctaaataagacctcttgtctctgccatttgagcacggccggctaatcgtatctttctgagctaatttccagtcatttccctcgtacatccgccacttgacatctatatcatgaataagaacctttcctttcagactgcacgattcatcagaattcaagatgaaaatagcaggcttcagtttttgttgaaatatttgctcttctcgtggtttgttcctttgaacatggttttcatctattgtgggaaa

SEQ ID NO: 49091 - DNA, 3436 bp, Oryza sativa
  unsure (1)..(3436): unsure at all n locations
aatttttcaccaacgtcagctgatgcacggtgtaattttggctcagctttgggtcccctagctgttgaccacgactcttacgacaggtaagtgtggtgtgtggataaaggtgggcccaagcccatggcgacgggcccaccacccagcggaggctgagagggacaccgtgggtctcggaaaaaaccgtaacggcgtctctctccgttacaacggacaatccttcgcaaacactgtacgtttttttcgtatccaggtccacctcagcccctatccttttgcaaacaaaaagagaaaaaaaaaggtgacctgattgttttatttgctttgcaccctgtcaatacttctttgttagataaacacccctgggaatatttttccttaggcaaatcttatctgcaaggaattgagtgcaaggaaagccttagaaatgacatagcaactcatgtttttcctatgtgatggattgagtaagtcaataatgtgatattttttattatgtggaaggcgtggccatgcataaataattattcatgtacactgtattcacgagtacatcgctgacactagatacactcaaagaatgtattcacgaattcatacactcaaagaatgggaggctaacaatagatccgtgacatcaataaaattgagggctgctagcccacgggataccgttgcaacggaatatttacgaaatattntaagtgactctcctttntccttccctctgtctacgtgtgctcccctagtacctggtaccttacgtaccggttggtacttgatacctgctatcttaggtaccggttggtacctagtacctggtaccttagataccaactagatatcgaccgatacctgatgcccagtacccaagataccgggtggtacctaggtatcagaccttggtaccaaggtatcaagcctgatacttgtggggtatcagagggtaccgtcaaaaagaggaggagacgtgggggagggagcgccgcaacggcggaggatggcgtcgaggaggcatggcgaggtgagggacgtgtgttcccctagtacctggtaccttagatatcggttggtacctggtacctggtaccgactaggtatcaaccgatacctgatgcctggtacctaaggtactgggtggtacctaggtatcaaaccttggtaccaaggtatcaagcctgatacttgtggggtatcaaagggtactgtcaaaaagaggaggagacgtgggggagggagggccgcaacggcggaggatggcgtcgaggaggcacggcgaggtgaggggtgaggcccaagccagagagcgcgagaagtctcgaggaggagccgaggaggaggttgacggccatacctgttgcaggtcgacgcgggctgtcagcgtccatcccgaaggcgcaaaagcgccagcccgcagcggggaccacagtgacgccaggccgagggccgaggacgaggggagctcccgcttcttccctccccggggcgatgactccccggcgcacacccgacccgacgagggcggcgagccagagcggcgcagcgaggggaggcgagctcgagggcgaccccgccgagggttggccgaccttgccgacgcagtgccgtcgtcgtcctcctcagccgccggagacgacgacgacgaccccttcctcccggccggcttcgtctccgctcggtcttcttcagagagagagaggggggggggagagggagagggagggctgcagtgctgtgtgatttgggggaggagagtgaggtaggaggagaggattcggatgattttggggagaggagtgaggtaggaggaggggatcccgtctccacgggatgtcgtggtgtaggttttctgataaatttttattgaaagtagcacatgagcaaaagctcgcgagctttaccgagccgagctcgagcttctactgagcttaaccgagcttggctgtgtatagtttatattgcatgctcaccttattgatataataaactaatagataaatatatatattagtatctatttacacaataaattagcatgtgttagcacaatatatttattttagtcattttctactcttttattactgcgattaactagaaaataattatacttatcaagagattatcattaaaatatatattatgctacttatggccgagctcaagctcgaacgagctcgaatcgagcttgcctaaaagctcgaaggtgcaataggctcggcttgagctcggctcgagcttgtgtcgagttcgagcttaggcaaacgagctcgctcgagctcggttcattgacagccctagcggggagttaaactatgtatatttcttgattttttccactacatattcacatgaaataaaatgtagagaagtcaaatctttcttggtcgtggtgaaaaaacttatgtgatgatcaatgcggaatggagggagtaataagtaacatattgaagtcttgaagcctcttttctttttgacggtttgcaaaattgttttttttttatcagaatgatttacgcggtattatgtctcatttggattgcaatcatgcttatagtgtatagtttggaacattttattacccttgactttgcacctatgcatgcatatcctctcaattcctccgaatcttaaaaagatactttattgtttatcattaattttgttgaaataataattccaaatagtaatatatactccctttgatctcgaataattgatacttgcactattcaaatttaaattttatcaatttgtattttcattaataaattacaaatatggacacgactacagggagcgcaagcacttgttagtgctaaccagcgaccatccttttttacccaaaaatagtacagtgtgtatcaactcattacccctcttactaaaagtagtagcacctgccacatgcatcctcatttaaatacttatatgatctaagatccgattactcagttgtgttcgttgcagttaaatttatacaacaagatcttatatgattatattatgatgaaaaaatatttatgtttgtaaaatacttttattatatactaagttacttttatcatatatataaattacttttagatttagatttgattaaattacttcctatacattcataatgctatgaggtggttacttttattattgtttttagtcaattccataatttgtgctgattaatttagtctctagatagagttatgtttttatccttacaacagatttacttctaatgttatgacaaagttactttccttttgtcttaagttacttctattataatatatgtaaattacttttagactttattaaatttacttttatatgtccaagaagtactttagtgaaatctaaaaataatttagatatattataaaagtaatttgtaatttttcatcataatataatcatgtgagatcttattataaag

SEQ ID NO: 49092 - DNA, 1245 bp, Oryza sativa
ccagtttagcttttagcacagttttgcacggtgtgtgtgtgtcttctgactcgtgtggtggcgtatatatagcccgcgaaatcgacgcagtgcaacacgtgctggcacgtcgagagcacccatagcggcagcagagatgaagcttcttccgtggaagcaggactcttcgatcccggaatacaagaatattaatcctgggaaacccaaatttccaaccaaaagaaaccccgaaaatttttttaaaaaattaaaagagaaaacctttcccggaatcaaaataaattttgaattggaattgagcccagtgggaaagtatggaaaactgaagatccggttgaaacacaaaattttaccgggaaccgctgaaatggtggaaactgctcccttcgtctcaaaataaagcaacctaccatcagatgggacatatcctaatatccgcctataataccaaaaacgtgaactttcgatgctatataaccaattttgcccattattaatgagaaatggatatatttttcacaaggccctgggactaggagggaatttggccggcgacaacatcgatctgcttgtaatttaaatcatttttctcggagaatttgacttccataaaagcgtgaaaaattgatagtactctcgatcgcctcgccacgccaccgacgatcgaaggtgcgtgctcaagtcagacctgatttagtcctggatcaagttagtcgctgtcattagatttcttgtcagcgtctacgtgtttggcgccaatacactcgcggggtgttcagttgaccacgggatgcagtgatgatatgcctcgaatcgcgcgcgaaaaattgcaatttgttccgatcttggcgggaagttaggccattcacattagcttcttcttaggcgtgtgatcgaattagtacttcctccgtattttaatgtacgacggcgttgactttttaaccaacgtttgaccatttgtcttatttaatttttttatgcaaatataaaaatacttatatcatgcttaaagaacatttgatgataaatcaaatcacaataaaataaatgataattacataaatttttttaaataaaacgaaaggtcaaacgtttgttaaaaaatcaacggcgtcatacattaaaatacggagagagtactagttaatcgtcaagccgacccgatccgtagtcgacggtatagccagcgcccaaccgctgacaattggtagatacagatagataaacaaggagagatgtgtt

SEQ ID NO: 49093 - DNA, 2284 bp, Oryza sativa
attcctccaaaatttacatggcattaggcaatccataggaatttcataggattccataagatccattcctttgattcaaagggctgtatagaaaaaattcctataggaaagaaatcatctaaaattcctatgaatttcctttgaatcaaagggggcctaaaccttcccaccgagagagttgtcagtgacaatgtgtgtgcacacatagaacctagcaaactaaaggaactttcccctgtaacagagaacaacaggaagcaagtggaagcttcagaagaagtagctcatgaagaaatggccataaacacatcgggagaatcatttgatagagcaacagcaaatgtagatatctactttgctaagaaaatagcctctgtcgtgaatctcgactgcgagcccatatcactcacagaatgcaagaaaaggtcggattgggacgaatggaagaaagcaatcacaatcgagttaatttctctaaacaaaagagaggtatttgaccctgtaagccgtatccctcctcatatacgggcataaatggttatttgttcgaaagaaaaaatcagaataacgagttagtgagatgtcacgtccaaaatttctatccaaaattccaaacgcttacatgtgtgttaaaccctcgtccagaaattaaccgaggcacacaataacaaattgataatagagtgctacacaaacaactaattaatattggcccaataataaaataataaactattatagaggtggatagttcttctcaaagaataaaattatacgcagcggaaataaaaccaaaacggaacagttatggggattccactccacaagcaactcgaccggaacaaagcttaatcctccagatcatcaccttcattgaagtactcttcttctgacgaatgaatattgcaataatgagcatatgacatactcaccaagccacccagcaaatatgcaagtgcacaggataacaaaagatggcatagtaaagctcatttgcataaacagcatttaataaacattttaaagaataataaaccagttgaataattaatcagtattaaataaacactatacaacacacccgtgctgcataggcccaacctcatctgagcaaccaaccccggttgtacaaatcaaacctccataccaggaatataccattccaaaccaaaagtcaaattaattaacacaatattatcattaatgaatagtgtggggctaatcacgaaaaacattgttaaactcacccataaccgcgggcacggctattcgaatagttttactctgatcagaggtgtaccactgtacccacaagacacaactccacaacatgtcatcatgcgcctcagtaccactacggtaccttggaaaggaactgtgacaatacccctcgcacaacacaactcatcacagtgcaccgttcctggatcatgatctccccctcaaaaccagaggcaatggactccccagcgacccccacagacttctcgccgcttcacagtctggcacaccataataaatcatgctatacaaaagataaagccgttgcccatgctggcttgtggttggcacggtaaatgtttcacaacagtagctcgcgaaccggtccttaattgtcatgagcacaaccatcaaaaccatatgctcacaacccaccttaatcaggttttagttatcaattaattaacataacacaattaaccattgtgagctaccattaaatataaccataattaataatgtagtatgattcatcccattaatgagctaatgtttctaagcatggctaagcaattatacatatagcatctaactgaaccaatccaatatataaggtacaagctaatcaatttattacccataggaaaataaagacatctttggccattaattaattgggaaaggctcaccacccgatgacattcgaaaataatgcataagttaaaataaaacattagctttaaacgggttcaacatgctcaaagggttgtttgggatctatattacttgccttgagcttccgcaaatgcttccgaaccttcctcaacgaaaacgctctccttcggaacgtcggaaactaaagccaaagaacaaaatcaaccaaaacagtacaaaaacaagcataaacagtacatgtggatatttttaacatgtagatctcgattttagaaaaatttagcaacttggaccactcgaattcgagttacgatgatttagttatgaatttccgaagtttaatcgatttgcatctaataaagaaaaccttaaaaaagggatttatgac

SEQ ID NO: 49094 - DNA, 3050 bp, Oryza sativa
cgcttttggaccacataatctccttgtaatcttaatcgatcgctcctgtttctcatcagaagtagcgagagggcaagatccggagaagtaatcaaggactacggaagtgatggacgccgtggaaacgatcatctcaaccgggatcaacatctatgaagcgacccagctgagcgatgaactgtcccgcctgcaggccaccttgcccaaggctcgcttcctcatcaatcgcggcgagtggggcaggttcaagaacaaggacatggcgatccttctgtcgcagctcaaggacaccacctacgacgccgaggatcttctccgcgagttcgatgaccaggcgctgcggcaaaagatggaggacgctgaccggagctgggcaggtcaactcttatcttcctctctaaatcatgcaaaaactttgatccgtggtagcaaaacaaggataaagtaggcccaggagaagctcgacaaggctggggctgatttagagggagcgatcaattcagtgggtcttagtatcgaggcagttcaacacatgccggagacaagttcagtcatagatgtgtctcaagtgtttggccgtgataaagaacgagatctagtgattgagaagctgggtgtgcgttcgatgattggacgtaatagtcaacgagatcaggtgattgagttactgggtgtgccactcaccaggggtgctgctgcacgggctaaagagaagagagcagcagccactgtcactggcacgaaatcagcatcctgcagaacgaagaaactgaagggagagagcagcagggcccctagacttgatgaggccaaatgcatcggcaatgtttctgtcttgccgatttttagcattggtggggtggggaagtctaccctggctcagatcatctacaatgatccaagggtgcaagctcactttggcaagaggagggtatgggtctgtgttccacacctcttcgacaagagaagaattacaaaagagatcattgagtctttcaccaaggaagagtataagccactgctcagtttagatgctcttcaggtggaaatgatggagcagctagggagacgaaagttccttttggtgttggatgacattgggcaagaagctattgacgagtgggagtcattttatgcaccattcaagaacggacctaaaggcagtatgatcttagtaactacaagatttacaactgttgttgatcgtgttgccaccaacaattgtaagcctatccaactcgaaggcttggatagagatatattttgggagttctttagcaagtgtgcattcggagaagagtgtccagaatcatatcctcaattacaagatattggtcggagcattgcctctaggttatgtgggtctcctttagttgccaaaactactggacgtttgttgaatatgaagctgactgtgcaacattgggagactgttcagaacagtgaattgtgggagctgccacatcgagacaatgagatattaccggccctccagctgagctacttatatctcccacaagaacttaagagatgctttgcattttgctccatgtttccaaaagattatagctttgaacgagatgagatcgttgacatttgggtggccgagggctttgttgtgtcaagtggaagcacacgtcttgaagatatggggattaggtatttggatgatttgaggagcaggtttctttttcaaaccgaccccaagtaccctgatcgaactagatatgtaatgcatgacttgatccatgatatggcacaatccgtttatgtggatgaatgcctcttgatgcaagatttgaggtctcggaatgagaggagaatgctacatgtagttcgccatatgtccgtgaaggtggctgatgaatccctgaagaacggaatgagaggcattcaggatttgaacaaattgcattcacttaggtttggaatcaaactcaatgttgagattacctggttcaatcagctctccaacatcctatatttgagcctaaagggttgtaagctggtcaagctacctgagagcataggcgagttgaacagtctccgttatcttgatatttctcgtagcggtgtacaagaattgccgaagaaattctgtagcctttacagcctacaggttgttgatgcaagtcgttctagtctgaaagcaattagtctggatgtcataaagctaatcaacttgcgtcgtctagcattgccagtgagttgctctccaaagttatcagagataagtaggcttggaaatttgtctcgtctatggaacttatcacattttagagttggaaaagcggatgggcgaaaaattggtgagctgaggggcatgaatcagctcagtggaacgctaactatcagtttatttgtaatgttaagaatgataaagaagccgctgaggctagccttgttgaaaaacaatacctccaggaactagttctactctggcgagggcatggcaaagagatagggaagagcagtgagaatggagtggtcgaagccttgcgtcctccaccaagaattgtacgccttaaagtccaaggttttgggggtgatagcttttctcctagttggtttagaccagaatgcctgttgaatttaaggagtctggagctttccaagtgtgatggcttgaaaaatctatcgatcgcatcgttaccttctctcgaacggctaatgctagaagcaaatttacggatggaagcagtaacaattcttggtggttcaactggtggtgaaaagacgaagcatacaagcagcagtagcagcaactgcactgcatgccttagaggactcactactatacgtcttgtcaactgttatcagctacagaatcttgatgggtgcttgtccccggaatacttgccatccatcgagtgcacagagatcaacaaatccagccatctaggactgtcaatacatgtcgatagtttcgtgggattcgaacacctacaagagatgaaaatatggcgctgcaaattggtgtgtccgcaaggaatggttttgccaccctcactccgacgactctctattgtgaattgccgtaagcttgattt

SEQ ID NO: 49095 - DNA, 760 bp, Oryza sativa
atgcaaagaggtaagccacatatagctgcactactatgctgaaatattttgtttgacatttctgttgatgtgttaatatatgatggtattgtgaaattcttgatgtcatgcatccctgattacacttgatggtgattgacaggtgcggttgctttcattagaagtgtttccattgaagctgtggggcttggtgtacatttggcggcaggagctcatgatatgcttctaaagacagaaagtgcccttacagcaattccaccacctttagcctcacgtgaagcaaaaagaaccaaagacaatgtaagagctaaccagcctgaaagtgcgcaagaagggctgaagaaggtattgaattcatccaaattgcacatgaactcatcttttctgagatgaactcatctgttgtctgctaataacatgttgctttaacctaactatttgcaattctatttttgtttgtgatttgcgtttactttctatatcaatatggtaagtactgccagtataagtttcatttgctgtgtaattatcaataattcaatatatgctgaacatttttcaggcatatgaaagcttgaccgatgggtttggaaggactgcctctgctttgattggaaatcctattaaagtttataatcgtggggctggtgccggatcagctttggctactgcaatctgtggagctccaggtgctgcagtggctccattatcagcgtcttttcgtgctgcacattatacacttcttggtataaggaatagg

SEQ ID NO: 49096 - DNA, 1361 bp, Oryza sativa
ttctcttagattttcatagttttcttttggtgttcgctagatgtggcgaaccattgtatattcggcaatctgccgcaaacccttttattgtaaccgaaacaggtggccgttgggcgtttttaaaatttgtataacagacctacttttcgccatttactgtcggtccaagtctttgacatattattatttcgctcatttcgcattatgccatacctcccccttcttccgcctattcctaccatgtaagctgtgttttgcttttttctgcactgtctatgtcacatcctgattttcgtttcaggatttataaattatttaataaattattaatagaatttatattaaatgttctttaatttacaagtgaagttaaatgtgggaaataaaatttcctaaatctaaagcatggatggatttaatttttattaaattctccatgattaattatactctctgaaattttctcgaatttttcggagctcaattcctaaatgatacaaagaacagttcagtaattatttgatcaataatgatctaattataattattaagagcttttcttgtttaagaatccttaaattataaattgttgtttaaaaggaattattagaaatgattttaaaagcctaaaagagaagatctaattttaatttgttaaatctcaatataaaattgggctaaataaaattttgttaaatactgtgcttaattctataattcctagatttttctgggatttatttgagctaaggaagtatttttaataaatggaattgcatttcatgaataatttaaattgaaaaaggttttaaaagtcttcttttggctttgggccgaaagccggcccaaaaccgctctctctctcctcctcggcccagtccggcccagtctgccgagccgccgctctcctctctctctcgctgtcgctgacaggtggggcccgcctgtcggacccgtcgtcttcctcgcgtcggccgccgcccgaaaccctagccgagccacgccgccgccgctttccaaattcggtcgatcctttccttctccggccgaattgattgaggggaaacaatctccgggatctcctccaccttttcccttttggaatcatcctctacttcggtttggaaatcgatggattcgagtttgttttggattcgttcttcccgaagtttccttcgccgtcgccggtcgccgtgggccttcgccgccgccttccaacccctatataaggatccccgagctctcctctacccgtcgcctcctttgccttagcctgccgtcgcgtctagcgccgcctccgcgtagcctagtcgccgccgtcgttgccgtcggttcagccgcgtcgcgccgccgttgcagcc

SEQ ID NO: 49097 - DNA, 2813 bp, Oryza sativa
ccatataaaggttttaatccgatttaatctttaaaaattcataactaattcatttgaactcagtttaatgtggttcaagttgcaaaagttatataaaataaagatctacatattaaaattgtccataaattgaattaaatttatttaattctttttaaatgggctttaattagatttaatcttgtaaaattcataataaattcatttgaagtcagaatgaggccgttcaagtctcataattcatctaaaattataatctacatgtttgtttactttttatgtactgtttatttggtttttattagtctttttcttcgttttacgtgttagcttgtcgtttccgtcgttgcgaaggttcgcaagtgcgccggaagtattcaagaagattaattgaagaccgattattgcaaggcaagtcacacagatcttaaacacaatcctttgagcatgttgatcctatatttaaattctctatatatttcaactgtgcatttattttcgaatgtcactgggtggtgtgaacctattctttgttatggcctgtttgcattgattactttattccttgataccttgggttattataacttgactagctgggctttatatattggttcagctagatattagatatgattgcttagccatgcttagaaacattagcacataattgggataactaatgtttcactatcacttatggttatatttaatggtatctcacgatggtcaatcgtgattggttaattaattacttgccaactaaaacttgataatggtgggttgtgagcacatggttttgagagtcgtgctcatgacaattaaggactggttcgcgagctactgttgtggaacattaaccgtgccaaccacaagccagtgtgggcaacggctttaccttttgtatagcatggttcattgcggagcaccagactgagaagtggcggagataagcccacgggggtcgctggggagtccatgccttgtttataagggggtgattatgatccaggaaggtgcgctgtggtggattgtgttatgcaaggggtaatgtcacagctcctttccgaggtaccgtggtggtactgaggcaaatggtgacatgatgtggagctgtgtcttgtgggtacagtggtacacctctgatcagagtaaaactattcgaatagccgtgcccgcggttatgggcgggttgagcaatgtttttcgtgattagtctcacacctctcacaataattatagatgttatacctggtaataatttgcttagctcctggtttggagttagatctgtacagccgggtatggttgttcaggatggttgggcctgtgcagcatgggtgtgctgttcagtgttgattaaaatttctgattaattactccactgttttacttctcttaaaagttttgctaaatgctgcttttgcaaatgagccaatattatgccatcctttggtatccttgtgcacttgcatatttgctgtgtggcttgctgagtatgtcatatgctcaccttgcgataatcaatcaacctcagttgaagaaaaaggatccagaaggagaagacgtttggcttataccccagttgagctgcctgtgggagtggagccggagcttcgctagattttattttccgctgtagttttcttcatgttgaggactaagtgcctcttaagtaagtatttattcgctttagttattgatgaatctgtatattaaattgtcagtttgtgtacctcggctgattcctggacgaggattttatgcacaaataagttcggaaattactagtgaatttccgggcgtgacagtctaccagggggttcgccgaaagtcgtgcattcggcctcctttcgggagctggcgaagtcaaaccgagaaatttgtggcgttgaagggtctgccgaaggtgcgatgtccatttcgtcctacttatcgcgaaatggagataaacggtcgcagctataaggttttcaaggttgccgattggctgcgggcgcaccccgggcgaaccttagaagattacgatcttgttcattcaagacgtttggaggatatggctcgcttttggcgaaaccatcagaagactaaacgtcaggaaacgatctttcagcgtcgttatagtttagtctgtgtttcgccccctactcctcttaaggttgtgtatgatattagtagtgatgacgaacctagttcgcctgacccttccttagggagggatagtgattatgggggcgaagatgtatttttacttgtaaggtgaattgtatcgtgtgaaccttctattctttcgaagttaataaaaatgtgttttatttccttttcgctatttttcgcatcgtcacattttgtgcttttgttaggtcggaacatgccggcccctttgcgtatattagcgaaataggtgtactgacttttcagcttttcatcgttcgttttcgatctgtagcgttctgtgttgaaagaaacgcttttgcttttatgttgatcgagcgtaacatcgttcggctagttattttctgagacaagctgttgcggtttcaacgttcggcgagcgatgcttcggccgattcgtttcgcccccctggcctttttcgctgatcaggcgtttgccttggggtttttccacaaattatcaatcacacgaaaaataaaaagaaggcggaggacacagagattttatactggttcgggcctccatggtggataatagccctacatccagttttttttctcttttttctctctttctttttttttcttgccgaaaggcttacatagtgccaaagggcttacataacggtatgtacagg

SEQ ID NO: 49098 - DNA, 1828 bp, Oryza sativa
agtcaatccaagtaaggtataaaattttaattatcgttgtccaattctggttctgccttgaattttgggagaaaggtactaccgatgtgctgaccatgtcttctctacattgtagatgagatcattatggtagtgtccagactcgtgaaattacaagtgaaaatatccaaactgaatgaagtttgttttgctataagtgttcatgctgatttaggaggtcagcggtatttttttttttgctctcgctgaattggttttcatttaggtggatactgtgctaaatttattccatagcaaaattctaccttttgtatgcttgcaacagattactacaaattggatcattgatatattaatttatatttgcagactgatcttttgtctgctcaccagcttcacaattgattgatcaagatcagcgggatgcctcacccggcccccgtagtccatcaatcctgcccacaggcaaggtaagttgctctcaatattgttcctccattgatcgcatatattaataagctaattctacaacagccatctacatttctagatgtcaaccatctgtagtgtgtattcttatctttagtgctatttgttgtaaccaagccaaaaggcatggtgtctattttattcatgttaccttcaaaatcctaggccatattcagttacatgtatgttttcagattgaacaaatttgaccaaacatcagtacatatagactacttgagaatggcatgctcatgttcctataattttcaactgccatccctaagagaaaatacaacttttcttgtcacaactgttcagtaatttgcagcaatactgtaacagcgaagagaatggacaaaatggatcgatggtatcagcggtactaaagctgtgtagtaataaactattttttttggttaagtccatagtaaatgaatctaatcttcctaactattcattttttctcacctagactgaagaatgcatttctcttttacctatgtgtattcagaaatatatatgaggtgagatatgcagatatgcttcttctgctttagaaatttgtggaatacaaataatgaaatatggcaggttaaactatccgtgcatatacagtatgtcatcaagccttagatttttttcgagattatcagaaaatgttcttggagaacaagattactagaaaatggaagtgtcataaacatgtctacttgttttcttttgtcaaacagaccgcttttttggattttattttaaaactttgtgatggttaataaatcttgtttttttttgacccatcaagctggagaacctgatggttagttcctgattccattcaacagggagtctggcctgctgcatcggtcactgacacagcatgcggtttgccttcctcacacccaagctcctccaatctccttaggatttcctctttctttttgttttcttctgtgttttctcctatcctcctatgggttgttgtggaatcaggggggcctatggctgtaaggccctgtttgattcagcttaggattattataatctagcttataggagtaaactgaaacaaacaaatagattattatagcagattattataatctataagccagattattataatctaataagctgctttaaaggagctttttttagattattgagtggctaaagacccactacccttacatatttgagaaaaattacccatctatgccatcaaccgaatagatagctgagggcattatagactttagcctttcaaacccaataatccatccctccaataatccagacaaacaaacaactcacagcttattttatatcagcttattataat

SEQ ID NO: 49099 - DNA, 2174 bp, Oryza sativa
tatcagaacatttatatattgcatcactttgttacttatttttccttttcatttcctaacagaaccgccgatagagaaaaccttgcgggcttccattgctgagatatctgttgttcttttgttcagtgatgaaatggatgctggcaattccagtgttcctatcagtcaattcaatgacatgagaaattctgaaatgttttcaagctgcctttcctttgcacattttgagcaatcaatgatatctcctgctcctgctgccagcttgaatatgcatcacgttgaagccaagtgtcagaacattcatctttccctggaggtatggtctgcttccaccaatagcactttttcgtagtttatatctcctaattttatgaagcttgattctaatgttatgttcttgatgtttgcagacatatcctgaaaacctaagtctcaagggatcaattgctgctataaagcttgatgaatactatggcagtaagaacaatgattcagatcatccaaatcttggtgctgctttcttgaacaataatttttgcagagaagttcaagcttctctccctcaatctgtatttgcttatcaagattaccatgaggaaacatcacgccgtcataccaacaattcaaatgacctcactaaggtcgaattgctaaacacgtttggtgagtgcgtattccactatgatgtcagttcctcaggtcaagatggcaacccagtaagctcaacttcactatcagtctgtttggctcctttggtttgctgggtgcactttcacacaatatatatgctactgaattttatcagtaaaatcgagtctgatgttttgcatggggaggataaaattcataggaagaatgacgaaaaaaatgtcaatttgtctatgaagtcaaatgtttctttgggaggaagccaaaaggttcagatagccctgtcgcctgcaagagtcatcttttgctttccttctgaatcatgggatttgagctgcccatccatgctggataagttccttgtcattgaccacacaccatctctgaaatcaggagcagattcatctccacatcaaaatgaaatgcctaatgatgtcaatgcaatcacaccatctactttggtccatttggctacagggaactttgacatctatttggttagaccagttaatgatgaactgaatgctagaacctgttctctgagtaggcaaactttctcttctctgaagattttctctgttaccggatccaattgtcatgaaactggcattacgatgctctggaagaagtatcctttaaaagaccctgagatggtgagcaaaacttggagtttgccaaacctgcatgagcaaaagattgctcagaacaaaaatggtaaatgggttggtgtttcctcttctacaacctcagaagatcttgaggaatcaagttccagtatacgcagggagctcctccggagcacagagtttttgttgcacattaaactttcttgtgtctcagttcatctcagtaagaaggactgtgggatactaaaccatttgctaaaaaacatccttgatggtctttcagatggagcaactggaaattttgaaaatgacagtgacaattgtatgccaatccatgatactgctagccaaacatctgtcatttttgaatgcagcatcttggatatctgcactgaattggatgaaactgttgaagttggtcctttattgcagactgaactagaaggttcctggaactgtctcaaattgtcaatttcaaaattttctctgctatcctcttctaatgttggcggggttaacaatgccaattttctttgggtcaatcatggtgaaggtgagctctggggctctattactggtacggatgactatgaagaaagcaaagatgttcttctagttgtttgcaaggattcggcaagtagacgaggtgatggtgaaggtagcaatatcttgtcttttggaactgcgggctgttctgtgactcatatcatgaacccaaagtttcagaagaattatacttctatcaatgttcgttctgcaacagccgttgcacctggtggccgcatggattggataagcgcgatttgcctattgtttagttcagcttcagatggaactgaacaaccagctaatagtagcacaatgaacgattcccagggtggtgaacctttttcatcactg

SEQ ID NO: 49100 - DNA, 5000 bp, Oryza sativa
  unsure (1)..(5000): unsure at all n locations
tacttgggcaaaactaagtattgcttaagcttgtaacttgagcatacccccgaaggggtcttagtgcatcagtcaatctacacacagaaagtgttagaatgatttggctttgaaaagacatatctttctaaaacccctatggtcggaaggtcactccaagtagaccaagatccgtatagaccaagagaagaagggaaggaagtcattggattagaatatccgtacttgagtgcaataggagtgctcatgtaccttgcaaattgcacaagaccggatatagcatttgtcgtcaacttacatgcaaggtacaacacagagcccaccaagaggcattggaagggcatcaaggacatcctccattatcttcaagaaagtaaggacatgaaattgttctacagaaagaaccaggacctcaccttggtaggatatgcagatgctgggtactctctccgtcccaaaataagtgcaaccataagtttcaatgtccaattttaattatccgtctgatttcaaatttttttttgaaaaaaaataaaaaacataagtcacgtataaagtactattcatgttttataatctaacaacgataaaaatactaattataaaaaaaattcaaataagacagatgaccaaagttggacacggaaactcatggctgcacttattttggaatggaggaagtacctatcgaacccacacacagccaagttgcaaactagttatgttttcctatatggaggaacaaaaatttcctagaaatcgtcaaagcaaaatctagtagcaacttcgatgaaccacttgaaaatcatcgcactatacgaaacctctcatgaatatgcatggtttcgtcgaatgattcaccacatttagcaatcatgtgaattgaacaccatccagactcctataattatctatgaagataatgcagcatgtgtcgcacaaggacaaatgggttacgtgaaaagcaatctcaccaagcatatataccccaagttttttttatgctcatgaactgcataagacgaacgaaattaaagtattgcatacaagtcatgtgaaaatatcgtagatttattcactaagtcattaccaacatccccttttgaaaggtgcatctgagggatcgggatgttgaaacttagagaaatgtaaaattcaggaggagaatttcactgactcacttgccaaacttagtccagaatgacaaagtacctaataagaataattggaggggttgtactctttttcccttagataatttttcccgcatttctttatcaaagtttttaatgaggcaacccgtgccacacaaaccgtatgttatgtactttttctctattttttttccactggctcaataaggagctttatgaggcataagcaatacatggtgacggctcaggagagtgttgaaaaacttggccaatgaacgcccaatacactaatcaggcctcaccctactttacatgtataagaattggctatataaagaaaaaagaggagaggctttatgtaccatgtataagaattggctataaagaaagaagaggagaggctttatgtaccatgtataagaattggctatataaaggaaggagaggagaggttttgtggacagttgaaagaatgtgaatgacaatactgtaccccttctcatatctcgtatctccaattttctgtagattacataaccctcaataactacttcaggtagcagaagcgttgcgtaataatttggacttccatcagttactacaaaagatcatctccagacacgcacacgcgaaacaagcgcttatatctcattgcagcagcacaaaacctgatgatatttacacttgtagagtgagagttacagtgagcagtttctcaaaccaacaaaaacgtaaatggaaaaccgagaaacaagagagatatttacatttgcactactcagtaatcaccaccaaatttatgtacaagagccaccgagccaagctccctgtgaccctctctctctagccaaatcctaagcaaggagtcaacaaaacttccacccgctccgggtggccacgtttgtgattacaaccgtgatcgtgtgctagtaatttacagtatgaaggttttcgacgtggcatctgaaactgtacacctgcagaggagatggattatgaactccaacaagaacatcggagatggcactgattcacaaatggttggattgctagtgtggaaatctgacttatcctgtacaagtttgcccaccaccctttgatgagattgcacacatgtgctcttgaaccagttcttccaggtaaatacgagatctcgcaaaagaatgaacagaccacctcttctcaatggaagtctacaattgaggaggcccgtggtatttgtacatagattctttcttgcgttcaggatcaaggctgtgaatgtagaagaaaagaaaatattagcaaaccaacattagcagtctgtggtcatgccaaaaatgaagtatgctcaagagttgtaacattcgcataggacaaatatgtattttcaccgatgctgatcggaagagaactcaattccactaatattataaatcaaaccaagatcacaattagatttttctgtagattgttccatagttacctagtcagttgcctagcctaattcatgcacattattatttttgcaattcgtaagagcctagttaaaaatcattggttacaagttctcccagttaagtgagctggggtcaatgtagggaatgccaagccccttttgaccctcataagtcctcggtgtaaataaactgtttttgctcaaacacatattttacccagagtaacaaatagttttatcagtgcacagactgataatatttaggacgataaatcaactatattctcattcttttgcatagatatacatttttcatttggggcaagtcagttacagttatttagctacgaagttttattgattaatcctaagctgtccagatccatgaactttgttaccttccgttgctaacttcttccagttccaacagaagacaaaaatatactaatacagtaaattgcaagtcaatatatttctattttcaaatctttttaatatctatttgtattactccctccaatctcaaatagaaaactattcagaatttgtgcaatcagaccttgagatcttgctcaccattatatgggggaaaaaagagagaggagattttatttttttatttttattttataaatactacctccgtttcatcatattataagtcgttttgattttttttcctagtcaaacttcttaaagtttaaccaagtttatagaaaattttagcaacaactacaacacacaattagtttcattaaaactaacatttaatatattttgataatatgtttattatggattgaaaatatttctatcttttttataaacttaaaaagtttgacttaaaaaaaagtcaaaacgacttataatatgaatcggaggaagtatatgattacaaaatgtaataactccattttttaatagatgacgtccttgacatttggaataacgtttgaccatttgttttattaaaaaaaatagtgtaaatatgctaaagtataaatcatactttcatgataaaacatgtcacaacaagataaatgatatttatataaattttttgaataggacaaatggtccaaagtcaacggtgtcatctgttaaaaaacaaagggagcattatctaacatgtgcatggagactttgctgatatatcataaataaacaagtaaaaaaagaaaacaagttagattagaaaatacaaatttttatgccatgttttgagtctagctgatggtctcatgtcacatgtgaaatgtgatcagaaaaacttagtcctattgcatcgagtaaatgataacagaacagaccgaggagtcaacagtgagttgggaatggtctggactgatttaagaattcaaaataaccgtagagcttcacaatgtttgctgatttgaaggttggaggtgaatggaatcacctattccttataccaagaagtgtataatgtgcagcacgaaaagacgctgattatggagccactgcagcacctggagctccacagattgcagtaaccaaagctgatccggcaccagccccacgattataaactttaataggatttccaatcaaagcagaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 49101 - DNA, 1311 bp, Oryza sativa
tgggttccaaatacttagttatatatgcagtctcataaccaacgtatattccaatcttttccaatggacccctttgcttgttcgttgaggtggtaggataggtatatagactaggcatccaaatttgaacaaatgggacaatttccgtgtgaccccttgcaccaatttcatttttgaatggattgtgtagggccatgaatctgaaattaataagaattaccacgtgtagggctgcatgttcccaacacgtgcttggcaatttacaaccttgcaagagtggcttggtgatgaatttaattcttttaatcaacgcttctgcaagtccattttgcgtatggacgtgacatatcgagtgctctgctttgattcccattgccatgaaatattcatgaaatgcttttgaaataaattcgcagcattgtccatttgaatggactgcacatgatgatcaagaaaattattcttaatttggatgatctgctagatcaattttgcaaagtcatggtttcgttttgatagcaagcacacgtgcgaccattttgaggaagcatcaatgagcaccatgaagtatctaaacggcctttataggtgctgtatagggccacatatgcccactgtattcgtgctaagaatgcagggatttcatccttcattttccatacggatggtcttgtgatcaatttcccggtggcacatgcatgcctcgcaaaatcttctcttttttttttctgaaaggaacatagaaagggaagcccctgttaaaaaaaaatctaaattgataattgaaaaaaaagattacaacaacctaatccagtttaagactacatctttatcaccctcattcaatctaaataacaaaagaaggagatcacccttgagggattgtctccaagaaaccaaggaatgaagaatattctcaaagaaatcaaattaacgtgcaatctccaatattacttgatctgaattgatgggccgcacaggtcctacatttgcacatcgtgctccatgtggctgaccgcagaggatagggtggagtccgccggtgatggatgttgtttgctatttttcttttgccggtgatggatgttgtttgctatttttcttttgcttgtcatctctatgacatgaacgaaaatgttcttacatttttttcgtgcttgctagatgatggatggctgctactgcgcaacgtcgagcccatctctataccacaccgctacacccttccatgattccatcgtcaaactaccgctcgccacccggttaccctctccactacccgtcacaagacacagactagcctctccatta

SEQ ID NO: 49102 - DNA, 2670 bp, Oryza sativa
ccttcagagtcagagccagacctcatgcggcggtggagatgatgaaaccgataagataaagccccgtcttgctgtttatgcccagttgccagtagaggacttgaagaaggatctggaagaatgccagaggttggacccctcagatggcacaaatcttgagcttgaaaatgcgtctgaatttcgactgagccaaattgtacgtttccattgtctcatgttaaaacgtccagttttctctccatcctttactttgctaaacttgtgcttcacttgcaggagttttcgcaggatagctttacgacggcatgggctggtggcaaggtgatcgattgacatgtctccaaggtgctgtcaacaccattttgtacattgaagaaacaactgaagcctcttccttctgcgagacaacagtaaaatgctgtcgatatatgtggtgaagcaactcttgtctcggacagtaaaaagtcataattttggcccggcggcttgccggggtaggcaaaaggtgagcttatgcgctggcttgcccctgaatcccttgatgcatatggactgtgcaccggtgactattcaatgctaaagatcacatattcctggctgtaaattgtgatggtggatgtctcattttgcttggatactctggaccatccggtggtacaaggggaacttttgcttctggttgaactgattactccaataactttcgtgttaataacttttgccatcatgatagtgcctattatttataaatgtggacacaagtcattttctggagcttgtggtaaagcagggctgagaatctcgtgcaagcttcatcttgtaaattgcagtaatcagcataagattgtgacagataacttccatgtttcagttcctatgcattactactatctaattttcctcgggcaatgagcatgaactatgcatgagactctacagaagatatcggatacgaccatacgaatggactaggatgaggatgctactactggccgccaattttgcttggcattatggtggattactctaatattgttttgtgaaattgtttctactacctccgtttcagattataagactttctagcattacccatatttatatagatgttaatgaatttaggcacacatatatgtctagattcattaacataaatatgaatgtgggcaatgctagaaagtcttgtaatatgaaacggaggaagtatttttttttcattatcaaaattatttcttttaattcatgttacaaatgatagctcctcgaaaatttgaacaccatttttttaaacatgagatagaagctccaccgatcaattaaaagggaaaaaagcttaacaaggtctataaaacaaagctataccgatcctactggtaacaaagttaatggacgcttaaaaaaagtatggacacaataactagaaagaaatttgagaatatacttttccttttaaaaaaatggacatgattgtaggaaaattgagaaaatatacacgtcatgtggcgcaaaactatggagtaacgggaccaaccaacaagttcttgctaatgggaaaaagagagggttgaatgtgggtgctgttcttattttgcccgagggatccgaattagcgccgcccgactgtatttctcctgagttgaaagaaaagataggaaatctctcttttcagagttatcgtcccaataaaaaaaatattcttgtgataggccctgttcccggtaagaaatctaccccgcgcattggctgagcgtcactgggttggtcccacagcccggccacgtgagactgagggcagcaacaagtaccgcgccgtgggtcggtcccatagcaccgggtctacaggccccatcgtttggccaagtatggataatagcactgtaataataatttataagtaataatagcactgtaattaaacttttatatatgtgctcttaacgatttaaataacaatgctgaaaaataaactttaataaaaaaatcaaaatcaacttcaaaattgagttgtaaaattcaaaatttggcagcggctgatattgtatggaggaaacgatgggaatcttaatacactgatgcatattgattttctcagttcatctatctctaccgagtttctaatccctactccctccgtaaaaaaaaagtttggacatagctaactacaagtggttttttatgtgaagagcacatgttatcatgatgcatcataacttcactaccccggactaaacaagattataatatgctgcaatctgcatggtttctgaaactttgaatccattttgaacaaaaaaaaaaggttttgagatgacatgtagacctagtggtgcggagctatatctgatatggaatcgattgggtattacgccgtcccgactgttgctaccttcggtcccgcgttgctgggccacaggactaacccactgccccgcagccgaggcgcagggtggagttggtatcacgctgttgagcaacggtaccaccgtcctcgttgtcggtcctgcagcttcacgccgcgccgattgacccacccatgtcttcgctccgtgggatgtgtatattttctcaattctctacgattatgtatgtataaaagcaaattcttaaaaatgaaatctatatcctcaatatttttttctaataactattacaattggatgggatcaatgg

SEQ ID NO: 49103 - DNA, 743 bp, Oryza sativa
ttttaaacaacattttaactttttagaaatcaattcattcgtttataccctcaaatagctatcatataaatcagataattcataagtatattttttttcatgcgagtccagtgtgcaggtggcattcgatggctttcgttgcagacgctatgtttggatgggactccgaggtgaaagccttgctcggcttgccaatcctagcagcatgatgcccttggcgccgttcaccttctcgagggcattgctattggagcccttgttcaactccatatcaagggatttctctgggtgaaaaccatagattcgttaggatcgggtgatgtcgccgttctgtcgacgtgttcttctcgaagtcttcgttttaggtgcttttcccttgctggacggttgtacttaaattttaggttcactccgtcaatgccggggttttcgccggtttttcataaattaaccgggccgtagtaaggattttgggtccagttttctttataagtgggataactctcttcttcttcttctattgggaaattgcaggagctccctacccgttccccgcgaaaaaaataatgtaattatttttggagttatttttcccttactgtatagttctaatcgtcaaggtttccttctattctctacttcctatacgatgaaaataactatttttttaaaaaaataatatagtgattaccctcaaaaatatagaaaataattttatttacttctgaatattctacactttt

SEQ ID NO: 49104 - DNA, 1137 bp, Oryza sativa
acggaaacgcaatgggtgaagtaggctggaagaggacaacgacaacgcgcttggggtttcactgggagacgatgacaacgactccccctccttctctcccactctcccgctggcctcatttcccccttctcccgccggcgcgacaggtagcctctcccccttctctcgccagcacgggcggtgggctctcccttctctcaccggcgcggccagggcagtcggtgtcacgcccagaaatttagcccaaatttccagactattttgtgtattaaatccctgtccaggaccagccagggtacacaaaacgacaagtaataaacagttccaaacgtaaataaagcgtaaaatacttacaaaagaggcacttagtcctcacaccgaaacaaaagcagcagcagcggaaaaaaggcgatcctagcggggcttcagctccactccacaggcaaaactcaactggggtctgagccttggtcttctaacttcgtcttcagctcagaaacactacacttctgaaaagggggaataatagcaaggctgagtacaaccaccgtactcagcaagccacaccaatgatgcagacgtgcaaagggatacaaggacggtttgtggctatttgcataaaggcggttgtgaaagattttattgagcaaaacagtaaaactgttgagtaattaaagtaacattaaatctccactgatcaacgctacaccacgttgaacaggcccaaccaacccacctaaactacagtgtattaggtcgatttattaagtgtgagactaatcacggtgaatctggtcgaccgcccataaccgcgggcacggctattcgaatagttttactctgatcagaggtgtacaactgtacccacaagacacagccccacgacacgtttccgtgcgccgacatgccaccacgacataccggaaagaggccgtgacaggacccttcgcataaccccctctagccaagcacaccacacctcaggtttcacccccgtccccagcgggcaacgggtagtcccctctcgtgcctaggtgaatccggaagcgacagaggccgtcgcagggcccgccccgctccatcacgcccacccttgcctggatgcgtcgactagaggaaagctacactacaagccca

SEQ ID NO: 49105 - DNA, 1606 bp, Oryza sativa
taatcctataactagtggaatatttattattctaacacaaatatgcattgcaagcataacttgttcttctttattttgatagtattggcggtcgaaactgtttgctaacgaccgtcaacaaaaccccccaagcttgaacctttactcatcccgagtaaaagacgaaaggaaacaaaaacttggttgttgatcaagagttgctactatgctatatatctcaagtgtacaggtgcaaggtatatgtattctctctcaaattgaataatctttggcacggtggcttacccttacccctgattcccatgagacactgcctctccttgccttgagctgttgaaagacagaacagcaatagaggcgggtttaaaaagggaaaaacaaatatttcacaatatttatgtagggtttattttggtcttacagataaattactctcttggtgtgactgtcacatctaacatccttccaattgcaaggatccacatcttgttcacgccagttgaggaatatcccatcaaaagttgtaactgccttcttgaaagcaagaagtgcttcatctgtagaaaaccgtcaaaagaatcatagcaaatgatcacagattgtcaaatgtaccacacaaataccaaccataactatggactgttacataccatctgaacttagtgctcttacttcacgagcaccaaggtgcaaaattaacaaaattaagaggaatctgggctattttctcagaaaagagcccattggtcaccagttggtgaagcatataaagatcaccatagcttattacagagttcatgtgtgaggtatactatgtgcatcctcttttatgggagatgaactccacatgtagatgtggccctgatgagggaggcaaattgctggcactgtaagtaaaaacaggaacatatcagcaatcatgcaaagttatcaaataaacagagcagcaatcagaaatgcagatcaaatgcagtacattgtgacacacttatagctccaccttaccaaaatggatgaccataaggaccaggaatgacaatttattaataaaagaatttcgatgtgcttccacaaaattgttttagggtaattgaattacctagaacatgcaatttgaagtttccccaaaaattctaacaaaaacaatttagacagcgtttaatttcgaaaaacaatttagtcacccccattactgtaaatcaacatctttcagttacctctgaaaaagaaaaaaagggaccaacttagttagccgaagaaacaacaaagcagttactgccggcgccaacaccaccaagcaaaaatagggtacagccacaacccaacccacaagcctcagggacgctaccgacactaaaccaagcacaccagatgagccgcccaaaattgcaagctcgatcgcgcacaacacaactcattgcatccaccaccagcagtaatcggcaatgcagcaaagcagaaacggcttaaggcaaggagcgagttataaccttgacgtagaggacaccgtcgatctggatgagatgttgcccttggtgatggcggactggtcggggatggggatggcctcctccttgagtgagtggacgtacgcgatgtgggcgac

SEQ ID NO: 49106 - DNA, 8838 bp, Oryza sativa
  unsure (1)..(8838): unsure at all n locations
ccggtaacaaatgccaagtcaggtcgtgtgcacacttgcccgtactgtaggcttcctacaggtgacgcatatggctttgttttcatttcattgagctcatactgatttctgggacattgcaatgccccatacttttcgcctttcattataggagcaggtgtagcactgcatctgtacatgttgaatttcttcaacaccttttctatatatgtcttttgagaaagtcccaatgcatactttgttctatctcggtgaatctctatgcccaaaacatatgaagcctcaccgaggtctttcatgtcaaagtttgaggacaagaatttctttgtttcctgcagtagactgacatcactactagccagtagaatgtcatccacatacagaattaggaaaataaatctcccatttttaaactttgaataaatacagttgtcctcgacattctcttgaaacccaaatttctttattgtcccatcaaacttcaagtaccactgtctcgaagcttgctttaatccataaatggatctctttagacgacatcccatattttcgtttcctttcatgacaaaacctttcggttgcgccatgtatactttttcctccaaatctccatttagaaatgccgtttttacatccatctgatgtaattccaaatcataatgtgccactagtgccattataatcctgaaggaatctttacaagagactggagaaaatgtctcattgtaatcaatcccttctcgttgtgtgaagccttttgccacaagtcgcgctttaaacttttctatattccctctggagtcatatttggttttgtagacccatttacagcctactgttttggctcctttaggaatttcttctaaatcccaaacatcgtttagtttcattgattccatttcatctttcatggattccaaccattcagatgagcgagcgcttctcatggcctcttcatatgaggtgggatcatcctccatatgcgactcttctatattataaactttatagtcatcacggatagccgatcttctgactctttcagaccttctaggggcctgcacatttggcacatcctgtacctgaggctcttgatgagtctcctgtactggcacattatctatttgagactgttgtagctcctcctctggtgtggcaaccatttctgttgaatcctgtataacaggttcctcactctcattcattgttgccacaggaagggtaacaacaggtgctggtacctcaatgacaggcattgcaggcacaacatcagcaggtagagagaagaaaggttcctgagtcgacggagcgggtacagacacccgcctctcctcaagatcaatttctcgaactaccgagctccccctaatcatttcgtcttccaagaagacggcgtgtctcgtttctacaaactttgtataactgtttggacagtagaaacgatagccttttgatctttcaggatagccaataaaatggcagctgactgttttggggtccaactttcccaatatttgggttaaatactttggcctctgcaggactcccccacacacggaggtgagttagcgagggtactcttcctgtccatagctcatacggtgttttgggcaccgatttgcttggaactctgttgagaatatgaatggcggtttttaacgcctccatccataaaccgagtggagtgtggagtagctcatcatgctgcgcaccatatccatgagggtacggttgcgcctttcagctaccccattctgttgaggttcgcccggtgttgaatactgggctactattccattctctagcaagaaccttgcaaaaggtccagggacttgcccataaggcgtatgtcgaccatagtactcccccccacggtcagatcttactactttaatctttatatcatgctgattttcaacttcagctttgaatatcttaaatttatccaatgcttctgatcgctctttaattggataaatataaccatagcgggagtaatcatctgtgaatgttatgaacgagtcatagccatccacacttttcacaggaaatggaccacaaatatctgtatgaatgatctctaaaattcctgcgcttcgttttgcaccctttttgatgctctttacaaattttcctttaatgcattctatgcattgttctaagtctgagaactccaatggaggaagaatttcattcttaactagtctctcaattctccccctcgaaatatggcccaaacgacagtgccataatttcgatgagacatcgggagttcactttcttttcttgttttcttttgtcaacgaggacacaacattcacattctcagaaagagataacaaataaagctcgtctcgcaacacagcaagaccaatacatgcattattatgccatagttcacatttgccacttccaaagcggcaatcatatccatcaaaatccaactttgatacacttattaagtttctttgcaaagaaggaacataaaagacatctcgaagtaaaagtatgaagccattcgcgagctctagaggaaaatctccaacagcttcaactttttcttcaactccattggcaactctaatggtgctttctcttctttgcgtagtcctcgtcgaacggaatgcctttaaacaattacaagcatgaatagttgctccagaatcaatccaccatgtggatctagagtaaccaacataatgagattcatttacaaatgtaataatgttctcacctttctttgccatgatcattttcaaaaagtaggacaatctctcttgtagtgtcctgtcttcttgcagtggagacattgatctttctcaacagcgaactgttgttgttgaggcagatgctgagactgtttaccttttgaggtgggagacttgtggttctttttcttatctttaacatagtttattgaaccaccatttgattctttgattctctcctcctcttgcacacaattagcaatgagcttctcaaagttccatttctctggacttatgttgtagttgacaataaaattgtcaaactgctttggcaatgaggccataaccagatggaccagaaagtcatctgttatgcccaaatccattggcttcaatttggaagccatgttgctcattctaagtatgtggtctctaacaccacctccatggtacctttctgtcacaagctgcttgatcagctgtgtagcataagtctttgaagagccagtaaactgactctttattctttcaaggtactctgagacagcgtcacactctgggatcgagcccaatatggtaggctcaatcgtattctttaccacagccaaacatttcttgttggctaaggaccatttcttttgttcaatgtcatacgacatgacgagaggagcattgtccctctgtctcttttgccagtcagcatctgactcattttcacctctgacaagttcagtaggttctataggacatggggtagtcaacacccagtccacctctcccaagataaaagcaaggtcgagttttcttttccattctgcgtagttatctccttttagggtcggaatatctttaatgcaacccatcaaggagtagccacctgaaataatcatgtgcggtgagaacaaaattaacattaaaatattatgcattaagcctacatcaccgttgggcagaaatagacataacacatataaccataactataatattgcaattatcaacgttggtcagaaaaattacaacatcatagcacataattaatgttcctaaaattaaattctcccgttggttcgaaatttaattttagaaacactaattttcatcaattacatctatttgcagcggaaaactatataaaatcatatgaacagtagcaaaatctctgtaattctctctctgtgaaaattctcccgttggttcaaatttaaacagaggtaaaacatgcaaaaatctattcaaaattctattgaaatttgcatgaaaaattgacaaaaataaaatggaaaaattgctactgttctcttttattcattttcggccccggagggaccttatatggactttttccggcctttgccggtcggcccatggccaccttgcgcgcgggcgagcgccccctcccctcccccaggccgcaacctgggcctgggccgggaaagccgccgccgcgcgctccccacttgggccgatttcggtccggccgccgccggccgtcgatcttagggtttgcgatcggacggccgggcgccgaaaacggggatcaaaacccctcgcgccccggccggccgccgaaaccctagcttctcctctctttctctctctcgggcgggcgcggtcgcgccgagcggcgtcgcgacgccggcggccctcgcgccgccgcgccatggccggcgctcctttcttttctcttctccgctccccccaccgtctctaacccccaccgtgtgagagagagatggcgacgacggagatggcggcgccggcgcgggccccctccccggcgcgcgcgtgcaggtgcgcgcgcggccgtcgagtggctcctaggcggcgcctctttgcccctccccccctccgttgccggcgtcgacgacggccggcgacgaggtaagattagggttagggtttttggttcttttgatccgtgcggatctgtgcttttctctctttggatttcttttcccgaaccgatctaagccctagggttgctctgataccaatgttatactttgcactaggatcacctaggttagatctagtcgggtggttctatttgggcttgaggtttgaactatagagattgaaaacgggagagggtttaaatagaccgaccggttgaggtgttggaggatgaagaagtgccggccatcgtctccgttggcgctcgttgtcgtggatgcggcgccggtgaggtcgacgacgatgacggctgcggaagtgacggttgtagatgtcccggcgatgaggtgtggcgcggcggtggcgcttcccgtcactggctgcgccccctcttgatcggattagggtttgtagggtggagttggcggcggcggtgaatctcgaaccttgtgccgtgccggcctccacccctcttttattatggcgcagtgtgacgggggcccaccagccattgggctgggcgcccccgatcagggcgcggtcaaggcccccttgagccgttgggctcaaggggagagagatctatctaacagtgggatgagagggagcgggcggcagcggctagggtttggggggccgacgatggtggcgggggcggtcgacggcgacgcgaggcgacggcgacgacggcgcgaggcggaggtggcggcgcgaggcagaggcggtgggagagggagagggagagagtgggggacgagggggagcaggtgcggtggcggctaaggtttaaggggccggtgatggtggcggggacgatcgacggcgacgacgacacgaagcgaccgggaagccggaggcggcggcggcgggagagggagaggaagagagtaggggatgagggagaacgtgcggcggcggctagggttctgggtggtagggttagtagcgtcttctttccaaaaagcccttcggcttcaactttttagagcgtggtcttaattcgcaatttttctctccttcacatgaaatatccggattttataatgtcctccgcatgaaaaacgtctcataggtactatttgcttgggacctatatcgaattacagaaaaatcaatggactttttcgcaaaatcgccaacccacgtgcattgctatcctacgtggcatcgcccagcgccgctcttctacggctgtttacaattctctgatagcatgctgtgccactgccatccacttcttttttgtgccatgacaaattttagatatccatactgattttaatataaagtcatgattcacattggttgcaattgtaaaacacacgggaaagtgcttgttcaagaaaaccaatttcatactccctgtggaacttctaggagcctatgagatctacccatttcttcctactgcagatgggagagcaaagagatgaagcaggcaaagctatctttgatttgttattgtctattgagccgctatgtaaagtagcccttgtgagttgtgatctaattgtgcttatgcgcttcgcaaagcttcatgacaaggaaaacatcagtttcatgaaatttgacacatgtgcgtggatgtagcaaaaaccgatgatttacatgacaaataaagatgtactatggtaaacctttttgtgaagtttgttttcctagagttgaataaataggaattgtttctaagattgatgattttttggaaaattaacttagaaatgtaattcaagttttattccctttgtactaagaacttagccatattatcttttacctcctgatttcttggatgtaattattttctaatacatatctcttctttctataaagttaagacccaaagctgcctcctcaattcgccacatcatcaacattatattagttgttcgatcaaatatgtacatcagatatacgcagatatacgccattggatccatcatcctcttgcccaacatgcatggtaatcacttgctccttcccattcccctcccttaatcacatgcattaatttacagtagaaaccgccaaatcaattgggatatgaggtgcgatggttaatacgatttatgtgcctcttgcgattctcttccaaaccttttaataagccactttgcaatcccctctataactaagtctcttttctcttccccctttgcatgaatcttttcatcgtacgttggattctacttcttctgtcccaaaaaaaaaacccaatcctagatttgaagtatttggtaagcctgaatttaacatttattttggccggattctctttgagtatatataatgatttgaactaagcaggagcactatgaaagctttgttgattagtttctctaaaattgaagaaagaatccctatcctatgcatttactgttgttttagtttcttaagaaaagattcgtcatacttacaatcaatacttatatgtcttatcactttaatttatttgagcagttgggaaggatacagaggattgcaatatagctgtcctgacatagcgagaagcagcttaacctactcggaatgtattttgttttcaggttcaatcaatacaatctaattgtttatactaatatgcatatttacatgttctcaaatgtgcccgcagcaaagcgtggggtttcatctaggtataaataatgtgcatagcacttgtatggttactgtaaattttttattgtttatttcattctatgtttacaaaacatatattctttcggttgtttgatttttacttctaaacattgccgtagcgttagcacgggcgaattactagtttgcttggttaaaatactttagctttcaatataatttctaaaaatgcattatttgatgatttttattcccgaaggaaaatcggggcatgacaaactctcagcgtttgcattgtaatcggacggcaagccactcacgatgggtgccttgggtcaatttgggtcgcgtcccttcacctgcagcctatcaaaatcctcatttgtttgggctagaatatacgcacgcaaaaatatattctggcccattcagccattttgctccctttctcgagaaggagttcggcacttgcatttccatggcttcttttatgattccaacggtaccgtacgnnnnngnacatcaagtttaatcgacatctctaaatcataatactagaaatttcacatctcattttatcaaaaccgtccagacagatcctagggcagtatcgctagctagtttcgctaacgcggcatcctaatcagcaaaagaaaataaaaaacacatgggcccatatgtaaagtgagaagaaaaaagttgcatatttaatgcctgggctatggtgaacagagagtggcgccgatcggttcattcgagagcgggtgttatgaatccatcaacgttgctaggacttagatctggtggagagcgcaaaaactctccaccgaagagtcttactatcgagagagaagaaaatggtgagaaaatctaggctgagagggactcaacccagaccagtgacttgctcctggtagctccctaccagctgagctatccactgttctctccaccaattacttttaggctctttagttacaccctgatcgaccaatcgaccgggcaacatccacggaatttgatttgatctcagcggcggccatcgatcacctcatcggcggcggcgtgattccgagcacagagcagaggcctagctagttgttcatgtaatttagcaattgctttcgtcactcgtccacttggagcacgaggacgacgatctcggccgccacagttgatgggcagagaccttgttgggaacatctcttggggctgagggggtgacggaagcgtggtgcttttgctccttctcttcttggaactcgtcgctgacgatggcgtggtaccggcactccatgctatagaaggccctcttagggccggtcctaagtttttagggccccagtgcgaaactaaatgtaggcccttaacatactactacataacaataatcaacaatttctagatgagaaattatcgatgacatggcttgataatgaaaaaaattaacactattatgattgtttaactcatataaattacacaacaaaattacaaatctaaatttaaaattttaccaattggttgatcgcaagcgtctagatgtgatgcgtaatgcatgaggacgattctatcgagtgaaaagaaacaaacaattaaacgctaatgcccgcgacgccgtgcgtcgggatggcct

SEQ ID NO: 49107 - DNA, 2061 bp, Oryza sativa
  unsure (1)..(2061): unsure at all n locations
gggccggccctgggccctctctcctctatacatgaagatgtccttgctgtgatgttgtcgagctactgccggcaaaggtcacggcaatgccagaaactccaccacccagaacgccgtcgtgccgacgccgaagcaacacaggatggtggtgcaccgcagctgcacccaagctccgaaacatccagtggtacggactcaacatataagtacggaagagatacaaagaagcgactgaggcttacccaagtggttgttttctgaggcatgaacgtttgtggacgcgggttcgaatccttctctacatgtttttccaattagttccaaacgtgctcttttaattttcttttgaaaattcaagtgtattttaaattcgttttatttttaaattaataccgaaaatatgcaaatttattattatcaaacttattattattattattaaattgaggcaaatgttatataatcgaaatagtcaaattggtccttccatgttaaaaattgcaaaattttaatttttcttgttaaagttcaagtgcattttaaattcgttttatttttaaattaagaccgaaaagatgcaaaattattattattaaactaaatattattattttttaaaaaataaaggcaaatgtgtggtccttccaagttaaaaaaaatcgcaaatttttagctattgagctaaattatatgattaatatcataatataagttctcaaattttttgtccaaatttaaagtaaataacaaaacatgtgatattttaaaagaaaaacaacaaggtagagtcagaggataaaaaacggaagaaagtatcgtactggtgtgggaacatatggagaaaaaacatatgctaccaacaggctagcgctccttttgttgtttactatttctatgcattatggctgtgtttagatctaaagtttgatccaaacttcagtcattttccatcacatcaacctgtcatacacacgcaacttttcagtcatatcatctccaatttcaaccaaaatccaaactttgcgctgaactaaacacagcctatactcagaaaagaggtcagcgccagctactacggtgccgcgctcccctcacgtggcggcaattgatttcgtgccaccttggacatggtacgttatatcctggtgccatcggggttgacgttgaggtcatagtttatttttggaattagttttttatatgggttattttttaaataagttttggaaaagtgtcaatttatcaaaacctacctcgtcgcgtttagctcaccgtgagcagtcgagagctcaccgtgtaccaatccggcagatcgccaaaccagttccgagcgcgagccgaggcggaaacacttccatttcgggcgcgagaacagcgacacgctgccagagtggctgcctggctggagacacgtgaggcgagacgcgcgagtgatcagctaacgtgcacgtggcttacagctgtgcccttgttcactgtcaagtgtagctggcanaagaagaggaggtaaaatatgatgcggcttattgctgggcagcctggggccctgggcttgatgagaataatccgctaggaaaaagtacacgcaatgtccctcaaatttgttagccagatacaaaatcgtccccaaccataaaacaggatatctggcgtcccccaacttataagaccgatcacaatagcttcctcggcggttttgaccacggttttatcccacgtggcggctgactcagcatgggacccacgtgggccccacatgtcatggagactatgtcagcaccctctctctttctctatttctctccttcctttcgctctctgctctcgcacaggcggcggcgcgcgcggccagagggtggtgcggccggcgacggcggctcctgggtggcggcgcgcgggcttagggtagcgcgagctcgctggcctcccaatccccctcgtgcggtcggcaatggcggcgcgcggctgcagccatcatcaccgatgcggagaggagggccgatgcggcggcaacggcgtcaccaacacggtgggaaagaaggtcggcgttcttaagtgctt

SEQ ID NO: 49108 - DNA, 3160 bp, Oryza sativa
gtgttgcatgagctagtggagcaaatctatcggttggttagctttgtgcatgcagctggtagtggatcgagtggagcatggatgtgtggcatgacctccgccgccagctccaagccaaggagaagctcgcgccgtcgcaagcaagtgccgaaactcatgccgccacccctccagcccagacgaaactcactgccgaaactcgccgggcacctcctccagctcatgcacgcgcggggacggcggccggagatcgaactcatcgccatggtcatcgcgaggcggcggtgaaggcgtggctctatttgttcgcggctgcgcaagttgaccagggagccgtcgcgcgtgtggctccagctctgccgcggcggtctcccgccgctccgccccaccaaacggcagccacatcggcggcgccgtcatgttcgatctccccttcctctgccgcctcaccccgacgatgaccgccgcgctcctccccgcgcgacggcagccatcggcggcgccgctcgtcccatcggccctcctgtcgcgccgctccttccccgtcagccgccggccacgccggccctcctccacgccgcgtcgaagacgctgccgccatccacgcccagaggaaaaaggagagaggaagagagagaagacgggaaaaagagaaagggtggtgacgtggtctatctgacatgtggggcccacatgggtcccacgctgagtaagccgccacgtaggacaaaaccggggtcaaaaccgccgagggatctattatgactggttttgtaagttgggggacgtcggatgtccggttttgcggttgggggacgattttgtatctggttataaagttgagggacctttggtgtactttttcctaatccgctatagctatacatggccatcaggcccgaggcccgacggcccggcccacagcacagtattttggccgaccctaccactgggccgtgcctgggcctccccaccggcatgttgggtcggcccggcatgaccgacccggcacggcacgatgggtcggtatgccaggcccaacgcataaagtatagggagtaaatatagacattatcgccacagtccaaagaatagggacgtaaaatagacttatttcagcccaaagaggagggagggaaactagacttattttgctggaccaagagaagggtggaaaaatagacttatttaggtagccctaaggaaggcctgatgggccacccgtgcctacaggccggcacgacacgggcccgactgctggtgggccgtgcctgagccggaggtgcagcccatgggccagcacggcacggcatggtgtgttggtcgggccgtgccggcccgacagattttggcccgagcacggccgtgccgggccgggccgttcgtttgaccatctatagctatagctagctaattacttaaacagcatgcaaagattaagactgcactgtgttttaattttgtcaagctaggcaaggactttgtgacgagttaactagagtgagtaatatattttgaggtggcgagtgtacggttgagcttgcagtatgcatgcgcttgctatgcatatgcactactaacttttaacatatcagtgaaaggccaatggataacttcagttattatacatatgccctcctgagtacttgtatttgggaataaactaggcattcaagataggaataaaaaactccactacttatactttgcagataagctgagaatcttgttttgatgagcatttgtcattttgtttataaaagaaacgaaggaaatttccaactaattttatcactggacaagttcaaaaatccacaaacttgacacagttaattagtggaacacaaaacatgatgatgttaagtgatgtgtttattttgtagctggatggaacaattgtagccccaaccagtgctaaagcttgggattctggtttgcttcaatggattgagtttacaaaactaaatggagtatcaattcaaggcaatggcatcataaatggtagaggacaacaatggtggacctattcagacacagatgacgacgaaaatgatgacacagtaagttctcccatcccttttagcatatccttataaaccaaccattccaaagatgggtcatttagtacttaccttggatacttccacagtacgatgtggagtttgaaaggatgccacaagttaaacctacagtaagaagatcactatatcaaatcacatttgtaattgtctgggtgcacacgaaaaccaagtcataagaactttactctgatgcaggcactgagattctatggtagtttcaacgttgtagtagctggtatcactattgtcaacagctcgcagtgtcatctcaagtttgacagctgtcaaggagtgatggtccatgacgtaacaatatcctccccagaaaacagcctcaacactgatggaatacacctgcagaactctaaagatgtcagcattcatcataccaacctggcttgtggtactacctccataactgaactgaagcagaacttagagcctatatgaatctaaagtacatcaaaatgcttagcgattttcttttataaaatcctccatacatgaaacaagggcaagagacatgtgtatgctcaataaggcctagaaacaactgaaatcctgtctccctgtcctgcaaattctgcagtgtataggacaggagggtaccaggaaaaacttcaagagtactgaactatgaagctatcttttgcagttactcaacaaaagcagaaaaacatagttaacatgtaatttttggtcgaatatgatgcaggtgatgactgcgtctccattcaaacaggatgcagcaatataaatatacacaatgtgaattgtggacctggccatggaatcagcattggaggcctaggccgggacaacacaaaagcatgtgtctccaatgttactgtaagagatgtcaacatgttcagaaccatgactggtgtcagaatcaagacctggcaggtaagcacatccctttataggtacaaacaaatcctacttaataggacagtcattacattgtcaccaaagaaaaggataaatatatcatgttcataaacttggacaatcagatgtggtaagagatatatatgagaaaagaaatgatgatcctaagtgaagacttaatacttact

SEQ ID NO: 49109 - DNA, 5992 bp, Oryza sativa
  unsure (1)..(5992): unsure at all n locations
agaatattccaacttaaaagccaggtattggggtgaaaattaaagatagttccaatcttatgtatggacaaatttaattcatttaccctatgctgtgattcattccatgttaactccatgcaactttttattaaagcaaatttgtgtgttggcggtgcatccatctaggtgcgttcagtctagtgcaatatcttgcaaaaaaaaaagaagctcaaactagtgtgctatcttgtttgatggatgcaaaacttgccaacatgggtaaccaggctctcttttgcattcattaaacaagttcttgtaccagttccgagtattttgcaaggtgttgcactagattgcatccaactcacatgtttttgtacccttagctacttcccacaaattctacttagtttctcaataaatttagattgaataacaaacctttagcacctgcgctagagaatcatgccttgtcttggcacaccagaagctacaaccgagtaaaaaaggaatattaagctgagcttatctccttcaactaaaaggcaagagagaaataagacaaatgcatacctatgtataagatcttcattaaaaccaacttttgttaattcagcaatccactgatgcaagattgtgcccggggcaacaatcaataccctttgtgtcaaatcggaataaaaaaggccagctagaaaggctgaagcctgaatagcaaaaaaaaaaactagattagaagcctatatgaaaagaacacatcatacaagaattcaagggaaggataaaggaaatttcaactaaacctggcgggttttgcctaggcccatatcatccgcaagaattcccccaccggatttttcacagtggagcctccagagccattcaagcccatccttttgatgagggaagagactagaaaatatctcactaggaaggagaaaggggtgttttatatggtgtccagttgctgcgataacaaaagcacctgatctattaatagacacctgcaacacaaatgaccgaaattctattaaaacaaacttataaatcctctgtcaattatttgtatagcatcacatattcatgttgtatagcaataacactattgtgagttgtcaatttctgccgaacagtcaacacattttgcactatagaatatcgcagataggacaaaaattgatgatctttgtaattaactgcttatgactcaccttttcaccaccaagattaacagtgttgccatttgagagaattttaattacagctagctcagaactgaagagcacaaaccctgatccttcagaaagtttattttcatccttctgagtgatctgatggtcaactactgttccatatggagagaagaagtgcacaatatcatctgagaaatcaaaataaccatcaggttaacactataaggaagcagatgactatcttctgtattaataataccattggacactgtccagggaaggccatccagagttatcctccggtttgtcttcttgtccttatactgaatggtgtcttccattaatgttctatcaactacaacctggaaatatcaatagacaaaccaataagtacctttcagttgggacattatggaactgaaaaatatgtgataattctagaggaacaaaaatccatatggtttttacttgcaggtagctgggaattaggatgagtaaggaagtgcatttggatatgtcgaggattaaaatcctccttttgaaaaataacttagaatatttttaaccaagttatttagattgggaatattagaatacaaaaaatttcaaatgagcacataacagacattgaatgatgagccatgttgtttaggtaggaatatggaaattgggagaatgacttacatgttttcctttgataatatgcctgcacttgattattttatcagaaatggcagcatcggcataagtaattttagcagaatcccctgcctgggctgtgcccttggccctgataataatcaaatcaactatctttccatatttaatgaaatagtctgctaggtcagctgtcataaaaaatgacagaaaccaaattagtattacaaaaagttagtatgccatggaaaatctgtttaccaggtagctgactgtaaatattataactatggaattcagattagttaatgagaaaatcgtaatcattgaaccggtgcaatagatgttataatccatcatcctccattataggaattattcactgttgttcttaccagtttcaactcataaagtacaaacatctcttaaatcgcatgatggagttatgcctttgagtcaattgaactgtatatatttataaggaaacataaataccaaccagggcagacgaatgggctcatgaaataggtgcgcaccatttgctacttgcatagaatatagaaacaaaaacccagaaactgagcacacagattgaagaatttgcctcagcaacctagtgtgtcattccagtcagatatttattgtcaagtacagtacttaacggaatctatgaatatctatcttccaggacttgctttgagctgttagaaacttttatttggagcagaaaaaataacggaataatatccccaaaaaatacctgcaataatatggaaatttaaaccaccctacttaacagaatatgatgtggtttcattaactagggtataaaggagcaaattaccatatgacaattcgctaggcagccctcttataacaacttgcctgcagcaccaaccagaccacactgatgttaattaagatcaataaataactggtgaaatggtgggaaggggtggggatagtgtcttacccagcatggctgctgccctcgccaagttccttaatctgtaccatcgctgcagtttttcctttcttttttcctggaggccggaaacaccaaaaatcaaaaaaaaaaaggggaaatagtcaaattgcaagagagagagagtgtgtgtgtaaaaattagggttagggggagaggctctagagagagatagccacagtttgccggcggattggcggtgatggcggcgacgattccgcgtatcgggaggggttgagcacggggagggcggtggatgtgggaagcaacgcggccggaagtgtggagcacggcggggagagggatagtgttgggggttttggaggaggggggggggtggggggccnnngggtggtnangngacctgcgccggccggggtagtggagcacggcgccgaccacccggaggggagggagggcggcggcgggatctttacctcctccgagacggcgaccggcggcgagcacgatggcggcgcggcgacttcccggtcggcttccgagttctgattgctgtcgacgagcacggcaggagagagcacgggtgggttggtagagtcaattggagcggatttacaacggtgggctaatggaaataggaaaatgtccactttgcatctctcgaccgcaaagcacggggaaaatggacaagtggctacgtttaaaacgtgattttaccggaatgccatcttaaaaacgattcgttaaaatgccaagatgaagcgcgtgacactcgccgctttaccattttcaccattttatgcattttcgataggaatttcgcttctctgccaagtgaccagacgaaattgccctgcagttacatagaaaggggatcgagatccagagggggtgcttggctgtctctctcttcctccactctccagcatgtttgctcatcagcgaagaaatcaatttggtcatggagacagctcgttgcggaaggagctcaccgtcggcacaccgcatgtaggcgccgccgtcgcactgcatcccacttgggtgaggatggcgaatatggagtgtacatggcaagaactcgtagccaagtaagtgaatccattctcaatcctttggcgatttgaatgttgttgatgttgcgattgtgggcgagttcgttgtagtttgtgcatcgtttaacttgcttccatttttctatctcaccaggctcgaggaggagcctgagcgtagtttagctgcggtagttggtgatgcaggagcggtagatgctgacgcaggagttaaaaccgttttctatgccgcacctaatggggttgtcgaacttgtgccacctccggccgatcaaggcccagctgttgatgcacctcctgatgtgatattgcctgtatggtacctctaattactaattctgctttttggatctataaataatatcatgactgaataaaaaataatttgtttatcatcataacttaggtcttgtttagatcccaaaaatttttggccaaaaacgtcatatcaaatgtttggacatatgcatggggcattaaatatgggaaaaaaaccaattgcacaatttgtatgtaaattacgagataaatcttttgagcctaattacgccatgacttgacaatgtgatcctatagtaaatatttgctaatggcggattaattagtcttaataaattcatctcacagtttacaggtggaatctgtaatttgtttttgttattagtctactttttttgcggggagttattagtctacgtttaatactttaaatgtgcgtccgtatacttcaaaaacattacaaccaaataactaaacacacccttaaaaaatatttacagtaacaacatatttaagatgtatcatgaatttaattatggatttcagaacctcctgaatctctaggcaatcggaattttcttaggacagtcctaaccctccacctaggatggtgtctatagcattaactacattgccatgtaggacttttagcttatgtggcactatattaattaagagagaaagagtgaagagaggaagaaactgagtctcatgcaagacacagcttcaacacgagaacctatgcactagacactatcaagtttagacactatcaagttttgcattgggagagaataatatcttcataatagatgaagaataaatatgattggtagagaaaagagatgatgtatttattaatggcccactttaagaaaccatgggttgtagagtgtagtttctattgtgatgtcttattgacatggcaccatagacactgcttatggacactatgggttgggactgcccttagcatgcgtccaatacgtcaacccaacacaggaccaaaaaggaaggtgatcccaaagctcgaggtgtctctttgcctcctcttcggctggaagcaggcaaactggcaaaggtttctgtttcctccaactcctaggaaaactcacggtccctgaggcctttcacagttcaccagccgacgagttacttcatacctccacgcaggatgcgtgatgatgtggaggagagagggtgtgggccctcgtatgttggaaatatggtcataaatcggtatattttaatccaaaatattaagacaataaacatgacatttacaatgtgaagcgatctagtgataaaactaaacataaccatgagtatgcttaaggtaaaataagcatcaacattgagacaacgcaataatattgcaactggcagttttaacaaaaggaacggtaacagaaggatgttataccctgtgaaagttccttcgctagattgtgaggcagaattggctccgttggtgttgtcgatcggtgcgccacctcctaattcgggcgcgccacctcctgccgcaccgggtgcgccacctccagtagacatcacgcgatgcagacggaaccgaacgacgacgaagaagcgaacagtcgtgcggaagcactccccaaaaacttgatcaccctcctacctgtgcaaatctcagacgagggtgtggttccggaggccctactagttccaatcacttgtgcgcgcaagcgatcagaaccggggaagaacagaacctaatcacccgcctacccgtgcagatctcaggggagtgtgtggttccggaggccctgctcgtcccaatcacttgtgcgcgcaagcgatcagaaccggggaagaacagaagcagcgcaggcacatgcacagag

SEQ ID NO: 49110 - DNA, 2341 bp, Oryza sativa
cattgccattacgtgtcgagatggcccagccgctgctccactcgacgctcgtccgccaggggagcttctcggccgccgcccttcttggtagcgaatgtgctggacggcatcgtcgtcaacggcaactccgacgacagagcggctgcgcacggtgagggaccaggcatgatgggggcgcggggcgagctgctttgaccgatggcttctttgtaggcgaggaactcattcctagttgagggacgagaaattctgcaaaaatacgaggacccacaccctctctcctccacatcatcatgcatcctacgtggaggcatgaagtaacttgtcagctggtgcactgtgaaaggcctcatgatagataggaaaagttacctgatactgactcctctttgtccagttgcctcgccatgcaggctctgttcagttttcttttctggtaaaccttgaggccccatttgattcaaaggaaattcataagaattttaggatttcttttctatagaaattttttcctatatagccatttgaatcaaaggactaaatcgtatagaatcccataaaattcctatggaatgcctaatgccattcaagttttagagaaaatctaatatgaagttctacctcatggaagctttccttcgagtatttatctctcctctaattcctatgttttttctacggtccaatcaaacggtcattcctgagtttttcctgtgttttgcaattctctattttacaatttacacttacattcatattaaaatcctgcgttttacctattcctacgttttctcaatccagcgattcaaaggggaccctgaatgacgagtttaagttcttggtggttgtggcaggtgttgaaaccaggaagttctgactactaacgctaaattttcttcatcagcaacagaagataaacccatctagatgcccaaccaaactagatgggtttcatatcataaaatgatcagagatgataagaacatgtttagttcattaccctaccaaaaattggtaggttgttaggctttattagataaggttgttaggaggtttgttaggctttattagataaggttgttagtaggggtgaaaacggtaacggtaattaccggccgaccggcgttcgttttcgactttctaccggccgagccatatggaaatggtaatcgaccaaaacaaaaatggaaatggtaaaaaatatggaaatgaaaacggaaatggttttgctgttataccgatcgtttccgtatttaccgtattcttgcggaaattaccgtttcttataatatggtaattaccgtattctaaatatgtcgatattataggacatgtctatacttgacccacagcttatagattgaatgactcttcaataaaatctctaacttttgtacatggctaaaatgaagttaatttataatttatatagtataagcttgaatttatgtatatatataacatacttatgtaaagttaaatatatgtttttatagtttaatgtttccgtatttgttaccagtttccgatctgtaccgacatgttttcgtccgtattgttccgtttccggttttccaatatttctgatatctttttcgtttccgactttaccgtttccgatttcgtttccgagaaaaatatggttacggaaatggttgaggctgttttccgatcgtttccgaccgttttcatccctaggtgttaggatgtttgttaggagccggctctatataaagagaggcaccacagtcatgtggaatcctatcttactataaagttataccccactaactccttaagtttaacatacaaagatgccacatcatcatccactaacaagatgccacatcatcatcgactaacaatcatcacatttaaacatcatgcaaacatgctatatctttatagtttttatggtttaagagctcttcaaatacaaacatgttaaattatcatccaatataattcacataatgtttcaatgtatatctttattatgttttatgatatcctatatacttatatagttcatcctcacttagttagtgtttaaatgattaatctatggtccaaattatctttctcctttttcctctaattaagtcatatcacatcaattgtttttagcctttagatgattaatctacattccaaactatctccctacttttcttcttccataaagtcataccaccttacattttacgtttgaatcaacattctatatactatttaaatttaaattatcataaaccacattaatttacttaatctgatgttatctagctatcttacacgttattttttattgttatcatactaaattcccgcagcaatgcgc

SEQ ID NO: 49111 - DNA, 920 bp, Oryza sativa
acttgtgcatgaagatgtccttgccatcgagtggctgccgacaaagatcatagtacgcctgaaactccaccacctagaacacagtcgtgcccgcactgaaacaacacaggttagtggcgcatcgccgctccccctgagctctaagacctccaatggcgcggcatgggaccatgtggtggtggaggacgacgatgacacaacaaatggcaacggtgaagatcgccagccttccattgatgctgccgctcctcctccggcacctcaagtatgaccagaataccaagcctgacccaaacctcacctgcatcgcggtggcgccacccaccgcgtggcgatggcgccacatgaagtgtcgcatggtccatggggctaatcggcgacgggatgccatctatgccatccagataccagtaacgcctaatggaaacgttgagcttacatgccacgacgctggccttcaccacggacacaagatactgggaagtctggaaagttttaaagatgtatttttttccctctcacttacacgtgagtcgtataatttctattttgtttttgctaactaggatgtcacgtcaatcaactgtcaatgatgtcttaaggtccatcttaaataattttgataagaaataaagatttatgttattatgcaattataaactcgactctaaggtgagagacaacaagcgggtagagtccgattccaacagacgaacaaatatctacgattctccactctctattgacgcgaatatttttctcccaccgggaaattaaacgtggctacctcgtcgcgtttagctcaccgtgagccgtcgagagctcaccaatccggcagatcgccaaaccagttcgagggggaagccaaggcggagccacttccatttggggcgcgagaacagcgacacgctggcagagtg

SEQ ID NO: 49112 - DNA, 834 bp, Oryza sativa
ccaccaccacccacacatcaactttctttccacaccacccaaaccaaaatgaggagtagtttggacgcttacctcgagacgtcgtcgcgagagtagtagcggaagaaggagcatcgcggaaggaggtgggtgttatactttgcactaggatcacctaggttagatctagtcgggtggttctatttgggattgaggtttgaactatagagattgaaaacgggagagggtttagatagaccgaccggttgaggtgttggaggatgaagaagtgccggccatcgtctccgttggcgctcggttgtcgtggatgcggcgccggtgaggtcgacgacgatgacggctgcgggagtgacggttgtagatgtcccggcgatgaggtgtggcgcggcggtggcgcttcccgtcactggctgcgccccctcttgatcggattagggtttgtagggtggagttggcggcggcggtgaatctcgaaccttgtgccgtgccggcctccacccctcttttattatggcgcagtgtgacgggggcccaccagccattgggctgggcgcccccgatcagggcgcggtcaaggcccccttgagccgttgggctcaaggggagagagatctatctaacattctcccccttgatctcactttttcttttagctttttctattccatcacagatttgtaaatagagcatgtttcatcgtcacggtcaatcaccgatggattcgacagccactatacacatctctattcagaaacagatactttacttttgggccctgtagtccaggattcataaggcttcccttaaacccatgccggctacatgttcctttga

SEQ ID NO: 49113 - DNA, 2685 bp, Oryza sativa
ggcagtgttcattggtctgcatttgccaagattgagagcgagttgactttgcgggtttgtggcacgcgactcggttcaccagacggctgacgtgtgcgcacgtatttgtgcatgcatatggttcgtccaatgtgcggccaagcaaggccaggtgtaaatttgaacatttttgtttttgatttttaggcctcaattttggtatccgagatatccgaactgtggaggcgatcgctcttgcattgttgatgatgttctttcttttttatatactagcaaaaatgcccgtgcgttgcaacgggtgaagactattttaatcttattattgttatatggtttagttagatgaaattcactgtattaaattcacttggatatatatatttggttagaaaatcatgagttgcaattaggagtccgatcgtctcaaattagcatacgggttttaaagagatttcttatatgattccttctgtatttttaaaagtgaacaaacttaaaaaaatgactcaaatacggatttatatttccaaaagcgaacgaatttaaaaaccgacccatacaccgatacacggatgacgtaccaaagtactggcaaaaacatcttcaatttttatatatatattttttaaaaagtagtataagtagaagagaagattactgacgagaagtctttttcgagagagtcggacatttttttctttttttatggtagaagttttttgtttttttttctcggcttttttttctccacagggagtccgactttttcttttaagtcggacgttattttttttgcgattgaagtttttttttctcttttttttgttttttctctctttttttttaccgctggatgagtcggaccttttttttttccgagtgaagtttttctcccttttttttgttttttgtcgctctttttttcccaacggacaacggaaacatgttttacttttttaagtagtagtagatatatacatgtctcgtgtaaattgctatctgcagagtcttccatttgaagatgtttataccgtgtgcacttgctaaatggtatcacactacttagaaaactgtgtcgatttaaaaaccaggcgcgttttacactaaaatggaactttgaccatggatttgtgacaatataagccattgttgacataaatttgcaacacacaatagtgacataaccattctaaacatttaaatatataatatgaccaacatttgaaaatttgaacttatgtatatcggtatgacattatccacgagaaaagactagcaccattcagagtgacagccatggcacattcaaaaaaaaaaaatcaagcgtcacgagaaagtcccaggcgtaggccctagttgaatataaagcaaaggcatgggccggcccattccatgtcagcaatgaggttggaatttttttcatttatagattttttttaatatttgcagaaataatctatcggccaaaaaaattgcaaaaatagaccctgccgccccagaggtgggcggcaagatgacgtggcagatggagggttgaccgcgccgtttgccgccgtcggccaaaattgcaattagccccttgccgcccatacaaagggcggcaagaggctaattgcaattttggccgcccataaagaggttgcgctcgtacttttttcatttaggccccttgccgccccagtagagggcgtcaagggacccagatgcaaaaagtaccgccaaacgatttttctatgttatgttaataataaataaagaagtatttattggtaaaacttgttaatattgttataaaaatgtattgaagttggttgtttcgcaatttcatatgttaaggtattattttgtaacttattcgacgtattagtactcggataattaatataggcctatcgcagtctcggtcgtagaaacattatatggacttaaacaaggagaattagtaacatgaagaaatagtagtacaatttgaacatgatacaactatttccattgcggttacatagatgatattagattcgaactaggagggaggtagtgcaatagttgaacacaacgacgatgtagtaatgggacaaggaagcatgacagtagaaatttcaatatgccaagttgtccgataatagctaaccgctacgtgaggatccctctcctctctcaaaccgcgctttagtaaccctgtattgctctggtagttcaagctgcacaacacggctaggtggagttagaacccttctggtgtctatccattctctgtattgacatctccttggtggttcctgggaggaaagaatagatgtaaagcgagcaaagttagtaaatgttgtgagaaaataaggattcatgtaatcaaaatattcttaccatgaaatcgtcgtcaagaatatttggacaaacaaagaaccttcgacccaatattgtaggctttatggaacgaagaacctaacaacgatcaccacacctgcatcttggacgggcttcccatggagggagtgccatagttagcacccgccagtcattctgttgttcacgacattgtcgttcataagccgcttttctctgtaagtattgctcaatactttcggatgcgaaatactaacgaccttcttgtaaacaagtggttaggtcgagaacgggattttctgtattgacccactcaatgtatgcgcaagccgtagtgcgggt

SEQ ID NO: 49114 - DNA, 4732 bp, Oryza sativa
aaggatggacgagaaagagtatgatgctcctcattaattgaggggtatatgtagggagtgaaaaagggtagttggggggtaagatggggaaaattttgaatgagaggtggttggagggaaaagtagtactctaggataccttatatccgaggacaaattttgaatgcttggatcccttgtatctggggatgggaggaagtaaatatcatgatgcatcaatagaagtgaatggaaaaaatatagtcatgtgtcaaatgtcctaccaaagatatactagcatatgatgcgtatataatattaataaatgttctggtcaatgagaaaaatgcatatgcgagtttttgttaccaaccatccacctatctcattgtaaaatacatatctgtgtcactgccatagtgttatttgttttgctcaattaggatttttttccctaaatatagtttgagagaagaggccattacatgaacaattttgtgaaaaatgataaagtacagtatcttctaaaaaatcatatatatgcaaacactaatattgttcacatattccttcttaggaaatacagctcattcatcactagcataatttctggttgtaatatcactggtgttgcacaaaactagatacagcaagactggcaaaaagtagaatgacagaagaatatgtgatactggcaactgttctaatacacaatcttcaatgtgaagctcagcaggatgttttgaaaaactgccagaacctgttcaagaagtaccagagatagaattttcagcattgcctattacaagatgggaagtcaatcaaattgaaaggtattaggatgaaacagagtaacaaacctaccgaaagctattcatcttgagaaactaatgagatcctttcttcctttgtagttctcaatactttcagggcttactagccctgtactttcctcatatttcttctctaggtcctattgtaaaagtggagttttgacttcatgtgagcaaaacaagtttgtcgtaaaatgtgttgtaaaaaatatatatacaggcacgccagcctacagaaatacttatgcacagttattagttgaagtcacatgagaggtgccttagctgggaggatgttgaaatataaaattttgagttaaaaggcaaaagatatagcaaactcttgatacactaaaaactcaatatttgtaactctggtagaaaaagtgaagaatacattcaaaacaaaggaataatatgttattaaacagttctagcattaacaactgctatcagatagaatttcgatgcaatctcattattttgcactataatgacgtttttacaaaccttcagtccctcacgcacgctctcaagaacatcaagagacatcctgtcaaagaaaagaatcccctgcacatccacaattaaatggttagaaataatatgttgaaccgttgttaggttgcttgagggaaaaacagcaagggtatatatgctccaatatgtcttaaataattggagaaattgatctctagattatggtgttgaatagtatatgctttatacgcacccatcccacattgaaaattgagttatccctaatttgggttctttatcaaaagtagcctggacaggtaagtataagcatgagcttgatttggtggacccttgcatatgttcgctacagaaggaaactgaagcgaaagagtagctgctggcaaacctttacagacagtcttgacaatttatttaacttttaccatggttaagcacgtacctgtaaatgatcaaattcatgttggaaaactcttgcagacagacctgacaatttaactttaatctttgcccctgtaacatcctgagcatcaattttgacattgtctggtctctgcatgaataaagtgatcataattcataagtcattcacccaaaggacacacagctgcagtatgatggaaattttgtttgcctatttcacatctatatgttgctaaacttttgggtatttcagtctctaaattatatagtgcttttgtgttaaatctagttaatatgtgcatattagtagtaggcttaaaacgagtaaccaactcttgaattctcatattgttacaaggtcagaatttgaaggatggttcatttgttataatcatgttaatacgttatcactgctttaactcaaatgcatagttaaaaatatagttcagtaaaacgtgcagggttaatctcagcaggcaacttcactgattgttcactgaatgcatataacagtccgcagaatgaagaattcagcagcacagtgcaaacacacaagcttaataaattattttccaatgtactacctttgtttttttaaacacaagcttaatcaattattttccaatgtactaccttcgttttttaatagatgatgccgttgactttttatcacacgtttgaccattcttcttattaaaaaaaattacgtatttataatttattttgttgtgagttattttatcactcatagtactttaagcatgatttataccttatacatttgcataaaatttttgaataagacgaatggtcaaacagatgttcaaaagccaacagcgtcatctattaaaaaaggagggaatatcatgtagactttcaagagtcatcaaataacaatatggcttgtacacaaagtatcctcaccaccacattggcatatatcccagggaatgataagcagccttcctcatacactaacaatctcttcgacattttgtatacaaccgggttgacaaggacaatctcctctccttctcccttcacaccagctggattaaataccataagctgtacattcaccccaacttgtggtgcagagagaccaattccatcagtcctgtagcaagaaaccaatggttcaattggaggaatatcttctcgagcaatagtagatagcaagcctttctaaaaatgatagcaagatatatgattggatatttcccccacttaacaaggcatttcacatactctgagaaataactagtatgccacacaatttcgaccacttcaaatcacgccgtagtagtcttggagatctgttaaacactagacctctctaaagcccagggagcctcgtaagcacaaatggtaccttaatttggttatttaacaaagtaacacatattgaatctgaagcgctagaaaaaaaatcaccatggcaggatcaacttaacattttcatgcataattcgtcaaaagagtggcacggtaccctcacgcgcatttcatcaaacaggtcggcgcacgcaaacagaaaaccccagcaacgaaaggcacatatgactcaaacgccagactcacttgtacataacgtcgaacatctcatcagtgaggctgcggaggttgtcatcgaaggtgttgatgcgcttgttgcgagcccgtaggattgggtcggggtacttcacgaccttgagcggcggctcgaactggaggtcagcagctgcatcgtgcacacacgccaccagaagcagaagaagaacaaaccgcgtgagaagcaccacagaggaacccctgagcagaggaacgcgccgtgaaggcggcggctaacctgtggcgaagtcctcgtcctccgccggcggcgcggtggcgacggcggaaccgaagccgcggcgggcgcgtgccgccgcgagaggcgccaccgagcccatgcgggagaggggcagcgctctggggtgcgcggcgaggaggggggcgaaggaggacgcgaacccgcggaggcgggggccgaggcggaggtgaaggcgcgcggccatggtggtgggggagtcgacgattttttcccccgcacgcggcagcgattgggcggtgcccgctacagatgcctcgggggtttttttttttttttttttttttttgggcgtgcgggagcagtttggccgttggcggtgcggagcggttgcacgaggagcaactctcagcgtttggattgtaatcggacggcaaagccactcgcgatgggtgccttgggtcgatctgggtcgcgtcccttcacctggctcctggcactatgcagcctaccaaaatcctcacttgttaaactctaaaaaaatatcctcacttgtttggagataaaaaaaaatcctcacttttttgggcattcggccatttttctcgggaaggatttcggcactttcatttccattgcttctggtacgattccaacggtaccctatctaatatctgaaccgtaatacgagaaatcttcacctcttatcacaaccattcaagacagattccaggatggtatcgacgacgggtttcactgacgtggcgctctagtcagcaaaaaaacacatagacccatgtgtaagtgagaagaaaaaacttctatctttaatgcctgagccgtggtgaacagagagtggtgccgatcggttcatgcaagagcgggtgttgtgaatccatcaatgtggttaggacttggtttggtggagaccgcaaaaactcttcaccaattacttttatgctatcgaccaatcaattgagcggcatctacagaatttgatctgatcggcggtggtgtgatcccgaggaggaagcggatgtctagctagttgttcatgtaatttaaccattgctctcgacgctcgtccgcttggagcacgacgacccgatgatcttcgccgccataattgatgggcggcgaagaccttgctggggacatctcttggggctgagggggcggttgtagcgtgacgcttctgctcctctttttagaa

SEQ ID NO: 49115 - DNA, 3545 bp, Oryza sativa
caaaagaagagaagaaaggtaaaggtgctgttcttttctcgaataagagttggataaaaattaaaattttcgtggcacgctttttaaactgctaaacagtgcgtttcgtgcgaaaattttctatatgaaagttgctctaaaatattataataatctattttcaagtttgtaataattaaaattcaatcaatcatacattaatatcacctcgttttgcgtaaaaacttcatcttcatcttcatctccatcttcaagagaaaataacaccaccaaaatatgatgcggcttagagcaggtacaatagtaggctataagtcagctacaaacatattttaaagagataaatgaagagagagaagaacatcgagctacatatctatagccagctgcagcacggactccaagacgtaatgcgtgtatgacagatgggaccaggtattaatagtataggtattaatagtatagtaagcaactattgtatgaattggctattacattgactatagatgatttggagttagtagtgggctatactattaaacttgctcttagccggctatttctgggcagcatgggcttgatgagaatataatctgctatagcttgctaattactcaaacagcatgcaaagattaagactgcactgtgttttaattttgtttggcaagctaggcaaggactttgtgacgagttaactagagtgactaatagatttttgaggtggccggcgagtgtatggttgagcttgcaggatgcatgtgcgcttgctatacatatgtaacttttaacatataagggccctctttagatcccgacaaaattttatatcctatcacatcgaatatttggacacatgcatcgagttttaaatataaatgaaaaataactaattacacaaattgcgtgtaaattgcgagacgaatcttttaagtctaattgcgccataatatgacaatgtggtgctacagtaaacgtttggtaatgacagattaattaggtttaataaattcgtctcgcggtttacatgcggattatgtaatttgttttgttattagactgttcaatactttaaatgtgtatccgtatatttgatatgacacgccaaaactttacccctctgatctaaacacagcccatgtgaaagaccaacggataactccagtttttgtttttttgaaaaaaaaagactagtttttcgattcaatcattctgtggactttatccacattgtggatgagcccgttccctcaaaagatgatccgtcaatacggacaggtttggacttgtacccgccgtcccgaaatggaagcgcctcaaaagaaagcatcccttttcttttgccaaactcggcaagtttgcagcatttcgcaagctagccacgacttcggagagcatgtggctccactcacaaacatgtgcgcaatgcgtaaagcactaaagcctcgtgacctcgtcgcgtctatataaacaccgacggcgccgggtgtccgatcaatcaggatccaagtgtgcggcagcaaatccaccgccccctcacccgtctctgctctgctctgctctctgttcctcgcggcacgctagctattcgatggccaccaggatgtgcggccgcgccggcgagccggcggtgcgcaagggcccgtggacgctggaggaggacctcatcctcgtcagctacatctcgcaaaacggcgaaggatcctgggacaacctcgcgcgctctgccggtgagctaagctatacgctcgatgttacgttccttcttcgttgctggaaattgttgggatttgatcgatcggagctttaattatctcgcgactatgtgatgtccgaactcagggctgaaccggaacgggaagagctgcaggctgcggtggctcaactacctgaggcccggtgtgcggcggggcagcatcacgccggaggaggacatggtcatccgggagctccactcccggtgggggaacaggtggtccaagatcgccaagcacctccccggccggaccgacaacgagatcaagaaactactggaggaccaagatacacaggaagccgcgcggcaggagccagctgctgcaggaccgtgcgaggacgccatgggcatgggcatgtccaccaccaccagcgaggcggcgtcgacgtcggcgtcgagcggccagagccaggccagccccggcgtctgggatgagtacatgcaggcgagcagcttccctcacccggagcttgtctccttcgccgccgaccaccacctcgaaatggccggcgtgggcgaggtcgccgccgccgccgccggcagtttgtcccgactgagttcggtttcaatgacggcttctggaacttcgtggacaacttttgggagacgatgccggtttcagacgtggtgtgacgcgcgccacgcaaaccaattaaccgcgcgcgcggcagcaactagctagcgaatataatagcactatagcctatagagagaagatacaagatacagaaatcgtcaacgatgtctctatacttgcttgtagaggcggatgtttcagatacttgatctcgctttttgttcgtgagagaacttttttggcgaggttaaaaagatgctcttctgcactctgtgaggttctgaattctgatacttcagaaagctacgacaatagtacaagctaagatttaatagtagcacatgcaaatgagtgaatctgtaattccgaatctttttgacaacacacgttgttgtatctgcgtcactgcatgtgcagtggccccggtactaatactactgagatttggttctatttatacgttcctggatgttgttctctgctaagtgaacgtacggctctagtctcaacgtggctagcgaatgcatgtgcactttaaattgctgacaagctcgaccgccggttcgttacgtcctaaaaatgagaccggcaaattggcgaccttctcgccatgcccttgtgtctaatttctcaggtcatgctaactgtcaatcggcagcacatgaccacatgcacatgatgacttcgtatttggataaaaagcagaggcaaaagagctatgtaaggccaccaatccagtcttaaaaatcagctggcacgccctcgagactagccttagatctatactggagttaaacaaatgtctcaggtcaccatgttttcacatcatcagtctcatgtgaaaaattatgcactcagtcaacgaaatcaagattatttctttgctcactgatgaccatgtgaccccagtagtgcactagacctagttgtcaactggttttatatttgtttgttggttatttacattgcattcctccataattattcctatgtttcttgcaaccatccaagcacccatcctataaaattcatgtattttcaaatcgtctgttttacttacgtgttcctatcaaatcccttagccttttctattcctctatttttactatttctatattttgaacaagccctaaaagtttctccaaaccaaataagccctcagcctttcttacgtatgtacaataccccaaagcaaatgggttttgtgttggcact

SEQ ID NO: 49116 - DNA, 6762 bp, Oryza sativa
  unsure (1)..(6762): unsure at all n locations
tactttacttgttaggcaagcgtggctcactgttcattgcttttctatccaaacttttgcctttgttaaatgcatcacctcgaacatagaagggtgcatcaaagattttgagagtaatgcttaaaatgggaaattggacacgaggttataaggacgactcatcaggaattgtgggttgtctgtctgtctcattgaatagaaaccacttacataatgcatttgttttcaaaagaatgcaacaaaagaatggctagttttcagtcaaaaaagaaaaggaatggctagttaccatgcatgttgattgaacccaaaccatgacaataagacatgccattttgtctcaagtaaactagcatagtagtccgcgctgatttcgcggctagcatcattatattttctcttatataatagcatatatacattcttattttaatattaaaataacaacataattttaaaatttgtactaaatttacaaaactactaatgtgtaaatattataccggtatggactctagtcttatctttctatattccttattgttaattccaaatttcagctattttaaaattgtattcctgtatgggctctattttttctcatattaatatgagaatttctaggccatgagagccaacatggaggcttttttttcggttactttaataagttaatagattttacgagcttatgtcatcaccacaacttttattagatgcacacaaaaatcagtaagcggttgtagcatgattttttttaggtttttcattgatcaataagacatatttaaaattccaacacatagcaaaaatatatagcaggccaaaaccttttttctttatggtagtatagatggtcctattctatacacttcccttctacctggtattatttccaccaattcaaacttttacaattatacaaaggtatactcatacaccggaacgggatcctcctgttgcaacatgcatgcaagtatgcaatggcagatggctacataaaggtgcagggatgtttgtgcacaatagcatagtaaccatagcgtatgacctgatacaccgtattttgattgaacggctatgagatggtcctaatttagaagacacaattatcctctatattagcacccatgttgtatatgtttaagtgacgaatctctctattaaaagaacattttatagatcgactggagttgagattactcgactcttctcaatttcatcgtttgaaaatcaatctctgactaacggaaggacccgagagcctagcgtccttctgaatcctaattctttgtgctctatcctcttgttctaccatcttatctcatgaaaaaaagcgctattacatccatcttaaaaatataactatctttaaacttaatttttatctcaaataagtcaacctaagacaagtataagggacttccccccctccaaaaaaaaaacaccccatgctacccctagtggccttatcaccccactagcccttaagacccaagccccacccatatcatccttaatctcatcaacccccttgtgtattactgggtaacattttagacatttcgtcgcaataacacaatccttaatttctccaaaacattcttagacagatatattttgggtaaggggagtacatgatagctccatataagtctaagagacgactcattatcgtctctctaagtgcccttctcactcaactatggacctatggatatggtgctatgttgtatacaggcaaccagaaccatgtggatggagtattatttattgtttcagatatcaacacaatctcagtgtatattttttatcactacttttaataactatacttaattacataatgctaccttcatattaaaatataaggagttaggtattattctgcagttccgttgtgtgaagactgatagtcacattgtttcgcttattcatacgcttatccaaatcgcttttcagcaaacaaaaaattatttgggagtaaaatttttatatatgcgtccttagcaactccaaagcaaatattgtaaaataaactatgatgaaaaaaataaaattaagttctaaaatttgaagtttatcttatttttttaatggaatcagcacgagagtgtgctttttcattgaatatagtaggagaaaaaatgcagcccctagagcaaagaaaaggcaagaacaaaaaactgtacactatacaagatgcaggataagctcgcgtagtctcttggcacccgctcacgcccacgtggcagcctcctcttttatttttgcaatgaggtactttgttgtggcctccttgtgctcaaagattctccgattgtgttccttccatatttcccaaacaacgaggaggatcagggtgcgcagccccttcttggggatgcctgctgaagcagcaagcgtttcccaccaatccttgatcgtctgagtcgtctcccaaagccgagggtcgaggtgaagatatcccacccagttcgctaccatgctccaaatccttttggaatatcgacattccgcaacaaggtgcaaggccgtttcatcctctctcctacagagggggcactgcccgttgttctgccattccctgtttgtgagacggtcagaggtccatactctattctggatgatgagccaggcgtgaagcttacatttcccatgcgcccaagctctccaaattaacgggtcataggtcgtgcctggcgcgccaatgcactgagctttgtaggctgacgaagccgagtactgcccatgagttgtgaacttccaagtgatttggtccggttcttcttcatccagctgcatgccacggactgcaatctatagtgccacgagttgttccacaagggtcactgagatttgcgggtttgtctccaaggccaaatctccgacccaggcatcatacgccaaacaatggctcttaaagaagtgaagagggccttctatttttggttttctgtcatcagtcatcacccttctcttttttgttttgtgtgatgctaatcgcgtcactgcgtcgttcaccacgagcgttccatgtgaagtttacgtaagcggtgacgaagcaagtgcccatgttccggggcggctcctctccaccagtatcagaagaactcaggagatagctgttcagtcgtctcgtcagcacgtacgcccatctttgtcagttttctcttggcaccaacgcgcggttatttatgttgaattattcataagctgaatattcttattcatacattcggatcaacgcaaagtgagaaaaactctacctcttacaaatttctgccaaaagtattcactacctgcgcaattattcagagcccgtgctaaacttggacggcaccccaagcaattggggagatgatcaccaagtcagatacgacttattacactagttttcctcgatggttccgctcgataatgagaactgaagtcatttcgattagaccctataaaatgggtggttccggtcttccgtagagcacaaagttttcaggcatctgaagttttggacttgcaacacactctgctttcaagttctgaactagcattctactctgttctagctgactaggtcacacatggctatcaaggatgagcagcagccactgcacatcctcttcttcccattcctcgcgcccggtcatctcatcccgatcgccgatatggccgctctgttcgccgctcgtggcgtcaggtgcaccatcctcaccacccctgtcaacgccgccgtgatccgctcggccgtggaccgtgccaacgactcgttccgtcgcaacaacggcggcctggcgatcgaactcaccgtcgtgccatttccggacgttgggctcccgccgggcttcgagagtggcacggcgcttacgacccaggacgaccgtgacaagttcttccttggcattaggctgctccatgagcccttcgaccggtacctgtcggagcaccacgtcgacgccgccgtggtggacagcttcttcaggtgggccgcggacgccgccgccgagcacggcgtcccgcggctggggttcctcggcaccagcgtgttcgcgagggcctgcaccaacagcatgctgcgcaacaacccgctggagaccgcccccgacgaccccgacgccgtcgtgcccctgccgggcttgcctcactgcgtcgagctgaggcggagccaaatgatggacccgaagaagcggccggaccactgggagaagttccagagcttagacgccgccgaccagaggagcttcggcgaggtgttcaacagcttccacgagctggagccggactacgtcgagcactaccgcacgacgctcggccgccgcgtgtggctcgtcgggccggtcgctcttgcgaacaaggacgtggcggtgcgaggtaccagcgagctctcgccggacgccgacggctacctgcggtggctcgacgcgaaccacgcggctcggtggtgtacgtctccnnnnnnnnnnnnnnnnnnnnnnnnnnngcggagatgcgggagctcgcccgaggactcgacctctccggcaagaacttcgtgtgggttatcaacggcgcggacgccgacgcgtcggagtggatgcccgagggcttcgccgagctgatcgcgccgcgcggcgaacgcggcctcaccatccggggctgggcgccgcagatgctcatcctgaaccacccggccgtcggcgggttcgtgacgcactgcgggtggaactcgacgctggaggccgtgaccgccggcgtgccgatggtgacgtggccacggtacgccgaccagttctacaacgagaagctcatcacggaggtgctcgaggtgggtgtcggcgtcggctccatggacttcgcgtcgaagctggagaaccgccgggtgatcatcggcggcgaggtggtcgcgggagccatagggagagtgatgggcgacggcgaggagggcgaggcgatacggaaaaaggcgacggagctgggcgtgaaggcgaggggcgcgctggagaagggtgggtcgtcgtacgatgatgttggaattctgatggacgagttgatggctcgccggggctccgtcaatgtgtgacagcactccctaacaaggtgattgacggcttgacgcatcaagaagatggtgatcggacattcggacatctccagagtccagactattgtctttttcctcagagttttttttttttggagtaactatatttatggcgccatatttttcatcaaaaaatagtcggtatatatttacattgtaaatttctaaattacatatgtaattttagtgtatttacaatataagtcataaaattacatatgtaagtctctaaattacatatgtaagtataatgtaattataatgtaagtgcaatgtaatttctatattttgcattgaaaattacatatattgattacttatgtgaaagaacgtgccaacgagctacggttaaagcagtgcttcgagccaatcaaatgcaattgatgagaccaatgccaccgaaaaaagcggcgctccagccaatcaaaggcttagaaaaatttcgactgagaattgagaaaaaatatgtcgccatatttatagcaataccgtttttttttctttttgactattctctcagattgtaagggttgtatgaaccgtcaacggtccaattttagtacaggcctccattgataagtttgttctggcaatctggcatgataacctttgtgcaattatcctagattgatcggcccagatattggtatcagccgtattggtcagcccagtccgaaatgtttaaaatttaggaaaaagtacactcaaggtccctcaacttatcatcgagatacaaaatcgtcccccaatagcaaaaccagataccaggtgtctctcagctagcaaaactgttttcttttggtccttcgatagttttgaccctggttttgtccgtcgtggtggctgagtcagcgtgagacccacgtgggccccacatgtcatactaatccatgacatcaccctctttctctcccttcctcctctctatcactcttcttctcctctccgggacttggggcaggcttgtcgacgggtcacgccacgcacgacggcgtcgagcccaggggcggaccagcgcgaggcgacaagcttgacctcggtgacggccacgaggtcgaccatggccaggaaggaccccggcatggcatcaccgagtgatgcgcttcaagctccacgctgcacgcgacaacgcgggagtagagcaggcccagctccaccctcagctcccgtggttccgccgccagccacggccgcagcgccgcctccgcgagcaccatttgtggcggggctagggggctcgtgctcctctctttagtgtcccatggactcgaagcggcggcggaggaaaacccggaggcgagcggtgaagagttctggcgacgctaccagcgccatcgagcgcacatgaagagggaagaggtggggaggctaaccgactccagcggttgggggccctcctccagcctatgctctggatcgatgccgtcctcctcatcacgctgcaccggtcgccatactcctcaccagcagctgcagcgcttcatggaggtgaggttctcgcggggcaggccgctggtcccagcggaggaagtcgacgatgtggaggcggtgaggtgggacactatgtcggagtcggattccatgacacagtccacctccgccgccggaggtcgaacgccgcgtccatgagggacgccactgccggagcactgcgaagagcgtgtggtacctgcgcgccactcctc

SEQ ID NO: 49117 - DNA, 2249 bp, Oryza sativa
ccccccacccgcagctcctccccctgctgccgccgccttgtgggcaccgtccgtctcgctttcgacgccagcgtcaccgccatcaccgctgtcgcgtcgccacctcgcactgccgaccttgctgagaagagagagagagagatgaggaagggagagaagaagggaaaagagagaggaagctggcgtggccacgctaacatgtggggcccatgtgggtcccacgctgacttagccgccacgtcggacaaaaccagggtcaaaaccaccgaagaacctaaagtgaacggttttgttagttgagggacgcctgatatctggttttttgcgattgtgggacgattttgtaactcgatgacaagttgagggaccttcggtgtactttttcctaaaatttaccccatacgttccaaaatactactgtaaatatatttaggttatttagcaaaaataatattaatattaatatatgaattttatattgcttaggacctttcccagcttttgattggttgaaaatgttttgctttctatggttggaatgtgccccggaaatatttatattatgtttaaattcaaatactacctccgttttttaatagatgacgccgttgactttttctcacatgtttgaccattcgtcttattcaaaaattttatacaaatgtataagatataaatcacacttaaagtactacgagtgataaaacaactcataacaaaataaattataattacgtaaatttttttgaataagacgaatggtcaaatatgtgagaaaaagtcaacggcgtcatctattaaaaaacggagggagtactataaatacttgtattttggaggatggggtactgctccaacttggataaattcagtgatgagcacaaaaccaaatacaaactcttattctaaacattctctcttgtacatacacgaaaccgagaatattactaaggattaataacacagaaattaggcgtccatgaagaaaaaaaggaacaactgaactcagatgttccaaatctcaacaccttcaaaaacgaaaagttcaagcacggaccaaaatataggcccgtgtcatggcctttttctcaatggatccagggccggacgcagcaaaacccaatatggatcgatgaagttggggagcggtgtcgtcactcagggcatgtttggcacagatcttttcttgctccagctccacctcttctggagttggagctcagcccaacaatttcagctccactaaaactgggagtggagctgggtggagctctctcacaaaatgaactagagttgtggatctgggtttagacagctccacaactccactccagacccaactcctggagctaaatttaggagttggagatgtaccaaacacaccctcaccgtcagcttctttctttatcgcatgcgtaggctagggccattcatagtgtttgtggcattcaatatcaacatgtcatgtaaaagattcttctccacgtatacaagtgccaaatccttggcgagcccctttatcccccataaggcccttcacggtgcagtgagttggagcgttacctagttctccagctaggccaaaatctgacgtggaggagaaaaagcagtgggccccgtgtctttgcaaggttttgcacatcctagctaggatccggtttccttacgccaaaaagagaaactgtgcgcctctgcgctctgcggtcccctccctaatcctccccattcttccccaaaccgattttcgttggtcgtcaccatccacgcgattcacacgggcttgtagctcaccggccgcgctaccgagtccagcctccggtgaggaaggggagaagccagaggatgggcggaagagaagtgcgacggtggtggcgggaagatgtcgtcggttgcggtctcggaagcgaggacgaccacgctgggcatgggaggagaggagagccggggtcgccgccgtgccgccgccgtcgtcgagtcatcgtcgtcgacgccctccagatcccactgccgtgctgccgtcgtcgagttgtcgtcgtcgacgccctccagatccatgtcgccgccgtcgtcgagtcggcctcctcgaccgccgccgcctccgccgccgctccggatccacgctgccgcctcggcctcctcgaccgccggcgctccggatccatgccaccgcgtcggtctcctcgctctccgggcggcgtcggtgttcatcgtcgaggtggggggagaggggagaggccgccggcggcgga

SEQ ID NO: 49118 - DNA, 6511 bp, Oryza sativa
  unsure (1)..(6511): unsure at all n locations
atcaattaccggtagccaattcggatttaattactaagaagatagccgaatattatatttaattatagaccaagttaagtcgtccaatattctaggatttcgttccgacgattagctcacaatagaaatttctaacctattaattgttacgattgctcgggtaggttagattaaaaacttatgaccacaaaatatttatacccgcaaaatagtttaaatcgaaattgggtttgccgtagttcgcagatagtaaagctaataaaaaggaatcgactttcgcattcgacttttactcggatttaagtgaaacttgaacctaaattcatctaacttcataagctttacaatgatatataattcactatttaacaagatataattatgattataacttaactaatatcaaataattagatgatagttaacctaaatagtgtgccaatgaataaaaaaaatggatattgtacagtagcgtaattatctttaacacgtcttgtcgctgtagcaactaaataaattagttataatcaatccttcaaattaatgggtgtataggaaaatattagtgccatttactagtctgtgtccaaatataactaaatccatgacttataaattatttacataaagtttagcctcatattttgtaactaaaatataaacacacttagatgaaccttcaacttgtctgaggagaataataacttagctagttgtaagtggaccacttaaagttagttggaataatgtcatatgaagtggaatatatatagttcggttgacatccattagttaacaaaacagagccatcttaatcacatatatcgtatagcttctagtaaatagcaactattcagtaaatgatccaatgattaaatattgttgcacccacatacattgtacatcccaatttagatgtatggtatatcaaaaacctacccttttgggtatagtaagctaatgagtctatgacaaacatctatagtggataaaatactaattatagatcttgacctaatataattgtaaattaggattattcattgaaaaattatgtgatgaaatagccgtaaccataatatgattgacctagacaattctaacatacaaagcaagggtaattgttaacctttataatttattttgacaagtaaaatatgtacataattaaaataaagcctccaccaataaaataataatacaaatgattcacagtaattatttgaccaatccaaatccatccggcaacagaacctctagtgtataaccgttctatttagatagatgcatgaataaccatttgctagactaaaccacatagtagccagatacgtatctcattcatactacgttggttagctcctatatagaccaccatgacaacagaaagattaagaaaccttaacccctagcgtgattggaatccattggtagacatgaatagtatattttgttatgcatatttggttgttattcgaatatttttcttgcgtgttatagaatttaattatcgggtagtcgtgaggcaacgtcagcaacttccaggaggtgaaggttgatcaggattatatcaataacaaggactattctgagcaggcaagtcatcactattccttgaacatattgatcccaattgcgaaattgttttgtttataaataaaaattgcatgcaatgatgaacaccctacttgtgattatgccatgccttgattattgtttacccttaaatctttgtaaccatgtttacgtatgagtccctagtcaattatgacaattgcttagaaatgctattctagattcgtgcatactcatatttatcaaatgctatatgcttgggcaattacctttgggaaggtaattgagatgcggcatgtggagacatgagcgccacattgccatgatattgatgacatgatttgtgaatagagaaataaaaactaaacaactgttttcgactggggcggatggaggatttgggtggtatccggaaaaggctagcaccgtccccggtcaattaaggaccgagccatgaagttaaacatgaaacgacccccgtacaaccgtacttctcgaatgggtatagacctagcggattaggtagctgagcggaggcagtatccctgcatagtagtttcttgatgtgtgaggtaggggctctacggtggggcagccattggtagaaccgcgaggcgggtgtctacagtggtgtcgtcatcagtaggactaccatgtgagaatttaaacataattacaacttaatgcaagtgtgagtttttccttcccgggtgcgccagaactcctctcactgctagaaactgtttacgcctagagtgcatgaggatgtaaagttcatggagcgggtactgccgatgcgaggttatcgaaaagctttgccgtgacgcgtctcatgtgttgggacgaggctcatgtgttgggcagtcgcggagtgcgggtaaagtgtacatccactgcagtgtgattaaaccaaatctattcgaatagccgtgctcgcggttaatgagcaccgggacatgtattacacttggctagactctaaattcttaacttgtgtgggatgggatattgcatgatgaattttatgctgatggagccacatcccgagaggagggaaggtggacatcctcagaaaaccatgacgaatcaatggcgggaagctatccttgggatcacaatggatggtggacagaaccgtcgttgtttaaagtgaacactggtactaaaatttgatcagtctatgctaggttttaggcttgtgaaaagaattgtaaaattagctttatgcaaaagaacctgaagccattccttgaaataccctctgtcatatgcattgttgttgtggtggcttgctgagtacggttggtactcacccttgctatttatataacttttaggagagtgttaagagagggggccccccccccccccctttttttggggtttttcccgggggggtttaaaaacccggggccccttttttttgggggncccggggtttaaattccccnccccaaccccaanaaggaatgnatcggnnaagtgcgnngtctttgttctaggtactcgttccccagtcgactgcctgtggcatgttaaccgggcccttatattattttgtcttccgctgttgttctctgatatttgttggcctacctggccctaatgtaagtatttaactcttttagcctaaattcattcgtgatatgtcgtgatccaactatgtatgtgtgtaccaactactgatccagggattggtacggataaacacagaagatttccgatttccaaaatcgggggtctacagagggtgcctgggtagggttgagatttgtattattttctccactgtaaggtgttcaatgtaaaatttatacttatttgtaaattaaccaaaatatgagggctgaaataaaaaatgataggggcttaaacgaaaaaatcaaagtcacccatgaggccatttgcactgtggggaatcaaaacttggacacggtgctttttagcctacgtggcattttaggttccgcaagtgagtagattgcactgctactggcctaagaactaataatagccttgtcagaacgtcaggaaaaacataagagagaagcaaaaagcataagcgagagggaagcaccgagggcaaccttggggaagtatatatcaccgctgccgagctctatgttcaccgccatttccccacatctagctgcatatggagagctcaagaccaaaccgtcgaacggaggagaggacgacagaggcaacttgcctcaatatgcactggtagtagcaccatcaaccaccttcgcaccgtgatacgccgtgccagattgaggagagacgaggttgaggtcgcacagcccctgttggcggtgacctccacgaggaagatgatgccactcggctaccgtctgattgctcgatctgcctgactacaccactgcagctagaggaggatctctgccttctttctcgtccaacccatgccgcctctaagctcaggggggaaggaggcagcgaggactggggaagggagagaccagcacaacgaggggataaggggataatgggtggcctcagttgaatattcgctatattttcaaataagggaaaagatcaaagtgctctttattaacaagaaaatatcattagggatttagggtagatttgtaaaggcagtgaaagaacaaaatttctcaatttacggatcgagtatacgtaagtggatacaaatttcaaaattgatttatttgaaaatagagcgaatattcctgtagtaacctgctttatagacactggactgcttgccagcatcaaaataagtgcggtttcgtctaccaaaagtccaaaatgctgacggatggaattcgatatcttctcgatctgtttggtggcctgttgttttcttgccctatcctatttttttgagaaaaattgtcttgccctatatgctgagatggcctacggtttgggcgacgtacgtcttcgtttaaaaaataaaaataaatgagcaacaatattatcctgataccaacatgcatgtattatttatatatgtgtgtgtttttaataggaacttataataccatagatttgctgttgttttcgtcgctacaggaaaaacatttgcacgtgcgtctgtgtatagtgtgcataactagtggtggatgcactgccctctccccagatttcttgctcctattctcacttcaccaaaacaagtaggaagcgtggtggatccgtgtttttttaatacttctttcattgcttcctattcgtcctgttcattcttcaaaaagaaaaattctggaaggttcctcgcatccgacggttgtatttcatcgtgccagtttttgtcttcatgtggatccaacggtcaatttttttagcttacgtggctcattatcgttccatcatgagattaatttttcacttagagagatgtgcggtccaatccaacctgatcccccagagtcgcagataacataagctgccggcagattctccaccggaactcactactgcacaaatgattttccagtcatggacttatttagattgtagacggaccataattggtcacgtctgtgaaaatatactcattttcgcgtgcggtgagagccgcacgcaaaaatacccaccctctctttcactcctacctactttaaattttccccactttctctcctctccttttctcctctcctctatcctttctcctctcctccccgttctatctcctctcctctcctctacggcggcggcgggcttaggcggcgatggcgatagcgcgcgacggcatcggtggcgcagcgacggccaacccccgcacggatccggcggcggcggccggacgccctctccctcgcgggatcccgctcccctcccttcccaacccagatccggcggaggggaggggcgtcgacggcggtgcggccggaggggagcgcggatccggcggccggccgccctccctcgcgggatccagctcccctcctctccccgtccttccctcccctgatccggcggaggggaggggcgtcagcggcggtgcggccgaaggggagcacagatgccgatggcggatggcgtgaaggccggcggcgcggaggccgccgtcgccgacgatgagggcgggagcagcgtcctcggtcgccgccgccgacgacgacgagaaggacgatgacgaggaggaggtggcggccaggagcaatggcggtgacggattcgttttttttttttgaaattttatttttttggatttttatttttctgaacaggcgacgtaagcacccagaatttattttttttttgtcatggagaaactgaaatgctactgatcccagaacaaatatataaagttttccaaagccaaaatatttaagtatttggagtaggactagcaaaagtgcccgtgcgttacaccgggtgattacggagtgtgtatattgaccataattgttgtttggtttagcaaaagtgcccgtgcgttgcaccgggaagcgcacagatcagaaaaaaaaatgcaattaattaaaatacaaattcgctgaaatatttggtatttttaagtaggtatgtgtataattaaataaatttacaagtaaagcaagtgtgagaaataaaatgacattgttaaatttaattttactaagttctccatgattagttatgctttttggaattttattagaattttcagagcttaattgctaattttaataatacaaacatcatttaataattatttaattggaaaaagaaagaaaatccttccttttaggtttgcttagaaataaacacattcaataacaattgtaaatgcttctaaaaaaatcactaaaaatgaacttctctttttttttcgcccgagggacctaatatagacttatttccggcctgagggacctaaaatagtcttatttccgtcccatgccggtcggcccacggccttatcaaaaccctaaccctaaccctaaccttccccacccct

SEQ ID NO: 49119 - DNA, 5766 bp, Oryza sativa
ccccccagccggccgcctctcccaccacggacgccgcttcccttcccttctccctcctttctcgccggcaggctgcggcggcggcgacagagggctgcggcggtggcggcggcggagggctgcggcggcggcggcggcttcccccacgctagcggcagcagcacctttccctacactagcggcggtggcggcggcggctctccttcccgtctcgccggcacggcgcaacgacggcggggtgcggcagagacggccgtccctccccctctccctctccctctccctctccctctccccgtcggcgtcgacggcgacggcggcgacggcgtcggcttcgtccgagggtggatcctccggcggcggtggtttttttttttttgcaattttttctatcgctattgcctattggtaactgaataggattgtgtattgacgaaaaatggacgaaaattagatgtgacgaccggaaaaatacgaatattagttatagatatataatgttcgaattcaatcaattctggagttgattactagagagtaatgatcaatgcatctttgatactaattccggtggataatctatttcatgagatgaattaattagcttatggaagcacagcaaaatcgaaattaaacaacaattagtttgatactaacaaaaaagcgatgacacaaaaccaaatgccatgcattattcctcctttcgtaactagaatgccgacatcaccatagctgactcacacctcaaatcataagctacttcactacaccactactaaatatgttactaaaataacaaataatctagttcccctatatcgccttttgaaattcgaatatcacccacttgtgcttggctgcgattccattcgattcatatgatgaaaccctgttaatttgaccagcctaattaaaaacattatgatcaggagagagaaaaaaagcagtggcaagaacgcaacattccttcgcgatatgagaatcttttgcagggcttaagttgaacatttttttttgtgtgtgtgtgcagcagcggccagtgggatcacctagatacaattatcaaatcacagccgagctagttgcacatatataagttgcacacagtgatgatagataaaatttagaatagaaaataaaatgaattctgataattggaaaaataaaaataaaagttcaagtaggaatataatttataaataaaaaatgagaatgaaaaatattgaatgttgaaagaaccatcagtataaaacacaatggtagtaaatgaaaataaagtggagagaagcagcgagctcataaaggagcaggcgagtagggtggcagtggttgatgggatatctaaaattataaataaaacctcaaaaagattatatttgatttttagaatacctatgatgaataagaggaggataacaaacatgtcgttgagaacctcagtcacggtggttggcgtcacggtggttggcgggacttttagaagtaaaaaatataaccaatgataatcatttcgatttttaaaatcccactaacattaaagagcggaggaaacgggtgggcattaaaggagtatatttgagacatttgataggacttctaaaaattataaaaacgaaacccgatgagataatgaactctataaactaaaaggtccaatttttaaatgttataaggagaaggaatataaatcgtggtaggttagggaaacaaataaataaaggagtaagggtagtcactgtgacttttaaaaaactataaaattagagactctaggatgacaagatctcataaagtcataagacaacacgatggctattttacatttttgaagtaaaatcatgtgaataaatagataatttagtggttgctagctgcgcaattgtgcggcccacctagctagaaagtaaaaaatgaattccaacaatagttatgttcgatttttataatcctaatgacaataagagtaggcggcagacgggtcatagaggagaatagtggcagcgtttgacaggatttataaaaattataaaaaaacctaatgagacaatgaactctaaaaactataaagtccaatttttaaaggttcgggcttataaaaagtaaaaaaataaactccaatgatgatcatgtttgattttaaaatctcaatggcaataaagaaggcagcagcgggcgagtcgtagagaagtatagtgacaaagttgctgacgttttggcggaacttctagaaagtaaaaaaaatgaacctaaatgataattatattcaatttttaaaatatcaatgactataaagagaatattcaacggatggctatagaggagtataatgatagcgtttgtcgggacttctagaaattataaaaacaaaaccgaacaggacaataaactctaaaaactataagatccaatttttaaaggtttcaaggagaatgaatagaaaatggtagattaaacaagtaaataaagaaggatatgacagaagtaacgggcagcaactggtgtgacttttaaaaactattaaattagaaatacgaggatggtaaggtttggtctttcaaagtcttaagacaacgagataactatttaataaattttaagtaaaacatatataaaatatataattttatatgggtactagccgtgcaattgcgcgggccaccccagctagttatagattaattaggcttaaaaattgtctcgcgaatttgctctcatttatacgattagtttattattaatctatatttaatatttcgaattagtgtcaaacatccgatataacataaaatttaatccttgatccaaataccacctgagaaggctttatagtctccgatgtgcagtccaatccagcgtgtaccccgcagggtcgcagagaacacaggctgccggtagatctagtaactctatgttggccaaaagatcagcagcacgggcacgcagctagccaaccatggctgtcggcgagggggagcagcagccgttgcacatcctcttcttcccgtttatcgcgcacggccacctcatcccggtggccgacatggccgcgcttttcgccgcccgcggcgttcggtgtaccatcctcaccacccccgtcaacgccgccgtcatccgttcagccgtggaccgtgccaacgatgcctcccgtggcaccggctcaccggagatcagcatcacgctcttccccttccccgacgtcgggctcccgccgggcgtcgagagcgttccgggcatctcctccaaagccgaacaagagaagatagccgaagcgttcctgcggtttcgcgagccgttcgaccggttcttggccgagcaccacaccgacgccgtcgtggtcgacagcttcttccactggtcctcggacgccgccgcggaccacggtgtcccgcgcctggcgttcctcggcagcagcctgttcgcgcgggcctgcagcgacagcatgctgcgccacaacccggtggaggcctcccccgacgaccccgacgccgtcgtgtccctgccggacctgccgcaccgcgtcgagctgaggcggagccagatgatggaccccagggagcgggagggcgagtgggccttcctccagctcgtgaacgccgcggaccagaggagcttcggcgagctgttcaacagcttccgcgagatggagccggactacgtcgagcactaccacacgaagctcggtcgccgcgcgtggctcctcgggccggtggcgctcgccgccggcaagggcatggcggagaggcaggacacggacaccggctccggccgccttcgccgacgaggaacgctgcctgcggtggctcgacgggaaggcggccggctctgtcgtctacatctccttcggcacgatcgcccgtctattggcggcggagctgacggagatcgcccgcgccctgcaactctccggcaagaacttcctgtggatcatcacccgcgaggacaccgacgcatcggagtggatgcccgaaggcttcgccgatctgatggcgcgcggcgagcgcggcctcgtcgtccggggctgggcgccgcaggtgctcgtcctgaaccaccccgccgtcggcgggttcgtcacgcactgcgggtggaactccgtgctggaagccgtgagcgctggcgtgccgatggtggcgtggccgcgttacaccgaccagttctacaacgagaagctcatcgttgagatgcttaaggtcggcgtcggggtcggcgccagggagttcgcgtcgttcattgaccatcggagccaggtgattgccggcgaggtgatcgcggaagccatcgggagagtgatgggtgaaggcgaggaaggcgaggcgatgaggaaaaaggtcaaggagctccgcgagaaggcgaggagcgcggtgaaggagggcggctcttcctacgacgatgccggacggctgttggatgagctgatggctcgccggagctccggcacgtcgtgagattgcatccgggcggtcgccggtcgatacatgatataatgaaataatgaccggacagctctgatggttagttggttactgaggcgatttcatcgtcttaggcctaacagcatgtattttctcccgtacaatacatttgtcatttggtgatgggcatgttaatgatggcttagactatactatactatactactctgaagcaaattctctagtacgttgtgactttgagagcctcatcttttcactcatgcttatgtttatttgaaaatttttgaatttttaactttaaatttagagctgagaacacgtatataaaagttttatttttgatttaaattttaattttaaggtttttttcatcgaagtttatttttcagcctttacttttagatcgctaagaacacgtatataaaagttttattcataaattatttttcgtttgcaaatatgttgtttcgcttattccgtgattacgtgagttattgagatgttgacctactttatagcggatccatgtatcaccgtcagtaagtaaattagagaatctcaatcccactttataatatatgagaattttaatgttagacatgacatctaataatttgtcattgaaaaaacttaatttgtcagcatcgtttattttattatgatatattttatcactagagttaatttaaattagactagcaactttgcatatttacatcaaattttctaatgagtggttaaacttatatagaaaaatcaacacatcatttttttaagaaaacataatatataacattatgtggactttggatcactctttcgctgtcatgcatctcaaaataaatataacccgtactagtttgatgatggactagattatgacgcgtctctttaaaacctcggtgtttttagtagacttcataccaccttttgctgtaattttctttaaaaaaaacactaccgaacacttcgtcatactctgtacactatatttctaggaacgttgtatccgtagtgatggaaaaaattcctaagagttttatttcaaaaatatgacatcacacaaaagtggtatgatgtatcacagtatcagctacgtcaaaactgacaggctaggcaaaagttagggtgtgtttagtttgtgaaaagaaaaggtttggttgtcacatcggatatttgaccggatgtcaaaaatggttttcagacacgactgtagcacttatggctaatcatgtaataattaggctcaaaagattcgtctcgcgattttcatgcaaactgtgcaattagtttttatttttatctatatttaatgctccatgcatgtgtccaaaga

SEQ ID NO: 49120 - DNA, 1540 bp, Oryza sativa
  unsure (1)..(1540): unsure at all n locations
ttattctaactaaatctatcctctactttgtttgcgagttattcataacaagggaattttggttcaagttttgttggtactaacacatgtaccatggttttgctcaacacaattgcacattcgccaataatcatgttgataataatgaatcaaatgcttgcacatttgttttggcagtatatgacaaatcagagaacaagaattctgatttcatactgttcacacagaatgaaatattgaggagccgctacacttttttttttttgctaaagaatggcacgtggttaaaaattgttggcctatgacatgtgatgcattatgttagtgttttgtggcaagccaatcgtgtgataacaagccaaacactaggctaagttggtaaacctccttaccaaagatgtggtaaagtgtggctaccaaccaaacacctgtgtactccagtaaaccgaacagctgaccacatttatctagattctagaaacaactaaacaatatttactctgaattccaaatgttccgtgagattgaggaaaatgatttcgagacagatccatgtcctggcattagaaatcatttgattgggctgatgctaaagaccaaaaacattttccttgcatgatgtaggtgtggccatcaattttgtcaaaaaggaagacatccgtatcctgagagatatcgagcagtactacagcacgcagattgatgaaatgccaatgaatgttgctgatctaatttgagtgctggagtggcgctaccatgtttgatcatctggtctggcaacaactgagcttgtttgttgtgattttggttgacatgctttgccgtgactgtattgctatggactttaaagggttgcgagtctaatactagtgattggtttcgttcccctctcttgtgacatgatctgtatataattttagtgccagctcatgtaacactatgattgcatttctgctcagaacatgagacttgttcgttatatttattgccacaaggatttgatgatgattttctcgttgaaggtgtggtggtatttagatcttctgtgtgttgtgatctcaaatgtttttgtcaaagtgtttcatttgctccagttcttgaaagctttgtaatgtcatgctcgatgttgcgattatactggtaaatgggtttattgcacatttgcacccgtaggtaggtaggtaggtattcgttgaagtaagtaaacattattatgcgtttttacgagcttttgtatgaatcattagatagccaaaaaatggggctcgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 49121 - DNA, 725 bp, Oryza sativa
aaatcaccccatagtaatcttggagatctgttaaacactagacctctctaaagcccagggagcctcgtaagcacaaatggtaccttaatttgcttatttaacaaagtaacacatattaatctgaagcgctagaaaaaaaaaatcaccagggcaggatcaacttaacatttccatgcatatttcgtcaaaagagtggcacagtaccctcacgcgcatttcatcaaacaggtcagcgcacgcaaacagaaaaccccagcaacgaaatgcacatatgactcaaacaccagactcacttgtacataacgtcgaacatctcgtcagtgaggctgcggaggttgtcatcgaaggtattgatgcgcttgttgcgagcccgtaggattgggtcggggtacttcacgaccttgagcggcggctcgaactggaggtcagcagctgcatcgtgcacacacaccaccagaagcagcagaacaaaccgggtgagaagcactacaaggcacctctgagcagaataacgcgccgtgaaggcggcggccacgacggcggctaacctgtggcgaagtcctcgtcctcggccggcggcgcggtgacgacggcggaaccgaagccgtggcggagaggcgcgaccgagcccgtgcgggagagtggcagacccgcggaggcgggggccgaggctgaagtgaaggcgagcggccatggtggtggaggactgggcgagtcgccgattt

SEQ ID NO: 49122 - DNA, 2802 bp, Oryza sativa
taattgcgccatgattgacaatgtggggctacagtaaacatttgctaatgacagattaaatagttttaataaatttgtcaaaaagtttcccaacagaatttgtaatttgttttattattagactacgtttaatacttcaaatctgtatccgtatatccaatgtgacaaccaattctaaaaattttccccaactaaacaaagaccttactttcagaatcaatgctatcgcaagttgacatctgtgtaacttaagagtgtttggataatgagaaatagagggtgggattgggattgggaaatgaatgaagggttaggattaaatgaaagagggagaatgaatggttaggatttaaagatgtcttttgatgggtgggaaatcatttccaatttccattagccaaacattgcctaagtgtttgatgcccaaactgtcctcaatacgaggttgtgtggttgaactgagctgtagtcattttcagtaccatgttcgatctccattgaacttaaccaaaaagcaaactgagacacagacacagagagtaaaaagtcaatcgaccaatgaactttgttgtttgcatcctggagcaccaatttctactggcacaaattctacatcatcgccagcttctacagcaatacaaacctgaaccccaaaaaaaagcaaaaggaagacaacaataaatgtctactggcagatttcacttggcgcgagttcttcagcagtttgaccatcgctaaccccctttccttttcttttcttctatctcttcttgtgatgttagttcagaaatctctttttcaatagccttcatttgtcgaagaacattggctccaaagtcatgagctgcttccttgatatgctgcaatgtataagcaatttgttatgtagcagctaatagaatggatcagggaaggcaagggaatgttgattagaacacaaaaccactcatctacaagcaataacatgcttagtgacattaaaaggtatagatgcccaatatgaaaagcaacgaatgtaaaaagcatttccaagttttcatttcagaaagcaacaatttcaatatactttgaaaagtcattacaaatatagctggaagcaactattggtttgaagagaaaaaactatgctgagtaatgttgcatgctctggtttgcatgtaaaaaggtctgaattacttacttcatacaacttaatcttgcattctagctcagcccttttagcttcaattttcacagtccggtctacttcaactttttcaactctgaatgatgtatttctaacaggttttgcttttggattcactgctaactcagacctgtaacaaagagaccattttaaatataatctagcgcaatcaaatgaaataagcttaaacatttttttttagttaccaatctatgcaactatctgaaagcgatcggcggtgctgagatcttgaatgcccaaccgtacttctattttcatcactatggaaagagttgaaataattagactgaattgctcatttcaacaattaattacgcatgaaaacacagcaattaccccatatcaatcttttgaggaggaagatacttcatatcaatcttttgaggaggaagattaattgttttctcaaacaatgtgttgtgaactgatacgcctactataccttgctgtctcaaaaatatcaaatgactcttcaatgttgccctactgagatttcatggaagaaatatatcagataaagtgctgacttactgaaattcatcacaatttattgagttaacttacatgttatctgtcatggtctctatctcaagccttttctgtaataaggatgttccgaaacccatctcaggaagttttaaaaattctttgtaaccctgtgaaacaattcaaacgaactgttagttcttcaagagttagttaaattgaaatttcaataaaatttatagcacaccagtttgttgatgtagcgcctgaaatcacgttcttctgttgcagctttgaaaatcccttctttggatacctaaaacacaacaggccatactcaaaaaaccagaacgcttcattttaacaaggaggcaaacaaaacaatctataacaaatcagatcttcatttagttagttgtgaggggaggaaaggaagctctgatgttttcatgcaagatactgacacaaaaagttatggaaacatagcatatacatggatattttttagggcccttgcccaacctaccagatgccttgagcttaagcaacacctttaacaaccattgatatttttaataaatgctggaaacggttctaacctgtttttcatatattctttcctcaatagtacacgaggttataagcctatagatgatgacattcttctcctgtccaattctgtacactctatcaacgcattgattatccaggctgtaaacaataaatatattaaataagtagtttcagcaaaaacaataatatggaatataaggataaaccgaatacctcggattccaagatggatcagcgatgataactctggaagcattagttaaatttagacctataccacccacttttgtggtcattaaaaatatgggaggcccatctttactttgaaagccctaaaaagattaaaaataaataaatagcatgcaacatataaagtaattttagtcacctgatttgttttaaaatttcagtcacatttgccatctcttccaaacatactcatatatgaaccaagcagaaagaaaagcaatacacttaagaagaaaatcaattctgcactggcagttgcataacaggctcgtttgcccctaatttgt

SEQ ID NO: 49123 - DNA, 3750 bp, Oryza sativa
accccgcacgtcgaagcaaccacttcatcttatgagcgattgatgaataccacaaattccttcgtgaacctcaccgattgcaaccttagcttgatcggcactcaagcacttaaacaacaccccatcaatcgtccgataatagagctcatcatccaacaaagtatacttcaacactttgtaacgcaatttccgagaagccgattgagatggattctgtaaatattgatgtacatcatatctccaatcatcagttgttaatgcagcaacttcaaccctaacatctttgatcatcggcttataccccgatgccccttgggccaaatcattagcttcaatattttgcctctcgagagacatgcctcaaagtaaccagccgaaattccttcattagctcttggcacttctcattataaaccattaatgtatcattcttgcactcatattctcctaccaattgactgatcactagcaaagaatcccccataatttcaatagcattggcttcaacttccttgagtaactgcaaccctttgagaaccgcttcatactcagcctgattattagttgcataaggtttaatagtgtaagcaaactcaaaacttgccccccgaggggaaattataaccaagccgatgccacaaccatgagtgcatattgatccatcaaagaacaaagtccatggcacgacttcaaccgagccgattgaatcatcacgatattcaacaataaaatcggctatagcttgtcctttgactgccttcggtgactcataccgaagatcaaactccgttaaggaaaatatgcactttccaacccttcctttcaaaattggagccgacaacatgtacttgacaacatcggctttgcatatgatagtgcattcgttggagaatagataatgccttaaccttgtacacgaaaaatataagcacaagcacaacttctccacaggggaatatcttgtttccgcatccaagagccgacgacttagatagaacacaaccctttcctttccttccagctcctgaattaagaccgagccgatcgacttctcaccggctaacaaatataatctaaaaggtacccctttctgtggaggaatcaaaactagaggagagataagatattccttaatactatccaaagctttctgttgctctgcccccaagtaaacttttgatgggccttcaatttcagcaatggtgtgaaaggttctaatcttccaaacaaattagaaataaaccttctaataaaatttatcttgccgatcatctcctgtaactctgtcttgttctctagaggctgaatcttcttgatcgcattaacactcgtttgagttacctcaatccccctctcatgaacaaagaaatcctaaaaattggccagccgatacaccaaaagcacactttgtcggattcatcttcaggccatatttcctggttctctcaaaaatcttcctcaaatcggctatgtggtcttctatttctttagacttaacaaccacatcatcaatgtagacttcaaccaaccagccgattagatcatggtatatataattcatggctctctgatatgtagctccagcacttttcaatccaaaagtcattacaacccactcaaaaaagccgattgcaccaggacacctaaaagcagtcttatggatatcttcttcggccataaaaatttgattgtatcccgcatttccatccataaagttcaatatcttgtgccctgaagcagcatcaaccagctgatcggctactggcattggatactcatcctttggggtagctttatttaaatccctgaagtcaatgcacaccctcaccttgccgtttttcttgataacaagaactatactagaaacccactcagcataccggcaaggacgaataaaaccagcatcatataaacgtttaatctcagccttgacaggttcaagcatatcggctttgcatcttcttggaggttgttgatgtggtctaacccctggtttgataggtagccgatgttcaacaatcaataggccgagtcctagcatttcgtaatactcccaagcaaagcaatctctgaattcctttaacagctctatcaacttggttctaaattctgaagataaattcttactaataaatgtcggccttggtctatcacctggacctatgtgaatttcttccaaatcatcagccgacatgaaaccctgtccttgcttgtcatcgagatcatctactgtgtccttggtgtagacgtttgaaccctccatgacgccctcaaaagtttgaaccctccacgatgcctcagaataatagcttgggctctccatcttcaattggttgtatatcagaatcagacacttttagaaaatctccatcccaaactttaccagataagcaatcgagaccatccatctcccaaagagctaaatcggcactggcaacattgactgacctgtcggctggcacaattttaatcttgtcgccttgcctctgaatcaagcattgatgcatggttgaaggaatacaacaattagcatgaatccaatcccttccaagcaacaagttgtaagaacccttcccatcgatgacaaagaatgttgtagggatagttttgttgccgactgtcagttccacattcaaaacccctttggtttctgatggattgccaccaaaatctttgagcaccatgtttgtcttgatgagatcctcaacatttctgctcagcttcctaaatgtagcataaggcatcaaattactgcagccccaccatcgaccatcatcttagacatcgacttcccattgacgtagtcatttatatacaatggtttaagatgccgattctctgtcccttccggcttctcgaagactgcttgttctggtgacaaaatcaacttagccgattccccttcaactttatcgacatcggcttgcttgaccccaaattcagcaggcaaggtgaacccatgttaaccgatgcaatcacaaccccttttcctttagccaatctatttgcttcatcggctgcaggagcttgattcttaacacgccactcccgcttcggcttggtcttctttaaccgatgattgattttttactcaacctcctgaaagtgctccctgtttttcaacctttgacccttctcttctgattctttgtaaaaatactatgacatcattgagtcttcctgccttcattgttctcttggttacaatcttggttcaccgggcccaacctttgatgaacaggaactcttgcttgccttagctgattgcctctattatacgatcggcttgaaccttctgcaacattactgcacccaggacagtcttcaatagatggtagcctcataccttcattccagcaaaatctaaagaactcacagccccaatgaggatcaaaaccgccatcgtcttcttcataatgcatttcctgctgtttgtcatacttcttctgatactttttgataattttagccgaattcacctgaaaacctcttgcacgacctccatcggctgttcgaccagctgtatgcaccatattgacaagaaaaggattaccatcaaccttcatcggcctcttagaatcatcaaatttgattttgcctccttcaatagctgcctggacctactgcctgaagaccttgcaatcattggtagaatgagacccagaattatgccacttgcaataccttctcttgctcaattcttcagccgatgggattgtatgaccagcagccagttgaatctgtttctct

SEQ ID NO: 49124 - DNA, 2392 bp, Oryza sativa
acctttttaaagttcttcctggcttctgcgaatctctgttcatgcaaggttcccttctgtgcaagatgtgataaactatcaaagtcttgagacgagaatttctccctgatcggagctatcataccctgaaaagccaaatcggccaactgggcatcaagtccaaactcaacctggaacatttatttctcatctttctgaccctctgaatgaccccatgcccaggctcatcatgccttggcttaaacgttgttaaatcagataatttcatctgatgaatccccctgtggaaatagctatgaaaatgcttctccaaatcggcccaactgttgattgatccacatggcaaagaagaaaatcaagtgaaagccgatctagacaagccaatgggaccaacctaaccctcaaggcatccacagccgatgcttcaccacactgagctaagaatcggctaacgtgttcataggttgaaatgctatcttgccctgagaactttgaaaagtctggaaccttgaatcggtcaggcaaaggaaccctctcaaaccactggggtaaggatgccgatacaaatttccagcatctttgggcttaagcccgaactattctctcattacatctgcgatcatatcggcccatggtcgttgctgaggtgctccttgtgcttgttgcggcacaggctcgaactgattgtattgaggaacaaactggggctgagccgatcctccctgctgatattgaacttgtggcgatggaggctgatactgataattcaaattgcccccctggtaatttgaaagtttggctgaatattgcgcaccaaatgttcgggaacaacttgaggtaccaccgtttgatctggttgcacatgatgaaccaaatgttctgggacgactctacagcgtgctgcctttgctgattgtcaagtgttccaaacccagccgacgcattcatcaaaccacaacctgccgccttggtggcgtctgttgaatcggctgcacaacctgctgccttggtggtgtttgctgaatcggctgctgctggattgggtcaacagtaggttgaggtggtaagaacatagctgtaacctgatcttgcgttagccgattcacattctgtccactatgctgtagttgctctctcaccaacaactgaggattaactaattgacttagtgccgataatggtgcagcaggtgcgggagccgatactggtaccgtcggctgaaccgatggtgcatgaggaggaattgactgaacagctggctgattatcagtgattaagggccgataattcgggaagacacctcctggcaaataaaccggtcctgtagctttatattcagctatcgagccatcaaccatcgacttcaccatgtttgacaaagtgttaactaatatcccagattgattgatcaaagcatgttgcacggcatagtcaacctgatcctggaagttgttaaactgtagctgtaccgtgttgccatcttgattaagatttccaccttgaaatccctgagaaccatcaccttaaattccttgagaaccaacaccttgaaccccttgagagccatcaccttgaactccttgagaaccaactgtagcacctttatcacttggttgagctgcaccatctggagcttgttgtacctctctatccttggaagaacctgttctgggaacatcagcaattacttttactttatacttctgaacaattgttcccttgcgggtctgcatgaacgagttcaagaattggttacatgcttgttgcatcattgcttcaagatccttctgctgcttaggtgtcaagttgtccagagtgatggtcacgatgtcgccttcatcaacctcagataaaccaagcttctggatcttagatttaacagagccatctttaccagctgaagccggcgatgctggtggtttctcatccatgaggaaacgtcgttgtgatgctgacttgtaatcagtcccaccgggcgtgccaaaagcgtgttgatatgaaaacacggggcttgggagatctgcttaactccagtgcaggtccaaaactcgccttcgggtatgctagcgtgccagttgatttgatcctgcaatcaacaagaaacaaatacaaagaatccgtggttaaatccataaacgatagccgatcggtcaggtgccgatgacgtatcatttatctttgagccgatgtcatatatacatcgatcggcaatcattaataagtaagaaagagataaatttacttgatcggctgtagatattaatgatatataatctctatgtcgatatatacttaaaatcaagtgactgggatagatcggtcgccatgccgagacagtataaatcactttcatcgaaatatatactaaccaccagattatatatgctcatag

SEQ ID NO: 49125 - DNA, 6570 bp, Oryza sativa
tcagcaaagcatataagataaatatggttaaatcaggtaagatcggctgaaaccccgatgctaccgtaatcggccaccaagaagcaggctaaaggttgagattttaattacgactcataagatcaaactcaactgatgcagctataagtataaaaagaaggcaatatctagacaatcaagccattggaagtttcatagagttgtggatatcatatataatctaagccaacgtcgctatctaacctaatcggctgccttctaccgacatatgttagctgattgtagattagatagcaatattgccagagattatataagatatataataacttgacgaattacataaacaagattagagtatcataaagatggaagcactaatcccgagaacgcaagccgccataaaaagttttacctcttgttgaagatcgaaaccgatgcagctcaacccgaaagtaagaacttgtcgaaataaaacgaaagcaaaaagggtggcgatgcgccgagattgtattgaacgtgtgttcgtttgattacatggggttcggggtctatttatacctgagaattacaaaacgtgtccatatcggacacgactcttatctctaacaaactctaagataccataagtctttgtggcagacttttgcccaaacatatgtctaaggaaattacataaaatatcctaattaatagatataattgccttctcaggactctatccatgtgtggcaatcatcttgaagcacgtcaacctaacccgacaatgtatgtcgtgtcacattgtcagattcggctcgatcggctaaccctgtctgactcgatctctgccgaccctagtcgtagccgatttggacttcaaccgatccttactctggttccgggatgattttcatctcgaattccatttcggtttcttcttcatctcctatccttgaattaccaataacaggtttatatatcagcaataagctaacataatacattaaccttaccttaaacttttcaaatcagatcttctacctagcaccatgtgactgacagtgtggtgatgcatctatcgtttgagtgcaggtaggcgtagtggcggtaacgatccctttcctgattctttcctcgtcgcacaacgggttcgtcaggatctggattgtgttggccatatacatgagcatcagagcctttattagcacctggaggtaattaattaacactctatatacattcttgtgcaactgcccgcggttttgctgtctgaataaaattgaccttaatttaaattttgttttcgataatttggaaacaatttctatatgcgcgtaatcgatctaactgaaggttttatgtactatttatgtatgatggaagcagacagggggccatggacgcttcttcgcacatgggcacctggccagtccaaaagcaaaaaatggttttgtttgggggggaaatggtgagatactgatcaagtttgtggttttgatgtgtgatgcgatgattaatcatgtgattagacaacacattatagaacctctttttttgtgcagaaaccaaaaaatgcgtggaatttacgggcttctattggggattctgctatttgatctcaccttgcaggtgttggttagcaagctggattaattcgttagaatatgccaaattttgggttgtgtccgcatatttaagttcgtttttaatctgtttgttggttctatacttagggttgtacctgtccggaggaagaaggaaacagcatggcgaatcttcgttctgaaagggcatgcgtgccggcgggagtgttggtcggatggtggcaacgcatgctttggcgtttggggcggagagggtgggccttgccgtgggtgaaacgatgctgcacactgggctctaggctagcatggcagcgcaacgtcacaatgcctttgtctggcacgctgcgcactccctcactcatttacacctgtggccaccgtctgtccttgcttcagtccttggcctggtttaattgatggacattttgagattgtgttagtgatgatgagtaacaacaagatactatacatcagcggagtctgagactgacaacaacaatggcatgcaaaattcaactcatataaggtgagttggtttgattgagtcgtccattttgcattagttattttttgaattatttctgttcgcaatggtctactttggttatgctgaccgtttagtattgggtacatacttatgtttccaagcaataccaaggtgccattgagaataatctatgttatatgtgattttgtaggtaccgagcgttttgttgggtttgctatctattggatgccttctttacttctgaggatgcggttggttgcattgcatgtatgcctgatgtttgtctatatgtgtatgtacgtgttccgatgcacacgtgtctgcctgagtgttgcgttgcatgtccacgttccactgcagcacctgccgttggggcaatggggcatggacgcgaaccctgggatctcaaagccgtcctagatacttcattctttcgtgcttattagctccctctattttattgtgcttttgcttaataatggaatgtaatttttgtctttgccagtatattagcttatatttaaccactacatatattctgcatctcaatgtattctgtcgcatcgtattaccctcgacgtagttccttaatccgttaagtactttagttgtccctgttctgttgtactatattatttatgaataatatataatgtctttggtaatgtattatcttgtacttaacaagttcaagcatatgtattcatgcgcggcgacagcggcgtgtcgccgcgcttatccttctagtaaaaatccaagttcggaagtcttcggaagagttcggatatggctctagcagctttcttttcttcttttgtaaggcctatactttatttagaatattcttctttatacaattctggtattataatactctccgagtatatgaataccaactttactttatatccgagttatattgattatactgctagcttatttgggagatataatggtacgggtatagtgtttgcttatgcaatcactctgtcatgacgatgatattagagtagtatctggtagtttaggcgtggtgtcttactgggtatcattatttggggttatatgctgcggaagagaggtgggccgctgatggtgacagctcagcacgggtattcctccgcacgtgtatatagtctaagttaatttcctgaggaggatacttctccgtatttagccccggttgtatagtcatgacgggctgtcgtaaggaattcggcagtcaggggtggcttctcgaagtaccaggagggcattggaaagatggtattagctagttaatcttatagctaggatgtatatattatatgtatactagaagtataggaatatattcttttctattttcttttcacctagcttagataatttaatatgagaatgagtagccttatgcttgtgtgtcactctaccctttgcttatattatcccctatttagactatggttattacaggtaatatataaattattagtacagttctctctactataatctttccatgggattaaacaaataccatacacttggaatactctcgggtgaaatgttacaatggtatatccgtgcgcgcttgcggataaaatatgtaaccataatatactaggagtatttctgcaccattgatgagaattatatttctagtaatgttgttaagaaatacccacagttataacaaggtataaacacccaacagattgagacaattatacggatgaactattaatacaatatgtgttgtattcaattgctcttatcgagtgaacatctctgttctccgccttatctatattttaaagatgcgttcgccactggatggaaatagaggcggatctacccattaggcagggtgggtcgaccaactcagctacaactcgtgtcaccctacatgctcatgacccccttatccccttatagtagtcgtgggccatcaaaatttggtataacaaggtataaacatccaacagattgacacaattctacggatgaactattaatacgatatgtgttatattcgattgctcttatcgagtgaacatctccattctccgtcccatctatattttaaagctgcgtccgccactcatggaatcaggggcggatctacccattagtcagggtgtgtcgaccggctcagctacaactcatgtcgccccacaccctcaagaccccttatccccttataatagtcacgggccatcaaaatttggtataacaaggtataaacacccaacaattgagacaattatacgaataaactattatagcaaatttaatagtatagccaactactaactcgaaatcacctatagtcaatttaacagtcaattcatataatagttacatactacactgttaatacctggtctcatctatcatacgcactgtgtcttggagtccatgctacagctggctacaaatctttagtttgttgctattttctcttctcttttatctttataaaatatatttatagctgttattgtacattctcttaatacgatatatgttgtgttcgattgctcctatcgagttaacatctccgttcttcgtcccatctatattttaaatttgcttacgccactggatggaatggcggctcgggaggtggggattggaagctgttgctcgcgttcgtattagagaaaggacgggagtgaaggacggctaaccggcgacgaggatcgacctgcgatggcggcggcgatggtgaccccgatttgggtatatttgctctgattgcgatcgggctccggcgagggcctaattggggtcactgggtttaggggaacttgatggcggcggcatggtggagaatggaaggtgttggtggtggcttggcggcgtgaagcggagagcgagtgcggcgacggtgagtgtcgctcgcgaaggtcgagcccgagcaggcgctagagtggtagagtgaggcgcggtaggtgatgggtagcgctagaggacgggcggtggctcggggagttatttttcgccggtgccgagtgcggagacgaaacggagcggcacgatgggacagggcagagcgcgtgtcggccgacagcggcgcagcagcgagcggtgctggcgcaggggcggacctgtgtacgcgcacggcggcggagaccagcaagatggacgtcgcgaactcgtggctcggcgtgtgaaagcgctattccaggggtggcagaggggctgcgagtggcggcgtggtgtcgggaggtgccggtgcagactgtgcagtggaggtgttgcggtcaagcacggcagcaaagcggcatgtggacattttgtcgaccggctgccgggcgtggggaagaaaaggaagggccgaaggatgtaacagacggtagcggcatgtgggccccgctgtcggtggaggagcggacgcgtgcatgctgcggcccacgggccggtgcggcagagtgggccgcgcgagcgtgagtgcgagtgcgggtgagtgggcccgcggcagacgttgggcaacggtcggcggatgcttggatcgagatctatccgtccggtcgtcgcgtcgttttgagggctgttccgtccgtctagtagtatattcgttcagaaatcccctcttctcccagatccgcctctcgctcccccaagttcgggtgttacaagattatccccggttccttcacccatccattcccggtggcccttgtttaaccaagcctggcaggcttacccaccgccaactctactcacccctaactcccctgccgccgtccttcttcttccttaacttcggcgcagggccgccgccacgtcgcaccggggtaacttcgagtgctcccaaggtgacaaactttctttcgctttacttggcctattttggaagatatcacttaacctcttatttaggagatattacttaacctctttgacgggttcccatgggtttagcttttgaggcttcccctgtgatctgttttttttttctctatctctattaatatactactactagttgtttttttttctccatctctattaatatacgaggcaaagcttttgccctctaaaaaaaatcttggcctattttattcatgcctcataacccgtcacgtttaatcgctcgtcgcctgatccgggccgaacacggagtagaatccgtttcggtatacataaccggatgttcttatgctgggtgtgtttataactagttataagactccatgcatgctacaaggcatctaatccagtcattgctagcatagacagcaccccctgccctgagtatacggtattccacccatatttctgttaacgaggtatatttgctgttgctagtgcttattacgccatggacttgaataccgcaaagagtatgatgctggacgacagcaacatcagcccaagaaagaagacattcacgacacgtaagaacaccatgctgagcataagcagaaacatcaatccagcagaccaagaaatgctcaaaacatacaagaggagaagagtgaacagggc

SEQ ID NO: 49126 - DNA, 6974 bp, Oryza sativa
  unsure (1)..(6974): unsure at all n locations
atttgcatggagagtatcagataatcaataaatgtctcactgtgatggcctggtgttattccaagctgacaccaagttgtatgtgatcaacctgaccacaagtgatgttcttaggttgcctgacaaccaagagtctgatacgctgaggcaggcaactgggctgggtcttgaccctcgcaccaacatgtacaaggttgctcgatacttctaccgttctgtagaccatactattgggacttatgatgcagctatggaagtgttctcaattggtcaggatgccttctggagggagacatcagaggttccaccatacccagttcgctctatggaaagtcccattcactccaagggatatcttttttggaatatcgatgagaggttcctcaaaggacaatcacgtggtttcctttgcttcagcttagaagatgaaacatttagtcttatcccccatccctgcccatatttgccattgaaccatggaacatcactcgtatcagagctagacggggagttatgcgtaggtttattcatatcaggtcaacaacagttatggatgtacaatggcaatcagtgggatcagcgcttcagcattaacgtacccgggccaaatgacttgtacattccattagatattcttcctcatgatcaattacttcttcaaaggggtccacatctgtaccaccacaaccaccagtcaagtgaagacataaaagaagtggcacgcatggatcaactcaactaccagagtcccccgggagaaccctacgtctacatggtgattccctacatggaaagccttgtccgagttacatgtaacatgtagaggagctgatataacataatcatgtaataatatatttggctctgctcaattttgtttgagatatatgaaatcatcatatttatttgtttgttttttatttgttatctcatgaacaaagttgagtttacttttaaaatttttcatggtggtacaatatcatttcttgtaagttctttttaatttacttagtacccctttgatatggaggattgtcatagaaattttgaggatgtaatttttttaaaggaaaatttcctatggagtctgttgattcataggaaagataggacatttttcgtagggttgtattgttatagttaaggcttggggggaaaataagcaagagggtctaacctcttggaaactttcctttgctttgttaatttcctatgatgctatcaaagggtttctcttcatcttttgtacgttttccattcccgtaggacaagaaaaatatgctaattcaatccctacgtctttttttctatcttgcgtttcaaaggggtccttaattggctcccttgtaaatttgttttctgttcattcgtattgctttacaatgacttttcgagtagggtaaactgttttgacagttcagaactggaaggtccacttgtagctgtcagagttacgtggaaccttgtgcttattggacaatgaacactgtataattatccaaaactaggaaaacggatatcaactattattcctcagtgctataattcaggcatacctgactaaaaactttctattcaacctaaaacaggtaaaatgtagcatttgtccatttgatggtcaatcctatgttggtaaaatatagcatttgtccatttgattttttttcctaccattagtgatctaatcatatcttcaccagaactataatagtaattttaattctatgttggtatgtacataaacttggttatcccttggcaactttgcaggatgggaaggtattgcctaatggacctgttgtgatttcacctgatgtttatttccttcattgtaccaggaaggtagcatcatctctccaatatttgcatattcttgatgacgacatcctccactattacccgctggcaaagacgccaaagtcgggcggcgaccgtgtgagcctctgaataatcccaccttgcttagcttgggaggaggaagccattttaaaaggaagagccacccttcccctattggactagtcttttagggagattgggcctttccctaagtgggtgtgccaaagaactgttggggtccggacaaccttaagttattgggcctcggccaaccccacctgggccggattgttatcatttggtatcagagctgggcccctgttaagggagtgggaatgatgaggacatcctccactattacccgctggtaagttattgggcatcggccaaccccacctgggccggattgttatcatttggtatcagagctgtgccgttgttaagggggtgggaatgatgaggatatcctccactattacctgctggcaaagacgctaaagtcaggcggcgaccgtgtgagcctctgaataatcccaccttgcttagcttgggaggaggaagctatcttaaaaggaagagccacccttctcctattgcttgcttagcttgagaggaggaagccatcttaaaaggaagagccacccttctcctattggactagtcttttagggagattgggtctttccctgagtgggtgtccaaagaactgttggggtccgggcaaccttaagttattgagcatcggccaaccccacctgggccggattgttatcatttcttctattatgacctgctgaataatgattagcaatctggtttcactgaactactaggatggtctgtataattggcaaccttaagttattgggcctcggccaaccccacctgggtcggattgttatcatttcttctattatgacttgttgaataatgattagcaatctggtttcactgaactactaggatggtctgtataattcaggctcagcttcgacaaagaaaagtagctaacagtgatcaacaatactgttacttttgtgtactgtaataaaattgttgtttagcatgttgtaatgtttcctttgttcttctcagttatacgaagagcaccacatgagtttaagattgcatgtatggaggtaattctctttaggcagttgtcttatgaggatcgggtttaatactcaatgtgctatgatactatgaaatattatgtgccagtaaaacaagctaattttatttgttagaataagaactatgaggtcttgtttgtatgtgccttttggtttcaattccttagtgaacttaaccgaacaagtccctaataaattatccctcatccgcataccatccctcctatggttaaggagtttgcttattagcttctccatttttaattcttgtatggcatcataccccatatccctcagaaatcactataagacntgcaagaattaagaaaagttgttattgtctcgaaattcctttctaacgggtacatgacaatcttagaaacacacattatttagattcttcgagagacctgaaactccatgttggtatcacagcaggttcttgaaattctttaatttttgttcttcggcagggcatgcactcctcccttctgattacaatccattttattctggatttgtcaacagagatacagataagcttagttacaaaaagatgggaattccaaaagggaaaatctttatcatcaacccgaaggtatgtctattacaccagttaaaaagttagtgatcccatgcttgtattgcctttttatagtcatcctgtgtgcgtgaagggggggagtagccataaacagttctgttgaactcctatacctccttacatacccttatccatgatatgttccctccaaacactcttgttgtgcaggttagcttgtcattcttcccttcttgcagtacgtactttttaagtaatgcatgaaaggtcttctctgccgtagcaattactatggccgacgatcaacgtcgtcccaaaataagtgcccctttcgaattcaaaatttcttcccatcttacctctaatcaccctcccactgccaaacgcacatcatttaataatgggcactatattgttttgttcttaaaccttaatctctaccaaacaatctaaaaggggcacttattttgggatgaagtatttactagctatgtgtgtgaacttgctgtccagaatcccaggcaccaatattttttcttgcaaaattgatgtcagttgatctgatgtggatgcatactgcatagttacagaaaggttaccaagttaagtaaccgtgttttctgcacatggataaaaggccacagagaatatatatatgttatgtgtgcaaacttttcatgagattagctagaccgaaaaacatgcacattcatgttttctttttctttggttctttcatactatcctggacaaactatttttatccttagtgcatagtcaactccagttctatgctgcctgagccatacaggttactgctgggagcaaagggcagctagtgtgattgtgttgtactcatggatggtcggactccataacatgtaaatttctttttgtgctgaactgctgatcatcaatgatgacgccatgcagaagactacaattcctggaattactggaagatgccatctccaaatgttgatctgtagtgtagttttaacaaacacagaagtagataccactagattctgcatcagcataacagtcaagttcgtgtacacaaattatcatcgctacgtcggggttctgtccaatctgtaaagcatctcaggagtttccatatttatggttttgatttgatctccaatgcaaaggttgtcattttttttttttttgcttcgacgaagctctcctgatcatacatcttttagggagtgatctgttatactcttcgttgaacttaggccttagcttgttagctttccaagttgtatcagcagctgctagccagcaattttttttttcctttatgtgttcttgtaggcttgtagctgcaactcctctgtgattagattactctggttcatggaagcaacaggcaacccaaaactgtcaaattacgctgtatgttgtacgagagagaacatcgtacatttcctgccccattttcactttcttgtgctgtatgtaaccttcaatgcctgtagctggtaaacgtttcatgtgctctgttatgcacgtagatggattgggtgttcgacaggagggcgaggctatagatggccaaagggcccgcccggcacggcccgcccaggcacggctgggcacggcccagcagccatcgggccggcacggnccggcccatgggctgcacctctcgcccaggcacggtccaacatctgtgtggacgtgccgtgcccgcccgaaggcatgggttggcccatcaggcccttttttaaaaaagtatattattcatccgtcctctttgggctatttcatatgtatggctaaaataaggccattttccgtccctgctctttgggcggacatatgtatagctaaaataagtctattttctgtccctcctcttcggctaacatatgtatagataaaaaagtctattttagatccatattctttcgtccatggcatataatatgtctatttttactcccctattttttttgtgtatcgggcctagctgccggcccatcgtgccgggccggctcggccgagccggccggcccaacatgccggtggaggggcccaggcacggcccggtggtcgggccaggccggcacgggcccaacctccgtcgggccgtgccgtgcttgggccgggccaaaataccgtgccatgggccgggccgttgggcctcgggccttttggtcatctataggcgaggctgctgcagcctcgccgccccggagcctaggtgaggtcaaacatagaagaggggagactagagataggtttaacttctttcttgattaattccacatgattgtgatgcctctacttatatagagccgacccctaacaaacatcctaacaaacttatctaataaagcctaacaaccttatctaatagagggctgctagggtacggtatcccgtccaaacgagatactttatattgatgatgtcacctccgcctcagctttatccactcatgagtccacgacttagcgccaccctacacgctcacgccacagccagtggaagagcacgcgtgaggcgctaggagaaggacacgacacgagtagtggcttaggtggcaaagttggtccctgcaatagcatgatgacccttgtatcaacaccacattgagaagaaaaaggatggtgatagggaaaggaatggaagggagaagacgagacaaaacgctggtggtagatggctcgccacccagccaagaggcaacaacgtacgttctctcccgataccttgatacctcgtacttggtacctatgggttatcggttagtacctataggtattagttggtacccgagacatcaaccatgataccacaggtaccaggtctgaaacctgtaggtatcaaccatgataccgcaggtaccagccctgtgtaggtatcaaccatgataccacaggtaccatgcctggtacttgtaggtaccagctgagccatggtgatatgccgcacgcacaacatacctgcgcacaatgtcgacgagcagccaatgtctgcagcaccacgttgattgtcaatcgaaacttcagatctagcaccttcatttgtttccccttcatcaccactaacagtagcgtgggaggattcacatcgatcaacatcctccccgacgacatgacaccgaggtggaggccacgggggttggtgcgatccatcgcctcatcgctgacatggctcaagcggatccaataatggaaaggccctaggtatctccagatctggtactggcagcgccctccttgactcattgatggtgaggtgggacagagcaggagggtaggtgagcaagagaaaggagcacaacccattttcaggcttccagccaggtaaggaagaagaggggaggaaggagaagggtggtgccggaagaagaggagaggaaggagaagagcggtggcggatgagaggcgtatgggcaactagaagagcgacaaggagattgg

SEQ ID NO: 49127 - DNA, 1181 bp, Oryza sativa
gaatgcaaacgacaactgagaaaatggcgctacagctaagggctgtagcacctcccccgattggaccgatggcggtgaagagggcatcgtcatcaccggttcctccaccgtaaccgcgaacaggggctatggcagagaaggtggcgccgtcgcgagtgactacagcacctctgctgtcgacagcgtgggcggcggagagggcgtcgtcgtcgtagtttccaacgtcgccccctaggcctcaaaacctgcacggagtgccaacaccaattctgtcaccttggcaagcctagctgtgatctctgtgatggaggtctgcatggccctagaggattgacgcagcatgtagaggtcatggatggcaggcatggtgaatggcgtggtggggcggatgacaggatcatggtcgtctgataccatatgttatgcgcgtagatggattgggtgctcgacaggagggcgaggctactgtagcctcgaagcaccggagcctaggtgaggccgaacagagaagagggagactagagatatgtttaacttctttcttgattacctaggtgaaaccccgcgcattgctgcgggaatttagtatgataacaataaaaaataacgtgtaagatagctagataacatcagattaagtaaattaatgtggtttatgataatttaaatttaaatagtatatagaatgttgattcaaacgtaaaatgtaaggtggtatgactttatggaagaagaaaagtagggagatagtttggaatgtagattaatcatctaaaggctaaaaacaattgatgtgatatgacttaattagaggaaaaaggagaaagataatttggaccatagattagttacatattttatccgcaagcgcgcacggatataccattgtaacatttcacccgagagtattccaagtgtatcgtatttgtttaatcccatggaaagattatagtagagagaactgtactaataatttatatattacctgtaataaccatagtctaaataggggataatataagcaaagggtagagtgacacacaagcataaggctactcattctcatattaaattatctaagctaggtgaaaagaaaatagaaaagaatatatccctacacttctagtatacatataatatatacatcctagctataagattaactagctaataccatcttt

SEQ ID NO: 49128 - DNA, 716 bp, Oryza sativa
cacagtactagcacgatgctgcaatgcaagttaatctagagccaaaatagatcgcacagtagggggaaaaagtggaaatactgaagtaaaatgtcagattggtgggtaagaggcgtactcacggacggcggtgtctacgatctggcagacggagagcgagatcatggaggtcttgccggtcccggactggcctgggcgatgacgtcgcggccgctgatgatggggaggacggcgcgctgctggatggcggagggcttctcgaagccgtaggcgtagatgccgcggaggaggtcgtcgcggatccccattggtcgaagctgctgatgacctcgacccccggggaggtctcgaaggtgaggttctcgtcgtccatggcgcccgggccgcgccgcgacgtggtggccgccgccattgggggagacgaaaccctagaaagagaagagaactagagaagagatgggggaaggaggtgaggggtggacgggtggtcggaagaggatcttttgactaaagtcacggccgtgcagtttcaatacgtaatatccaccgtccactgccatccaacggttctctatctgctgctttcctttgcacacgtccaacgtggcaacgtctccttcgcatcccatcccagtgtggtcgctgtcgtcgcaggggaggacttctctgcgtgggcttgcaacctgattgaatttttttcatttttagattttttt

SEQ ID NO: 49129 - DNA, 1787 bp, Oryza sativa
aggttttgcccttggcatttgcttttgttgagagtgagaataccgacagctggtactggttcctgaaattggttaaaacaaaagttgttagtatgaggccaaatgtgtgcctgatacatgataggcacgctggcattctgcgagcgatagaagagttgcagtttgggagtatggaacgaggataccctggtgagtgggaagatgtatagagtaggtggtgcatgcgtcatatgggagctaatttcttcaagcaattcaagaacaagatgtacagagtaggtggtgcatgtgtcatatgcgtcatattgctaagttcattgtacatcacatcgatcgtctcgtattgcagcgccgatgggctcacgtccaggttaggcagtcgtatcctgagtttgttatggagttcgaccgccttctgccgactgacgtcgtgtgggagccctacagtgtcgcggctacccaggctcgtgcgccgttgggtctgtccacactctgtaccagggaccaggcgtactggatgactacggttccgatggtcttcgacatctgcgttgagcctcacgcccctttccgcgtgatgcggcagttcggcttccgtcagccctttccagtaccgtttccgacgaccgtcctagctgctattcactggtaagatctttcactacgctttgagttgttgcattaaaatctacatgtccacacatatttgcaccatctgtcgattcacactaatatgacacattaattcgcaggtactcgcgcaagggtgtcacacctagaaattctcgaaccagaatttctaagctgaatgtgcattaaatccctgtccaggaccagccagggtacacaaacgataattgttgacatacagacccacgtcttacaaatataaaagattacaaatgcagcgggaaggattaaagcgagctaaaccgggaaacttgacttcagcagcggcgactccactccacaggcaatccttgacggcagcgacaaaaccaacctctctgcgacggctccaactgagaagaacttcaactctggtgtgagggaaaagagagcaagactgactacccactgtactcagcaagtcataccggaagaggaggtatgatgcaggatataaccaaaggaagctaggggttcttttgcataaagcaggcatttcaaagcagtagttgaaagcagtaaaacagctgtagtaattaatcaatattaaccaatcactgtccaacgctacaccgaattgcaacaggcccaactaaccacctgaactacaccagttcattaagctaaactaggggtgagactaatcacggtgaatctggttgatcgcccataaccgcgggcacggctattcgaatagtttactctggccagaggtgtacaactgtacccacaagacacgattccacacatgtcgccatgccccgaagtatcaccatgatactgcaaagggggaaatcgtgacaagaccctccacataaccctcccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacttccgatcaagcagttacccactcccgcttgtggtaagcacggtaagtctcccagggtttcccgtgaaccggtccttaactgccatgggtgcgaccaacaaaaccatgcacccacagcccacca

SEQ ID NO: 49130 - DNA, 5907 bp, Oryza sativa
agcagtgatctgccgtgcgtgaccccgccgattagagacatcctgttcccatatctgctgtttcccatcgacacccagtgctccactcaggtctgatcccaatccgctgcctgctccactcctttgattgttattcccctttcttccacataattgcacacttaggcagattcaaccaaattttgtttttcagatatattgtgatatagtgttacacaatgagaattcctcctcacaaataaatggctccacgtgcttctgttttcttggaatgctatacgttagtttttagatgcagcgattaagcgagtataatctgtgagctatctaagtaggatatgacttaattcgtgcaaggttaatcgcaatagcagccatattgtagattagtattcttgagaaatgccatataggaaatggatcatttcaccaatcatatcattttattcctagtttcaatagtaaggcaatgaatctgcatacttcatcatgttaacaagccggcccaattaactactgatcaatattttttttggaaaataaatttcatttaataatgccatggattggagaaggttgagaaaacaaattactagacaagattcggtggtatccactttagacttcttattggcaaagtcttgaacattttaggtttatatattttgggatgaaatgctaggctcatatattttttatttgcattctccttcttaccctctgagtaaataactgaaaatagatgttttagcttcttttcaattctcagaaatttcgctaattttcacaagttcaggagatcgtcgtgcgtgacttgcctatcggagacctcctgtgcccatatcctgctgtttcccatcgacatcctcagttcatcattaccttaattgaaggtaaaagcagtgccttctcttttttttttcctgtttcccttgagtgattgatatgagcaaatattctttttcttttttttctttggcatctgtgcatgtggatttactcatctgaaatacccttgagactttgacttctatatattccttgcaaaggggaataatgtctgttttctatcctgactcgttgggttgtctctcatatacaagggaaggaatttgcaagagctgtagccatactaccttctctccaattatatcggttaacagaaagatagaaccattattccattttgccacacaatcccaacaggacagatcccggagttgctcagactttgaggattaaaatactaactttgtaatttctcacatcattatttttccttctgtgaaacaacgtgaaattaaaaaatggtgaaaaaaagacagattccatcccctgaggtggaaggtgcgttagtgcatcacacatgaaatttgtacttagctggaaccatcaggtaaagacttaagagctgttaagcttaataaaggaattcagttgttgaataagcaggtagatcctgacctgtggattagtacctatttgtgtgtttataagatgaattgattgttcatatgttaccgcgagttaatttggaaaagaaatgagcatagggtgaaaacagcagagttattatttcatttgcactctgaatgaaaaataagtaaataacaattcaataagaagttataaatgcaacaaattgatttacctctgtacatgattcaagattcaagtgcaacagctaaaaggtttcttcccctggtcaaaatagagtgaatctcaacagccatgtataataccaacgttctacagtattctaaaattaatcatcccaatgttttcttttgatcaatggtgtaatcctaccaatttggaattgggatacatcgtacatccagtttgcatgttctaagtgtgcacatttcttactccctggccgctatcacaaagcttgaccagtataaaagtctacgacataactgtaatcttatttgcatactttatgaattcattccttctctgtttgcaggttggtacgtaggcatgccaaaaatctaccatcatttgattgtacaacctgtaaataaatatgctggagatggagtgatcagaatgaataacaatgtcatccatcagatcgcctttggctttgaacaagctctatgagatggtcaaagattttttaatcttctgcttaccattaattggttacctgataggagccaaggtcacagtaatagagggaggcttaatgaatattcccttgattgaatttttctgactccatatgtataataaaaagttagtatggccatattatttgggtataaccctgttaggaacccaaaggcataaaattcatactagggaaaactgctccccttttttctaatatagaaatacttccagctggaagctgctggtcatttgttagtatatatcttgatgattttttcctctattgctactttccatttttatagccaatgaaataagttactaacatacgccatacagacaatattatttttgaacttgttttacagccacaacaaattaatggaataactctatcattcattttttgtatgtgtggacatatattgctctatattgtactccctacatttctacatatttgacaccggtgattttatagcacatgtttgacccttcatcttatataaaaacttttgcgaaatatgtaaaactatatgtatacatataagtatatttaacaatgaatcaaatgatagaaaaaggattaatagttacttaaatttttaaattttttgaataagacgaacggttaaacatatttaaaaaagtcaacggcatcaaatatttaaaaacggagggagtatattaaagcgattggatataatggtcgatgccctcgatatcatagtattgtgtcgcgccttaaatatatttatatatgatctgaatggaattaaaacttaattggatggattctagaaaagttattttctgacacatgaaattttaacaatgtattaaaaaaaattatgacaacgtagcgttagcacgggtatattactagtgatgagtgaaaccatttgttggactatagggtagatttatgatgattttttatcccgtttatctggcattacatgttgataacccggcaaatcttttctgaagaatagtactattacttgcaacagctactgagcaccaaattatagtcagtgagtcaggatggcaacacaacaattcaagctccctgctaccctctctagtctccaccttactacagtctactggctgctgctgtgtctcgtcagataatgagataaacatgtttgtttcctgaactaatgctggaaaaatatcatgaaattagaggagttacagacgcctatcttggttatctgaagactctgatgtttaagctgttcagccgggtatttgacagttatatgatctctactccaaattgatgccgacttcaacagacaagaagaactggtcgaatcggagggctggccctcgtgccgctcatccccagggcggcgaccaggcgagcgcgccaccgccaacctcttcctctcctcccctccatctcgctgccactcgagcggccgccagcaaagccggggacgcaatgatgacggtggcggggctccctacctcctctcgcgggcccggcggcctagggcagtagactcgctgctccggggtcaggacttgctcagcatcttcagggccaaggactacgacgccaccgtcgagttctactaggcgtctaaatattcgatgtgacatctattttttttcgtaaactaaacaaggcatttgaccaatatgaaaacgatatgtaacggagggagtacatttcaacaccaaacataatagtaagagatatcatgggtggacaaatactagtagcagcagataaataacacaagaagaagaataagcagcagcagcagcagcttcttctcacaaagagggctggaggaggaagatctcttgtgctcggtttgacatgaggtagcagcgcgccttgtgcttcacaaggcgcagctgtccttcttctccggcgacggcgacgacttggacagccatgaggaggagggcgaagcgcgtgggcatattagaatagccgtattgctcgccgaactcgacgatgatggtccagccgatgcacaacctgccatctcccaggtaggccaggctcgccggcccatgcgggaaatatccccgctccaggcactcgcgagggtacgtctcctccacccacgcgtacctggtcaccggcgccgccgccgccggctcggcggaggggacgtcgaaggcgcagaggcagtaccttgtccggcacatggcgaagcaaaggttgagttcgggcacgaacacggcgcgccgcacccatggaagctcccagtcgcctaccttgcgccacgccatggcattcccatgggcggtggtgtcgaaggagtaggtgcccctgtccggcgcggacacccagatgcgcgcgccggcggccacgaaggccgtggtgttgcagaagatcatcgcgggggccggacggaccatggagaagtcggccggtggatcgggcagcgcgcgccacgaccaatggcgccggcgccggccgccggacccggcgacaggggtggcgggcgggaggaggacctggaagcaggggtcgggctcgcacgggcggttgtccatggagtagagtcgggtccccagcaggatgagggccgtgccgccgatcgtcgcgtgccggagctcggaccgttcgacaccactgcggcggcggtgtcgtagaggagggtgcgcttctgcgtgctgacagcgacgacgttggatccgaccaggggcgaagtcgaggcgctcggcgcaccgctccagcgaatcgaacggggcgattggaggaggtaaggccctcatcgttgcccaatcgtggtcgtcgccggcgtcggcgaacatgggcttgagatttagggtgaagacgaagtatatgccgttgccaccagtatccagcctcttctcatccaccacgaaaaatatgcgatttctcctcctccccttgctcttcttacgctgctgctcgcttgcgccgcctgattccatctgccctgccctgatgaatcggtggagacggcgaaaatgctttggtacgggagatgcagagatcacccaagaaagacgtggcagattatcgccttaaaaaagtttactctattttatcgacatcatcgctccctcaccgacatcagcgtggcggccgccaatccgttccgcagtggattccgactctctgtttgagttccctgccgacggaatcagaataggactgggagaaaataaatactccctcgataccaaaatatagtagtaagcatatctacaatcaaaactaaattagagtgttctcgctaactgaggatgatctccggaaaactcatctcttaatggcggacactccagatggactcctcaaaatctagagtaagttggaagagatactccagcctacaacggttatcctagaccacaaaacccatgtatatttttactaccctacccctaatctctccctcccgcacaaaatctctcttttttcgccgccgcccctccacttctctttttcttcgcctctctctctctccctctcgccgccgccgtcaatcgcctctctgtcgcctgtggccacgaggaggacgagtagggccacctccctctctctctcatcgccgcccatcgcatccctctctcccgtcgccggatctaggccccccgcggccagatcggggaggagacgttggcggacacggcgctggcggaggaggccggggagggaggttggcggcggtggcttggtgcattccgacactagtatagtagtgtcataaaggagtagtgtatagcaagcgcttctaactgcatcaagattaactaaaatcctgtgatcttgagaaaatcaat

SEQ ID NO: 49131 - DNA, 1084 bp, Oryza sativa
agatacttcaccgaggtcaccatcatcctctcccagaccggcggctccgtcgcctacctcgtcttcatcggccagaacatctgctccgtcttccccaccaccgccgccggcggcgaggagccgccgcgtcgcgtgtcgccggcagccgtcgtcctcgccgtgctcctgccggccgaggcggcgctctccttcatccgctcgctgtcgtcgctggcgccgttcagcatcctcgccgacgcgtgcaccgtcctcgccgtggccaccgtcgtcagggaggacgtccagctcctcgccggccgcggcgggagcccattccaggggcggagcgccctcgcggggctctggggcgtcccgttcgcctgcggcgtcgccgtgttctgcttcgaggggttctgcctgacgctggcgctggaggcgtccatgtccgaccggaggaggttccgccccgtgctcctccacgccatcgccggcgtcaccgccgtctacgtctgcttcggcgtctgcggctacctcgcctacggcgacgtcaccagagacatcgtcactctcaatctccccaacaactggtccaccgccgccgtcaaggtcaccaccaaatcaaacataaattcttttagagttctttgatcaagttggccatcaagcacgatttgattatccgattcgcagatcgtgctgtgcgtcgcgctggcgctcacgttcccggtgatgatgcacccgatccacgagatcgtggaggcgcggctgttcccgtcggcgggcgggtgggcgcggaagcgcgcggcggtgcaagcgagccgcgtggcggtggtgggcgcggtgaccgcggtggcgtgcttcgtgccggcgttcggggagttcgcggcgttcgtggggagcaccgtgtgtgcgctgctctccttcctgctcccggcgctgttccacctccgcctcgtcagagcggcggccagcgcgtggcggcgctcggtggacggcagcttcttgctccttgggctgggcttcgcggtccatgggctttacaccgttgtctcggggcctttgaacatgggcggtaatgggctttcctcgccgtccaatcccaatc

SEQ ID NO: 49132 - DNA, 1350 bp, Oryza sativa
acgacttagccgtctgcgttcatagagataagtatatgcgtgttatgagtgtttacgttttattatgtttctaaaaagaaaggtagccggatatatttatactctaaaatgggtagagtaaatatgaattttatgttctttcaaacaaaaaggaaaatgattaattaattactccgtggctccgtgacgtgcacggcagtttgtatgtagtgtaaaatttgtgctaattagctcgcgcctcaagatgataacgtagctaataaggtacagtaatttgtcgaagactgagaaattaccattaaaaaaagagctctgtctcttttctaatactctaccatatatactgggcatctagtacacatagcctgtacagatgtactctctgcgctatatttactgatacaacaaaaatatgtagaaaaatatagtactagtacctgtactctataaaggtacgtactgtacaagcttgcaatagaaaaaaagacgaaaagaaagaatcagacgctcctctgctgtgcagtgtactgcatctagttacaataactactgtagaaattttccttgagaaaaaccaatggaaaacagggagatcttggtacgttatactgccccaatagtacacactacggtatgtatacttacctacgtggcgcattctgggccattgagttatcagccatagaggatcggacggaccacctgaagtggcagctagccatcaaatgcgcacacaggtaaatgaatgataggccttttttacaaccaattttgcagggagaggcagctatagctgttgcatcatgtgctagctcgtatgggtctcatcctgcattacacccatcactcgtagctgcaccttccctgcaactcaactgaatatatggagtacacttgttgcagaactgaaacatgcacgcaaagttgcacagacaatcacgcaaaccagagaacaacaccaccaccaccaacaacaataataataaaagtatgtggtttagcgtctgtgtttataatgtatatataaaaaatttatgtgcgcatttattttgaaaatctaacttatgaaaaaagagttcaaaagaagtatttctccaaggtttattagaggtagatatggagggaatggcttgtgtggtctttggcagactgcaggattattgatattttgcattatcatggaacatgctcatgaattggttaggtcagcatttacttcgttcttgtagggtagcaagttaaggccatgcccataacgtatcaatcaacgacatgcatgcaaggtggttcatgaatgaatacatttatacatgcatggtttcatgcacatagatgcatggagtatacagt

SEQ ID NO: 49133 - DNA, 818 bp, Oryza sativa
agcatcatgcgccgcgcggccgcggtgaaacgaagaaacgtgcgccgtgcgcgccgcgagaccgcgcgcggcgtaaccgaggccagcgtacagccagccacgcgccgcgcgccgcgcgcggcgacggcacgagcgggcggctgcgcggtggcgcacgggcggtttgacctccacgctcgcggcgcgggcagcgactgcaactgcacggcccgccgcggctaagtccactcaccgtgccgtgcgtgatggatggatatactccactttgcctgtacaagtgcggctaaggccattctcaacccatgacactagacatagtttctgtaagctccacatcatcaagaaattagtactagacactactattccaatgtaaatatcactaatccatacttcaattaatgccacttatctcacatgatgtcttgaatgttgtgtagaaaccatgtgtcatgcaagatatgttttccttctcattcctcatttattcacttgctacatcatttttcattttaggtggcagcttatttaatgctatagacaccattctagtcattgggttgagaatggcctaaggccttgtttagggcctgtttagtttatgaaaagaaaaattttggatgccacatcggatgtctgaagggttttttcggacacgaatgaaaaaaaataatttcataacttgcatggaaaccgcgagacgaatcttttgagcctaattaatccgttattagcacatgtggattagtatagcacttatagctaatcatggactaattaggcccaaaatattcgtctcacgatttcctccctaacta

SEQ ID NO: 49134 - DNA, 1564 bp, Oryza sativa
tcttgtagtattgtgctaacgctgatgaaatttatcatcaggtggtttcgacacggcgcacgcggcagcaaggtgatgtattaattaagctcgatcgcgtgaatagaattaattaaccttgttggattaactggtaatcatattgattcatcgaggttgatgtacttgttgctaaatttgcatcgatcgatcatgtttacgcagggcttacgatcgcgctgcgatcaagttccggggactggaggctgacatcaacttcaacctgagcgactacgaggacgatctgaagcaggtgatctagatatatgattacatactaatcgtagtatgatactccatgctagctagctagctcgtctcgacctttcgatctcatgtgagtgaactgagctgggttgctgcagatgaggaactggaccaaggagaagttcgtgcacatactccggcgacagagcacgggattcgcgagggggagctccaagttccgcggcgtcacgctgcacaagtgcggccgctgggaggcacgcatgggccaacttcttggcaagaagtaagcttaattagctagctagctagtgatcccccttcatcaatacttcaatttcacaaccgtataattaggagtgacaaacgaaagtacagatgtgagatgttcaggttaggaatgataatgagtttaagctaattaattgagtccagggccatgctagtgtgacacaagttgtttccggttggggcgtcttaatatgattcgggtgagaggtccacatctccaattctcagtgcatcaattcgcagccaatattggggaaaacacatgtactttctcagctggagagacagtattgtcatcaaagagtctagctagcagttaggcatgtactacgcttttctgatctgaagtggtctcagaattcagaaatatcttcttgcaggtacatataccttgggctctttgacaccgaagttgaagctgcaaggtactattcctttgatgaagtgacatgcatgacgagtcatgaacttcctggtttctcgctcactttcgattcatgtctggttgaatttggtagagcatatgacagggcagctattcgcttcaatgggagggaagctgttaccaacttcgagcctgcatcctacaatgtggatgctttaccagacgccggaaatgagggtactacaatcagtctcaccatcgaattttccgtttcagccgaagcacaccaaacaccatttctcatagccatcactgtttttttctttagcaattgttgatggcgatcttgatttggatttgcggatttcgcaacctaatgcgcgtgactccaaaagcgatgtcgccacaactggcctccagttaacttgtgattcccctgaatcttcaaatattacagtccaccaggtaatgccgtaatgcttatagaaagtaataaattctcaattctgtttttagtttcaattttttttcctgtttttatgattttctctgcaagtatatatctgtcgaaaaaaagtgcatgcaaaaaaaaaaaaatggtagtagaatggaaacaactgtagc

SEQ ID NO: 49135 - DNA, 2150 bp, Oryza sativa
gccaatcttctgaactctactcctcgctcattattgtctaatataggatctagatgcctctctttgatctcttgagaggaaaccggctctattgattcagtcattccacttaggcaacctggcatattatccatccctgcatctgaagtatgcaaaacaggacctttccctctttcaggctcaagcatatggccttttgtacttgcaattcctaagcgaggctttccaagcctccatagaagaggagggagaggtggtggtttttgaggatcttcataggaaacatttgaaaacggttcgttgggtggtggaacaggagacgacaaccgatatgtttcctcagtacttggcatggcattagcagaagacattgtcgatgcctcagatagtaccactgattctgaataacatggttcgatttggcaatcaacttgaggcaagcaataagatccgttctctgattccaattgcttgcatggaggttcatctagctcacaaaccttatcatcattcaaggaacatggagcaactagagaatccaattctgggaatgaacacacttcttgctctaactccaccggaagaacatgagttgatgtagcaccatctggttcattagtcttatcattaggtgaagagcacggaatgatttgggaatcaagatcaccagagacactgtcttctgactcgagttctattaaaccagaactgctcaacggaggggcatttagttcatctattttctcattacttggtgttggagaacatgaagcgatttgagaagcagattttcctgggacacaaacttctctctccatttccgctaggagagtattgctcaatggagaggcatcatccagttcacctatcttctcatcaaccaaagaagatttggtgacttgagaattatgctctcctgatatacaatcttctggttcctgttctgcttcaagaacagtactcaaaggaggggcatctacatgatctgccatctcattaacagagcaagatggaacagctcgagaatcaagttcgcctaaaacaagagcttctgatccctgggtttgaattcgtttgctcaacggatgggcatccacttcatctctcccctcatcagttgaagaccatggaacatcttggtaattatattcatccgagtcatgaacttcttctgatggttccaacaatacggagttactcacaggaacttctagttcatctgtcctttcattaataaaagcacgtgaaacaagattggcacaggtttcctgtttatctttcactgcaatactgttgcctgaaggagagctacatgtttcatcgatcatgtcattatcccacaactgggaatcaccatgagaatcaacctcatgcaaggcatgttgttccacctctagttccattggaacagaagggacacctaattcatgaattttctcatcaatgaagggctcatcggattttaagtcagaatttgctgccttgtcatcaggatccgctttggcagaaaagtgcatcaatgtatcatctggagcatccctggattcctcctggtccactcctgtccgtactgcagagacacaatagaggaactccgactcactggtcaccaaactacttgagacgacattagaatctgaggctggtttatcatcaatactttcaggcgttgctgtcagatccatctcgtggtactcatggcagaacgatctgaagtcctcctcagtcataacttctgatggcaatggcacctcatcaggtggagttgcaggttcccagagggaatcagcaaccggaaccggattcaggtcttcgattcccatattaccatgagggattaatagttctgaaataaaatcctgttcttcctcagagaaacatggttgatagctaggacacggatcagctagagcatgattcgctttgtacccaggatccatgaatgggtttgtaccaaaagaatcttgagcacgaggctccctcaccaaatcaatattttctggttgttcttccaccattttactattcaagattactgcaccacccttctccacatcacaatgatactgaacgtcagcactaagattggtctcgtctggtaattcctcttgacaaacaggatttttcggacaatgcaatgctgaaagatg

SEQ ID NO: 49136 - DNA, 1288 bp, Oryza sativa
gaatattactacatctgtaagagaacatcaataatcaacaacaggcatatctttgttgcagacagtacaactaaaatgtcatacaacaaagcttataagacaaacctcaccaacaaagagcctgtcaaaagccagcaaaagttttgcaatcaccagttccaaatgatgacacggtatataatagaaacttttcaaaaaaaacaaaatgctttaaattttacgaagtgttgaacttagatactgaccgaattgagttgaaaacactacaactattccttcaaaagaaaatatatatgaaaggcgctctcatctgactctctagaactttcgtctctattatgaagttcacaatgaaatgtctttgtccctcatctaacaaaatccaaactatgcagcatttccaacactccgcaatagacaaaattaacaaggttgaatacccttcccaaattacagaaattagctgcagtgttaattttctcttctattcccaaatacaacaatgtaccctctagtctaatgtctaatctcttcactcactaaaacagctatcaattgcactacgaaaaagaaggaactatcctgaaatccgcacagcgtgcaatgaagactaaaaaaagcaatatctgcagtggcccatcttgctagcccgaaagggatgcaaatgtaactcacaacccccatttgccaaggaaaaaaaacgtcatgactcaacccaaatttggaaatccaattacatgctcaaactggactcagaatacatccctcgtggtctccccaaaatttgtaacaaattcaacaggtgaagcaaattctaagaccaactgatgccatgaaattgagtaaatgagcgcaacaaagttgaattaaagtgtttccaaaaccatcgagttatctagtacatagaaacatcccaaaagcagatgaacacacacaaaaagaaattcaaacaccgacacaccgcatctcaatcgaccgtaccataagtccaaaacacatccagaaacttgcaaactccacagcgaggccactcactcactcgctcattcgctaacacgaaccctagcatctctccacacaggaaaaagaacaaagaacaaagccagtggtactcactccgcgagatccccgagctggcggagcacgccgacgagccccgccatggcgaccccctcgaggagcgcctccgggtcatccttctcccccggcgcgtacagctccggatccgacagcccgtactcgttccgtatctggtaccgtatcatctccgctccccccttctctctcc

SEQ ID NO: 49137 - DNA, 813 bp, Oryza sativa
atccaggcccgtcgtttacacgtactctcccagtctcatgaaaaacaaactttgtacgaaagtgaatactagcttttaagccgttgtaaacatttaaattttaaaagttgattttagaattaattctgatgttttttttttcttcttcatagtttgatttttgagttaatttcactttggatcttattttgctgttaaagtttcattttagaccatcatttatcctttttttaaaactattttactatgtaactttacttttcttgcataatggaccgtctcaaaccacatcttcagcacttcaatgatctcgagcacatcgttaacaacatgccggtcaactttcctacatatacgcttgtcatagctttgcctaaggaaacgcgagacataattagtgaatagagttaagatggtccattatgcaataaagataaaagttaactagttcaaactgaaaaatattatgtatatgatggtccaaagtgaagttttaccaataaacatggtctaaagtacacttcacttttgtttttatcatttgcttctaaatggttgaggacatagatataagaattttaactggcaattttttttttttgctgacacatgagatctattcttcacctgctatgcttttgtacttcctccgactaagagtgtgtttagttcacgtcaaaattagaagtttagttgaaagtggaacgatctgatgaaaaaattggaagtttatgtgtgtagccatgccttgatgtgatgaaaaagttaaaagtttaaaaaaaaaagtttaggactaaacaaggcctaaaatga

SEQ ID NO: 49138 - DNA, 701 bp, Oryza sativa
tcgggagattgtggtcagagatgtaagccgctttcaccattttaaagatggcagatgctcttgtcgtgattattggtgattgggaacaaagcatggtaggaatttcttttgcatcttctgaggggaacaacatcaacataccttacctggtttttgaactatctgaagcaatcagctgcagttgatgcccagcagtcataactaaggctcaacgggtgccacactctttactgccagctggcggtggtacaactaacaactcagatcggctagtatgcacacttgaatgaaccctaagatgcgaatgctcaatggtgtttggtttgtacttgtctaatggcccatgtacatacatgatggcttggttcccatgtaatgcaatgctatgggagaattcatctgttttcaccagatatctgccttattaacttctagaccagcgatgggagattgggtcttcaccaggtaccaaagaaccatgttccgatgttatatttcaaacaacagtatcaatactttgcattcttgctgataccaatctattaaatgaacagagataccacaaactaatctggaaagagcgcaactcgagaatctttgaacacaaagattgcactgcagcgcaagtttacagagcccttagagatgaagtgctgatttggagggaagctggagtgtttaagcatagagagtagtgtgtg

SEQ ID NO: 49139 - DNA, 1527 bp, Oryza sativa
gtgggaatctatacccagtccaattagacaatttcctgccatggctaacaaagctcctttcaaccatatagaaacctgtaaaggcattggtatttggtaagagtgttaacttgcaaggggtgattggttgggagaggtttagaagcatagcataaaagccactatccatgtctcttagcttctttcaataggtaggcttgaacttctcaaaaagttgtatggagatatttggctggacactattgaattgtcactctgaattgcattgatttgattgtatcattattttgaattggttctttcatatcctatttcagggttccctacaacatatggcaattctgaggcaacatatccagcacctgcagcatatggtaactctgagacaacatatgcaccaacgtatggtaatactgaggcagcatatgcatcaacatatggaagttctgaggcagcatatgcagcagcatatggaaattctgatgcttatagcactaatcaggttggttacattcccttatcattgttctcttgtttcatttctggtgtcaagtatatctttttgctttcattgttatgcatgtcaaaggatacgcactcaaggactgaaatccattattacttgaacagatgtattttagttagtagtttgaatatttgctcctctttttatttcactgttggtcttgaaatgattcgttgtgccatgtattgtttctgaagttttccacccctccataaggaattcaacgaaatatgtctttttagtgaaggaaaacatggatggtagcccattgtattctataacctataggtgtaactcttttacatcttcccctgtcaacgtcaacagcattaggtatttacaagctacattttgtggtctatgctataggttaattagtatgggtaccacttgctctaaactgtaaagtgtaaacatatgctctgttctattagggactaatagttcctggtgagggaaaaccattaaagcttctctcccttaattgttggatcatgggtgtattttgaatttggtttctgttccaggcttgaaaataccaaattatgctccaacttcctagtgcctctatatattattagtgattgctgtgtcttctttatcacaggctcatacccgcaccgatggcaatcctcattacatggctccacctgttcattatgcgcagtatgacagccagcacaccaatgtgcaaagatgaatgatgagtcagggtagctttgaccttgggtgtaatcctggcatttgtcaatgtagttgctgggttcaccaaatttaaggttatctgcaggaattcattccatggaagtgatggatacactgtttttcccctatcttttcattaaccagttccggaatgctcgagccagttgcctgaagtcaaaatctttctgcaaattgtcgatgtatcaccctgatgaaccatggattagtgagaccgcagctcagtctttttagtcagggattgtgattattcgcaaatgtagtgctgcagcattttc

SEQ ID NO: 49140 - DNA, 868 bp, Oryza sativa
tccatgcataattaactcagttccatctagcaacatgccagtacaaaatgcaggtgtttgttgatcctgccattcatagaccaagtctgatgattgtttatgcatagatcaatcatactatatagtaggctcgttagatcaatcttatacggttagcaactttatagcagcaaaatcaaaccaagttttgtttaaaacaggttctgttgcttctgggttcaaaataagttatgagctggcctaatctttttcagtcactgtgtacctcgtgcccccagtgtcggtgcttaccagtgttgggcacttggcttttttgagaaaagccacatgttcttttttttctcttttatgttcttttttttctcttttatgaaaatacgatgacatggacgatgacatgtacaaggcattttcgtcttttcgacaaggaagaaagagaaaaaaaaagaagggagaaaaaaataaaaagattccatgtcatcatccacatagcgtgttacgtaggtaagaccatggtcaaacgcggctttggaccgggatgatacaataaaccaagtttaagaaccttgatgtatgctttgcaagtttgtggatctaagtgaaacctcctgacaagtttaaggactgccggtgcattttactcaaaaaagaatgtgcagcaaaatcaacagcatgtgattagcttccattaactcggaaaggccacataatattctccatgcgactgcaagaatattgtcgcctcgatattcatgtccaacaaaatcaacagccatgtgattagtacagtatgagcatgtggcttttcaacgagctcagcattttccatgatatttccatctagtgctccttgtatatttatgattca

SEQ ID NO: 49141 - DNA, 3060 bp, Oryza sativa
atttctggggttcatagttgttgtccacccgcctcacggagcgcattcagtaccatcccataggcttcctgtgtttccatgtgtgcaatatccttactggtatcgttcaaaagaaccggaaggggaagtaatgtgttcagaattaacattagtatctgatcaactccagcttaaataagtaatcttgtggtctagacaatctacaacttctgcatttcatgaattcaataatcatgcacctctgaatttaaataaatcaattagcaatgcaatgctggtctggaaaaaagcaatgcaatgttcaacaaaatatgatcttctctgctgaaaatttccacatcctctcaaattttatctatccaaagacagtgcatttgaagtgtaggagaacaagaaatatgagaaatgttctgaaacataccacatataatgatataaatggaaggataaatgaatattaatgtgctcttcaaatataatgtaagctttagccttcatgtgagtaataacttgtaacaatagaagatacttacagaattttcatcttttgtccagtcatccaccaaaggtagctgttgaataccaagatgtcagctcccttccaaaacctggcatgcttttcaagggctgtcccccttacaattctatccgcaatacggtgaacaacagcatcatcagaatttgattcagctagaaagggagcccagtagaactcaatggtggcattatagttctagcaaaaagagaaaaaccaaaagcatattcagtgtgaatgagactattcagcaagctattaggatggaaaactcattatataattaaaaaatagatgtaaaatatttctaaatttggatcctgttgctctctttgtgtctgctctagcaatgttttgagaaacatttttaaatttcgcagtaggttcagtaatcatgaacacattttaagttacaatctgtcctgtaagcttccattagaaaaagaaaaccataaaacaaaacaaacaagggatacctttgctctgaaaaccgtaagcgagtcaaaagtttccatggactttgagctctcagggatggaccggtgtaggaggcacaccaatgacacatactgtccacggttcagagaatctccaacaaacatcatgcgcttcccccgcagcatctccaacataagagttgcattaaagctgcaatgcatgccattattaggcattagaatgggataagcagaaccaactgaagagcttgatcaacaatttagcatttcggttgtggttcaactgccgctttcatgtacagcactaaactgctaccatgttgagattcgtttaactatttaagagcacctgatattctttcataaatattttttttcaacattatttaagagctgtctagcgagttcagtgccacatagtatctgtccaggcccagatggtgacccaagacctgggccagctgccagcccattgcattttgtgctgggccatgtcaattacatggtggaaaaaaagcacattaaagtgggctttgaatcccaggccttgggccatggcccgtagtatgacccacatatgagccaaaattttttgaggagctgtgcacaaggaaaaaattacaaacaagttggtaagttcaggcaggcagttgggggaaagaatccatctacatgcatatctggatgctcatgcaccatggcatatatttaaagcgcactacaatttgtgcttagaacttagaagaatagggcatttgttttgtttaaatttgaaaacttgtagcaacctcaaggtacattaaatggacaaaatggtgcatgaacatccagtcctccatatgtgtacagactatagatgcgccaaaactgcatgaattatcaaatgcacatttaaattgaaccaaatgatagtctaaggcaaagattaggatgaggccagacagcaacagtacaccaaacggccccccctcatcatcagaactatcgctgaatcaagaccagatccgcagaaagagaagtataataaaggaacccccccaaaccttgcaagatggagatgggtccatgcctccatgccattgcattaacattaagccaatgcagagcacacgcaaaggagttcccttgccatggccggccggccctcatcctcctctccctcaaacccccatgctctcccatgtgacacctgctccctcaatgtcacacagctgcgacaaactggagccctcatgtgattatgcaaatgcagcgagatgcccacgagagtttggcactttcacttgtttcaccgtgacccagtgagtatggttgaaccagtcagcagccacggctggctgccggcggcgaacggctgcacggtgcactgtgctccgtcggccgggccggccatggctgtacccggttcaacgaggctggcctgttctacagtagacgccatgttaggcaaggcccgccattgcagccaagaagagcagcaagaatcatcaatgcgcattgctacgcggctacaccaggttgctgccgcgcgtcgagccgtggcgccctcgccgcacgaacacgtctcgctgtctcgcaccaagcccaccgcccaccgcccaccgccagccatgccgtaccgctcacctcacctcacctacacccacccacccgcctgagccgacacccgacagcccgagacacgcgccgcgctactcggccgctcgcccacgcaacgcgcggtcaggtctcccggcaaaatctcgccggagtttctaccgtttcgcggcgattccgcctgaacggctgaacctgaaaccatggccaggcaggagacccacgtgacacgtcgatttttattcagggataatattgagtagtaactaatctactcaacatcaaatcttttttttggaacatgcgtgctctcttcgctcgatctagttggtgcgcgttcaacaactcgatttctttaccaaatgttcttcttcttcttcttctttttacagttctttaatgcaaaagatcgaactaaatcaggagggaatttactgccattgttcgcgacgccgacgccgacgagaaggt

SEQ ID NO: 49142 - DNA, 1986 bp, Oryza sativa
gccgccgccaccgcccccacggcgaacggcggcaccacatcgccgccaccggactgggcaaagaacccgagttatcagcaggcattggcagatagaggattgatacactgatacagagggagctagctagcgaagcttacgctgctgccgccgccatggtggtggctcggggcgcgggggcgggcgatctggcggcggtggggaggagggcgggtgaggaagggttggtggagcgtggaggagaagtccttgaagtagaggacggagacgaaggtgatgaaggcgagcgtgagcgcgtacgacgtcaggaaggggctcctcgtccttcctcctccatgccccgccatgccgccgtgctgcggcttcatcatctcctccccgccgccgccgccccgcgcatcgagctacctcctcttgctctgatctgatgatctcggtgaggatctgatgggatctggagcaatgggagaaggagaagatggatgtgttcttggctctgcagtctgcaatgagaggagaggagtggcttttggtgatggggcctccccctttcttgcactttggtggagtaggcttgaaaatggttgaatggcgtggccgactactggttactggtagtgggtagagaagtgcagaggtgggtggctccagctgaaaacctcaaagtagtagtagatgagagaattggaacaattaacaaatactcctcctctacttttttttttcggttagaggaaacaaattggatatttattaattgtattataatgatttgataatgaactggagtaattggatggtcatttattgtattgtaatcatctgataataacagctgtcactatgaagagaaaaccaccaagttaaaataaccctctaccttttcagttaacaaattggttgttcattaattgtattataattatctgataataacagctctctctgtcaagagaaaatcaccaagctaaaataacactctacctttttggttaacaacttaacaaattggatgtcattaattgtattgtagttacctcctaacaacagttgtatctgtgaagagaaaatcaccaagatgaaatactcctataccttttttcagttaacaaactggatggtcattaatagtattataattatctgataagaacactcctacctcttaagttaggaaattggaatctctctaattgtattataatcatctgatagtaacagctgactccttgaattgaaaaccaccaagttaaggtaactgctagcaagaggtaatcttgatatcatttgctacttgcaactagtagtacaaaaatactcaagattcattttttttgtacggaagtggttttgtctgaacaatggtcgttttcagaggttgctaaacacctgtttaatagtactagtacttctacttgtgtagccaagcaacatcatcctgccctccttggcacggagagcttcccttccacgtgttctgggtagctagggccacatcagacgaaaaacaatatcctgaatttgctggtccattgctctggaccatttggttggtcctttcagtttatgagaacgattctttgcaaagttgcaagaagattgatggtgattaatgaagtatagcactagtgattggaacaatattaatttcagaaacattgctgcttttatgtccccaacgccccaactactatcggttgcagtatcttcatattccaaaatagttgtggtggggtagtgagcaataacatttttcataattcagatcagaaagcctagcgttttatcaaaatagctgtgtttcttgaacacaagttcgtcagttctcacaatctcacttgcatgtgaaaattcagacaatcttttcctttctgcttgtgcagaatgcatggaggctaatttcatttgactactgacgacctaaatttgatggatatgtctgaacttttttggctgatgaatcatttgctgagttctaatcattca

SEQ ID NO: 49143 - DNA, 2411 bp, Oryza sativa
aaaaatattcagacactcccgggctctggcggagggacgaccaatgtcaacgcgctgcgctaatcacgcgcggtcagacgttgactaccatgaaaatgccacgccagctgacacgtcacccacaggcaagtaggcccactggactttatcagtgggccgagatatgggccttcgtcgaccgacagagatagtgggccaagaaaaagtaagtagccagagttatgggcttaatggaattatgggccgtgtaggcgatgaggcccactagagcccacaaaaagcccaagaggaaggccccgtgtccccgtctcgtcttccccttccttcctctcgttccccttcgctttgccctcgtgcgacccaaccaatcaggcggcgctaatcctcgccgccgccgccgccgcctgccatggccgcccgccgcggcccgcacgtaatcaagctgcacgactccgccccggcgctgctcggccgcgcgccgatgccgccgccgcctggcccccgagacgagctcccgccgccgtcggccgtgctggtccaccacccacgaggggggctcgcgccccaccccgccgtcgcggcgctcgaggaccggctcgccgtccgcgaccgcgacatccaggagctcctcgtcgacaaccagcggttcgcggccacccacgtcgcgctccagcagcagctcatcgcggcccagcacgagctccgggtggtgtccatcgccgccacgagggcgcgtgccgagcgcgaggatgaggtccgcgcccttgcggagcaggccgcgcgcatagaggccgaggctcgggccgccgtcgccgcgcgcgcggaggtcgaccaggtccacgcggacgttcaggtgctcgccggcgcgcgcactgaactcgtggaccggttgcaggacctccgcgggcagctcgcgcgcttccaggccgaggcgggtaagactgagtccgtccgtgcccaggttgaaaccatgcgccgggagatccagaagggcaggtattctgttggtttatctcaacccccagttttaatgctaccatttcaacactaaatgtctgcttggattattcgtgatttcgtgtttacattttgtgaatgcacatgagtgttccatctcatgcattgcaaggaagaaattgtgcacttcatagcttaactttaggcctgatgaggataatgtttcacagagttggcgtgagcccgtgacttgagcacattgcttaagcgagttgtgttctttgttagtcaatcgagctgcttagagcttctacattttagcaagtcagtttgtgtttagttagagtaggttgatgatgcctcagaatttcacttagacatgtagcctgtttagatgctagtatatttgatcaatctggttttccagaacctttcgatttctgcttgcttatgtttgtatgagtccaaacctgtggcctatacatgatcacagtactgtgtttctttgtccagcaaattgctagctctatatggcactgttgtcattttaagcataattgaagtgtattagataggatgtccagggtgagttgttgaacatgctttgctcatgatttagctggagactagaaatcacttctatttcacatgttatcagcagtagttattttcacaaaaaatattcacatatacctgactaagtccagatagtctaggcctaggaataggattcttgctaagggtgttaattctgataagcctagtttccatggatatgccactgcatcggcgcttccacgcacaattcttaactcttagtcacaacactttcaagttcgaaattactaaaatgagctttgctcatcataaggcataaattataatattgtatgctggcagatgattctttgatgattggagtggtaatgtactgcccttgaaagatgaaggtggtgagaactacctattgctttcaagcactcccagctagtgttctaaaaagtggtcgtgcagccgcttaaatatggatggccatatcccatccatgcatgaccatgaaccaaacacaccctaagtgtacaaggttgccaaacctttctgagtattgtaatcgcttcgttttcaaggcttatgatgttaagtgggcagcacatgcggatatgcaacccatttaccgcatacaaggccgattaaggatgtatttggttggagggattagagtgtataggatgcgatagtacatgatacaactcagttatttgcttagaggtatggaaacgtacaacagtttgtctggttacttgtatgatatgggatggtatcgtacgggaattcgtttggtaggatgaatgaatttgatttggtaatacaaattaaccccatacagtaatgagctccatcttttgcctttcagcttattagccgttgccaaaatttgaattttaaaacttaat

SEQ ID NO: 49144 - DNA, 818 bp, Oryza sativa
taatgatcttaagctgataaatgctgttaaaactacttcagtgcagtacggttaactattgctctctgtttgagaatgcaggttcctcgggcatcagctagtgcagtagcatttggtttgggtctactttctgggaaagggaagcttggacctgtgaaaaaccgtgccttttctgttctgagtgagagtcgtgcaagtgatatttgtctgcgattctttgatagctgtgaaacatacaaggtactattgatgaactatggtaacaatgagataaaataataaacatatttggagaagaataatgtgatcttgtatctcgacatatttgttcccttctctttggatgcagacattttatatttataagacatgcaaatgttggatggatatcttaattaccaattttgaacagatttgttcagctaatcaaacatactgctacatgcacttgtgtgatcactctgtactctatactctgtactctgtactctgtacatgcatttgacgggtttttcatgtactgttttatgcatggtgcattcatacttctgcttatgtctgttggctattctctctggacttcttgttttgccatgtgattatcaatctctattcagtcagtgatagtaaaatgttctttttagttcgatatgctgtataagataactttcctctgttcatacaactgctattgaattgttactttgacaaaggattgtaactacaatactattttcaggactacaggaaaagaaaggagcctgatgttgaaaagcaaaaggaaccaattttagaacacgtcacatcggcattagtta

SEQ ID NO: 49145 - DNA, 702 bp, Oryza sativa
tcaggtcagaccacagatcttcgtctacctcggcggctaccgcttcccccgaccaggtccccgactttgtcatcgccggcaactactacggcggcgcatgcactgtcttcgccggcaactcgaactccgacgccgacgccgccattgctcaggtgagctaattaacatctcaaaattcatcaagcagatcattggtgatcgattttattgggaaagcaatttcatccctcatccctcatcaaacaatatgaaaaattagcaacatagattgatatgaaatatatcactccacaaacatacaagtttgaattcaacttctacaagttaacaaaaataacaaatatagttgtgaatgtgcgataactattttcagtttaatttgttatttttgttgcaacttgtagaaattgaatttggtcttgcatttcttgtggactgatatattctgtattaatctatgcttttatttttttaatttttttataactatttagataacatgcaaacaatgagaggatgtcccctcgagggatgaaaatccatatccgattttattaacatttttgtttgttgaatttgatgctgtagatcactcgtccaaatttggcgggtacattggtgggattgacgaggtctgtgtatacggctaggatcaacccggggatagaccaggcgttcatcctgtcgctcgttgtgattctg

SEQ ID NO: 49146 - DNA, 782 bp, Oryza sativa
ttttttgggcagcaaaaggcgcatgtatatgggctgccagtccacacaatcgaagtgtcttactgggcctaatgcttatggcctcaaaacataagaaaatatcagaataagtccacctttaaaagtgacccgaatctaattcataaccctaaactgcaaaatctaattcataaccctaaactgtaaaaccggatgtcttgaccacccaaactgttgaaaccggtgcaatttgactcctttggtggttttggagggcggtttcgctgacgtggcgctgacatggcggtgttgacctagtatgtttagttaacgtggcgcttaggtggtatttgaattaaaaacatatacgtgggatccgtgtcattcacacacattaaaaaattgtgggacacactgacatgtggccccacatgtcatcatctctttcttcttccccaacatgatctcgtagttcttggtctgtgaagatgcgttgttgggtgctctattttcccatcgaggacgaacctcaatctgtgctcgagagatagctctccatacactgataagggatgtatggattcttgagaagagaggagccgtagtgcccccggaccgcccggaacccacgagtgaatagaaagttagatctacatgggatctcacctgaattgccccatctatcctcctgaggagaagtttgtttggtttcaaactccgattcaaacaggaggagtacgccatgctaatgtgccttggatgatccacatcttcgtgtcaggcgctgatgagcacattgaact

SEQ ID NO: 49147 - DNA, 2089 bp, Oryza sativa
atatagtgtccatgagctataagatgcctcttgtggctggagctgatttagttgctgttcgaaattatgaattaccctccaggtctccctagtcattagcaatctatacatttttacgttttgctacggcagtgtacactatatgctgaaatatggatcataatctcatgggtgtagtaactctttctgatgaaatgctctcaattcactggcttaagcaatcagcatagcattcacccctaattcaatatttccatggctagactccactggagtgtaaatatagcaggcttgttaacattttctgtctgctggattgtgctctactgatttaagtagtagtcaccacaaccatatctagttgcatacatctgtttgctatgctattgccttgtaggagtattgcatagtggatgcatattagacgcatagtgtttcccttgggaaatgttttccaattggaggcgactataagaggtggtgggacatttgcgtttgcccttagcctgatcgaacttaaattgcactgtcgaatctcttttgctgctttccctttagcaaattggttgttcatgagtgatgcttgcagtaaactggttgttgagtcctcaaaattcgtctcatacttttgggtagttgaatcttcttcaatggagtgatctgtcagacagagttgtacctatgtacttttagaacaaaagcaattacactcatcttaatataccactgtgctaatatttctagttcctttgatgctcatgttgaaactgtttgacgtatagctttagaactttattgatgcacttggtgtttacatatatttcttggatgcaattgcagtaagacacgtggtatgggagctgggcgcaagctcaagacccacaggagaaaccagaggtgggccgacaaagcatacaagaagagccatcttggcaatgaatggaagaaaccctttgctggttcatctcatgcaaagggcattgtccttgaaaagatgtaagtgcaataaacgtagagcaattatttgctctgaagaacattcaataaccaacatgcattactttatctgcagtggcattgaagctaagcagccaaactctgctatccgtaagtgtgctcgtgttcagttggtgaagaatgggaagaagatagctgcctttgtgccgaacgatggttgcttgaacttcatcgaggaaaatgtatgttcaactgctgccatacagagctttcttgttgcttatcatgttcttaccattttccgttcgggatatgcaggacgaggtgctcatcgctgggtttggtcgtaagggacatgctgtgggagacattcccggtgtccgtttcaaggtggtgaaggtctccggcgtctctctcctcgccctcttcaaggagaagaaggagaagccaagatcttaaatcctattcccctccattgcaagcagctggagcggcatggcggctataagaagtacaattagctacattcagctaatgaattctggggccttccttttctgcttctggcagctaatctctctctgaaattcagactcgatgttgtggtgaacatgtcaatcgtatttttaccccccctaatcacctgaattcaaattccatatagaagtagcagcggatttggtttccttcagcgcgattttaaaattcaaacctggaatgtcgtggagtgaagtagtgtcatcatatgcttgtgaatctctgcaagttgcaagcagcctattttgttgttttcttgtggcgcggtttgaatcttgaatgaagtcatcattttgaaatctctccctctatgctgaaacggaacggatctgatctgatccacgtgcgggttcatctgagcccttggcggcgagatcggaccgaccaaaaaaggcctcgggggccaaacgaaccggataaacccggtcctcccttcccattggacccggttgaaaacccccgggccatcccgatctgtgccaggtcagcaacctatccgggcccacacgcataggacatagctccccctacccatcaactcacaccaatacttttacccaaccccacccacttccacgtgggtcccatgactcgc

SEQ ID NO: 49148 - DNA, 4118 bp, Oryza sativa
ccaacgggagctgggaggtggcgctgccggcggaggaggtgccgccggagctgcccgagccggcgctcggcatcaacttcgcccgcgacgggatgaaccgccgggactggctctccctcgtcgccgtccactccgactcgtggctcgtctccgtcgccttcttcttcgccgcgcggctcaacggaaacgaacggtactactcgctcgcatccgcaattccgcataccttccccgaattcaatttcttggctggaaaaaaaagaaagtcagtaaaattttcagtgtctctttcctgacagaaagatttgtgcagttcaaagctgcctttcggtacagtagtttgcttgattgttaggtgaaggaggattcgcgtgatcgatttcatggtctaatttttgtttcagttggcgcatgtgtctgcatgtgcacatgtatcccgtgctcttctttttgtttcctttctttgctttgagtgaattggagtcatgcgttctggatgtgctggctgtagtgtactggccgttctatgtgagttttacatccttacccttctttcatgatagaattatcaattcatactctagggttcatattgattcatggtagctgctcgtaagaatttagtgcctatcctatcccattttagtttttgaattgaaaaacttttccagaacttgatttaatgagtcgcagagtctagcaaatgcaggctttaaagattgaagtagcacctacaagactcttatattaaatgaagggccattcatttctgcatttttctggcatgtcaactgcgccacaacttactccatttcattgtggttggagaaggtgtacatttactagtactagttgatataggagtaatgtgtatacggagcaaatatgacaatacgtgtatatgcctacatagtactattcccgtcttaaaataagttcacttttatacataaatctagacacttattttgggacagaggtagcaagccattacttgattccttggtcaagtgctatgcaagtaggtctctattattctccttttagagcttttggcattttagctggcatgatatatcatatatgaccaaattattctaagattttcgtagcatttgttaccagaaattttagattagtagtggagtttagcacacaatgcatgccagaaaaatatgctttccatctacttatgtacttcatgatgtatctgtgctgaagttaaattttctttactaaggtgaataaatcaatgaggtcatgacaaaaggagtacttgatgctcgcatcgatgttaagcatcaaaatgccccttatttcagctttcttgttcatcccatcgttgttcatttgtctagagacagttgtagctaattgcgggtatgggatgttatatctagaacttaggagcacataatgacattttctgctacacataatcctaccacttttattccaatatagtctactgctggtatgtcgacaatgcaatcaaagggattaggcaacatatttaggctttacttattgttcaactctgcgcatatagtttgtggcagaggtgttctgttgataaaagcgataacttgtttcttcttagtttaagaagtctgcgtatgctatgtcctggtatgctattagggtcgtaatccagaatctcgtgttttccacatcaatgtatttctctgtactagtttagttttatgttattcatttttttcttcttatttttcaggattagatgtgtattttaactgaagaaatgatgtatagtatttctgtttatgctactgagctactctattatactacatgttagtcacttagtctcgtctttggcatgctatccatgatggtgtgttactattctcatgtacatgtatctgccccatcaccttaaaattcaatgtttgccaaaaaaaaaaaagttccgcaatgcttacgagtagtttctttgctgctgactgtatgttgactttaggctgttactgaatactctcccgggctaataatattagtcattttgaacaagggtaaagtcaaactttaaaatctttgactatctaaaatatttatcttaaaaatatggaaacatatgtgtagattagtcttaaaaaatacttcaataaaattatatatttgttgatatttctatatatattataatagaaaatagttgctaaagttactttttggagaccatgcgcttggagggagttacaatattgctccttttgtttctcaggaagcggctcttcaacatgatcaatgatctacctactgtatatgaagcattggttgacaggaagcacgtcagggataggtctggtgtcgatagcagcggaaaatccaaacattcaacaaaggttagtatttccctcccccaaaattcagaaacttcaaatgcagttacttcagattttgtaacctaagctacaatacacagagaacaggcgaaaggcaagtaaagcgctccaagggtgttgcaaaggagtacgaggacgacgacgaagaacaccacgagacatttttcgggacttgcggtggcctttacaacgcgaacgagttctggatcgggtgcgacatctgtgagcggtggttccccggccaatgggtcaggataaccccgggtaaggcggagcacatcaagcactacaagtgccctgactgcagcagcagctcctccaagaaaaccaggctatagggtaaattgtggtgtgtgcaatctcctctgaccaatctgatcaaacgacaatctgtcctgccactaggaaaaaaaagatggtgaagctgttcttcggtccaatgtcgtagcttagctagatgtgaagtcatctagacattgtgctgtgtggtagatgaggcaaaaaagagtgaactgaaaagacgggaaaaacgtattcgatctttagctttgttttataaatgttttcttcattgtcaccgatgtgctttgggttttttcagacttcagagcatgggtatcgttgttgaattgtagctgcatgcattgcatgatatatttgtcaagtgctcaacaactggagcattcccaatcatagcgtctctgcacatttccattattcataaacacagagtgcttgctgaaaatggcataataacacattaacacacgagtaatctactcaggcagaaggattaatgcatagaaggatcaagagatgaagcctctgctcttgaggctttccactgaatccctgatgatcttctccatgggactgaactgcaaacccagcgcgatcagcttcttcgacgcagcctctgctctcaccagcccaggctgcgtttccttgggtaatctgccacacaaaaaccaaaaataatttatcagttagtgatatttgcaattgcagctgcatcattcacagtttgatatagtcatggaagcatttggagatttatgtggtacgtctaaggtttttgccgggaaggccgaaggaggccatccgaatgtattaagaaggtacgtctaaggtttggcgtggcaacctttggctgcgaaccaaacaggccctacagtccactaaactcactttggcactttgtactcggggtagagctcggcgactttggaagcgaaatcgctccagtgagcaatggactgcacgcagaggtgcctcccggatgcagatgggttctcgtacagcagaatatgggcaagagcaacgtcttccacatggactggccccatgtaaaaatccgcatactcctctgtgcaacctgcattgtcacaatggtgagcatgtttaggtgtttccttgcagtagcaatcacagctggaagaggcaaccattcaatcaagaatttctaggcacacaaaattgccattctatccctcacactgaatcaaacaagagaagtttttgagtagcacatgcatggtcatttaggaatcaacggttctcttttatgccaactgaactgaagaagcctatttttcatgtcattacatcaagtgttgagggatagcaaaacatgcggtttcactctctggtgatactaatcactgtgacatattcagtgcagcactatcagcttcctagtattctcagtatttgtggtaattttttttttggaacaagtatttgtggtaattt

SEQ ID NO: 49149 - DNA, 1684 bp, Oryza sativa
gttttgtgaaatgtactcgttataatatcatcatcaatttgcacttcgcacactgtcaaataattccaatgagaatggaagaaaaatggagatgccaagacacaagactgctcaccccgttcttctcgcagtagtcaaggtcagtccagcagcgctcgtcgcgcacctcgccggccggccagccggggctgggcacgatggcggagatggacgaggtcaccaccacccgccgcactccgccggcgtccttggccgcgcgcagcacgttcagcgtcccctccaccgccggcaccatcagctgcgcctgcaaacaacgggaacacggccggaggcggtgagcctggagcccgccgacgccgacgccgacgaggccggtacggacgtcgagaggagaagagtcgccggccggtgtacctgggggtcgaggacgcggtccacgatgcagggggaggcgaggtggaagacgccggagcagccccgcgcggcggcgaggagggcggcgccgtcgaggaggtcgcccgggaacacgcggaggcggcggccctcgccgccgccggcggcggcgagcgcgtggaggtggtccgtctcggccttgtcatctgcacagcacaacaccattgtcttcatcacctcctccgccttgcaagcaaacaagcagcagtaatggcggtttcgcactgaccggggttgaggacggcggcgtggacggagtagccgcgggcgaggaggcggcgaacgagacacgagccgatgaagccgctcgcgccggtgaccagcaccgtctccccctcccctcctccgccgccgccgctcgccattgtcgccgacgagagagactcgagctctcgtgtgagagagctgtggcttgtgagcctggagcttttattgtcgatgtggctggtacctactagtagcactgtagcacagtacagtacaaagcttgactgacagaagcagaagcagatgcagaagcagccaactttttggatctttcacagcctcacaagtgacagtcacacggatgatttgtcatgattcatctcgaattggggatctcccaaatctggattgattgagctgaaagcttgaaacggattgtccaagtagtagtacatgatctcaacctaccacaagggccacaatcacaaccgtgtgctagtactttcagtttgatctcaacagagtcagcagttgagcactagagaaagtccagattaaaacaaagattacattgatcaacaaacgtcttctatctgaaagaagaggggcaccagtgatagcgtgttgttacacattggactcgctcatcaaactgagggttgcaagtacagaaacaccgtagtttagtccacgagtcagtcccttggttatccatggtagatggatagtagcagcttagtgcgaaaggtagaagatgcaccatctgcctagtataaacctacagctccgacttcacatcctgagcactaacacggtatcctttctgcgagaacaaacctaggaagaaattggacatcctggaactgaaggaggaaggctcctctcttgccaccggccttatcttgcatagggcgtcgtagtcatgcttcaggtggggttcaactatcttctcctgtaaatgtagactggcattaacgagagatgctcagcaggtaactgctaaggggattcatgtttgtttctt

SEQ ID NO: 49150 - DNA, 3111 bp, Oryza sativa
  unsure (1)..(3111): unsure at all n locations
tgttgagattatgggcatataatgatttaatttattccataaataaatcatgacattacagatgaaaactagcatgaacgcatcattagatctacacatgtaaactacgcagaataacatgaacagatcaaatatgcgcaacatattgaacacgtaccgaggtgacgaaaagaccggctgcttggtcgaaacttttcgcaggtgtctacgaaggcacgaaacacgcgagcgaagaggaaggcgagccgtcacgaacgaacagggagcagtcgcgcgaagcgcttcccaaaaaccttattgccgccttctcccggtgcaggacgtcaaaggcagaggttccggagacctgctctcccgatcgctggtgcacgccggcgagcgggatggagtagtctacgagcgacggcgcagtacagagtaggaggcaaaccctagattgattttcgcatatatcgcgtgaagacggcgggtcggtttatatagagaagggtcgcttgatcagggcgcccgcacgatctctactgcgcgtaaccgaaccggataagtcgcgcgtaacttatccggactccacgccgtttgcacgcaccggatttttcggaacgtttccaaaacaaaacgaatccgaatttgcagcaaaacaaaactgcaaaaggaggctgcatctgcgcaagggtgaggagccaatttttcggaccattcgacgcgtacgtcgtgcacgcgcgccgcctgccaggccaggcgaggcgagcgagcgcgcgcgtgtttcccctcttctctcccccatacatgcttcaagtggctaggagggcatcctcccttttaaggaggtccccctctcctagaataagcaaggtggtactaaactccacatgcatgccatcccatgaggtgggcttttgtgattttccaaagaattaatcttcgagtgggctaaggcccattcattaattccaacaggtaaaacatagaagcaatcaaacaaaaaaccaaacataaaacgagataaaatataatctaatacaacgaatctagacataataaagtatatcccatcttatcctagtttttttaagagagtaacaaatactacctccgtcccaaaatataacaacttttagctataaatcggacacacagttgtctagattcatagctaaaaatgcttgcattttaggacagacggagtagcaatatagtactccctccgtttcacaatgtaagtcattttagcacttcccatgtttatattaatattaatgaatctagatatatatattaaattaacatcattataaacgtggaaagtgctagaatgaattacattgtgaatcggagtgagtactactcaactatacgtcggctaggagcctaatggatttcttaaaaaaaaaggggagcctaatggattcttcttttgcaattttatactactaccagctgatgatgattcagcagctcacgccgtgatcacatagaaaaggatcaaagaaggaagagacaacaaatctcatgcttccacgtagcacactctacttctgaaaaaaaaataattttacgcgggaaaagctacatctgaagctgtgattgtgtgaatacgcgttaaagatgattcctttatcgatttctgaattttctttacgtccattcagactgcctatgcctgaagaattcttttccttttcgttaatactgatctcaagaagaatcctgcttagtacaggagccatagtagcgaaacgatatatttacaaataaaaagtatttgtgaataaaatttttatttacgtatttctagcgatctaaaagcaaatgctgaaaaataaactttaataaaaaaaatcttaaaatcagctttaaatttaaggttaaaaatttaaattttagttaataattagtataagcataagcataaaactgaaagcgtcagtttgtttttgtcaaatctgatcacggtcaccgaccttcctgccattgtagtggtcaaatctttcagcgtgggcgtggacgccagaggaggaagacgcgtcgccgcgcggccaagccatccccgatcgatccccacccgcagcggcggcgaggcggccggagaggagggagatggagatggaggcggtgccggcgctggcggtggtggacgcgcggttcgtcgcgggggacgcggcggcgctgtccgtggcgaagacgctgagcctgtccgggagtgacttcaccgtcacggacgccgccacgggcgccgtcgtgctgcgcgtagacggcgtgctcttcagcctccgccgccgctgcctcctcgcggacgccgaccgccgccccgtcctcaccgtccaagaatcggtgcgcgcgacactcgactcccctcccatactctcttctcttcttccccaccgtgccaatctgatcggtggtggtgagctccggtgggtgnnnnnnnnnnnnnnnnnnnnnnggtggaaggtgttccggggggagagcacgagccggcgtgacctgctcttcaccgtggtgaagccgtcgggatccagctatggggttcgaccaaggtgagcgtgttcctcgccagcaacgacgccgagcaggccagcgacttccgcgtcaccggcagctaccacgacggcgcctgcgccgtctccctacggcgactctgacaccgtcatcgcaaaggcaagcaaagcaacccctctctctcccccttgctcgagccacttctgtcatttcatcgaacacctggtgggcgtgctgctcgacctgacgcaaaaagtgtttcgcgcgcagatcgaccggcggttcagcgtggcgagcgcgctgctggggaagaacgcatacagcgtcaccgtcaacgccggcatcgagtacgccttcatcgtcgcgctcgtcgtcgtcctcgacgagatgcatttccagccatgacaagatggaaaccaaagctctccctgctcccatcgattcaaaaagacacgatttttttacccttcagttttgctagctctgtatacaggcttgatagacgagaggaaggttgtaattggttgagaagtgaaaacaattcagaaaattatacggtggatgattgcaattgattattgttgatgaaagttgttatattttgtgataaat

SEQ ID NO: 49151 - DNA, 1043 bp, Oryza sativa
gtcaacatacaagcacaaaataactccctcacccccaccatggcgatagtacacacatttatctgcctcattgactgcaaagcctgcagatgtcaatattgggtcaaatttctcatgccattgcttaggagcttgtttcagaccatacaaagacttcaacaatttgcacactttgccttcttgaccttcaactacaaacccatcaggttgatccatatagatctcctcatccagctctccattaagaaaagctgtcttaacgtccatttgatgaacgagaagaccatgtgaggctgctagggaaagtagcacacgaattgtggtcaatctagcaacaggtgagtaagtgtcaaagaaatcttcgccttctttctgagtatagcccttagcaacaagccgagccttgtacttttcaatagtaccgtcaggcctaagcttcttcttgaacacccacttgcaccccacaggttgacacccatagggtcgctctgtcacctcccaagtcccgttagcgataatggaatccatttcactacggacagcctccttccagtagtctgcatcaggagatgcatatgcttctgaaattgacttaggagtgtcatccacgaggtacacagtgaaatcatcaccaaaagacttaccggtcctttgtctcttactccttggaggagcttcactgacatcctcctcagagacaagttcatgtgtatgttcagtttgttctggtggtgtgattgaactgggaattatttcacagggttggttccaaccactatgtgtatccttcattgggaaaaagctctcaaagaaggtagcatcaccagactccataattgtaccaacatgcatgtccggtccctccgatttaactattataaatctataggcaatgatatgatgagcctatcccagaaaaacacagtccacagtcttaggtccaagtttgcgcttcttcgttattgggaccttgactttcgccaagcacccccatgtgccccaataagaaagtgatggttctctaccaatccatatcttatatg

SEQ ID NO: 49152 - DNA, 4813 bp, Oryza sativa
tactagatccatccaaaggcaatggatcctgttctagaacgtatgaaaatttcgtaataacagtgtaaaattcttcctcgcaaaaaaaaaggtaaaaaatctcccaatgaaatcgtgaaaatctcatgcatccaaaatgaagcaagacaaaattgtccactgagatagggtacaattttgatacctctcgatgccttagggtattatgatatatcaaactttatattagaaaatgttatacacgtatctttttaatggcagtaaaatttgtaatgaaaagaagtgcatcgagtctgtatgttgcctcttctcaaagatgataaaatcactcgtggttaggtggtgtagcaggtgacaccacccgattcttggaaagatgagataagatcagctcgatctggacctcgagcactccattgtcaaaaggagaatgaataaaccaagacagtttttgccatttcgtccctaccctacgtacggccggtggcgagtgacagcgtaacgcccgcatgcactcaccctcaccggcggtcatgtgtgtctctccggccgggccgtgctacctaacttcttctgctgtttctgcaggtctcaaagtgtggctgttagctatagctactagtcggcaagcatcttgcagtgtagtacatgtgtgtgtgttttttcaagtgcttttgacctgcacagtctgggtgatctggtgagagatgttcgttcatcaacgttgctaaatctgcacgttttggggtggagcctgatcctgatattaataaaaggagaggatgcacctgcaggctgcagatcatgtctgaatgttttttttccttgggattgaatgcttgatctgatggcacatttcagaagcaacatgtaacctacttaagtacgacagaaattcagaagcattttttcagataattgcctgaaatcaacttattacgaagaggaaaaaaagctgtatgtatttggtgaccaagatacaggcaaactaaagaataatcttccatttataatccagctgcacttcttcagaggtgcatgaagctgaattcccattttggctttcttattaaccgaggtaaggggggtcggagttttagtctccaaaccctcaaaggtagtgtattttgcttccgtctctctccaagcgaggtcagggggttcggagttataatctccaacccccatgagacggcaatttaatttaatccccgactcacttgaacttgatctggttgccaagaagagatgcatgcgattaccgctgtcaatgaccaaaaatttcagaaacaaaccttccttttttagataatcagaaacaaatcatctgaaccaaagcctgttagaaatgcatgaggccatggtgtctactatattaacatttcagaaacaacttatctgaagtctgaaccaaagcctgaattatctttgtgcttcttaacagaggtcatggaggttcggagttttaatctccgagcccctttgcatttggtctcgtcgccaagaagagataacggccaaaatggtaattcagtttcagataaatttctgaaccggcctttatttacgaaattcataagcgttttcaggtaatggtctgaaatcaacttattacgaagaaaaaataagttggatatattttcttcccgcttgattccggctagcaagatacaggcaacctcaattataatcttccagtaattcagctgcacttcttcagaagcgcatgaagctgaattaccaattctgttttgttctgaaccgaggtcaaggggggtcggagttgtagtctccgaaggtagtgtattttcctttcagtctgctcccgagcgaggtaggttcggaacccgttgcactcgatctggtggcaagaagagatgcatgcaattcccgctgtcatctgtccaaagatctcagaaacaacagatgtttaccccgaatattttcccctagggcttgatctgattagacacttcttattatcatcacggccatggtttcccacgggcttgatctgaagtctgaaccaaaggctgaattatctttgtagaggtcagggggttcggagttttaatctccggacccctttgaatttgatccgagatgcatgcttgtaaatttctgaaccaaggcctgtcagaaattcagaagcagttcagataacggcctgaaatcaacttattatgaagaaacaaagaaaagctagttgtatttacgaatttgagagccttttctatttgttttttcagccgattttcagtagcgtcggctgctctatctacttgcattgcctgtttcagaaacaccaaacctcaccaaacggcaagcactacgtaccgtccctgttcactggccacctgctccttttgcctgtccaaatcctcattctttccctttagcctttgcttagactctacagaaaaaaaaacgtctccttttcaatttgttggtagtacatgttttctgctttacgatattgctttcagtacaccatgtcctacaatattgtaaaacaaaaaacgatttgctgtatgtttggtctatcacttttagagaacatgcttgaaagtgatgatttaattagtggatagaatttaggtgcaccaaatgctggcaatatgaaccgtggagtaaacgagtaaacgaccctcacctaaaagaagtttaaaggtagtcacaagtaacaacagctaaaaaattctctccagattttcaggcatgacgtgaaaaagatggattaatcgtcctggcttacaaaattaatccacacaaaaacagaattccaaccaagagaatcctgtctagctaactctaaccaaatcttcagtctagcagcagtaaaacgtaaaagttgtcaagaaaaaaagacgcatctgccgtacggtgctagcacagtgaacagtgatgaacactgcaggtctgcagcagtaaattgtggaggaaaaaaaaatgttgtttgttttgtaaaagttttggatttgaaattaaaaatggtggcctgaattcgtagggcaggagaaggtgtgtccaatgtcgtcgtccctacggtgcggttgttgggggatagacatagttagagccgctgtccctgcgttatatctgaaccaaccctccatctccttcactagccttctctaccaccctcactcgcgagctcggctcagctcagctcacctcgcacccagatcccaatgcaccaaccagccataatgcagcgggctctcgccgtcgtcgccctcctcgccgccgcagccgccatcgccgccgcccaggtacgcacgcgtagtgtcaacttcgtgtacgttcttttcccggacgcatgcatgctgatgctttgggcaacaatgcagggggagtcgccggagttgctgccgttcgcggtgggggcggcgccggaggggtgcgacgtcggggaaggggagtgggtgttcgacgaggcggcgcggccgtggtacgccgaggaggagtgcccctacatccagcccgacctcacctgccaggctcacggccgccccgacgccgcctaccagcgctggcgctggcagccgcgcgactgctccctcccaaggtaagctcatccacctcctcctcctccggccagccattgtcgccgccggcgaccaccacctcgcttgctccgtgaacaaggatagaatccaatgcgcggctttacccaaagaagcaggccgtgactgtgactttgctttgctcaactgcaacgagctgcaggggggaaggggcagttattactgggatctaattatgcttttttttttttacaaaggggttaaaaagagaacgggtttaaccgtggtatacgaaaggagatgggctgcatctcaactgccgtgctagtttgtgatgacatccaggaaggacgccaataatgcattgtgcagtagtagggcattgcatggaaggacagctggtaggttaggtcatgtccatgacaattgtaaaagtaaatttacttcctcctagtactagcagtaacaacaggaggaggagtacaattttcagttcatataggtgtgagcattccaagatccatgcactcactgcactcactcaatgatcagtgcacatttgcagtacctgatactccctccatcccttaaataatttaaaaattattatttattttatttatgacttactttattatccaaagtattttaagtataactttttgtttttcatatttgcacaaattttattgaataagacgagtggttaaaccatataagtaaaatatcaaaatcccttatattggggggacggagggagtaatagaatcacataaatgaaatgagtttcattagctctagcagattaggcagatgacccatgctaccaactctccccgtggtgattattttatctgcatgtcttggcgtctgcacatcgtatgcctctctttagaggaaagatttcattttgtgatgattcactcttggaaagtttggtttcaaaatggaggtttcagtgaaggaagtagacaaacatgcaccgtgtggtcctcatacgtgccagatattggttgttttggtgggtcagccggtcaggtatccatcatgcagtggactccagccttgtcgagtcagaacactaaaaaaaaggactaaaaattgaccacaaattttgtataatcatctttaaaaaagacgtaaacatgttaccagatgcaaaattccaatgcaaagatttgtttttttgattgttttccttttgtctttctcaaccgctatgtggactgctagtacaaacaaatttcattataaaaaagtattcattccgtcttaaaataaattta

SEQ ID NO: 49153 - DNA, 3640 bp, Oryza sativa
aacgagctgctctactggaagctcttcttccccgcgcgcgacgaggcgatctgacctcatgacgtcacgccgccgccatcgtcgtcgtcgtcgtcgtcactaatcggtgtaatctgctccgttcccgccatttcttttcttggcgatcgatgtaatcaaatctctctatacttgctcctcttctctcctcttctctttttgaacgaagtgaaaatacagaagctagcattatttgcttgcatgtgtacaaaatccacgatcttgcatcaagattaactaatgtgatcaccaattcaggatcactctgttgagcaagaacctggagttgcacagatgtttttggatctcacatccagaattggaggttgccttttgatgggccgaaattacaaaaacaaggcgggcttatgaggcccaattatagagattatttgggccataacgagaggggtcggaaactaaaaatccgaatccctaataaacgaggtcaattttcttcgaatgcgcgtgccactatatcgatgcaattttttttattcacgccatactttttttgtttggaataattgttatcagttgcttcttaattgcgggaagcaagaactctggtcaattcatggtagaactcaccaactctctctagtctccaccttactgtctagtggctgctgcagtgtctcgtcagataatgagataaacatgtttaatgctggaaaaaaatatcatgaaattagaggagttacagacgcctatctggttatctgaagactctgatttttaagctgttcagccgggtattcgacagttatatgatctcttctccaaagtccaaactgatgctgacttcgggcagacaacaagaactgtttatgtcgatggcatgaacggtagtaggttacatctcctctccgtgggttttattgtcaccatcatttcgtgatgtgattcagttaagatcgagtatagtagatcgatatgatatgaacaacgggatgccttcttctgaacttttgtgttcagcaagtttttctggcctccatttagaaggaaaaggaagatatccatctattctatttgattcaggtttcagttgtgcagtcaagttagaattgtttgtttgtggggcgcttgctctagtgctgatcaatgtcataagtacaaccttgacaaatttgcttgagaagtcggaatacagataggccaaaacatattcatccattctgaaaacaacctgttccaaccgtagtctgtcaggctggcatacatatataccagttcagaactccatagttagtccttcagataagacaaatttattcatcagagtttaagcaaacaccaacagatcagagttttgctactgaaattaaagtaaattaaacaaatgcaatccagggattgctatcagaaaaggaaaacccaattagatttcagtaaggtcaagcgaggatagtgtgctcatgaaataggttttgtgaggcccaaatctatagattttatttgggccgttttgaaatgcagttaatgtttaagacgctcattcttggatttggaggttaaatttatctcatttttttcctcaatcagataaaagtattatgcttcatttttccaaccttaatttagtactatgtgctggacaactaaaaggagttgcaacttacaaacacctatatctggctgtttcaagagtctgattctctgctcctatcacttttcgagaattagtagtatgcagaaagatgaccttacaggctggagaaggaacttctatctcatgaaattcagttgagtattcgacagttatgtgctatctgctaccaagtgtccaagtcccaagtaatgtcgatttcagcagacaagaacaactgttcaggtctatgttatgcaacgggtaggttatacaccctctctctatgggtttgatggtcaatatcatctcgtgaacttttgtgttcgttaagtttttctttcctcagacttagaagcgaagtaagacatcaaattgtttgatttgattaaggtttcagttctatcgcccaccaacagtcgctattcgcatgctcgtttatgctccccctcccaacgttttgcgctatcccttatcataagttcccccttgacccttttgctctgagaactcccgaattaatacaccacacgcctgctcgtctggtccattgcaacatattggcgtcactcattctgagaaaaaacacctgctccccagtgccacactactccggcattcccgctgacatgcgtacacttctttggaacttcagagttttaagcaacatcaacagaagagagaaatacgtaaggagtatttgaaattagactgtcagttgtgctaatgaaagtaacttacaaaagtgataagaaagaaagaactgaaagagcacattttcagggtactagtgtgtacctgacaaaaggcgtgaccaactgttcctctaactagtcggatatgacactccacagacataatccctgaaaaccaaacttaaagtttcattagtagctctattaatctaatcaatctctgtagttagcactagtttgtagggcaagtatgtgtactattgacctttgttagaatcatggaaccttcaccaaacgatgttggtaattggtcatctgctccacatatatactactcctacttgccccaattcccgcaaaaacctttacttgcaagacatcaagaaattaattttcactttacaaatcaagtacaacaccagtagtagtaatcaacagattttcttcagacagaaagctaaataccctccatccaagggtgaaaacggtaatgtgaattccaaaacagtaacgaaaattttcggtcgaccgatattcgtttctgattttgtaccgaccgagccatatggaaatggtaatcgaccgaaataaaaatagaaatggtaaaaaaatataaataaaaattaaaatggttttgatgttgtaccgatcatttccgtatttactgtattcttgtggagattaccgtttcttataatatagtaattaccgtatttctaaatatgtcgatattatagagtatgtcgctattttacccgcaatttagagacaaattgactctttaattaaatccataacttgagtgcatggttaaaatagagttaatttgtaatttatatagtataaacttgaagttatttatatgtattacatagttacacaaagttaaatatattttttatagtttaatgttttcgtatttgttaccagttttcgatttgtaccgacatgtttccgtccatattattctgtttcccttttttatatttccgattttattttcgtttctaactttaccatttttaattccatttccaaaaaaaaaaaggttgagacgattttccaatcgtttccgaccgttttcatcccgactccatccaatccgctagttgtttagtcgtcagaatcacttctcagctattctccatcactacgatattagtactataattttttcaaatgtacaaatatgctatgtgccaatagtaatcaactttccgatcgtttcccggctccatccaatccactaattgtttattcttcagaatcacttctcaggtcttctccatcagtacgatattactactataatttc

SEQ ID NO: 49154 - DNA, 3846 bp, Oryza sativa
tcaataaagctcccgtcgtcgtcgtcgtccggcggcggcgagtgcgacctcttctccgggaggtgggtgtacgacgaggcggcgtacccgctgtacagggagagcgcgtgcagggtgatgtcggagcagtcggcgtgcgagaagtacgggaggacggacctccggtaccagcattggaggtggcaaccccatggctgcgaccttcctaggtacgtatacgtatactatacgttgcacacatcgtacgtatacgtacgtagtgtgtacattgtagtagatcttggcgtgatgaacaaaaatagtctgccggttgttcatcaactggatcatgtagatgcatgttggtagctagaagcacactgcagtttcctaacaactcaaatttaattaagtacgtagagatcgagatgatgctcatttggggtaaattaaaatacacgtaacttaaaatatacttcccagaatacttgtaactttaagttttttttataattttgatctttcgtcttattcaagaaattatgaaattatttttttttatgatttgctttattataaaaagtactttaagtatcacttctccatttttatatttgcactaatttttcaaataaaatgaatggtcaaacgctacaagaaaaaagtcaaagcgactattaatctggaacggagatagtatgagtactagtttaattggttgtgtagtgactagtgagtcagtagaaataatctgaaacccctacagtcctagtactactcaagaactgtcattttcatgtttggataattatggccgaattcatttttttactactgtgtgtgtgtccaaatataaatcttaaacagactggacttaaactgcattatacgtactcaacttataggtttgacgcggagaagtttctggggaagctaaggaacaagcggctggtgttcgtgggcgactcgctgaaccgcaaccagtgggcttccatgctctgcctcatcgacaccggcgcccctgaactccacacctcaatcaactcctcccgatctctcaccaccttcaaaattcacgtaaatataactgaacgattccaaaatactactgaattttgcccatattatgtacgagtttcatatgcgtgatttgagacgataaaatacaatggcgcgcgtgcaggagtacaacgcgtcggtggatttctactggtcgccgttgctggtggagtccaactccgaccacccgctgcgccaccgcgtcgccgaccggaccgtccgcgccgcctccatcaacaagcacgccgcccactggaccaacgccgacgtcctcgtcttcaactcctacctctggtggcagcgtcccgccatgaaagtcctgtgagttttagctactctctccgtcttaaattataagacgttttgtctttggtcaaagttaaactactataattttaactaattttgtagaaaaaactagtaataattttaacataaaactaatatattatgaaaattatttaattatagatttaatgaaactattctgatgttgtaaatattactccatccgttctataatataagagattttgacattttatttgtactgtttgaccactcgtatggttaaaaaaattgtataaatataaaaaataaaaaattgtgcttaaagcactttagataataaaataagtcaaaaaaataaataataattctaaattttttaataagatgaatggtcaaacagtacaatcaagagcagagagaggactactttttttatatagagttagtcaaactttacagacacgaaagagagagagtagccagtagcaagcttgcatcgatccatggatgcagttgatcacctcgctctcgctgacggacgcgttcttgctgcaggtgggggtcgtttgacaatccggcggcggtggtggcggcggcggcggaggaagggaacgagtacgcggtgtccaaggtgattgacagcctgcgcgcgtacgagctggcggtgaggacgtgggccgactggatggagttccacgtcgaccgcgcccgcacccagctcttcttcatgaccatgtcgccgacgcacctccgctccgacgagtgggaggacgccgccgccgccgccgccggcggaaaccacgggtgctacggcgagacggagccgatcgcggcggaggagtacagggggacaagcgggacggacatggcgttcgcgagggcggtggaggcggaggcgcggcggctcggggagcgcagcgtggcggtgcggctgatcaacgtgacgcggctgtcggagcggcgcaaggacgcgcacccgtcggtgcaccgccggtactgggaccccgtcaccgacgagcagcggcgcaaccccagcagctacgccgactgcatccactggtgcctccccggcgtccccgacgtctggaaccagctcctctacgcacacatcgtctcatgagccatgagacctcatatcgcatctcctttttgatatatttttttctcttcttgtatgctttcaaaaaaacaaatgtaaatcctccaacaattgataagtattccgtcactttcaaaacacaaacatttgtagattgtttagtatagtactactaaggttaagaaaaaataattaatagtaatctctttgccctgaaaaaaaaacaacttttagtcacgaaatctggaaatagatatatctagacgaaggtggattctaaacactcaagtggatgtccactcattaagtgcatgtcaactaaatgatcatgaaaaaaattcaaaaaaatttacaagataaattgatatataatatatcactacacaaacatgcaacttaaaattcaacttttataagttgtaacgaaaataacaaaattaattgcgaatatacgtatgctaatcagagtttgattttttatttttgttacaacttgtagaagtcaaatttgaacttgcatgtttgtgggggtgatatattacatatgattctatcttgtcaaattttttgaatttttttcatacacatttagttgacatgcaacaaatgggtggatgtccacctaggcgattagaagtgtttcccatatctagatttataatcagaagttattttttttctagcgcggagagccttaggcttgacttgaaaattcaccaacattcgcatttctttcctttgtgcaaaatgtagtttgtataaaagggttaacctttttgcaaagtggtcaaacattatttgaattctgaattgcttacattttcctcccaagcatccggttggttggaaaatgtatagatttatgtgtattgaaatcaatgtcctacaaatgcttatattctgatacaattttgaattctagatcgaaatgtttatattttgaaactgaggtagtaccacgtacatacccaaaattcactgaatcattctgcatttgtgtgaccggagtagtaataagcactgacaaaactgaaggtttcagtcttgaatgggcctgaggcccgaatggaggtcacacgcttggaccaggtaggtgatctgccacaaagcagatcgccactcaatataggaataagttcatctaaggtcccttaactttacactgagttcgatattcatccctgaatcacaataccagatataatgggtccctcaactatcaaaaccggtgtagatgagatccctcagtggtttagatggcggttttaactgatgtggcgctgacgtggctagtttgacttactcctactcctatgtgacggtgacgtggtacttggaagcaaaataaaaggtgggacccatgtgtcaatctaaaaaatactggacccacatgtcagtcggcccaccctgctctctat

SEQ ID NO: 49155 - DNA, 1293 bp, Oryza sativa
caatctacagtttgaaccagtcaatggagtagaaaaggaattattttgctgaaaaaagagagatgtgtgcccctgggttaggggcggagaggagcacggggcaggccacatggaagacgtcgtcgcagccggcgatggccgccgccacgctaccgtagtcgagcaggtcggccttgaacagccgcagcctctccgcggcgacgtccagagacaccaagtgggcgttcttcgcgtcgtctttgcacaaatcatccgcactagcacaccaatcaatcaatccaccagaacaagagcataacgccatgaatatcaaaaactttgatgcatatggaggggattggggaagtgggcagcggcggctgcgactgcgagctctagtcccgggccccgtcagcgccacgctgaccgtgtcccgcggctgtgagctcgccgtcgccgcaactcgtgcagatcgatgcggtggcgccggaggagggggggcgatgtcgtgcagctccggccgccgctctctcgcctgccgccgcgcgctcgccggcctacccgttccgctcgttggcctccccacctactccctctctacgcacgctcgccggcctccccacccgatggctggcgcccttctccctctccgcacgcgctcgccggccggctagggagctcgaggaaggatgaagaatggccgggagggagaagggacaaggacgacggcgcgggggagatagagagcagggtgggtcccactatttttaatgactgacacgtgggtccgaccttttattttgcttccaagtgccacatcaccaccacatacgatgaggactaagtcaaactagccacatcagcgtcacatcagtcaaaaccgccatctaaaccgctgagggacctcatctacatcggttttgacagttgagagacccatggtatctggtattgtgattcagggacgaaaatcggactcggtgtaaagttaaggcacctcatatgaacttattccctcaatatatcctgtacaacccagcaagcacaataaaaagaagatgaaatttgatccaactttttttccgagtcaggtacgtacggcgcagattcaaagatttgaaaatagtacagtacgcatttgaaattaatcacgtgtcctttgaggagcgagtacacttaaatttctcgttctcgatctgttcagtagtcaactgtacgagttgcagtaattattaatctatcactgcggattagtggaaacgaccacttcgatctatagaaacagacttttgttttcgaggagcctgcattgat

SEQ ID NO: 49156 - DNA, 1266 bp, Oryza sativa
agtaatccaacctgattttctttcggggtgacatgcggccatcatatctctcatgttaaatgcatagacaagactatcttatctaaaaaaaagggatgagtccaatacaaccaatattattctcaaaccaaacatgatgttaaacttcttgatttggactgttaatttacctgataatccctccatcccataaaaaacaaatctaggaccggatatgacatattatagtccaacagatttattgtactatagtatgtcacatccggtcctagattcgttttttatgggacggagggagtagagtagtatacatgtagtagtgttaggagtagtattagggtgtgtttagttctttgggtgtaaagtttttgaagtatacggacatacatttgaagtattaaatgcccagtaataacaaaacgaattacatattccgctcgtaaactgcgagacaatatttattaagcctaattaatctatcattagcaaatgtttactctagtatcacactgtcaaatcatggcgtaattaggctcaaaagattcgtctcgcaatttacatgtaaactgtgcaattgatttttttccccacatttaatgccccatgcatgtgtcaaacatttgatgtgatgtttttggccaattttttttatctaaacaaggccttaagctgtgtttagttcccttcaaactttcaacttttccgtcacatcaaatgtttggacacatgcatggagcattaaatgtgaaaaaaaaaccaattgcacaatttacatgtaaattacgagacgaatcttttgagcctaattacaccatgatttgacaatgtagtgctacagtaaacatttgccaatgatggattaattaggcttaatagatttgtctcacaatttacaagcgaaatttgtaatttgttttgttattagtctacgtttaatactttaaatgtatatccgtatactttaaaaactttacacccaaataactaaatttagtggcatgtgcaatgaatcagtcgtgcatgcactagaaactcgcaagttgaggccctaggaatcagtaaacctgacgagtttggccgctccaggagaggcatccatccatccatcagacttggcaacacgtagccggagctagctagcccaagtctatttcgtcgttgcatttgatcgtgtgtgtggccggagcccggagtagtacactgttcaagtcgaggagtagtgtgtgggagagagtagtctaggagtagctagctataggaagcgag

SEQ ID NO: 49157 - DNA, 1606 bp, Oryza sativa
  unsure (1)..(1606): unsure at all n locations
gtttctttatttctttagagaacaaagaatatagaaagcatttacgtgaaatacctcatcattactagtataataagtgtgctaaaaaagaccgaacaaataacccgtaagtactccggccccctactcttaaaagagatcgttttacctataaacattgctattatagaagtagccaattttaaaacaaaattaggtacaagtagcgatatattaggatgagggagtagatagcaaaaattcagtaaagaaaaacaaaagggggttaatttctagttttcagtctagtaaaacccctaaaatttaagccactttttagacggtcgagatcgagattcacacgtgaagagtgaaccttatatgctcatttgtttttctcctcccctcattcccgctcgcgcgggagagatcaagcgatccggtgccgccctccccctcccctagccctcctcttaccccaacgtccaccctcagaccctaaattctaaacctagtgcggcagtcacctattgcgccatcaccggagaagacattgtcactataagtcctggccgaccttccctctcttttctctctagagcttaaagatctattgccttctatgggctcttttgctggagcttaaagatgacttcttgaccggtagagagcaggtgagcgagatttttggagatcttanggctggtttggtcttgccacgttttaccaacgtaagcttaggcatgcaacgagtacttaggttacttggagttggcttttctactaaccataggcttgctataacttgatatgcatgtttctgcatgctcgttgtgtcttttttcccccaaattttatagtgttccgtcacaaatacggtaactatcttaccttagacatggcaactttaggggttgtatggtttgtaaccacacgttgctatgctttgccacacctcaacttaggtagctctgactaagttagctatgcgtttggttcatttctacacttgcggtgagattctttttctatcactttggtctcacacatcatcgtcttagaaaagtgtgataaggtcgtggattgctagccaaagtgtatcgaatttgttcgcctaaccttagacaagccgaaaaaaaaaactatagtaacccttggcaatattactatgtgaacaaaacaaccccttaatcaactgagatgctgagaactataggagcagcaaattggttaaaacaaatttgtagtgaagccattttttcatatggagagctgttcaacagttcaggtgtacagcagctagtactgctactagcttgctaatgcttttatcagtgtactgctcgtactagctgtggagtaaaaaagaaaacagctggctggtttactaggacaggtggtcaacggaggtggcagcagctacaactccataggagcaggcacaataccaggctataagggcaagtgctatggtaaatgtgactaacacctccaaatttatctattttattcacttaccaactaacagtcaacccatacaatgtatcacctctaacacacaaataccaatatcttggatactttaacacacttcttaaaatttgtgtggaggttgtctcttgattta

SEQ ID NO: 49158 - DNA, 1117 bp, Oryza sativa
tgtatttggccacctttccggccagagccaactcggcctgctgtttgttgccccagaggaggacaacagggagacgatcgtcgcgcaggatgcgcttgtaatcacgtggaactcgtcgccagacaccgcagatcttgcccgtggcattctgatagacactgagagtgcccgccaaggtggtctccagttgatgctcctccaggattacacccgcatcatcaacgaattgaatggcacgcggacgaccgattcgcgatgaggtgtagaaggagtagtatagattcttcttgtggaacaggaaacgggcggtggccaccacattctgcggattgtaggtggtgtacatggacttcatttcctcacccttgaggaaataggaggtgcggcccgttagcaacgcagcgtaatctataaatagggatcaaatgaaaggtggagataatccaggtgttagataaatacaatagttctcttgttaattaaatgtaggagctggtgaatgggattacaatttcccgcaggatttggcggattctattgggatctgggtgggtgtccggtacttttgtacttacgtttcatgttgcgctcttcctcttcattgggcacgggcacatccaaggctacatccgtatctgaaagatggagggaatacaaatagagaataagatgatgctgggcgataaggtacgaccttaaatggaatttagatagcaacaaatgcttcaaagcaaccgaaccgccgccagccattcaccatccatccagccagccatccagccagccatccagccagccaaccaactatccatccacaatttgtggacacaattccggcattcaaccaaaattccagttgaatgggtgaatggtgaatggctgaatggacgaatgccaggggatcatcatgaatggcaatgcaactatcaggtagagatcccacctccgaactaagaccttccatttccacctctcgcttccacccaggtggcattcattaatcgtgcataaattgagggcaggtagaaggtagagtttctcgaacgggaagtctaacctacatctaactagggaagtgctttgtatttgaggatgtgcggactctagggttctgaat

SEQ ID NO: 49159 - DNA, 7259 bp, Oryza sativa
cctgattctttttcatctatttccatacaactcttgctatgtttctccttttgtatgacacctgcatagaaagaataatctaagattgcaaaagaacttttgtatttctaaaccagcaagttctaaaacatagagtgtatttcccattctttttcataagtccatttacagtaaacatatatttgtattacagtgaaattatactgtaattccagtaaacaaaaactgtaactacttaaaaatccaactacaatcaatttgataattgattatagacactgaagtgaacaaatgaatcagtttgtataattctttcaaaataattttaatattacactaagtatgtatttcaattacagggtaatgctactataattcaagttaaaatttactgtaacttttttacctgtattttttccttctatttccttagaacttttgcattctttgtccttttgtatgacacttgtaaagaaataatcaagcaagtctttaaatgtttttcaaacctgtatgagtctgttccataagtagtattacagtaaataagtatttcaattacagtgtaatgctactgtaattccagttaaaatttactgtaactcttgttacctgtgttttttctttctttttccttagaacttttacattctttttccttttctatgacacctgcaaagaaataatgaagcaagtctttaaatgttctatatacctgtatgaaatgtgatttctaattgttctgtgtacattgccctggatgcttttctaaatggcaaagtcagcgaaatataaaattacttgttaatatgacagttattaactgaatcactgtcttttattaaaaaatcacacatcaagaaacactaaactactgtcctttatgttttcttaatcatatttcagttgtgccaaatatgaaattattcataaatcaggctatgatttatgatctttttaaaattcatatagtttacatcatctgttttcctgattgtgactatgcttaactatgatgacttgttctaattctagttttacttttcacatttaaaagtacattgtatattgtagttttttggccagatgatgatcaataaaatttgaattgaaaaacaaatcaaaattttgcacgtcatcaggcaagaaaatcaatcatcctaagtgaaaagaatgatttaatttcttgtttgatgatgtgcagaattttgaggtgtttcttataatatctgatggcactttttcttttctatttctttgtactgttgatttgatttgagcagtttgcaaaatattttgtatttttgatatatatttgtgttaaaaggatgttaaatcaaagtttagatttgaacctgattccactttttgcatgtccatagaattgttcttttccttttccttgtttcctttgaatcctgtaaataatgaaatgagtttgtactgaataatgtattagaactgaaagtaaaatataatgaagtcaaaagaatgcataccttttgaagttttcatagatatgaattcatttggcttctgcacatgaccaactttgaagtagtgatatcctgttctttgcttgatgaatctaaaatcattttttaaattggaaatgaagatgcattagttcatgaaatcagcaataaaactcatatacaattgtgttaagagacatatatattgtgctgattgtgatatctcctgtacaattgtgataatactaatgtacaattgtgttagactgtcctgtaattagaatgaaaaacaaattgattttaaatcttcaaaattgattttgaaagtagaattttcagatatgatttgttttggcttttacatatgtactacttttgaagtattgataccttgttttttgctcaaaaatctgaaatcatcttgaaattgagattgaaactgcattagatcttgatttcgtatgaattttacattgtttctttgtagttacatgtatgttcaattgaaattgtagtgttcactctatatatttgtaatagaagttcactgtaactagtttcattatattctattttgagacattgaacaaatcaacaatgatctattatctgaaatcttcatttgttgtctgatgatgggagaaacattaaactgagatagtcttgagtgtaaaacatatcttgaatgtgttcctgaatttgtgcatgattgtgtgagctaaacttttctgaactaatcttttactacagtgagttaatactagaattacagtgattcttgtatgtaattttattacttttttactgtaacatgtaagaaatttgtgagttcctataaattggcttttttgtttgtgctgtatgagatcttgagctttatgaaatattgagttgtatgagacaactggttgacattgagaattgaatttgtcattagtttaatatggtgattatgctgataaaattgaatatatcacaattcaggatatgctatatggcctagttgttatatttctgtataactgtataactgtgatatcttcagagtaaaattcagtaaggttggaagtctaatcaatctgtcatgtttttttataaagttagtttggtattcatcaatagtacacaataatacaatcatccagaatgcagggttgtagtactgaatgcaatttaggcttacttttaacaatacatagttcatatttacagagcaaacatataaattgacagtgctgagttgaatttatccagcaaagtggaatgttaagtactgattcatttaccttgtttcatttgacatattcagcaatttcttgtattcttttgaattgtatatttgacctaaactctctctttattcttgttcaggatttagaatttctaatagaggttaagaactggagccttgaactaacctttgaactggagccttcttgtttctcttaatcttgccttcctcttgtttttcctctgcgttctccagatgttgtgtttcctttgtatggatctcaactttctgttcagaagttgtctttgatttcttctttcctctagaactactctttgattctgacattatactctccccttcttccatctgcgatttggatcctctttttctctcttttttctcttctcctagctccatgtttgattcgtgctagatctgtttgtgaactagtagcgctgttgaaaagtaggggattgaaaagtgtggtcccatacatggttgattcacgtgacatatttttcatctacttggcttccaagtttggtccctactacttttttgcttctaattttgtatcttgggcctgctttttactaacgggctattatggatctggatatggacttgggccttcaaataattggcatgggcgaaaaaatcatgggctttggttatttgtgtgtgattcaaattttgtatcttgggccttctttttactaatgggcttttatggatctggatatggatttgggcttttatagatctggatctgaatttgggctttcaaaaaaatggcgttcaaataatcaaataatatatctgtttttaagtgtaatatttatttgtatcactttttctgagttgttggatgtgcatcctatggtagataaaatctacatgattggaccttcagaaatcattcgattcctatatagacagccccaattaaaaaacggttcggtttctgatacaaatgaaaatttattcgcaggccactttgcatgcttatcttctgaaatctttcttctcttactattggatggtaatttctttcgcactctttcgatgtcattacaaagtaataattacttcaaatctaattgcgtgccactaacatcactagataattcgttacaaagtattagtaatgaaatctgatcttgcctttaccttttctacagagaaagagagtctctgtattcttgaatgctactctactactgtctttcttgctgcatacatgcatgcatttgacaaaaaaaggattttttttaaaaaaaaagaaacatcagtagtacgtacaaagaatcaagcaaaagaactttagtactggtattaactgtataaacggatcaaaatctaagattctagatagctgcctagtaattaactagcagcagctgatgctaacaccagatatactagaaaaatctctctgataacagaagaagcgccgagttaatcggttaataagcaacagctactccaatacagttgatgcatcgcactggaagaagaagaagcagcaggtactcatgtaaatgtaataacgtttgcattcagtacgcaccgagggaagacaagatgaagcttcccaggtacatgctctgcccttctgcagtgagttaagaagcaggggtaggataagaagaagcgaccaccccaacagacagagttactctacacaggtaagaacagatctattccgatgacgacgggcggggacacggcggccggcaaatgactggcagacagaacctgtcgaaggcatcaaaacagatccacctccgaggtccgtctgggctgtggctgtccataatcttcagctgaagctcttctccaatcaaactcttcacgaacctatactcaaaacagacaactgcgtgccaggccgccttacgggcaattattgcagactcgggacagcctctgtacactcttttggctcgctgttttgcatccgcccgataagagaagtagtggggtgggttaaccgccagtgcaccaatgatcggccctctctgacgaataagcctggctgtctctatggcggtcaggggtttgacatactccgtcagtctgagcatctgggtcttgtaaggtccaggatacttattcaaccctaccacggggaggaagtaatcatcatccatagtcggcagacctcccatgccaacaacaacctccaatacatgctcaaccttaccaccttcttcggggttccatgcttctttctttatgcattccatcctcagagtagttggaggtacctcaactctccatcggaatgagcctgagccatggagcctatcgtaaatcatccgatgctgagcttcagtgcatacagtgcaagcagacaatgaacacccacctgcaaccacacatcaatatcattcatctctgtatctgctgtcatgcaagttaatttaagcatccatatatactatcagtatgattgattgggagcttctcacctctgccttgaacagcaggtgatccgacaattttctccagctccatgtatctggtaacacgagcccagcaagtgtggtaccagtcttccatgccagccatcttacagcttggttgcaccagcgccatggtgttaagtatgagatgcaagcaaactcggtgtcaaccttcctaatgcctcctccaccaaaagcatagtctgcggcccttcagccctctcattatctgcgcccatcataccattgtctccgccgattgggaaactggttccacttatctgagaaaagaacacaatgttaattaaattctccataagattagcacaatccatttcaaaaaatattaccacgatgttgcaattatgcccatgttagaaccgaaattaaaaatgttttgtttactgccagaacattttctggagaaacacaaacgtgcccctggtgcatgaaaactgttaccagagctactctatgtcagatttgcaaatattgaaactattggtttatcaattatggctaagaaacaggattatgtaaaattacatcagacatggtttcatttaagctaagtaaaagaagaaagttccacacattcaagaacatgagtggcaaatgtcatgagatcagtgcatctgtgaacatatataagaaagaaaaaactttgaaatttgatctgtataaataaccacaggctaaaatgatgaatcaaatagaaggcatcttcataattacatggagaagcctaaaccatgtaaacatgtcattttcttgtgtgccaaataatctgaataaacgtgttggttccagcactcatagactagcattattgataaaatgtcaatgggatttgcagcactaaaaacttgaacctacaggctagagactccttatggtttttttttttttgaagggaacctatggaaataaatgatactaagaatttcttcccgcataatgaaagaattgcaacggagagcagaacaaatacaatttgctcaatctgcatcctctgtttcaagaaaacatcaacagttgatccccaaacaacggagatgctcgcacgaaccatatatacaatgcatcatgtcctatgggctgcagcaaagaggatggcatatagcaattcaatacaatttgcaaagaacgcaaacaatcttgaacatcatctagcacggtgctatctaggacatagtaagagaatgacaatggcgatcagatgatgttaccattttcaagaaccacaccgaaataaatttggagaggaaaattcatagcgtgtacagaaaatttaagtaaacagagagagagaacgatattttaagcaggtgcgatgatgactttttgatcagctattgttgcaccttgttacaatgaaataaaactgaaatctcagctttcctctagcagaacaaaaaactattaagggaacataaaatccctaccgctaacaggaaatgaaaatttctaaatatattattctatgcacttgttcttttggtaatgtataagctagaagttcatggtgaataatggtaaaaaagggaattacttcacactaggtcttttttgggggaataacaaaacaagaagtacacttgatagcgtggtcatggtggagttcttcaagggtacagttgttaccctgatcaccctggaagaaccaagtaaacggagctgctgcactgtgaaggaagcaaatggggaggagcgagaattggatagcaacctaagaactgcccccctacgaatgtaacatacagaattaaaatgcaactaagaattcgagacattggtaacatcagaagcgaagaattttttgcaatctgcgttcaagaggacatcaagaattgcctcaaagaacctaagtcatgcaaatcaattaagaattagctagggaagggagtgctcaccagaagatttggttctgaaactggaacggaacgcagggagtcttcggggggatgacttgcaccacgcaggacgtactcgtgggagcggccaaggcatccagcagactcgtcccccgatcccaagacgacggtgaacaagccgaaggcggtgtaggtcgcgcagggtgac

SEQ ID NO: 49160 - DNA, 1840 bp, Oryza sativa
ggcgctcccgctccggtgagggggagagaggcgcggggctcttggttcttggcgcttccgctccgctgagagggggagagcggaggagggcggttgcgacagttacctcccggcgcgcaaggcggctgcaatttgaagtagctctcccgttagctgacaggtggggccgcacttcctcagtcgctgacagtgggcccacatgctccatgacgtccttcgtgcagctgcaggctgcagcctgcaccacaccagacgccacgagctcaccgacgtccacggcggccagcagagcactccagcagcgtcgtccagtggcgccggtatgtgcgtgcagcatcgtaccggcgcggcggcgcccccgtccccgtggtatcgcatcagaacagaaagcaaagcgaacgactccctcccagtcatttcaacgaacatcatatgtgcgcatcgcaggtagaagagaagaccaccatttgtctcaaacaaacaccgccgccagaagagcttgctcctcctctccttcctccaacaccaatcctcaatcttcaagaagaccaaccccgccgttgtcctgcttccctaacctcatctccctgattccctgattccctgatcctatagctctggacgccggccaaacaccttgtggccgatctggacccccaactccccttctccctgctctgcatcccccaagaacctccgacatcagcgcaacataggtaaggtaaggcttcttcccgacgatgacgacgacgaggccgtgcttcctccgcgcggtgtgcctctgcttctcgcaagggaagggagagactagaagcatgggttgatgggaggagagatgaaggaaagtgagaccgacatgtggctcacattcctgatgattacatctttgcacagttaaacccctcccgtacttttcacttatctctattcccaaaccaccccctctctcactcggtcactccctccaatcctagaaggggggcaattttcacccgccaatgagcggggatggggacccgcaaatttccacaaacaggggtggggattgtcagctaccctcgggtgacccagcggggccctgggatattagatatgccttaaaaatatagtccattccaacaatacaagcccagttaatccaataagtcactcatataaaaactaaaccctaattcaccaatcccccatcccctactcccactcccctcaccatcctccacaactgtcgttgcccggtcgtctcctcgtccccttcgcctccgctcgtcgccgttgtttccactccgcctctactcgtcaccactccacctccacctccactcgatatcgcctgtcactacactgcctccgctcgtcgttgccatttccgcttcgcctccgcccgtcggcacaccgccacacggccgcgtctccacttgccgcctccttcaagcatcctcgcctacgagtgcagtgggcccccggaggggccgaagatggggatcgatttcaacccgccctccactccgaggttggggccgggtggacccgcagaggagcggaaagggggtcgttccagcccaacccaggcctaccctgccctgttgccatcgctacccaaccctccaaaaaaacataatggaaccgctaaccttttgtcgacggaaaatgcatccccaaaacttgtagattgtagatttagatcactggatgtgcttcataattcgtgctccatgtgcgtcttctccaactccgatgacctcctcttcttctccggcgctggtgacaacccaaacttcagcagagggccgacgaattagggtcccggggtggggtggggatgggaggttgggaggggaaa

SEQ ID NO: 49161 - DNA, 3746 bp, Oryza sativa
attgaggggagaggggagagggaagaagaaattagggttaggttttcactggatgaatcttaaagcgatctaacagttcataatttccaagattttaaggggtattttctatcaaatgacatatagacagtcccaaaaaataattagaaatgtcaaaatagtataaaccacacccaattatcacgcttgttttgaaatttcaccttataacctatttagaaaattatcacgtacccctaaatttttacccaatatctccctctcccccccattttactaactcttttacatacccttgaatattttgtttagatcccttccctaacctttccgttaattgattgttaaattcataccattttgtgccctttactatgaacaagctggagtcggactcatcccatagccacgttcgttgagcccaccctgactgaatatgacttgctatgaatccatgcggaaagaaatagagaaaatcccttgtatacccatgaaaaaacttacctaatctcttctataccctccaattttactcgatctcctgtgtacccccaaattttcactttggtcccctccatacccctcccgttaggtttccgtttgatctgtagcgtgacctgtgtgttacattgtcagtattttcaaaaaataccaaaatgcccctgccagccaaccctaggtaaacagatccaatctccttctcttctccccccatcctctgcacgccgccagtctccaatcgcgcggtggccgccgtcctcccgtcgcgcggtggggcgccgctggctcccaccccccccggtcgtgcgcgccgctggccgctgtcatcccgtcgcgaggtggggcgtcgccagccgccaccctcccgtcgcgcgcgccgccggccgccgccctcccgtcgcgcggtggggcgctgcgggccaccgccctcctgccaccctcccgtcgcacggtggggcgccgccggccgccgccctcccatcgcgcggtggggcgccgccggctcacgccctcccgtcgcgcgcgccgccggccgctgcccttctgtcgcgaggtagggcgccgctggtccccgccctcccgtcgcgcggtggcgcgccgccggccaccgccttccagtcgcgcagctgccgcccatagccctctgtcgcaggcaccgccggccaccgtcctcctgtcgtgcggccaaagtccgataccctctcgtcgctgcgccgccctactggtaggagtagcagcaattttcatttcttcttcttgcagttttcatttttgtttgctgttgtgatgccttacaaagtgtttgacatatttgatctgtcatttgcaacatttgtgtatggagtggaaagttggtttggttcctgcactattgggtatggaaatgaaattgtggtatgtgcatcatatgagctgttctgtatggatgataaaaatgaaattgatatgaagtgctctgtatggatgatgaaaataaaattgtatgaaatttatatgaagtgctctgtatggatgatgaaaataaaattgatatgaagtgctatgtatggttactactattttgattgatgatctatgatgatcttgatgctcttattgatccagattattttgtttcacagattttctcctttgtccacattcctgttgagtgtaccaattttttttacacagcaaactgatgtcactttgattttccaaccctattattttttttcaaaacaaatcgttcgatggattgcattttttttccaataccacaataaaagttttaaactcattattagtctcataaaatacacatgttgtgcggtcaacatattccaattcttttccaatctacctgcagttgctcctccatctaaagggcattatagacatttgcaaccacacataactataaaatgaagaaaacctaacgggagggcatggaagggatcaaagcgagaatttaggggtacagaggggttcgagtaaaattgaaaggtatagaagagattgggcaaatttttatgggtacacaagggattaactcaaataaatagaccgaatcagttagttgcatgtgtaaactatgatgggagcaatttcaacatagtagtattaggtgggtggtttttttttacataaaatacgttatgggatagaatttgaaaacaacactgataattagggtgttttatgtaatttcgccttttaagttaggcaatttttttgctttaacccacaaggaataagtccaatttaacttcatcaaatatcagtccgatttctgattcatatttctcaaatgaaaaaccggatatatcgattgactcctataaatatttaaatccatgcgaaacaataacttttgacatgaaatatatacgaattcatgcatgcacgatgaatgaatcaatatatatttacgacaataacttaagtttctgaatcgacagattaagctcatccttgtgctgctgctttccgcagtagaattcggctgggtgcagaacgcgtccgggcgggcagaaggcacaatcgttgccattggcggcggcggcggtgagatcggcatcggccggcagctgctggagcacggtgcatgtgtcgacgaagaagctgtcaaggacatagggggtgaagcggagctccgcgaaaaccaggcaacgctgcttctgccagtggctgttcctcgcgcgagtgcgagccacgaagttgatgtggaggtagatttcgcctctgaatcgggcgcagcaggcgttgatgggaggcggcagggggatgagcttgctgtcctccacgggatcgaactccaactcatcctctgctctgctgcagaagaaggcgtggtaaaaggggaggacgtccatgatgtactccacgcgccgctctttctccgtcactggcatcgtccttcttgtaccccgacgaccaactgctctcaaaactgaactcctcaccttacaacaggcttccccggccatctccaataagattgcgcatgacaaacctgaccccattgatcgatcgatccaagagttttggttttcttgtttttgagctagccaccgtgattgattgatctatagatcgattggtgcctggtgtgtgtatttgtaataagcaaattaattaacacaaatcgatcatgattcggatctgaataagattaacttcttatcctacctggattggattggatacacagaattctagttagaaccggacattcgtaatcctaatccaatttactaattaccactttatacgtacaattattgatcattcttctttaacaaaaaaagggacggatcgtttttgtgggtggggggtccgtatttatttatttatgtgggccggcatcctccctgggctggcccatttaccaacacaaccgccttcctcgacatatacacgcttctgcaggggcttctctgcaattttgcaaccgcgtcgtctcgtctcgtcgaggagaggatagagaatcgaatccatcgccgcctagggtttccttccttgtcaatcgcgcggccgcggcgatgaccacggcggcgcggccgacctgggctccggccaagggcggcaacgagcaaggcggcacccgcatcttcgggccctcgcagaagtactcctcccgcgacctcgccgcccacaccacctcaaggccaggtactctttcccccttttcaatccatccacatcaattcgattcgatttttagctatgtgcgtgcttcgtgtcgtggagatttggatcggata

SEQ ID NO: 49162 - DNA, 768 bp, Oryza sativa
catgaactcagaaccccagagtccgcacatcctcaaatacaaagcacttccctagttagatgtaggttagactgcccgtgcgagaaactctaccttctacctgccctcaatttatgcacgattaatgaatgccacctgggtggaagcgagaggtggaaatggaaggtcttattcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcgctgctttgaacatttgtgctatctaaattccatttaaggtcgtaccttatcgcccaacatcatcttattctctatttgtatccctccatctttcaaatacggatgtagccttggatgtgcccgtgcccaatgaagaggaagagcgcaacatgaaacgtaagtacaaaagtaccggacacccacccaaatcccaatagaatccgccaaatcctgcgggaaattgtaatcccattcaccaactcctacatttaattaacaagagaactatggtatttatctaacacctggattatctccacctttcatttgatccctatttatagattacgctgcgttgctaacggcccgcacctcctattttcttaagggtgaggaaatgaat

SEQ ID NO: 49163 - DNA, 3544 bp, Oryza sativa
agcgtaccaggccttcttttttggccagcactcctttgcctgtgctgatcttctctggcacgcgaagggccctgctaaatgaaagttcttcctctggtttgcatttcagcggcgctgctggacggccgacctcctcctaaagcgcggcttggatagtcattcggcctgccctttctgcggtcaagagcttgagactgcgaaccacatcctcctcgattgcgtgttcgctcggcaagtttggctccgtgtgctgtcgcctcttggttggactgccctctctcctccccggggtagctgtctccaagattggtggccttcttctagggtttgcttgccggggcatctccgggccagtttcgattctatggtcctcctagtctcttggcaactgtggaaagagcggaactccagagttttcgactctgcattgtcatcggtctcggaggtccttgagtccatcctctctgagggccacctttggtctttagctggtatcgctaattttggggttctcctgggaaggtagtggctctgccccctcccagctatttggagttgtgtgtggccgtgacagtagtatttcgtctcttctttattttatctttttttctcccctttcttggcataagtcggtctgactgattgcgtcgtgtaacaaacattctattcttctaatatattgacgtgcaatccttttgcgcgttcgagaaaaatgaggtgtttataggttgtaattcttgtgcatatacaaatagcagtatttctgaagatttactgtatgcatatacaacaggtagctattgaatatgtacaccacagatagaggaattatagagtcgttcgcagatcagaattcagatattggagaaaggaactactactactaggtagcactgatgatgggcaggctgaattgatgttgtcagggataaatgggcccaagttgatgtagaagagaaaggcaaggcccacttggttacgagggcctttgggctgaggcagagggatgtatggactagtcgttcgtcgtcttctccgttgaattattaattaaggggagtatataattcacgtttataaaaagcggaagaagaaggaaagaaaaagagaaaaaccagccaagatgacaatcctatcatacgatgacgatgtatccagctttgtggtacgcgcagcacgtagccctcacctcgccctgcagtctagtagtatattcccattcccattcccattgagttagataggtagagtataggataatgcgagagagctagcatatgcctaccatccatgatatatccatccaaaaacacaaatttggattggattgccccctcttaattaatctacatgtggcatgcagcaagcggttttaacccagatttaattactagtagcatgctgtttgtcaacaatataatcatttcttaatttacattacctttggtttcgcatcaaacactacatggcaatccaaatgaacgatcaacatagctgcttcgtctttgtagccctgtgataattaaggaggccagcgatcgatcgatcgagccaaattcctagctagcttggttttaattcattctaccctatcctatcgataattaatactcctattcgtctgtctatatatggcagctgctgcgacgaggtgctcgccggcggcggcgccaccgcgccccgtccgaattccaagagtgcgcgtccgctgctgcgaggacacgctcggcgtcccgcgcagccgccggcccaccagacccgagctcgcgcagtcgcagcgcttcccggagctcgtcacgccctacggcgccgccagctaccttccccaccagcagcgctaccctcctcccccacgcccgcgccgcatcgtcctcgtccgccacggcgagagcgagggcaacgtcgacgaggccgcctacacgcgcgtcccggacccgcgcatcggcctcacgccgcagggctggcgcgacgccgaggactgcggccgccgcctccgccacctcctcagcaccggcggcggcgacgactggaaggtctacttctacgtgtccccctaccggcgaacgctggagacgctgcgcggactggggcgcgcgttcgaggcccggcgcatcgccggcgtccgggaggagccgcggctgcgggagcaggacttcggcaacttccaggacagggacaagatgcgggtggagaaggagatccggcggcggtacgccgcttcttctaccgcttccccaacggcgagtcggcggcggacgtgtacgaccgcatcaccggcttccgcgagacgctgcgcgccgacatcgacatcgggaggttccagccgcccggggagcgcaacccggacatgaacgtcgtgctcgtctcccatggcctcaccctccgcgtcttcctcatgcgctggtacaagtggacggtgtcgcagttcgagggcctcgccaacctctccaatggcggcgcgctcgtcatgcagaccggcgccggcgggaggtacagcctgctggtgcaccactccgtggacgagctccgggagttcggcctcaccgacgacatgatcgaggaccagaagtggcagatgacggcgaggcccggcgagctcaactacaacttcatcaccaacggcccttccttcttcacccacttcacccatcatcaccacgacaaacacaaagccgccattgacgacggcactggaggatcacaaccgcaccttcttgatcaccctacctttaattgtttggttaattaattactactccttccgtttcacaatgtaagtcattatagcattttccacatttatattgattcattaacatcaatatgaatgtgggaaatgctagaatgacttacattgtaaaacgaagtaagtactcctgtacataccactgctacttaattagagtgattttatggttctcaagaacgtaacaggagatgccatatttttcggtgtaaactttgatacctctcactatgctttgattgactatacacatatttctgtactctgcttagcttctctgtgtctgaatgcaagcttcatctaatcatccatgcactgaaatgatgagctactcagctcagttaagttagatgaaagaaaacaattaatttagctgttccatatatacgatgtgaatgccatgcaggttttgtgtgtagttggtagcaccaatatcagcttaattagcaattcagaacaattgcagtgacaatgcaaggaacaggggcactctgctttttcctgatggagaaaaataaaactgggcttttcaggccagcctatgaatcacactgttgggcttggatagatgaagccgtgaaggcctaagggcaaccgcaatagttatctataggctctctactagagatccatgtcagcatattttcctacctgaaagagaataaatgaagagagagagagcaaaactatctactaaccgggagatagtgtataaagaaaaacgaggcaatggattagagagctatagatacccatgtagacataccattgaagtggtttactattaatctagtctat

SEQ ID NO: 49164 - DNA, 1739 bp, Oryza sativa
aaagtcaacggtgtcaaacattttaaaacggatggagtattatactaccatggatcctctaattaacttgctaccctctgattttgagtggctgaccatatgtcagcgacccatgtcagaggagtttattttcaatgttatatatatgtcactctacaaacatataaaattaaatttaatcttcacattccacacaaaaaaatatgcttatgattagtgttagatatattcatgaacaaatttgtttattttgtttctagctcatttgtgtggattgaatttgtgagtttcttttttttttttgcacgacgatggatacttactttatcaatgttacaatttttaggtctttttacaactgtttgattgatatttaagaagttgtaaaatccatttatgcacatatatatttacaagttcatgcattctatcttatgttaattattaataatttgagtaatttgtgtgttgttttctttttttttttaacttacaaaatgtttgcgaaagcctgtgtagcgcccgttccgccgtggcgcctagcgggaaaactatctcttaaaaaccctttttgcgaaatctgtttctttgcttgttgtctagtgtccgtgccttctcatatctcaaatccccgatctatcgtcgagttcaatcccgaatccaaatccttcccaaatcaatcccttcgcaaaagtctattttgcctccctcgggttcgatgggccgaatccctcttggcccatcttccccctccctccccggctctctctctctctccctctctctctctctccgctctgcccgcgcaccgcgcgcgcgtgcgaggcgccgagccgagccctccgactcggcccccgcgtgccgtgcgcgtgcacgcgcccgcgcgctcgttccccgtgccgcgcctggcccgtccgcgccgcctggccccactgccctcgctcgttgccgccgctcgccatgtgctcgccgccgtcgccgcccgagctcggaagcgcctctcgtcgccggcctccctcgatgcgtttcctcctaatccgacgctagggacagattcccgtagccgcgtagatgctctcgccgccgggaatcggcccctcgtgaccttgtcgccgtttcccccttcttccgccgccggttgccgccgccgcaatccgccgccgtcgagcatcccccggcaaatccgagccgttggctcgactcccctcgtcccgcgcaacttcccggtgtgctcgctttcgcctagatcgccgtgtttcgctccgccgctcgccaccgccgtccgccgtccgttccggccggcgtcttcttcaacctcccgtcggcccgcgtggctgccacgtaggcgccacgtcggcgccagctcggccaagactgggtcgagccgaccccggtcagccgctccctccggccccgctcgcgggcgcagtccaccgcaagccgtgaggctgcgcgtgggcccgccgcatccgcgtccaccatgaaccgcgcgcatgcgccgcgccccgctccacaccctagcgccgcgccgcgtgcttcctccgcacggtgagccgagctgctgacaagcgggtcccacccaggaccacgcgaggtgagcccggtccaccggctccctctctcctcccctcccgcgcgcgctctgggccgccttttgggccggccggcccatttagctcggccgagccgcccctttctctcgggccgcgccctagccgcccgagggaagtttaattccc

SEQ ID NO: 49165 - DNA, 7049 bp, Oryza sativa
atattgagcttaattatgttgcttgaaaaatattatgcattgataggatcgcacttaatctgtttgtcccgtctgcaaggcagattggcggacctacctagtttgttgcatttgatccttcctttgttaattgttataccatgttcccttgtaaccacccagttgcgcctcggaaatcgtgcactctgcacgagtatcgacggtcgccttcaaacttaaaatctgaaaaacaacttgggtaaaacttgggttttacaaaagacttggaaaacccgacacctgggtcggtgcttgcgaactaaataaatttccaaaaccgcggaccggggaacgtaccgggtgtacggtttcccgctcttgcacttaaggaccgtttccttagaatttcatccgaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtgtcggctttgaaaatgccttgtcatgaaagcttggaggtctcccgacgtggctgatccccacaggctgggtgatccgggttagtaatgtcgtgtgggtaaaatgtaccccctctgcagaggttaacaaactgttcgaacagccgtgcccacggtcatgggcggatgtgaggtgattcctagcgtagttttgtttgactactccttgtgaaattgctgttgtgaaaaggggatcgatgtttggaaaatctgcagctgatgggatcagctaggcccgggtggccgtttgaaagttgttggcccgggtggccgtttgaaagttgttggccgggtgccaatcttgatcaattctaaagactgatacattgcacatactccgaccagacgagacgcactgtctcatccgtgtcgtttgagaagcactcacttagttgttttcagaaaagagttcaaataaaatcaattgcaaaaacaacagcctttccttgaagcctgcattaaacacttatttcccatggcttgctgagtactcccgtactcacccttgctctatataaataatcccccccagttgctgaagaagatgaagcggatcccgctgacaaggagttcttccaggagcaagccggctacgatgagttttagggtttcggcctagttcccaagtcgcgactgtgttgtttggtccaagtcttggcttccgctttcctttttgtaatgcagttgtgagctcgggatctgtccgcagcccaacatgactgtacctctactctataataaagagacctctgttgctgtgatattctgtcttcctgtgataccagcactgtttcctgggactggtatcgattaacaggttaatttggagcgtcacgggctagttccggtcgggactagttcggggcgtgacagcctgtcatagtacttttattgatgtttcccttaaaaaaagatggccttaaaaggtgacatataaatataaatatatatgaccgaaaaaggagcttgggaaagcatgaaggacacacgtatataatccacatatttagtgatggtgtgtacatgtatatatcactagctctcccactgttgccaatgtgacatgcatgtactgattgcatccatgaatatatcaaagcttggcgtgagtaagtactcaccgctttccacaaaactagctacttaaccatgttgagcttgctcaattcacagacgaaaactaattaacaaagttttctagctaaatagttgccagaaacaaattagtcaacgaactgcatgaaaaagtatgctcttttctttttaacttatctaggtttttacttcaactttaatacaattaattaattgggcagttctctcctgtaggtttgttttttttaaaaaaaaaactgtaattatatgtgaaaggacagagatcgatcgagtggtagttaataagcaattgtcccaaaactattttgtatatacttgcatagaaaaggtaaaagtagccaggacagtgaaggaggatcggaacaagtgaaaatttcggtaaaaaaaggaacgagtgaaaattaacataagtagtaaaagactaaggacagctagctagcactgttaattactagtagaagtactgaagtgagaaaagaaaaggaaataaaaaactgaaagatgcatgcgtgtgtgcgattagactagctattaccttgatctcaaaaaaggaaaaaaatgaaaaaaaaaagaaagaaagaaagagaagaagctgttaattaattacctcttcaaccatggacaagatcctggccttcctcctctcgagatccaggaggtccatggagctcagagacaggttgccccacgaacctgaaccctccacgtcgtcccactttccaatcttgggattgggattgggaggtctctgctgcttggcgccatccatggcctcaacgtcgaggctgcagaactcggcgagcagcgccttcacagggcccaggtacttggaccccctcagctgaacattaatggctgcgccgccgccagctgctgatgggcaaccaacgacgacggcggcgagcctgctgcgccggcagcgttgttgtagagggagagggaaacctgctgctgcgaccacggcgatggcaattgcaaaccccctcctcctcctcgtaggtggtggtggtggtggtcggcggcggcggcgacgtcgtggagggagaggaggccggcggcgtggtcgaaggaggagatgatggcgccgctggcgtttgggggcgacgacatgtccaagaggtggtggtgctcatgatgatgatgatgggccgccatcatcgatgctcgcgcgcgtgtgtgcaaatttgttgtgtgcttgtcgtcgtcgtcgtcttcgtcttcgtcttcgtcggtgcctcacactgatctctctctcttcttctcttctctctctctataaggctacaaataattaaaccatggtactactactgtatatagctctagtctagtatagtatatatgtgaaagtgatgaaatgtgtgctagctagtttgattgtcactcagaaaagtcagctacaacacctgcttaattgttgctaactgatatagctacaacctgcagatgtcaagatttcatgcaactaattaattatatgcatgtgcaagtgcaagctagctagctagttagacacatgcaacaacaagaaatattaagctagctagatagtactggatatacctatacatgttgggtgcatgggtggctaggaattaattaattaatatatatagattggcaatatatatacataattaattcaattcttggtgtagtaactttttttttgtctctgcccctccatggagttggactgattctatatatatctgcttgcttaaaaatatatgaggctatatataaactaatgtgactaactatatacatacatgtacggtgtatagtgtattgaatatggatggatggaagattattgatatgcatcaacatcatatatcgatcttcatgcgtgcatgctcccaccaacaaattaaattcaatctatctttctagctagctctagctagctagttaggttgcatatactggtagtactaggtttgattgatctcctccttcctacctctgcaatgaagaaattaaacccagtttttctttattttctttttcgatcagcagattgcaggtttagttgtgctagcttattgctccttttgtgagagagagatggagagtaaatattcagaaaagtatgggctgacagaaagaaaatatatggagcagtagaggttgaagtggtcctcttctctttctctctctcacacaaacaaatctccatcattgatttggattttggagtaattaaggggagaaagtgaaggcagcaagaatatttaagagattagttgtgctagctgccactcataaactttaagagacacgtgaaatatataaggttaattaattaagtccccttctcttttttcgggtatcatccatggaatatataaattgtgtggaatgctatattgaaacaaatcagaaagcacatataaagagaaaattttatgatccttgagaaaatacactgaggaaattaaacgaggaattaagtaatgcaattttccaagtttaattaaattcgaccaacagctaacaaatagagctaatgcttgatctatctagctattaattgtacacatatcgatcttccactgaatttattcgctttctacatccatcgtctctgagtggacctgttttctctcccagctgctacttgcctccggtggtccaaagcttggaatatgacacaaattcctcttttatgcttgcatgatcggtttctctggttaattattggttctcattccaatcaaatggatatatatgcatgtacgggccacaaatttacgaagaactatctacacaaattaaggaaataatgtcaaatttttgtgtataggttatacctcgatttcgaggctacaggaaacagtacgtcctgcaaatgttgatataggatagatatcatcaacacgaaattaaaccaagtacattagctaaacttctcctggccagatcgatccatatatataccgattgattgattttcacatgtagcgctagcgcagtacgtactactttatctttatcaattgtcaagtacataactctttactttagttatctattactccctccatcccaaaatgtttgacgccgttgacttttttaaacatatttgaccgttcatcttatttaaaaaaattaagtattattaattctttttctatcatttgattcattgttaaatatacctttatgtatacatatagtcttacatatttcacaagagtttttgaataagacgaatggtcaaacatgtttaaaaaaaccaacggcatcaaatatttagggaaggagggaggatgtttcaattcgtgcaagcattgaagcgtatatatactagtagttatgtttgctttcttgttatacagatattatagtttcaacatgaatcccgattccctatctagtttggccctttaatttgtatccagagagattaatattacaatttcactcccgtactactcctatgtatggtaacgttctaaattaattttgtcctaatatgaaacaagatattgaagtactctcttcgtccaatgaaaaaacctggacggagggagtacatatgctatttaaaaatatccaactgcaccgatgaaaatatatataaagatgatttcatcaggtgcaccattaattatttgcttctgtgggaagctagattaacttatacagtgtgcaaccaaaatttgtccatccactgtatatgttaaattatatatttgtcagcatcattataagtaaatattattgtggagaggagcacaagttagttggagctaggcacatcaaagaccccatgcatggttgtacgatgattgctactgatgaaaagacctgcctgcagctggccactacagtacagtactactactagtagcacataatttagcatgtggcgaatttggggcgtgcacacacatacgttacatactgacatacacacatgtagtaaagattagagatgtctcccaatcgtgttacattatagtactatacatacatatataggagtagtacttcctccatctattttttgatagttatatttttaaatctgaaaaaattatttttaataggcatatttcaatccaacaacctatcatcttaatgactttctcggttataatgcatgactctctattcttctacacaagattggctacatgggcatcgagaaatgtaaatattaatgaatcgcttatttatgagaaatgactggtaacatgtttaaatgtatgataagtagaattacttattcttggtctgtatgccaagatgaaatatgactatataaaaagtagacagaagggagtagtatatatcatgttcttcagattatcagattactttactagtagcactgctgtatctccaattctccatggttgagagagatgcatatggatcgtccgtgttggttgtattaacaagctatctgcgagccaactcacttggttaattaggatgtggaatctgtccacccagctagattcatccaaaataataataaaaagagatgatcttataattttccaagatgaggttgtagtttctttttaaagtctaagtctaaatctcgagaagtatagtaataggttttagtaattaaggtattgttcggttaatcatcccactcttaagaaattcgagagggatctaaagatgaataatttcatacctactattgagctgtggaatttaaacatcctcaatgccctccaattcatcccttatgggaatagctgaacaatgcctaaaagtggttatgatcatctttggggaagtttttttttttttttttttttacagaatcttgaactttctcgaacagtttactagattgctatctaaattataataagaatccatagttatataatttagaaaataactaaaaaccaatagaacatgtagtatcaactgtttctcataattttaagctccccaaacatgttaccatgtatgtatatatagtaggtatggatagatacaaatgtgcatgtgcctaatattaatttattattaatttgatgccaacatgcaactcctttcaattagatcataaccttgttttttcagttacttgcgctaataattaaccacacatgttgttaattgacggtatttcagctacagtaacaacaactgttaccatattttgtgacgatcacattcttttttaaccatgtcatatcaggcacagcacactacagtaggcacgattaattgcattagtcgttgtcgcagctagcgcaccgatcaattgagtggatgaagagggtttgatcaagagaggctttcattcgcccacgtttg

SEQ ID NO: 49166 - DNA, 9312 bp, Oryza sativa
  unsure (1)..(9312): unsure at all n locations
acacacacacacacatatatatatatatatatatatatatatatatatatggtgcaggccctagggaatgtaatgttcaagtgttctgcgtctaattaaattaatttgagattcttgggagatttgcaaattgcaagctagctaggtctgctagcctttaatttcttatcctctactttaattttggtccctgtttcatgcatgtattgccgatatctcaatctctcctagctaaccggccacctagttctgcccatgtttctttcttcttcctcgcaccaacgctcacactgccacctaataaccattttttaatctttaaatgcctctttatttctccctccgtattttactgaacaatattgttcactttttatcaacatttgaccatttattttattaaaaaaatttatgtaattattatttattttatgtcttgatttatcattaaatattctttaagtatgacataaatatttttatatttgtataaaaaaatttaataagacgaatggtcaaacgttgttcgaaaactcagacctaattgagcaaaaattgtgagctaatattattacagctggaatggaatggggcgcagatatgagatatcaactctaacaaacttgatttaactgattgaagtagaagtgttacagctccgtaaagaagtagagatggatccaccaggatcgagcttgatcatgagactgggccttcaaaaccgagaccagatccacccatgcaccactagaggtgggcaaaaataatcaaggaccaaactaaccgagaccaaaaaatctatcaacgcacaagtccaggttacccatttttcagttaattcggtcatatgccttagttacccatattgaccaacaatagcccagtcagcctaatagccatacatagtgaatacccactagagaaaactatatatatatactttctgcttctgctcgtacttggcatttagccgtcgcctcatgctgccagatggtccatgcggcggcctgtcctactgttctacgccgttgcccgaagccggcccgcatttcctccgaccctctttgcccatgcatatgcatatgtagcctcgtcgtgcagtgaccgatctagaaataaatagtaggggatctgaacaaattacaaccctcttttcatctatatatagcaaaaagttttagtaagggcaaccatagtcctcgcgctaatagtggagacttgagactccgccgctcccatgttagatccatccctgttgtcgagcacacgtacttttccaccccaaccagctcacaggcgcatcgtccacctcttccaacctgcgcgtgcatcatcctactccaccatcaacctgtgcaagcatcctccaaaattttgctgagatttgatttgtgtgttttctcctctatatctatctgcaatttcgatcacggtcgagactgagaccaaaataacccaaaacgaatagcttggttctcaaattgtttactacacaattcgctcggtctctactttcagatgaccaaaatttgctccaagaaattttcagggagatcaaaatgctcacccttacctatatccttccggccggtttcaactccgagtctccaacccaaaaattcttgacccttgagcccatagggctgcttcatgtccatgcattaattaaggaaaaggaaaacggttgttagaaaagatataaggcatgtttgatataactcctactccaagagtgaagcggagttgagaagtggtgggaatgccgctccgcttttaaattgcaatttttaggatcggagcagtaactctattctatagaggagcaattttgtgtgtaaccccagttttacaggacaaaaatgttgagcatgactgtatgagccgtatcaaatgagtcaatagcatgcatggacttaaagtttaacgaagggttcaaaagtttagtgctttaggatgagaaagtgtttaggtacccatagaaatttcaaatattttgttaattttagtttgaagacgacggcgcgcgatatatataggaaaatgttgatgcgtacatgtatacatatgtggtggacggatgggaaagtttacctgcatgacggaccacgtacgtatgggtacgatcgatcgatcaccaaccaacctgcagattacttgttcacttcattcttagacgacctcgccaatagcctatagatattcttaatttgtcctagcaaactgcaaacgaaaaaagtcaatcttaattcaccgaatgatttttcattctcacagcattcgttttgtggtccattgatttcgggtggcaagattcgtgcaaaacagtgtggactcctctgctattctttttataggagcgctagaaatctgccgaatgatttttttatttccacatcatttgttttctggactgtcgattttcggcgtcaaaattcgtgcaaaacagtacgtgcttctctgccattttttttacataattgttactcctggaaaacttttgcaagcattttgttcccaaaacttccatattaattagtgaccatcaaatcacttcgagatttgtgcgtaaagaaaaaaatgctagaaaatttttttcacacatgtcatacataagatcctgatgctaaccaaccaaaccatagttaaataaaagttttatattaattatatcatagttacagtatagttatagtgtagttacaatatagttacacttaaattatattatagttatatctaaaagtttttcgctccaaaaaaaccctcccattacatactttaatttttcgttcggggtttatatatcctgacgcatggatatattatgcagctgtagttgcttcattgcttggaatcagtataccggccgcattaggagattttagtgcatggatagactagtggttcggcccattattgttgaagcccaggtttgattgacctgcaggctgggcttgctattgtagcccaagcaccatcctattctattctaggaataagttcatctaaggtcccttaacttgtcaacgaatccgattttcgtccttcaccacaaaaccagatacaacgggtccctcaactatcaaaaccagtgcagatgaggtccctcggtggttttgacggtggttttggctgacgtggcacctatgtggcaaatttgacttagtcttcatctgatgtggcattgacgtggcgcatacgtggcaatttgatctggaaaaataataaactttgtgggacccacatgtcagtctcacacataaatcaataaaagaatggtggggctcacgtgggccccaatgtcagccacaagtccctctcggctttcctttctcctcctcttcgctctccctcgtcctcgcggcggcggcaggagcatgccggcggacggagcggcggagaggcgggcggagcggcggcaggccgcgggcggcgaggttgccggaggaggaagaggcagaggaggaggtcgtcagcgagcgcgacagctacactccgttggccgctccgcccgcgatgcccagttgaaaggcgctgccctcctcgctcggtctccgcgcgccgcctccctcctcgccttgccgccacacgccgcctccctcctcgcccgaccgccaccgctgacatcctcgatggtcacatttgggtcggagctgcccctcccctcgcccggccgcctcaaaaaacccaagcttttgccgccgccccgactggctgaccatcccaagaaagaaggcacctcctcgtcgcctctgctgcctccacactgcccgcggcgtgagggccctagacctccgggagggctccggcgaggtcccggcggaccgcgagttggaaatgcaattaacagattcaaatattcaattcgcttcttgattgagcaagttataggtgcaaggattttacttatatgtataatgaagctattaatattccctcttgtgatgctatatttgcgatatgcttggctctgtctggatattggttgccgcgagctttacttatatgtctgctgctgctagccgtagttgacgaggagacgcagagcggcgagatgtcctcgagggcatcacgctaggcaacgccctggagaaggagaagagcaagctacgtggcggcgatgacccgtcgcgctggtccgacgagaagagcggcagcggcagggagtggtcaagcctgggatggcacggcgatcctcggcacgagcaagcggtactgcgcatatgcgaggaaggctcgtttggcgacggacggccgtggcagtccgagggttggcggggagaggaggggcggcaagccggcggcgggttcggcctggtcaacggcgaatcggcgatggcggggcggctgggtccaacgatgagctccgtgagggaggaggcgagctccttgtgctccgacggaggaggggctcccactccgtcccctcgtactcgggttccggcgacgagaacggtggtggtggtgacgagaacgccgcgagcttccatggcaggttcttgtcgcgtccggtgcgggggaggaggtggcgtggccgccgtgttccgtctcgccgccggcgccatccatcggtgggcaccggtcgatgccatccacgagagagagaagggtgaaggccgaaggggaagatgaaaggtgatgaggatagagatgacatgtggggcccacgtgggtcccaccattttttaattattttgtgtgtgaagctgacatgtgggtcccatgggttttattatttttttcatatcggattgccacgtaagcgccacgtcaatgccacatcagatgaagaccgagtcaaattagccgcgtatgcgccacgtcagccaaaacagcagtctaaaccgccgagggacctcgtttgcaccggttttgatagttgagggatctattgtatctggttttccggttgaaggatgaaaaccggattcgttgacaagttaagggacctcagatgaatttattcctctattctaagaggataaaagtccattcggccctagaagttggccttaaccaacccccctcccctaaaaaaaaaacttttaaaaccgtgtactagaccttcaaaatttcaatacgagggcatctgacctctttataacgttttcaatcttttttttttggttcttctggggataagattcaaagaaaattaagctcaggaggattattgggatgcctgcaggccggcatgaaattaataatatatctgacttaatatgtaggagtaatatgcgtggcgagcatgtcctgcaagcattagtcacacacattttttaaaaaaataaaaatgaaaacaaattaatcgtgcgctcatcaacatttggcgcgatcgatcattaacgtggcaggcaccaactaacaagagctagctagatcgatgtacccatgcatatatactccagtagctagctacaatcaaatcatacgtacgctagctgcacatccctcgccgccgatcgacgacaatagcatggccagcagctggaataatccggccatcttcctcgccgccgcgctggcggtggcgacggcggcgcaggtcgtcacggccggtttcaccacagacttgtactggcagcaacagccggcgcctggtgccgtcaccccctacaagacatcggactggcacgacggctccgccaccttctacggcgacccctccggcatgggcgacgacttcggtacgtagtatcgtcttcatttcatttgcttttctctccggccatgaacgccgacgagctatataacgaatgcatgtactactactgctatataggtggcgcgtgcgggtacgtgtcgaacgacatcgtgtcgctctactcgacgaagacggcggcgctgagcacgccgctgttcgccgacggcaacgggtgcgggcagtgctacgagctgcggtgcgtcaagtcgccgtggtgcaacccggggtcgccgtcggtggtcatcacggggaccaacctgtgcccgcccaactggtacctccccaacgacgacggcggctggtgcaacccccggggcaccacttcgacatggcgccgccctccttcctcaagctcgcgcagagggtcgccgggatcgtgccggtgcagtaccgccgcgtgccgtgccagaggaccggcggcgtcaggttctgcctccaggggaaccactactggttgctgctctacgtcatgaacgtcagcggcgccggggaagnntttgggtctccgtcaagacctccggtggcggcggcgcctggatccaggcggcgcacaactggggcatcacgtaccaggtgttcgccgcgctggacaactccgacggcctcaccgtcaagctcaccacctacagcacgccgcagcagaccatcatcgtctccgacgccatctccccctggtggatcaccggactctgctaccagggatccaacaacttctactaatcatcaatcgatcgatcatcagatcgagttcaaagttgcagtggttcatctcttcattttgtttcttcttcttggcttgctctgctatgcgatgcgatgctagctattgtcaaagttcatggactctctgtttctttcttttgttcatagaacgggatgcatttctagttcaatgtttatgctaatccatcttctgttgagagaattctttttccctttttcaaaactttcaaaaatggtggattgattatgatgtatacttgatctccgcataagttcagtaaatatatatatccctgaaaacaaagtttggtttcctctctgtgtatagctgtctggactctggaattcgtgccaccaactagatttgatcgagaatatcacacatatatcaacttcttttcaaagatctaccaccacatacataattgatatgattattcaatttgattggtttatgtatatccgatccgaactgcacagcatgtctgttggtcaaacacaagcctgaatacaatgctgcatgtataggcgccactaccttctcctcatagcaagattatataatatcgacaaataaatttagcaacttgctacaaacaaattgtgtataactcgctcagtcaacaagttgatcctcatcaacacattcacttctcttctgtgaactgtttccacaaccacttctgtaaaatctgaatattttcaccgtcttccaatgaccagctcagtgtcaacatcaatatcctggacatgctggttctgattcatctcgcgcgctggagccccgattggagcatgttgcaccttgccctccacaaacaagaacgaacaagaagaaaagattcatcatcatgcaaaagctgacatgtatagatggatattaacaccggtcactgtaagttgcattggatagatagcgccttttgccccacatgtcagtgacattattggcagattaatccggcagctagtaggtgcagtaaataggcgtgtggttgatgatgagttttttaatgatacctgatcgaggagcagtgcgttctcctccgacagaatcttctcctgcatgttcagtttcgtcagttaatcacacatggatatatagataatcttttgagatttgtatttgtatcaacatcttttgtaaagcagtacactccaggaagagacggcttgttgaggcgaacaagtgtttccatctaatcatactgatgtattactaacaagttatgcaaaaatcctctttcagaacaataattcttgtcagccatgctttgatatatattatattcagatacataagtgcatacctgttgttgtagctgtgaaatcttatccatcagcttcttttgctgcaatgttgacggacaacaagaaagatatttatgtaaatctgatcaaaatgcatatatcatagagatattcacaacagcaacaacatagatagcacattgcgaccatttgcttgccttttgtaaacggatgctgcttaggctcttctccatctgcatctccaggccatgcagttcttgcaacgagcatgattccaggttttcgccctgcatcttcctacgtgaaaaatcattttcatctagtcatgtgaatttccccaccctaataattaggaacatatagtaattgccagtctgcatgatttcatatatattctgataaggaataatcattgctattatagttaccttgtgtatgcctcaactgtgtcaatctccattgctaaggtttcggattgagatttcatattctgtatgcagtagttgtgaagaaaaaaaaattaatgcaagttgcacacattatcgtcatcgatcctaacagtatatgatcatggttgatagatatgaggaattcagaatgtatccacaaggacctttacagtaagttcacggggcttcttgtttgcaggcgcctcttgggtgtggctaatgtagcggtcgattgtcccctccaggctgaaaaaagaattccagagttgtgaaaaatagtttattacatggaaatacagataatatatatgtgttcataatcaagtaactgaacgtactactactggatatcagaccaaagtaatgttttcactaaaaatagcagcggtacttatatacgttaatttgtgcctaataagataccggtatcagaaacgaataaaaacaatacaaatttcagcaagaatagataccactacatatgtacatgaaactgactattctcaacaaacttaaattgtaaatggatgtccattaattctaggaagcattatagatgatgaattaaggatccaccattgacatttaatttatctgataacaaattaattgaaactagtatactaaaaaacatcaattaatataagacatgaaataaattgatacttcctcctgtcagaaatatttgacaacggtctaacacccaacaccacaggcgacggctgggaaccaggacgaaaccctaatcttcacttcactttatcttctcttcagggccggggaactatatatatatttatatagagcaagggtgagtactttcgtactcagcaagtcacgggaacttaggtgtttaatgcaagcttggaagagaggcaaggttgttttgcaaatcttttatttgaagacattttgaaatcactaagtgatttatttctttctaagtttgggccgaaaagagacttgcgtctcgattcgacattaagagatgtttttttttcaacagctcatttagtaatgtaccgacctcccgggtcagatcattacttctcggctcccagagccattccatttgattaatcggctcccagagcctttttcattttctcggactcccagagtccagctgcccagcagcacaacaatccgcttccactcgggaag

SEQ ID NO: 49167 - DNA, 21726 bp, Oryza sativa
aaatggcccgaggaaaaaccggcccacaaaaatccgagggaggcaaaatagactttttcggaggagattgatttggagagaaatggagagatttagggtttggattcaattcaaatttgatattcaaactcgagggtttaggaatgaatcaagggagactcaaggaaatgattcgagatggggatttgatattttcggaaatggggataggtatttggcggggattcaagggatgtgattgaatttcggagacttgagtcggatttggaatcttgaggtggacgattttgatggcgatgagagggaacaacgggatttgaattgaggtccttggcacaacctagactcgcacacaaagaacgaaaattttcgcaattacgattttgccgaaatagtttttaacgactcacgaaaagcggagcgttacagatccaccccccttacaagaatctcgaccccgagattcgaaggtggaccacacacacgaaaccaaaaaggatcttcagacttcttcacagcttcagactctgctagtctttcttcaacttattgttgcgtgcttgccgcaaaacggtctggtactctgactcacttagaattcttcatcttactgtggctctgctcttgcctgtggaacctgttcttctcctgctccttcaacttgctcgagattcacaacttttccgtttgtttctacttgcacatggttcagacgaccttgtccgacgggcggtgaggtcaacgaggcagaaccactgtttggtgactttgaactttttggtccagatacgttgggaaggcttgttgttggttggactcgttttgacttgactttctgagggcagcaccatgaatagtgtcccatctcatggcagatgaaacattcgactcctgccttataaccacgtctttttgaaggtgtagggcatggtacggagttgcttccttcatggctattactgttgatcattgtggcttgctgaccaggttctgacatagtcgaacgagacgtagaaccggaactagttgaatgctgagatgctttctgatagtattgtgctggcgagtttgtttttcgacacaaatcttcttttgcttgaatctctagggacattactttgcgtctcttgtattcttgcatctctttcttttcttggatgtcttggcacatgtcgcaggatgcttttgctcttttgtcatcagggaaggttgaacgtactgcattaacatttggcgaatttgggcttccttggggatagaagggcatccttgaggttctcatattagcttgtagtggtgcatccatatagggtttttgggggcagtgtctcatgtaatggccaattttgtggcaaatgaagcatatgaatccgggaacgtgtctgatcttctttgatttgagggtgggggacttgggtaagttttggcaagattgcattgtctgacattgtgggacatcttgcatgtcaacttctgatggcaaggtctttcttttgtgacaactccttctttaatcatgctattttctcgcgatacggatttattgattgagttctgaaggttggggcaattattagctcgaagtggggttttcatccctgtaatcatcacatttaagaattctttgttcttctctttatgggtatcagtgccttctactgattgtgttccttgtatttctgcggcctcattcttactcttgtctggattcaccttgggctgtggtagtagcagttgttgttgtatagaagccaaattttgagctatttcttgtagcatctgagtctggttggctagaatctgataaatatccattgaggagtgttgatttctgggggcaacttccttgtttggtccaggaacagtattatcagtcttggcaacttggttggggacttgttcagctagttgatttggattttctgacaaagctgggtcttccttagaaccaaggtagttgcggacacaagtctgacaggttggttgaggtgccatctgcttcagagggactgagatctgaccaacgcagaaagtagataagaagaaaaggaggaaaacaaaaacactacatcaaaacggttttcgaaatcacagaagacataggtggtgtgttccagccggtaacccaactggtctaacacctgaacacggactaccaaacaaaactcacacacgcactagttcaccacaactcctaccgagcgtgtgacggtactaaggttagcctaccaacaagggcttaactaagactcctaaaggcttgagcacacctttcttcaactgggcgtgaagacaggtttactctaggataaaagtcaaaacgaacgactagcttctacttttggacacaaaagatttttcgcaaaactagagctaaaggggacaacgacaccttagctttcacaaatatttttgtactcaaataatgccatcctattaaggggtttcgatcctagggccaacctatgctctgataccatctctgtcacaccccaatctgataccgccgtacaacggcacctgacaggagcgtgtcgtagggaaaacggcgcgaaccgcttcctacgaaaccgcgatctcggtaccagtcccaggacatagtgctggtacccacggtgacaaatatgaatcatagcaatccttaaaataaatagaggacttatttaccttaacttaggttgcagctcagacagcccgagaatacaaccgacgacacggacgaggcgaacaccaacaacagcagcagcagcggaaccaacggtctaacacccaacaccacaggcgacggctgggaaccaggacgaaaccctaatcttcacttcactttatcttctcttcagggccggggaactatatatattgagtactttcgtactcagcaagtcacgggaacttaggtgtttaatgcaagcttggaagagaggcaaggttgttttgcaaatcttttatttgaagacattttgaaatcactaagtgatttatttctttctaagtttgggccgaaaagagacttgcgtctcgattcgacattaagagatgtttttttttcaacagctcatttagtaatgtaccgacctcccgggtcagatcattacttctcggctcccagagccattccatttgattaatcggctcccagagcctttttcattttcttggactcccagagtccagctgcccagcagcacaacaatccgcttccacttgggaagcctagtctatgatgcccgcagacatcccgaatcacacagattcgtttctgaccacttaggtcgtccatctgccacataggctgattctggttacgattcccacaccacaacaacttttcacaaagcacaggcaaacaaatctacgcaacgggaaccacctcacatccgcccatgaccgtgggcacggctgctcgaacagttagttaacctctgcagaggggtacactttacccacaagatacgaacttattccgaacacccgtcggtatcggaggttcgcaacaaagcctttccccagccgacccagggttacctcatgccacatagaaggatcaaatcctcacataaacataggccattttaggcgtgcacaaatcaaactccaaccaccttgatcggtaagtgagcaagcttctcgtccttgccttaccaggaacccggtttgtccgaccccgccccggcgttcccaactattggcatgcgaggtttccctgaaccgtctagttacttagccagggtgtcccattccaccttgtggttgcactttggttatgttcggtgagtttcccacaggaatcggtccttatatgcgaatacgggacagtgccacataggcacaacccccgcatcgcgagttttcacaattcattttattttcaaacacaccgacaccacatgtcgggttttgaaggcttcacaaacccatttcccaagttttcgacaaacaacggtgtatgtgggatatttggtatacgcgctcagagagcacgaataccgaggtaccacaagggtggagcgtcaaggaatcagggtagtatgacctacggaaattagtgcgactactgggtaggtccgtcgatttggcatgcaacccgaggccaagcaagttaagtgtgtgattctaaaaatgcaagttgcaaacaaaataataatgatttttcaattataggagcaattgatcaaagggtgacttgccttgctcaaggtcttcacgaagcttcacgaatcttcgagaaaacccgcgatcgacgaaaatccgataaccgcaactatacgcaaacaatcgaaaacctaaacaaaagaccaaaagaaagatcctatttagactaattattagtgccattgaaaagatctcaattttacggaattactggaagtggaacggagtcaatcggatgagcggttgagaagacatgaattttggaagtttaattggagtttctggaataggagaaatggtttatggaattttatagaaataatattctcaagaatattattgacagtcactgacgcgcgggaccaaaggaaatgatttgtggaattttggaataaggaattgatttatgggacaaaggaaaaaggatttattaaatccctggaaaaagaaaaggatggagggatgtcaatcagacttgtctcgggtggcattggcgcggcccgagggacttgcgcagctcgggcgagcctaatgggccggcacggccgcgaggagggcggcccaaggggcgcgcggggagagagggtggcccgtcggggtgggcgcggtccaccgcgcgggacccacatggcagtggttgggttcacggtggggagggtgcacgcggaggtgggcgctagggtttcggatgcacgcggttcaggcgcggcgcgccgggtggacggatggcggcgggcccacgtgcagccgcacggcttgccgtggaccgcgcgcacgggagggaagacggagggaggaggctgactgggcgcgacttgacccaatcaagcgggcccgggactgaggtggcgtccacgtggaagtcacgtcggatggggaggcagaggaggccgggcaggttgatccgacggctcacggcgtgcggcgggatccggcgaacggcggcgagccggaaggggcagctagcactggcggcaggaggaggagaaggggaactcattccacggctcggatcaggaagaggacgcgcgacgacggccggcggcggcggccaatctcgccggcatgccgacgtggccgcgcgcgaggagagcgaagggtgcgcgggcttgggtttagccgaaccggtatggtgttgcgacgcgcacgcggtgacgcgggacccgatggtcaccggcggcgcacgcacggcggcgttatgcagcggcggaagcggcgacacggcgcggagacaaaggagaaggccgacggccttggggcagccagggggaggtcaaagggatccccgggggcgtggcggcgagaggaatcgacgcgagagaagccgacgatggcggattgcggcggcggcaatcaccggagagcaaaaaaggggaaaacacgacgagacgacgagggttcgattcaaagggatgggagcatctccggggttcaaggaatccattcccggcgtcggattggacggagcggcaccgaggttggctggcgacgagagacggcctccgggacagagcatggcggccggcgagctagcgcgcggtgcaagggcgacgagcggcggttcggcggcgagacctggggcagtgtccatgcgtgttcggggggctagccgagctaccacgcgagctagggagggagaggacgagcaagaagggagaacggagggtggcattaccaagccgagacgggcgcagtgacgagcggccgacggctcgggagcgagctctccggcctcgggccgaggaaggggaggaaggagggtgcccggagtcccgcgtcacgcgtcctcgcacgcaccggtctcccggtgctctgcggcggacggcgacggcgagagcagaggaagggcgacaatggcgcagtggagtaggagtgtgaagtgggagggattgagatggaatggggagctcggcttcgggttttataggcgcggggtgaggcgatgtcggtttggggggagaaccgaccttggcggtcaagcgctcggcttgcggcagcggcggtttcgtgggcgatgcgaaagcggcgacggcgtggatgctctgggcggcgaaggcggtggatcggacggccgatttcgaaccacgggagcgcagggctggcgcggtcaaggtgggagcggtgagctggcatggtcgcggtggtggcgtgggcgcgacagggcgcaaaggtggcgtcagcggcgccctgtgtacgctcccgcaccaggacaagggagagagcgagacggccttgcccgcaagggaaaagcgaaaggaggaggaggaaagggagccttgctccttccgtttttgggcggcgaggctggagaggcgcgtgggattggcgtcgccacgttggcggcttgtggcatgcggaggcggggccatggtgacgcagcggatgacagcgaaaagggaggagggctggtttggcggcgagcgcggaccaaggcggtcgacgcggcaggggcgacggtggcgcggccacagcggtcggccatgagcggcgccgcgcgcgggagcatcggcgtggcgcggtcaaggtggggcacaggcgcggcaggacgttgtcggcgtcctctgcctccgcgcacaagaagacaagggcgagaggagagaggccgggtttagaagggaaaagtgagggaggacggtggaaagggaagcctctcccttccgttttgggcggcgggcaggcgaggcgcgcgcgggaagggcggccggcgaattcaaacggcggcggcgggaatcggcgccgaggtgaggagaaagcagagagggcgagagagggagagggcggcgctctctcttggctcgggcacgacgcgcgtgctcagcacgtgggaagggaagggggaggagcggctgagaggagatgggccgaggagaaaacggcccacaaaaatctgagggaggcaaaatagactttttcggaggagattgatttggagagaaatggagagatttagggtttggattcgaattcaaatttgatattcaaactcgagggtttaggaatgaatcaagggagactcaaggaaatgattcgagatggggatttgatattttcggaaatggggataggtatttggcggggattcaagggatgtgattgaatttcggagacttgagtcggatttggaatcttgaggtggacgattttgatggcgatgagagggaacaacgggatttgaattgaggtccttggcacaacctagactcgcacacaaagaacgaaaattttcgcaattacgattttgccgaaatagtttttaacgactcacgaaaagcggagcgttacatcttaatgcctgaaatgccctttgactaattgactaaaacctagcccaaatttcacgaatcctcaccgccggcgaccaggtgccgccctccccgtcatccggccaccacgactccaccgccggcgtcctggctccgccccccaccatgcctccatcgccggcatcttggcgccgtcgcccgcagcgccgccgcccttcccttcgtccgcccaccaggcctccaccgcggacatcctgaccccgtcgcccgccgcaccgccgtcctccccgtcgttcaccaccacgccaccaccgcggatgtcctggcgccgtcgcttgctgtgccgccgtcctccccatcgtccgcccaccacgcctccaccgccggcgtcctggcgccgttgcccgccgcgccgccgccctccccgtcctccgctcacaatgcctccatcatcggtgtcctggcgtcatcgcccacagcgctgccaccctctccgtcatccacagcgccgccgccctacccgtcgcccgcagcgctggcgccctccccgtcctctgcccaccacgccttcaccgtcggcgtactggcgccgtcgcctgcagcgccgccgcccttcccatgctctgccaaccacacctccaccgccggcgtcctggcttcgttgcctgcagcaccgccgcctcgtccaaccgcccaccgcccctccactgccggtgtcctagcgcttccgtccccatcaccatcgtccccggcgccgctgcaaccgccgtccccagcgttgctgcaaccggtcgcccaccgccggcaaggagctggccctccttgatgacaacaaggaggtagccatgcctgtagaatgggctaggggcaaataggtctttttagagctctaacagaggttaactagacggtgatggcacattttagaggttaaacaaaacacggtggtacattatagaactttacaatatcagtggtagattgtagaagggtgacaaactcagtggtactgagtggattctctctatatactatctaaaacactctatatatgaccaaaagttcccccatacacccctgcaaggaatgagtcatgcatgtttaattagcacctatatttgacttacctccttgtttcacacgaaaaagggttgacatgaaagtatgatgctttgggccatgcaagaaggctgacatgccaacaatttgatgatcttataatgacaaatagttcatgttaattatgtagtctcttcatcgatcgtgcttattagtcatagccaaattttgaattttaaaacttaattatagagttaattttaaagttatttcatcttaatctgtttttcagcaatgggttttaaaccactaataataacacagatatagaatttatattcataaaattagttttggcgtatttgttcattatattttttttcatagcttgtgatctgccgcagctcaaacaatttgcaatggatttaatttgccctcattttttttatatgaatgctttgtgtaatcgctatacctctaatttgacatcaacaagtagtaatgtaatttggttaaggctatggttttgtgaaacattatatggcataaaacgtgtggtattacattattattggtgttagcatgcattatattttgtttgcacagttataattataaaacagaaaattagttaattgatctctcttgtcacaaaaaacagaattacgtgtacatgtgtctgtatatttatggccgatggatatatagaaaatgagaaaaaaaaataatgcctatgcatatgtaaatgtggtggtggtttggtgtattaattgaaaaagcaatgtgtgatagaaatgaatgacatatcaattcaatatatagtactactaggaaatagtagctactccatatatagtagttgtagattgcatatataattctgagattttataagctatatactccctccgtcctaaaaaaagacaaaccctggtttccgtgaccaacgtttgaccgttcgtcttatttgaaaaaattatgaaaaaaattaaaaagacaagtcgcgcataaaatattaatcatgttttatcatctaacaacaatgaaaatacgaattataaaaaaaatttcatataagacgaagttgggcacgtaaacctatagtttaccattttttaggacggaggaagtatgacgcaatttacagtgtggaggtgagaaaataaaatggatcgatctatcaaatccatctgatatcaaattaaagctagtagtacgctgctacaccagctagtagagaagcagaaacagtatatttcatgtagtagctcgtgacaccttctttaaatccggcacgtacggatcgaactagctaggggaataataagggtgaaaaacagattagaaagatgaaaaatatcatgaggtaatttagtaataaattagggaattaataagctagtacagtagtagggaagaaggaggagggcgggatggtggcgtacgagggagcggaggcgaagtggaagaagcggccgcgcggggagaagacgagcagcgccacctccgcgtcgcacagcaccgacagctccgacgccttcttcagaagccccttccgccgcttcgagaacgtcacctgccgcctcgtcgtgtcctcgatccgccgcatctctcgccgcccgccgcgccgcctctgctgccctcccgccgccgccataagcagtacgtgcgtgcagggtatgcgagagatctactccggctcgccggccgggaacagatcgatctatgtcgctgctggctgcagaggagaggagacgtacggatcggatagggaagtagaagaagaaagcggcggcgattgaaagaatgaatgatttggggggccttgaattgggttacctgattttcctcgcaaaggaaagcatcccaaacctggaaacacttggcatatatggtattcgccttaaatggcccttcttcctcccctcctccactgcaccaatgcccgcttcacacttcataccacatatatttttatattttctttatttatttactttctgaagaatatgctttgcatcagtcactgacatgctgggcgctcgctatagccaaatacatatatactccctccgtcctataaaaaaaccaatctattactaccgaactagttgggtggcccgcgcaattgcgcggctagcatccatataaaattatctattttttccatatgattttatttaaaattatcattcccgtgtttcaaattttattgcaccttatttctttatcacccctttattgtttgcttgatctatcactacgactattcattgtctttagaaatttcaaaaattagaccttgtagcttttacagatcattgtctagttgactttcgttctcataatttttagaagtcccatcaaacatcgccaatgtactcctctatggcccgtttactatctcatctctttactatccttgggattttaaaaatcgaacataattattgtttgtgttctttttactttctgaaagtcccgccaaactattagcggcttcgccactatactcctctacggcctgcccgctgcctcccatcctttttgtcattgagattttgaaaatcgaacataattatcattggggtttatttattttattttctataagttccgccaaccgccataaccgtgctgcttaacggtgtgcccgtcgtccctcctcttaatcgttattgggattatatttttcaatagtctttatttttattacgaattttatttatttataaaatgtattccagatgaactcctattttttctttttctaattttaggatttagtttattttaaatttagaattttagttaatctcatatagtgctctgattttatttaaaaatatcattctcgtgtttctaattttatatttttcagtcacccctttatttgatttctcgatctaccacattttctttagaactttaaaaattagaccttgtagttcttagagttcattgtcttgttgagtttcgtttttataatttttagaagtcttgtcaaacgttgtcaatgtactcctcttcggtccgtccacagcctcatctatttattgtctttgacattttaaaaatcgttcataattattatttgtgttcttttttattttctaaaagtcctgccaaattgtcaacggtttcgtgcaaaacttatggttgaaggagtttgactgcccagctggtttgccttcctgcacatgattttgtacaggacgtgttaattgtgcatatatactatttctaatttagctatgcgtataggacgtgattgtctcgtgtcagtaaattaagtttggtaatctgattttgatttcagaggctattgagcacatgtcaaatgttattttcgcgctttttcatgaaaacatagtcaagcttttacacctatttcgattaaatctcaactcttataatctagatctattatgatctaatggtgtagactttttatttctctctgattttcgtgaaaatttctagacctgtagggcaaacgtgatgtctcattttaaaattatcttaataatgtactttttaatgatactcatataaaaatgtagggaggatgtcttcagaaatttaaattgacgtgtacatcttagttcttatttgtttgaatatctaaaaggtgcttggtagtatttaagtttagaaacttgaaagcaaaagagaactcatataacttataatttttaaaattagcatgtgctaatcattaagagcttgttgtaattaaggagtataattatcaggcatcgatgattactaattatatgtttgaagaaaaccaagaacgtgtccggttgataggccagaagctcaaaagaacctttctactttgtccggctgggaatccgactctgaataggagtccaaacatgatttatataatttctaaagcctgaataggacttatatatatacgatcaatctcaaccgttataatctagatctactacgatctaacagtttaaatatttttctttttctccgattaacgtgggattttctagcctctacatcaaacgtggtgccttattttcaagctgtcttaattatataatagatagtatagcacatcttaatattatgcatctggacatacatctgtccagattcatagtactaggcagggttcctctcaccgttttcggtgtggttgccggacccgcggtaaccgtgcggttacagcgaaaaccgtgtggtaaccgcgagacataccgtggtttataaggttaccgtgcatggtaaccgcgataattacgtggtagccgcgcggttttgtaaaccctggtactaggatgtatcacatgctatcctagatttggtttttatgggatagatagagtatgtgtttatttgcacttatatatacatttgtagcttatcacgcattatctattcttgggatatgttagaatgatttcaagtcagtctctagacatgctcgtacatactacaagggataccgtcacagtaatccataagaatcagttttactttcaaaaagagcatgccaaccaaaataaaggacgatcggaattgttgatttcgtacgtcattaattcctgcccgacttgggataaagctggacgacaaatcgagctcgtatttgaaggcctcattgtttggcttatgcttattcctataaaccaaaatttaaaatttagaacttaatttgaattcaaatttttggcttttttatcgtacttttttttacatcatttgcttttgagtcgctaagaacatatgtataaaagatttgcacacaaataaaatagtctttaaacgaaacaatgggctgtgattatttatccacacgtatgtacaaattaaattggctctacccgttgcaacgcataggggtatttttttctagtatattattaagaatataattatgattagtttgaaaagagtactcaaattcactctctaggcatagaccgtaagcactggatgaacatcagctgttgcagccacagtcccagccttatgaacactcgtatagaaattattaccagatcgaccggccggataaatcgaaaggcacatgttgcagaaatgtttatatttagacaaaatttaaatcctataaatcatttatattctggagcagagggagagggcgtagttgtttatactccatccgtttcaaaatgtttgacactgttgattttttatacgtgtttgaccattcgtcttatttaaaaaatttaagtaattatttattcttttcatatcatttgattcattgttaaatatacttttatatacacatatagttttacatattttacaaatttttttaataagacgaacggtcaaacatgtgctaaaaagtcaattgtgtcgaatattttgaaacggagggagtattagttagctcatgcgcattgcatacctacatgcgggtatgagttctttgggcactccaataataatctcctattttaaaagccccaaagaccaaatgaaggttgccccatttaatttcctgagaacctaaaagctctaaaccgcactccaaaccacttactccctccggttttattttaattgacattttggacaatgacaccgtctacaaaatataccttgaccttattttctattataatatatacaataaataaatacatgtttacttttattatagtgttttgaaagacaaatatatatatgttgttctagtttctttaaactaaatatttttaaagttattgatggttaaagttataaaagtttgaccttaaccttgttcaaaacgttaattattatagaaccggagggagtaggatgcaaaataagctggtcttgatagttgagagatattttatatttggtttaacggttgagagatgcttatcaatttgggcaatatatgaggggtcacaaaaagacttttgaaaggcttttatgggccaatgcaggtgcggaatccgtcttgggcagagtatgtgtcatgggccgtgcaatggctcaccgcttattgggctttttcgcgcagcgtgtgagaggccggaatggggggaatgggatggaaaaggtacaccgaaggtccctcaacttgtcatcggaatataaaaacaatctcgaaccgcaaaaccagatatttgggatcccttaactatataagaccggtcacccgaggttcttcggtggttttgacccggttctagtctacgtggcagctaaatcagcgtgggacccatgtgagacccacgtgtcagtgtgccacgtcaacagcctttatttcccatcttctctccccccctctctctctcaatcttgtctctgcagggcgccggcgggtggggaggaggccggcggggagctcctcctgcgtggccgcgagctccgcgtcaaagggtggtgggtgctgccggtcaaggcgcaccacgccgcggggcggctgacgggcgccgcgtccgccatgcttgccatcgcagccgtaagacatccctcctcggcgagacttcccctgtgttcatgttcgctgctgcttcttgattcgtcaggtcccgcgatgaacttgctcttcctgatttaatttgtccggtgcagtgcgggaagcctctgcagcatggcgccgttgcgcggggccaagcgccggagaagaaggctacaatggcggcggccgctgcggcgggtggcgtgcccagagcagattgcgaggcggatcgacgccgacggcgcgccgggggagagcacagcgctgcgggcgcgctcctacggctgcatccgggtgttcctcgtcctatccctgctgctgctcgccgtcgaggtcgccgcctacctctaggggccttgctccccccgccgccgcctacctcggccaggaggacgggggagctccgttttcgtacccagccaccgcgaccccatcttgaatattgatacatactctgaattttgagagcttttggtgtgtgttcttgtttcatggttgccctctcgatcttcatggtcatgggacgacgttgtccttctccagcggaatcgatcgatccacccgtccgtggccatagccgccgtcgccggtcaatacatcatccacgcaattgtgctgctcctctcccaagaaaaccacgcaagcgagctccgcggaaaccgatctccgctgccgacgacaaaataggcgatttagatgcaagattggggaacggcggggaggattcctgctccatgttgatcctccgcagcagccgtgaccgcgtccatgtccccatcagccgccatcccgccatccggcggggacgagtgtcgccctcctcctcccaccaccgcgctcgcctcccgccccgtgccgcgccgcgccgttcctcatcgtcgacagcctctcccgcaatcacgacggcgcgccgcggcgtcgtcggggcagacgagcagttgggcctccccatgcttcgcctccccccgtgctcccgccgccgtcgccatcggctgccgcacctcctttcctgcctcgccccgccggcctcctccccacctgtcgccgccctgcccgaatgagatgaagagtgagagagaggaggaggtgagaaaacagtgaaaagagattggtgatgacgtggacagtctgacagatgggtcccacgtaggtctcacgctgactcagccgccacgtccaacaaaaccagagacaaaaccaccaaaggactgttttgtaagttgagggatgttctatatctgttttgcggttggaagatgattttaaaattcgatgacaagttgagggatgtttggtgtacttttctccgaatgggattgcggagtatatatgggccgtatcttttgtgaaactttttgggccgacgcggtgaggaatttgacatggtctattgggcttcttccatttcccttctagtccgtgtaattaagtatagtcaattcgccatcgtcaacttactcctcatataggagtatatactatctgatcatgaaacatctatctcacctacttcctccgtttcacaatataaatcattttaacattttttatattcatattgatgttaatgaatctagatattttgtctagatttattaacatcaatataaatatagaaaatgctagaatgacttagattgtgaaacagatggagtaattagctacgaacttacttaaatttgtcctgacccgacctggattgatatgatcagtatcttgttggtttatatattatctggtagtacttgtacttaccactaaatatatgcttaattagatatgccatgccggatatatgcatgtacaacgaactaataataactccttaataactgaaaaaataactaataactcttcaactgaaccaagggttaagcagctcgatcgatcgatcatcctctctttatagttattatatatgccatcataatcattaagtatactcaactagtgtactgcacgctagctatttccatcttaattggcacgtcgtggcatagccaactagcatcaataattaacttccatcacgcactttttgtggccaaaggtattacttattcatcaagccaacaactgcatgcagctcatgtaagaactaattcacatcgaactttttttttcttaaaagaagagattaaaatccggtctctcatatatttcataatgttgaatgactttgcaaagtgagtggataggtttcttgtggtgaaatctatctatcctgttcaagttctaaatttgacacatgcgcttttatttatgactaattattcttttaatgatagacgatacatatacccctcacagcgagacactcctagtgatttcttcaatcttaagacatgtcaatctaatctttcaaaaatgtttatagggtagtttgtgtgtttgtaaatcccaagacatatcaactcagttttttaaaagtgtttattgtatttttaaaaaagaaacaataccgttgtgtgtcttatgacataagccggagatgtaatccatttccattatcttaaaaaaaaaagaaacaataccgaatcattcgtgttttttggggtaagtgtgaaatcgtgtttcaaaaaaaaattgttgaacgacttttgacttaatattttttaggtgtgccttttctcatgatcaatagataatagatgaatagtttgtgataattatttatggtataaatgaatgacttaataattataaaattttaaaaaatggatttaaaagtattataagaagttcataatatataaaaagttttagcaaatattgtaccgtttaggatcgagtggcctaacacaactaagtaggagtttaactgaagcaagttaccaagttagccagctaggaataactgatcttgtctcttgggggagacgagtgggtcacaaacaacaagtggcaaagcaacatcttctccattaatcaaatacaactagggcaagtgcgccctaatctcctggtcaggaaacttgggagctattaactgtttgcgattaaactatacaaaatgttttgattaaagggagctacggcaacaaccagctttgaatccttctgaccaagcagaaacaggggtgacataaaccacctttccgacgctgacatcacaaccttcaagcttaattggatatgtataacctgttatacccatcagattcctacaagaagaggaacactattaacttaatcctaatcagggccaacaggatgaggacaaggtcaccatgacatggcacattgccaatttgccttttcttttcttttcttttcttttcttttctttttttttttggttttccttttggtcctccaattatgcacttaaacaatgggatcatttttttgtttcccacaggacaataaaaaggcttaattggactgatcaactattgctgcttgcaaagcttgctcacctggcaaaggcattagtttaagcttggtcgacatgaccagctggttgagcatgaagtgtactagatttgtttgattcagctggttccgagctaagccagataactacttgccaaatagagtatatataactatctgattgatactctcaatgcctgtataaacatgagtatttaatttggtcattagcatccagctttgcttgcatctactctaagactttgcaaccgatatatgcgacaaaattatcagttgaccgacttaatctcttcagctcatttatttatttatttctcctactctgcagcataatcggagttgattatctaattgggtagctgctgggcattcatagtatgattagctcaagtacatcactacatctgcaaatggtaattgtctaagcaatagtgcccatggcatcattgcattacaataataaccagtttgatttgttcaagcaagaagaaattggtgtgtgtaagcatgtgaatttgcattacccatggtttaattcgatttatatttacctcctgcagcaggaccgacgaccggccggttcttaaccttttctgaagaagaacagttctgttaacgtcaacagattcagcaactctgtagatgaaatggtaaaggtgattacaagtgctttaattaattaattaattttttttactggcgtcaagtttcgagtggactgtatctcactctttttcttacctgctcgatcgtagttatttaattagtcactcatggggcctcatggtttcacattaatctgatcctcaactgtaatataccaatatatactacacttatcaaaggagtgatcaaagcatgacacagtgagcaaaaaaaaaaagcatgacacagtgatcagacataaaccttggatcagcatgcgcaactaagctactggttcaaagatcaatacacggtggattgaagaatcattctttcaacctctctcacttgtaattattttggatatgtaaagttaatgtacatggattattagtatctaaagctgtgaaatagttgtacgtacgtacgtacgtacgtgcagtaacagaatttagactgatgcaattgatttcacaaaccatgggagatggtgacgtgcacgacagcttgatttcttgatctgattatataattagggtagtctaatcacgctcccacatgtatctaatctatactacgtagtactatctaacacgcggagactaaggaacatttcctccccgttgaccacaaacgaacacaagatccatgcatccgggccgttggatcgtatgaatcaacggctaagattatccacgcgccaagcacgaaaagtcagcgcatgtacgacgggcaatgagaaaagtcataggccgttgatccctgatcggacggtccaggatcaacctggaaagatcccacgcctagtcaccatctatatatacgtggagactggagagagattagctttgtgattagtaagcaacttaacacaagatagtcctagttctagctagataggtttgaagagctagccatggccaccattgttgcatgggagagtagaaacctgcagctgcaaggaggaggaggtggccatggcggtggcggcggcggtggcggcggcgagcggcgggagtacatgttcgagaaggtggtgacgccgagcgacgtggggaagctgaacaggctggtggtgccgaagcactacgccgagaagtacttcccgctggggccggcggcgaggaccagcccggcgggcaccgtgctgtgcttcgaggacgcgcggggcggcgacagcacgtggcgcttccgctactcctactggagcagcagccagagctacgtcatcaccaagggatggagccgctacgtccgcgacaagcgcctcgccgccggcgacaccgtctccttctgccgcgccggtgcccgcctcttcatcgactgccggaagcgcgccgcctccgtgtcgtcctcgtcgctggtgccaccggccttgatcaaggtgcagctgccgccgtcgcggcctgtcgtcgacgaggaggaggctgcgtgtggccggcggtgcctccggctgttcggcgtggacctccagctccgcgccgatgcctcgccggcgctggatttgcagctttgatctagctgaggcatctcatcagttttgtactaattctccaactgattagtattcattttccctcaaaaaaattagtattattcatacacgaacatgcatgctgctctcctgtcgaataaaatgaggtcgtcgaagacgaagttgtacattagattagcacaagattaattaggaggggtgaatttaattaattagacatggatcgattgatatatatgcactgaagatgattaattggacgatggaagcaagcaacaacacaaggctaaggtacctagctagctttgctttcatttttccaaattaaatttcatgtttcttgtcagatcgatgaatagaatttgtttttgcgggttgattgtgaatttcggttctcctgttcttaatttcgccctcttcacacgcgtcgccatacgacattaacacgatcgccctcttaacatattctaattcaactagctagccacctacaccatgatcagaacaagaaagcctatcactatatatctaactaagctctagctagctccaaatatatatatatatatatatatatatatatatatatatatatatatatatatatatatcccggccacttgatatattacatacatcaggtcaattaaacttactcatcttgttcataaacaatctgcagcttgactgcatttatatgcagtcatagcagctagcgtgtaagttcacttggtgcaaatcagggaaaaatcaagttggtaccaagaaagaggaaggcccatgtacactgatgtcttcaataaacttaattaggcccaccgcattcatgcttcagtgcccatgcggcccagcccatcccttcaattgggctcactgtggcctagagcctactccagtagtttatctttggcacagacatctctgccccaggacaattatcaacttctttacacattaacccttctaatcccaccgtcaaatatttattcccccaattccaattcctggtgcctagtttcatccattacgctgtttttttttgtcaaatggtactaagcacatggaaaacaaatacaataattaatctctactattataaaaattaaagatgtttttgtcggtactttagtacgtcattcgtgtttgagtcggtttttaaattcattcactttaaaaatacatatttgggtttgactcactttctaacgtcattatcttttagaaatttagaaggagtcgcataagaaatcttttaaaaa

SEQ ID NO: 49168 - DNA, 4930 bp, Oryza sativa
atttgtttacagtgaacgactctttggatggtcaaaagcctgatatttttccatcggtgagatccagtagggttgaggggctactaccagaaaaggcagttgatgatcttaattataggcttcaaagtctagtgcctggtgattcagaacatgttcaagtacttggtcctgatgcgctgggatcccattctcatgaacggcgttatcaggctgaatctcaaaatctttatcatcttctacaaggtagaccacctgcactggctcctcgtcctatgatggatcacattggtaataggaatcagcaaaccccgtttgacatgacacaagcgatacagcatgatcctcaccgttccttttcatcgaacatgaatcctatgcaacaatctcttcatgctcctcgggctcctcatgtagacccagctgctcatcatcttatgatgcagcacatctccacacctggaaattttccaccagaaggcctgcaaagaggtgttccgccatctcagcctgtgcatcacatgcctggttataggcctgagatgagcaatgtaaataacttccatatgcaccctcgccagcccaactatggagaatttggattgatgatggcaggttagaaagcctctgcaagctgatattatatgttgtgtgtatttgcaaatttatgttgtcacagtttacaaaggtgagattgcagaagcaggcctgctacaggtgacaagataatatatgtgtcccaaatgtgacatccatgactgaaaactacagaattcactaattcacatagacaaaatctctaatctgaattatatggcactaaggtttgggaatatgaattgtggtataattgtgtgcttctgctttccttgagcttaacatgccaagtacttttttttcgttattcttgtctataccaattgttttattctctatatggaacgggctttctattatttccttgaaatcactttttaaggggaacattttctcgattcgttcattgttaggactacattaccattgtttgtcaaccaaataggtttggtttttaccctgaatttacctgtataccaatttggaccacatgtttgatttctgttctttcgtttttcgattttaggtccatcaggtccagaactgagaggcaatcacccagatgcctttgaaaggtttctccagatggagcttacagccagatccaagcagatgcacccagcaatggctggtcatgtacctggcggcatgtacgggcccgagcttgacatgaacttgagatacagatagatggatgcgtgtgattgcttatgcagtatgaaggacccagaaacggtttgctgtacttgcgtcaaatagtactctttacccatgccataccgctatgtacctgtgtcaatgagcttgggttagcgtttaccatcaatacaatcgtttggctgcgataaggtacctgatgattcactggtggtgggggttggttgcatttgcatataaatatggagaagttatgaatgggttggtgatctggagtgatctgttgtgaaagtggggaacccaacgaatattgggtgaggtccatcaccgtagcagccacctctgcattgtgtctgtctgcctgcctatctgttgttttcagtttctgtataaatactattctgcaaaagaaagtaccagattgacagacacatttggaagtgtttccctggcctcaccttttcttttagctacagtagcattttatgtttaatttagtttctaggataaaatgctatccatgtaacgattctctggtatttaagcatttaccccctccgttttcaaaaaaaaaaaagagaccaatcctaccaatgaaccttgattcgtagctaggaatttgtttttttttaacggagtagtagttcagaataaggagtcgccgcagaaagatcaacccctcagaacatgacatgttagaaaaatagtgtataacattggtattttcctatactaagctatctgtttttttaaccaaacaatttatatcaatccttcttttaatatatgacttttgcaaatatatgatttttgcacgtatgtatgtaattaccatttattttgctaggatttgttcttttacaaaatttttaacaaaattatatatctatactaaacagttgtggtggagtagtcactaccactgacatgcgatgccattgtagggggctttcacccattttcctgattccctccttcgaatggtaaaaaaaaaacatttaaaataggacagagggagtacaatgtatgatgatttattttcttctactcgtatatatgcaaaattcaatggtaacatttttcaaattaaataaatctagaataggatatcatgttattctaagttggtttattttagaatatattataagtgggtttattttggtagggagcaaacaattcatgggcttaaaatgttgggaagtttctcatttctaggcctaaacgatgctagtactaggcaagtagagtagcagccaaagcggacaccgctaccacctccactacccaccttccttccttcctgaggatctccgcttgaagaagagaaccccaaccctaaccctaactccaatggcgttcgccccgcgcctcctcctaccttcccggtgccccccgccggcctcctcccccgcgcgccacggcggccgcaccgcgcctgagctgtccggtcccaccccgcgcgtggtggtggtcacctccggcaagggcggcgtgggtaagaccaccaccacggccaatctcgccgcctccttcgcacgcctctccttctccgccgtcgccgtcaacgccgacgcgggcctgcgcaatctggacctcctcctcggcctcgagaaccgcgtccacctcaccgccgccgacgtgctcgctggggactgccgccttgaccaggcccttgtccgccaccgcgcgctccatgacctgcagctgctctgcctctccaagccccgctccaagctgcccttcgccttcggctccaagaccctcacctgggtcgctgacgcgcttcgccgcgccgccaacccacccgctttcatcctcatcgactgccctgcaggtcagtccgccccaccaccatttccatcaacttatgatgatggatgttatatgccactcgatttgctttaacgcaattaataattgtgatgtttatcttgttctcgcttgcccatccctatctattgcccagaattgtaactttaagagccatgatgcaagtcaaactttttatgatgccagtgcataaccgtgatgcaacttatattctcaaagtcaatccatttatgcatattacctattttctattttagattttagagccatatcaagttatcctttgatcattgtaacttaagattttgttttcttacctgccacatataggtgttgtttaggccaggcatcagtttgtttaatttggttgtgagctgtaaatttcaaccccactgattgagtgattgaccatccataactaactgcagcataattctgtcatgtcaatatataattatgaaccttcaccttttagtgctggtctgttaagtgaaaatgttgcaagacttagctttatcctttgcttaggacatggcaccggtgaaatggtaataggttccttttggctttgtaatcactggttaaacgtctattacatttccttaatgaaatgggaatgtcatcctctctttcttaaaaaagaaggaaccttctccttttctatctctatagtgctgtattcactatcccatgttcacagataataagttagagcactgcaattgtcaccactgatttgatcaattccagtgccacaaatattatctgcagttgcctgataataatgttagattataaccagttatatatgcatccacatatgttatgccagattgcttaaatcagatttttctttgtaggtgttgatgcagggtttgtcactgctattgcccctgcagaagaggccgtgcttgttactacccctgacattacggctctccgtgatgctgaccgtgttgcagggctattggagtgtgacggcatcaaagacattaagattattgtcaaccgagtacgcccagacctggtgaagggagaggatatgatgtcagcacttgatgttcaagaaatgcttggcttgcctttgctaggtgttgtgccagaggacgcggaggtgatccggagtacaaatagaggtgtgccgttggttctgaacgacccacccacaccagctggtcttgctctggagcaggcgacttggcggttggtggaaagagatgcaatgacagcagttatggtagaggagcaggagaggcccaagaagaaagctgggttcttttcattctttggtgggtaatttgctgtgagattaatgagctcagtgtaggcagtgtgtacagatttgcgttttggagctacgattgtttttcccatttcttttgctttgttatagtgtagaatgattcatccgttgtgcttaaatccatagactggagtattttgccttgtttgctcagtacataagtaatttacgaagatatgttttggtgcttctagtcttggatctggttttacgtcagaattaagcaagaatggagatgctcgtttttgtcgtcagaatcaaaccgtatagttgtcgagttgaatgcttccatagttccattgattttaaactgtatactgttcggtttgacgccaattactttataatgtttcccttaaaatttttctgtcttcgaggactaggtctggttgatttctttgacattttgccagacctttgctatctcggcaatttgataaatggtagccacatcataacaaggtaaattttgtatcacgacatcaaactcaactggaacactccgaaatcttttgatgattgttgaatattttcttatcaata

SEQ ID NO: 49169 - DNA, 2055 bp, Oryza sativa
tatttgttaaaatcccaaaggggacgctgtcaccactcttcattcagagttgcacttgctgctgctgttgttgctgctgttgctgttgctgttgctgttgctgctctttatcatgttcagcaacttttggagggaggtgcaaggcctcctgcctcttgccccacagcagaagataaaggccacctatcacaagtacagatcccagcacgctgcatatgtgtatggcagtgcaatggtttcaaaatctgaatgtgcaatcaatctgacattacttacataggagcatatatatgctgtaacaatgagtaaccgtaccttccaaggaagagctgttcatggaggacagtgaagtcaatcactgaaacaatgatctgcaccaccggaatgaaggctgcgacgaacactggaccgcgcttctcgatgcaccatgtcagtagcacaaacgaaaggccacaccccaccacaccctgaaacaaaagaaatgaagaaagaaaaaatgatgagaaaattaagcagaattgaagctctgtaagtgatcagtgaattgaagcaagaagaaacagaaaggagttgagtaattgcgtacggcgtagaggatggtgagtatgtggaacttggtcctgacgatccagacggagacgttgcgttgtgtggagaggccgacgacggccacctggaggaagctgaacatgcacatgaaggcattgcaggagtagacatgggggtacttcttggcgagcctgctgtggaggaggaaccagcaggagaggcacacgcagttgcccaggatggccaccgtgcccagcgtccagttcctgctgctcatggctgcttctgctgctactgctgctgctgctgttgcatggtggatcttggttgtgtgggtgacagccacgcccttgtaaaatgtcagcaccatggctcctgctactgatatcagcgtgcccacaagtttgcaatgcctgtctttctctccaggttcagtgattttgacctgtccattcgtgtataaggccaggccaattaattggcaagcaaaagataaagagaaaaaggttgccacttggtgtgcaataattcagaatttattgggtcttccaatcaagaacctcccgtgttaggatggcaagcaagaatgtgaggacagaacggatattggagaaggcagtgacgaaggtcgccgtggtgtatctcaaagcaacgaagatcatgtactgccttagagctgccctgcaagaacaagagagaagaacaacttagtaaagccatgaatttgttttttcgccgggagatgaatttgttttttcttcaagagcaaaagaagaagaaaattaaactagaggcaaaattcgtatgaattgaattggtacccgagcgcagcactgacgaagagataagtgaagatctccagtgtgagctttggcctggacttcctgcatgagcacaattcaataaagcagttacagcactgaattgttgaataatccaggtccaggatgtgtagatgcaagtcattgatgaacacctctctttgaagtaggcaattgggccgaggaagatggcggccgtgagctgctgaagagtgacgaggacgagagggttgaggccgccgtccatggcgaccttgacgagcgacaccaacaccgccgcgacgacgttgagagccagcatggcgatgaccggcaggccacctccgagccaccaccccatgctagcttcacttgttcttggaagctcgatcctctcggtgcagtgccctctgctctctgactggactgcaacaacaacagctaagctaagctgtctccttgatacaacaacaaagtcagtttcaggtagatttatagggtttcgatcgatagaggaaggagatgaaagaaagaaagaatgaggtggcgaggatgacaagacacaaaatgctggacgggcaggcgcagggggtgaccaaagaatcgtttcaggtacgcctttttcgtcctgaagaaaaaaagatgttgatctctgaattctgatgatgatgatggattagtagttacagcatttgggtgaccgatg

SEQ ID NO: 49170 - DNA, 1787 bp, Oryza sativa
ctaatgtgatccatcaaccagtcaaaaactaacttgcaccagtccaaactttcaattaagtccatgtcttcaaaggcacttaggtattttgtactcggaatcaaagaagagttcggacaaaggaagcaattcaaggaaacaatcataaagcagatgagaatttgatcatcaggaagttcttcatttttaattaacttttctccaaagaacttgacagaaggaatagaagttttcccaaaaatatgaagaatcttttgtttgccagaatcaaattttgaatggattgtactaccaccaacatggaggcctagcacaacatggacagattgcttgttcaatggaataagtttttggcccaaaactatatcagaacagttcacatctacttgttttgcaatccaaagagcaaaagaattgggaacaaaacacttgtcaaatagcagcatgcttcgaaaacaagaattttcaatgactgttttgtgatgtggacttaaagaatcaagaacttttgagaaatatttgacagagaatctagagaatgcatcagacttcaaatcagtgtcaacatttttgtcctaacaaaaagaaaataaaacaaattaattaataaataaaaaccaaacatagatataaaagggcattgcaaaaaactaaccttcaaattttgatcacctatgttgtgatgaatattaagcttttttttcaaattgttgataatctgatccatttgtatgatatcacgtagaacctgatttatcattacatcattgtccaattcaatagattcagaccttttcatctaaaaaaattcaaaattaaaaacaaaaatgatggaaaatataaaatgaaaaataacaaacaaaataattaccttaatgttatcatcttcacttcttttagacttactgagttttcttttcaaagttttcagaagttcatttgtagaaatttcatttacatgtggttgtgaaacatccatatcctaagaaaacatattaaacagttaaaacattgcaaatgtgctatgaaacatggctacaacagaaattacattaagatcatttgtagaaattacattaagatggtcttgtgaaggtacatccatatgctgaaaataaaaaaagaaaaattaaaactgtgcaaatgcatatcaatgaagcattagtgcaaaagtaaaacaaaagtaacaagttaaaaaaaaacttacatgactgtcacaattatcaccagaatcacagtaaaaagaaaagtaacaagttaaaaaaaaacttacattactgtcactattatcactagaatcacattggtagttatcatcattatttggcaacgattcagaatgaatatcatcagattcatttaaagactggctacaatcctccaattttgagcgcttttggcgaaccatctgttcaaaatttgttatcagcaaaaatggggcaaaacattaaaatattatatgaaattggggcaaacagagaaaggcccatgggttaaaaaaattaagttcacaaacatacatacaaaattaatgtaattcactagggcatacacatgcaaaagaaaatggtgtacaattaggtaaggatatgaacattgcacaatgtagtgatgcattgcagaaagccccatcaaaaatcagctagcaaaaaaaatcataaaaagcattgaacatattcagagagggaaaaatgcaatgcactactatgtatgccaaccaaagctaccaaatataaatttaaaatcaatgtgtaacttctgcatagcgatgcagtactgaaaaatat

SEQ ID NO: 49171 - DNA, 27353 bp, Oryza sativa
  unsure (1)..(27353): unsure at all n locations
tagtaaatcatcaacactgtgctagtaaaacttttcaaattgaagttgagcttctgtagcatgaacataagtacaacaaatcaggagtacaaaaaaattgaaataaggttgaaatgattggttaagataaatcatattcctagtgaaataaaaatgttacatcaatcccttttggtaaaaacaaagttctacatccatttgatctcagagaaaacatacatagcaaagagaattacattaagatcaaattaaaataactacaataccaaaacacattacaagttacatccctatcatcagatagagtactaaaaatcacataaaccttacattatatccagaaaaaacttatagaaagaataataaaaagcatcacatcacaaacaatttgtcctcctgcttgtgagcacctagttgcaacacaaatcggtagcacaagttggggataggggggaaaccatgcaaaacacagaacaaatgcaacaacaatgataaacagatgcaaaagcaaaaaatcacacagttaaatcatagatctgaatttatattggcgaaactacacaaaataaatcagcctagtgaattaaaatcatatctacatcacacatcacgttctattaaatcaagagcacaacaacttcaaatcccacatcatgttctattaaatccagtacattcatcctcagatctaaactgaatcaagtccagataacaactagatcgaagattcaaacaccaaatcatacacgaacaacatgacatcgttgtgagaagcaaaacatcacaatctccaaaaagcaaaagcccaccacgcaaaactactagtactggttgcaaaaaaaacttgatccccaaatcctatgcatcaacaaattcgaccacaaatcatatacgaactacccaaaaaaatcacgcatccagatggctaccgattccgtcgacactcgaagggaagaaggaggaagatgagcaagtactcaccgacgaatcaccctcacgccgctccggcggaatcgccagatcaacgccgcggcggaatccctcgcgttgacgacggcaaaatcgccgaaatggtcgcctctctctctgtttctctcacctcccagagaagagaacgagaaaaagttctctccaactctctctctctctctctctctctctctctccgacacggtcaatgccagcaaaaagataggcgcgtattccgaaatttgaacagtaattgtgggttccacatgaaaacaaaaaaaataaaaaaaacgagcccaacctagaagaagcccaacttaagcccgaagaaaacataaaggcaagtccagcccaaacaaaaagtccaactgtcagcccaaacaaaaagtcagaagaaggcccacatttagcccgaactaaaaatagtccaaatcacagaactcaactgcacgaatctcaaccatatctaacagcccaaaaaagaatgattgaggactcaaatatcatgcgacagtaatatagcctttccgtttttaattaccttggaggactcccccccccccgcgtcgcccacgcgctggcgacccgggggcaaaaccctagcagcgccgccgcctttcctctcccccctcccccacctctccgccgccggaaagtcggcgggcgagccataatggcggcgacccctcttagcgcgggagaggcggcgaacggcggcggccaatgccggcaaggagacggcggatctggcttcaccttcgccgaatctggccatcccctggccagagtgggtgctggtggcggaggaggccgcggcgcggcgacgcgacaaggccggcgacgccggcacgacgaggcggcggcgacggcacggcgacgcgacggcgacgacttgcacggcagccggcggcggccgccccgacggtgagatgcgcgcgggcagcggtgctcgcgccgctggggggcgagtgacggctgcagcgccgccggccctggtggcagcgggccgagtgacggcggctgcacggcagcgacggcggcgcgaggcttgggaacgacggtgtcggcggcgcggctggtgatgggcaatggtggcggtgccagtggcagccgcggctgcagcctgaggcagtagcggcaacgcccgtcggtgcggaggcagaggcctcggagctcgtcgcagcggcggcgtcagcggctgctgtggcacggtgagaggaggcatggtggtgcgttcggcagcagtggctgcggttgcggtgaccacggtcgccggaggcatggtggcctcggacgactggcttgaggcgtggcaaacggctacatcggaccggcgcagcattgtttggaggaggggtcggagaccggcttggcacagagtggcatagccgatgacagcggaggccggctcggtgcgagaggcgcgagcggcggagatggaggccagctttgcgcgagaggcgcgaccggcggtggaggaggcgaccttggtgcgaggaggagcggccggtgggtatggcgtggtctttggcgcacgaagactggctggcgggagacgccagtgcaggggtcccgtatgtcggcagagctggagaggtggtggagcaccggtgcgtcagccaaggatttgcaggtggtgagcagcgggtgaaaacctagtccggccttggccgggccgacgacaatggttcattccccctcctgagggcgttgtcgtgctgtctcacccttcaagggcggttgccgggcaaaagcctagtctcggctcctttgagccccgacggaaggcggcggcggttttttcggtcgcttctcttcttgaagacgtcgtttttggcatcccttagagggcgatcttgtctgtgttcctttgttggtctagcggcggtcggtcacgcttagcggtggccggtccggtgctatcctcctcccgggttgtgtgttggcgctgtcggtgtgcgggtgttggtatattttttttcctttttcctggttacgaccctctagggttgtaatcttgtaattttttcctgctctatcaatagaacttcgcaccgtctcgtgcgagtcgttcaaaaaaaagttatggagtactccctctgtcaaaaaaaaagcaacctagtattaggttaagttttcttgggacagagggagtagacattaagcagatgaagcaggcagtgacaccagcgcacacacagatagagagagcgatgtatgtatactcttaggcagcagtgtgtaaaaactattgaggcaatctacctctcgtggaggctgttcaagtcattatatacgatacagcaatagtacaactcaagaccgaatcgtatattactaacctatacagattctacatacacaaggaaaacacctatacagcatcggaaacgaatcagttatgcagtaacgtaagcagcagcatctctattgtttaacacagtgatctctgattaattattgtttgacagacaattgacaatcgagcgctgcgctgtataagactgacgccatagttaaaagttgccatagaaagatgtcaaagattttctttcatcagaatataagcatgcaaagtggctgacgactaatttctcatttgtatttcacgaactgaagtttaagttacataattgcagagcaaggagaggcagcactgacatgacgcagagcgagcgctgtgaagcagcacagtcagaaaggtcactctgggttattgtttttgtttcagaagaccgcacgcagaggctagtgttgtagtagtaacgacggtcacagctacagctacagcgctgcaggctgcagccagatcagctagatggaggccgggacggagtaggcgcactgctgcatgacgagctggtcgatgggcagcgtgtccgtggggaacgggcaggcgccatcgtgcgccccctgcagcggctggcacggcgccggcgtgacgccggtggacaccccctcgatgtcggtgcaggtccacgggtacttgcgcgacttggagagcgtggcggtgacgttggcgatgcagatgccgcggaagggggcgccctggatgccctccagcctggcggcctccttgtacacccccgtggccaccacgtcctggtagctgatgttgtccacgacggggatggcgttggggtcgtaaccgtcgtccgggtgggacttgtagttccccgtcatccagaacacccacttcatggtgtccagcgacatcccccggacgaacacgtcgcgcacgtacgccccacgccccaccgccgtcttgatccgcaccgccgactccgagttcaccgccgttatgtcctccgcccgcacgtcgctgatcccgcccgacatctcgctgcccagcgcgatcaccgcgcttgtcggcgacacgcacgtcagcctccgcaccacgatgtgctggctgggcatcccgtacgcgatcccgtactcgtcccacccggacttgatcgccacgcagtcgtcgccggacacgatgtagcagtcctcgatgcggacgtgggagcacgagtccgggttgatgccgtcggtgttgggcgagtgcgtcggtgccaggatcgtcaccccctgcaccacgatgttgctgctgtacaccgggtggatgttccacgccggcgagttcaccagcgtcacgttcgatatcaccaccgtgtccgagtgcatcacctcgatcaggtacccacgcgtgtacttgagcttgttcgaatggaacttggaccaccacatcgccccctgcccgtcgatcgtcccgttcgcgccggtgatcaccacgtccgtcaggttggacccgccgatcaggctcgcgtaccggccgccggccttgtcgcggccgcggccgtacgacgggaggggatcgatgatgggccactcgcccatgtcctgggaccccaggatgacggcgtcgctgtggaggaacagggtgaagtggctcgtcaggttgaacggcccagtgagccacttccccgccggcacgtacagcatcgccccgccgccgccctcgccggagtactgcgacaggtggtccaccgcgacttgaaagccgccgtgttcgacgtcgtgccgtcgcccacgccgccgaagtccgtcagcgacgccgtgtgcgcgcggcagctcggcgccaggtacatgctctgcccggcgatgggcgccgccgggccgtggcgccgcgccgccaccgtcgccgacgcggccaggaggaggacgcatacggaccgaagaacctgtgccaacaaattaagatcatcttatttactaaagtactctcctaaataaaagggaggaaaatatgaaaaattgcagatttcgacatactcagatttctcaatctactgtgcttgctagttacttcgacagaaaaggggatggagattgctaattggacagaaaatttagtgaaaacaaatactatactccttataatagaggggaaaaggtggtgatgaatttcagactttgacagtgaaagctcacataatttgtactactgcactgtccgacacacccgacagaaaattttaaccagaaattgggattcaaaaagcagggagcgcgtgatctttgtttagttggtagtgcattcctaaagcattgttaaatcagtatagaaaacgagacaagaaaaaaaaacattactgtacaatattcagagaagaagagagcattcttcaggataggagaagattaggtacagagaaacaggaacaagcaatgaccaagaacaggttgcaagacaatgaaacgggcgttctggcactgccattcataagatttttaggacagccataaagaatacagcaagcgaaacagctacgcaagcaatgaatgatgctactaaatagcaagatggaggcagagtcagttacatacatgaagaggtgacgcatttggtaccggctgcgtttgcaacgccattgctctggatgagagtggagtgtggtcacggatgagatgagagaatggagtggggtggattggatggtaacggcgagtgaagctgcagatttataggaggcctttctgcactattgagcactcactcctgcctcatccttagtactattaattaattagtgagatttattatccatgcaatccagcactaactttccctgtcttttcttttctgtacgactcctccctttttctcttcaaattgacatcctgaatactttatgctattaccagttcatgtgaaaaatttacctttttactagtagagcttttcagctgcctgcctgcctgccaatagcccaatagcttgctttttaccggccacccggcctcatcttatcgatgcctagattatattcgctgtgacttaatacgaactagtgaactactaaagcattcagtttatactagtagtagagttcttgtttgttcagttcagagatcacatgtgatggtcagttcagtgttgtgctctcttttcaggttgtctgtttccctatcttaacactagatggttgatactgtcaatcagtcacgggtctagaaattaggcagcagcatttaccctccgagtttatatcttttctataacatattctcaaattaaacccctaattaattttcagctataactaaggtttttttttctgttactgaatcagctctgtttttttttcagtctttattgtgcactatgaagtatgaatgaccacatgctgtattttgtgataaaaaaaagtgcatgtgttaaagctgtgattgtgggacggtggtaatgaacaattcatttgtctaatcaatcatgttgtgatcgatgaaccacatatatatggtgcggtgcttgtcatcgtcgtcgccggaattgaagtgctctgtttcagtgcgcatgcaatcctacgcaagacagtctttgggaagtcgccgctcgtgctggattttgtggccaccaattgctttagaattttgtgcaccttttggttccactagttagtatagtagttattattcaggaggattaaacctgcttttgcacctgatttccctcctttggatagaaaagggcaggtgcatccgtgcatgagtattactccatatgaaatcagcctgccagatcctccaaaattaaaagcttatggccaccgaaggatcacatttggactgaatanctatgatagatcatgtgtgggggtggtgactggacatatattcagagacaaactgccggtttagtttttttaaaaaaaaagaagccggttcatagttcatgcattgcgtctcattgtattgtactactatcagagattcagagagagagagagagagagagagagagagagaggaattcagccatgtcacggggcgttcatagttggtgagattggtcgttctttgtggttcacgggtggatcgtagtatatgcattagtaccattgtcgtattattgttgtcggtcccattacacgatcacgatgctttcggccttcactctactactactaattagccttttcttggattacgcaaagcgagctcacgagctcaacatacatacggatatgcttgctcgcctcagttgagtagaacttgagtgttcatcagctcagtcctttcagttgttgctgtcttctcctgaatcagtttcagtacgctctctgccctctgcagccggttccaaactgtaatcctactccgagcatgcaaatgaacctcagttaattcattactgctgctaatcagtgaatacaagtgtttttttaactaggagagccaagcaaatgagacattacatcagtgaaatgagacagaaatgagacattacatcagtgaatacaagttgttaaggaaaaatgttacaaacaaatactactatgatactattcagtgaggctttaaggattcagacagaaaagatagtgaatgctactgtagtacatgttcggtaccactacaaacacacactacacttgcattgcatgcgtgcaagcttaacttaatcaagtaacaagtggcaacctcatgtctgcatgcgtgctttacgcgcttagcttcagtgggtcggcgccgctctgccatatatgctatgctctccaccatcacaacaacattcacaactcgatcagcaatttatttattttgagcaggctgcacatgtacatattacaggatatcagacagctgaaaatgcttgtccaaccacaatatttacatatgggaattgaaaatgcatgcatcacttaatatatatgctggtccaagcacaatccatatttttacaaggtcagaaaagaggccgaaattatacgcacgcccggtgcttttcgtcagagaaaagggtttctccttttcctttcctttcctttcgtttgtggcacgcccggccgtccagtaatgggatgggattggtatcgcccactaccattttccatccatctattccattctcaacttaaatcacccgatcattgctcagtaaaattcaagtgaactgaaaggagtcacagagctttcggtgataatgctggcggcggcgaaaaatcaaggataactcaacctaggctctagaagtaaaacgactctcacaacttatcctttaactttgtttctttctcgtactttttttttccgcgaagattacatttctttccttacttgtaccttttcctttttctcctgctatatataataaaattggtatggtttaagtgccggttagttttttttaaaaaaaaaaaagaaatcacctagcaagccgatatatatactcttgtttttacttaatttttcagtgataaaacagtaaaaaaatgacacatagctttttataatgaaaatggtttgaatttccaatctctcccagcaggcacgcaacgagcaaaatgacacatataaacacatgtttataccaccatacatacatgacactagcaaggagtagacatgtgtggtgttcaggcctaaatatgttcatggacaatcgatctgcagtagctcttgtgtgcgatgcatgccacgtacacacgcacaaatgagcttaccgttcttgttatactattatgtaacatatactccatatcttttggctttttgcatgaagcagtttggggagttcgcacaaaggtgagagacatatatagatcgatgggaatgcagtccccaccactcacactatagctagagagtacagatccaatattaacactgttctatcaattaacaatggaatgactgctgcaaaaaaggaaggtggccaggagccaacccaaccatgcatggacaacaataatacatgcactttctatccactagaattagagtacatgcatatgccggaaagaaattaggaaaacaagcatcacaacctggaggtgacaattcatcaataatccattccagccacatctgatctactactatgagggaatttaacatgcagatgctaggttatttctggtcgagatgcgatcatgccaacacaacgaaacaatcaggtaagcatcatatcattcatcactagtctcctcaactctcaaggaagctagctaggccatctaaaaatgcagtttacaccacaaacactttcaatcaaataaggcaaggagggcccattacaacacctatataattaactgacaccaaacatttttgtctttgaactcgtaacatgcaacagtaaaaatggctttcctataccaaactttggtttctaaagaaaagaaaaaaaaactaagtatcactctgataaaaagatgcatcttatgtgactacatacagattatgcatttggtatgtttataatcctctctgtatttctgttcagcctattgttggttccactgaccactttcagactcagtggctgaagatgctgccgctactgcttctccttggatggtaaatggatcctccctcctcttctgcaatggtgagacaatggctatagggccagggtggatatctgactgagcaagtgcttcttgatagagtggtgcttcacaatccgtcaattgctcccatgatgaaaatgtctgggacatgccccaattggtccatctcaattggggaacataagcatgagagacacttgttggtttgccagaaggataagcatctactccttgtgaatctggagcaaatccaaagcccacaaaatcctcccagtggttgcatattctaaggttgttcaacatcaaatggcagggttcctcggagtcttcgtctatgagaacatgaagagccactgcttcagctattgcagcaccttcatcatctagcctctgttgctcttcccttttctgctgccgtttcttctccagttctgaaataatagcagccgagtttgcaagtgctttctctaaccggcgccttttcttctccgcttgcttttggcgatccagctcatcttttgcatgcttctttttccctttcttcaacaccttgcctccctgattgcctccagccttatccatggaaaatgtgccaccttctcactatatgtgatgttcctatacaaatcaaagattcagaatcaaaagatacctcaatgatagattttattttaatgaagaagctattcaggcagtaatgaattcaagatggaatacctaaatcaactcaggagtcaggactgaaagaatatactgtttcttctattgttaattttgcccataatttcttgctgcgcagtttttgccccttttcatagcacaacaaactcatatggatcttctcctgtattaaggaaataacaaagtgaggtactgactactgaactaatatatgaaggtacaaaatgcagatgctggagtaaagcaggagagcatacaaggtgattcttagcagtcaaaggaatatacacggggaataaaggccatcaagtacaacatatgtttgctgacaggcctaagatgagggtgatacattacttgttgaacctgaacgcaaagtcaagccaaaccatgttgaaaaaaaatggaacatttttttcaaaattaaagtttgatatgcttttggttttcggaatttttcaggaagagacagtggtatcttaaccctattgtcaactacaaatttcaataacatatatggagaacagaggaatataaataacaaaggcaaagaagatgctagcagccatgtactatgtgcaccagaaattataattagactaagaactaaagagttgcattcttagatataatatgcagaccacgaatatttagttcttatcattaaataacacatagctggagcccaagatcaaagattaatacttctagtcataggaaagtctacttttgtgtctcagatttaataaagaccaaaagattcatatcagacaggagctgtcttcctaagcccaacatcagactaaactccataaaactatagaagtgatcctgagtaactgcagttaatactaatattatttgtctcatcacttagcatgggaaaatgcagcctgaagatacaattcacagctgccttgcccgtgccaaagggttctgattccacccacccggagcttgttggtcctccagggctccttccaagcacaatacgcattaatcaccgccggatagtaggacccagcgcgacaagtttctggctttaattttcacagctactctaaatacccctggtgaattctgttgtgtatactttgtttggaaattggaaatatagacgggtcatagaaaacaagagtgcataggaactagctattcaaggagttagctacatactaaccaaaatttacaagtttgggcatccagaggataaatagttatgacaagacattccccctcatagcattaattggaaattgaacctaaatagtggagtcccatttttacctatttgatcgccaaagccaaaagtttcctaatagagtagacaaaatcaagcaaaatttgtatctagcgtaaggctttcaaatcctcggaaataacctagatttacagatttgatcaatactactatatgcaaaacaattaccaccactagtgttatcctggtacagttgaccggaaaaaaaagatggaaaattgaagcaattggcgtcccttgtccatctgagtaagaaacaagagagagaattgaggatgaaggattgggggaactcacccctatggacctatatgcgtcccagtggcggcggagaaggcggaggagggagagatccgttgggtgcgagtggagatccgggggggaggaggcgaagtcggcgagcggaggggggtcgagatccggcggcgaccgagtgcgtcgcggcctcgcgggggaagagaagagaagagaagagaaggcggcgacggagggaggaaggaaggaatccgcgggcaccaaaccggatatcatcaattaatttccctccctccaatccaaccaccgcaaaatactaccgctgtactacatgggatgggatgggtgggaccatcggtatccaagactattatctctatttggcttaaatttgcaataaaaaatttaaaatttctcaagccaatttgcaacgcaccatcataaaatgccactaagttgaaaaaaagaaacatcatatttgcaatgtagatttagactgggtgacgctaatggacgggtgatcgccgtccctccccccccccccaatgcactcctctccccccttcctcctcctcttcttctcttcctactacaccataattttttaaagaaaataaaaaaacaaagttagaaaaatttatgtatagaaatactacatataaaaatatttgaattctaattctaatttgaatcaggtatataaatttttgacttataaactttgggtctataaactttagatgtatagaaatactatatataaaaaatatttgaattcaaatttaaatttgaatcggatatataaacttttgacttataaactttgggtctctaaactttagatgtgtaaacttgaggtgtataaactttaggtacataaatttactaaaataggaaagtaatgcggtgccaaaaaagaaaaccacatggaggagggggtgatagctcggggcgatcgattgcccattaggcttttcgattcagactttacatgtcatactcatataaaggctatgtttagttcctcaaaaacttttcgcaaaaacatcacatcgaatctttggacacatatatggagcattaaatatagataaaaagaaaaactaattgcacagtttgcatgtaaatcgcgagacgaatattttaagcctaattagttcatgattagccataaatactataataccccatatgtgctaatgacggcttaattaagttcaaaagtttcgtctcacggtttacatgtgagttatgaaattaggtttttcattcgtgtccgaaaactccttccaacatccggtcaaacgtccgatgtgacatcaaaaaattattatttcaccaactaaacagggcctatactagatggaaaaaacgttcttccagcacatgctcaataggacaggcaccataaataaaccaatacattaaaaaaatcttataagtattcgggtaaaaagatctatgccgtacggatttatcaccattctaccttatacgatccagtagtagtactacctccgtttttttaatcgatgatgccgttgactttttctcacatatttgaccattcgttttattaaaaaatttatgtaattataatttattttgttatgagtggttttatcactcatagtactttaagtgtgatttatatcttatacatttacataaaaattttgaataagacgaatggtcaaacatgtgagaaaaagtcaacgacgttatgtattaaaaaacggagggagtaatagttattatgtgccacatcatttattgataaaacattttgatttaccttgattctcatcgaacctatctcaagaaaatcgaatgcaaaactcctgctatcgaaaggggggaaaagaaaaggaaagaaacgtagaaagggtgaaaaatagaaagcaagggaggcaggcatgagccaggagggatcacagacgtgactacacagctagtggtagctgatttgtctaaactaactaccactccatctataagagatcctatccacctatacttcaaataaaattttctcttaaactactcatccgatctacgatccgattacaccgttgtgttcgtaacaattaaatatttataacaagatcttacatgattatattttgatgaaaaattataaattacttttagatttcactaaattacttcttagacatataaaagtaaattcaatatagcctaaaattaatttacatatattaagtaacttataaaaaaagaaagtaactttaatgcatgcctttttttcattagccgtgactacacaactagtggtagttggtttgtactccatctagtgtctcctttcatattatttttaagatctatttgtatcattgtacttcactcaaaatatgtgacaaaacgagattcatattgaatatattctaacattttattaatttaaaagtaatttattacatgttatagaaagtaacttccaagttatcaggaagtagctattacatcttatacatggttaattctcattatttattccatcaatgttatttgcaatccatcaaaggttttatcttcttttctcattctacacgaaaaacaaaaatgaaaggagaaaaacaattggtaattaaacagatttatagagagttacttctgaaccatgcaaaagttccttccaattaacattgaagttacttttaaaaattgttaaacttatgtgtgttaatctgtgctgattaaatttaatttctagataaagtcatatttttatccctacaacgaatttacttctaatgtcgtgacaaagttacttccgttttgttttaagatacttttataatatatgtaaattacttttagactttattgaatttacttttatatgtcgaagaagtaatttagtgaaatctaaaagtaacttacgtatataataaaaataatttataaatataaacatttgttcatcgtaatataattatgtaagatattgttttgaagatttaattctaacgaacacaatagtgtaatcggattgtagatcggataagtaatttgagagaaaactttataagaagggaaaagagaggttactttttttcatttttcccttaaaaaataggctttcttggaaataggaatcatggaataatcctgaattctaatgtttatttctatagtataagaaaaactaattgaatcaaattcatggatttaccacgacctcggctgtgaccccatagataaaaatgcaaaatttctatcttcgagaccattgaaaaaagacattgaacgagaaaaaatcgtcggaaaaaaaaagacatgcatgtctacattgaaaaaaagcatgcacgtgtagtagtactttttctcacaactagatggtcgctgattaacactaaatcaagaggcttctcggtttagattttgccgggggatcacccatgagcgagggcgaggaggaggaggggaggcaggtccaggaggtggtggcgcacgtgtacgacgttgcgagcagcgggtcgtcggaggggggcggcggcggcaccgccatcctccacgtcaaccgcttcttcaaggacgccatcggcctcggcggcatcttccacaccgccatccaggtttccccccattaattgttcttccggattgtaagaaatatcgatctgcatcttgcttgcgcccggcccaatgtattcgtcttctacggaaaagaaaaactctcattttgaatgctaagcaaacagacagcggtcgatctgggaataaccagtttctcctgggaagatctttgctcattcagtcacattggaaccggtggtgcacaactcaattgatgtagaatgccttgcaaaaatcggaccttttagaaactggaagaatactgtgagaaatgtagtacacctggtaggacaattcagagcctttttcggcttccacttaggtctcaatttcttgttgattaaatcgtcaaaaaatatcctacattttagctgaaatgttcactacgaattgggtaaatctgcatatactagccttccgggaaaaaaaattatattgatgcacttaataggtggcaatactgttccttgttgaactttcttgatacatggtcttgcaacgaaacccctagctacttactgttgattaatacatgctcattcttgagcatctgcaatcagatgaacccctaggtattgattcattctgtgtgcctattacaggtgtatggagatgaagaatggtcctttggttactgtgaaaatggcaccggggtttttagctgccccccgtgcaaaaaccccatgtacacgtaccgtgagtccatagtgctggggaagacgacctgctctattttcacggtaaaccaaatactacgggaactgagctggaaatggcctggaggctcatatgaactcctgtccaggaactgcaatcacttctgcaatactttctgtgagaagcttgatgtaccaaaacttccaggtccttcaaattgtttgctgattcattaccatataaaccatatgtactcatatctgactgtaatagttttacaacacacaatgacaacaaaatttcaatcaattatgtacagcttgggtcaatcgcttcgcaaatgctggggatgctgctctagaggtagctgaaaatacagcagaaaaggtgcaccattctgaacttctatgctatatgtaacagcccagtgtccaagccggctctagtaagtagtaaccccattatatatactatacacacatagcaacccatttgcacttttaactcaactcatgctaattggtaaccagcttcctttgtgcatctaaggtttatatgctggttcccagcttcaacttaatactggttatactccatttgtatgttcagtactttaactggcactagaaggtagaaacccaataccatatatatcccctcaagtcccgtatatctgctagatttttcagtaacaaaatatggatacagccgtagcacataaactgtgtgagcacatgaatgatacttagatgctcaattgaaataaataaataatatggtgaaagcacaaaaaaaaactgcaaatcagcacttatactagctgtcaaaaattttgaaattaatgtgcacactgtcaacttgtcacatcggtttggaaaggtaattcatgaacaatagttcttagtataaatttttggtacctcctcaaggatcataaaaacaaaagaagtgcaaaaatccaaataccatgtccactgactattaacattagttagttttactgcctatttatttggagtaaattgatctggcatagatcttttttacttttcactcagctgaagcaagcaaaaaaggacattgcgggtgcatgcaaagcagccaccacatatttgactggtgcatcttcaagttcaccatcaaatgcagatgactcaggcggttcaacaaatagttctctttttgaggggacatggctcagaagtatcatcggcatcagtatgaaaccatcaaggagtctcatgtgttcggatagttcagatagttcagatgatgaaaaatctgaagatgagagggaatcagattgccaacagcctagcggtgatcaaattgaagaaaaaaaggatgctacacaagagcaagcaggaaagtgagaatagaccatgccatcatccatgaaggtcacaccacaatgtaccgaaagaggagcaacatttcaagattgcaatttgctgattaaaaaaatttacacagcgagcaagcaatctacaacaagaacctaatttacacattgggtggcatcgacttgtgatcaagaacggggagctgtgacaaagccctgacaagtgccgaagtgatggcgctcatcacaatgcgtgcaatcctggactttacttgcccacggcgtggcagtggacgaactctcatttgcttttcgcccttgtagactttgatgagatgagcagaggcaaccttgcaagctttctcgcccatgttggtgaaggagatatcagaaaacttgtctggcactatgcttgatctctgttcccgtcgtgtacttataggctaggagatgttgtatctgaatggaagacatgacagctaaactcttgtttcattgccgtattagctgagggagccattgactatacctgaatgatgttgtttttttgtataatcttgcagtgtctgttgagatgaaatgagatgcttctgttgatctatttgtgtcaagattgatagagctgtttgtccgcgtgtgatgtgcaaatctttgactagatagaggctctgtggtttctgatgaacagacatgtgtgcatctggtggaacaaactgcagacttgtcatttattctggtcaggtgtggtgtcgtgtccatgtttctcaggtgcaaagaattgttgccaacctgtgatgtcccccaaatctgagtataaaacctgatgcagaagcatttgtggttaagcttgtttattaggggggcaatcatgaggttcgtagcattgtctcaatcttgaaggaaatcatgtccaccattattgccaattatccttgcttgcgtggtagagtagttgcagtccagagattggctgaatgcacgtactggtgatgaatctctgatggatggaagaagtttcctatgccaagacttgatcatcctgaagtaaggtattccctccgtaaatatttttttttaaaaaaacgaacttggaactgaatgtgatatattctagtacaacgaacatggttagaaattctgtccagatacgttgtgactaggacatgtcacatccaattctaaatttatttatttatttatttttggaacagtaggtaggagaagccctggtcctgtgggagagaagcagaagcaggtcgcggcgttcatctcatcactcatcagggtttgtggtcacaagtaactcgtaccatatcttctcctatctcatttctcaactgaatgactcgatttttatggcgcttttcgccactccccgtccccaaatataaaaccatgatttcgcgcagcaactcaggcacagccaaacagcctgaccattaaaaaaaattataatttactgttttgtgttttggtgtgcctgactaaaaatgtttaaacagcacgccacgacggacaaactagaaagaaagaaagaaagaaagaaaaaaaaacatttatccgtttggtaccacggtagtagaaaatatcagcatgaggaattaaattgcgtttggatttatcaggagagaattgatgctcaaaacctgaatgctactagttgtttgttgcaacataaagaagaagaagaagaaaaggaggagggcgtcacacttggcgcagacaaaacaacgagaccgtacaggtagaggtggtaaaggtaaacgacgagagctaaagaaatctggcatggcgccaccggcaccggccgctttcctcctcccctccaaccattcatatcgcccgctcttgcctcgcccaatcctgcaccacgccaccggcttcgcctgcgcctcggcctcgccctcgccgccccctcgccttcgccttcgccttcggcatgccgccccgctccgtgccgccgccctgccggccatcgccatcgcccccggcgaccactggggcaactgggccttcctcctctccgccgccgccttcggcacctggtaccgaatgccgctcccttcttctcatgctcgtctcgtctgctctgctctgcctgctcattgctgaataatgatggcatggcaggtcggaggagtccacgtcgtggggcgccgcgctcagcggctcgctcgtcagcatcatggccggcctggccgccacggccacgggtctcgtcacggccggcgcgccggcgcaagacgccgtcatggactacctgctgccggccaccgtcccgctcctgcttctcggcgccgacctccgccgcgtcgtcagcaccaccggcgacctcctcaaggccttcctcatcggatcaggtaacttaattatcttccttattatgtgtatattaatcaattctagtacctccacaattaattaattaactaatgtctctctcttgaatcagcgaaccaataacattgcaaaactttgctactttaattgattaattccccctcttgccgtccggcctgccggccagcccagctaattaattttcgtttaaaagcaaacaaatcgcaagctcccaagatgcaaactcactcggtcatactgacattatagtgcatgtgtcattgcctttgtaactggtaggagtacttactttgattaatttttaactacaaaatgccacaatgatttcatctttccaagtcacccagtcactcaaacactgggacagtgatgttgagcaggaattaactgactgacaagattgatgtgatgcggctgaatgtgctttattattgatgatgcaattaacctttgcagttgcaactacaattggcacaacgatagcctttctgttggttcctatgaaatcactgggtcaagatagctggaagatcgccgctgcgctcatgggcagctacattggtggaggtaaatcatcgttaccagctaaatggggggtatattttggcaggatttaagaaagaattacacatactacattttgattaattaggacattaattatgatctgagcacgcatttccatttccatatgattgaaacagcggtgaattacgtcgcaatctctgaagcacttggcgtttctccgtcagtgctagcagccggtgtggctgcagacaacatcatctctgcactctacttcatgaccctcttctcgctggcagccaagataccagctgaacctaaaactgctcaaggtacgtacggagattcaatatgtatatatcatctgaatttcttagcttataaagctaattaatgaaatgatggatggagcatagcagagggtagtaacggcggcgagtctgagggcggaaggcggatgtcggtgctccatggcggcgcggcggtggcgctgtcgttcgtgatctgcaaggccgggtcggccatctccagccagctgggaatccagggcggcaccctgccgtgcgtgacggcgctggtggtggcgctggcgacggcgttcccgcggctgctggggaagctggcgccgtccggcgagaccatcgcgctgatcctgatgcaggtgttcttcacggtggtgggcgccaacggcaacctggtggacgcggtgaccaaggcgcccagcgtgttcgcgttcgcgctggtgcaagtgaccatccacctaggcatcgtgctcgccgcagggaagctgatggggttcgagcggaagccgctgctgatcgcgtccaacgccaacgtgggcgggccgacgacggcggcggccatggcgacggccaaggggtggagctcgctgatcgtgccgggcatcctggtgggcatgttcgggatctccattgccacgtttgttggcatcgggttcggcatgtttgtgctcaggaggatctgcggcgcctaaccaatctatagtactaacaattcaattggtttatatatagctgtgatcaataaataataatggaggagtagtagcaatgaagaatcatgcatgcatttcaatgaaaagtgtaaacattagaagaagaagaagaagaagaagaaaatactgtattatttatcaagagtaatactattattattagaagaagaagaagaaaagtttgcagatgatggatggattacaacaaattaaggttctgaaccgaaaaatcaagctcgtccttgtgctactgatttccacagtgaggaaaattggttgggtgcagtaaacgggcagggggacagaaggcacaggtggtggtggtagttggcaatggcagggtcaagcgtggacgaagctgggggcgtcgaggaggtagggcgtaaagcggagctcggcgaagaggaggtgcttgtgggtggggtttttgatgctgcgagcgacgaagttgaggtggaggtagaagaggcctctgaagcggatggagcaggcggcgatgggaggcgggtcaggcagcagcttgctgtcctccactgggtcgaacaccaagtagtcgtcatcaactccttggctcttgcaatggcggcgccatcgtggcgagttgtaatgggcgagggcttcttggatgtactccgcacggcgctcttgctccgtcattggcgttcggtgctcggtgcaggaccccatcacaagtagttgccggcgtgcttgctcctgctcctccaggtacggtggccgcttggggtcgtccaaaacggcgcccccctctaccatcacccacctcacctcatcacctttcgttgcgcgtcccaaaactaaccccaacgattcgatccaccgcgcgatgtatctcttatatttatttacaatctgtaggcagcctccctcgtttcgtgtttgtatccaaatcggaatcattatagattaatctcaatacgactcctactgcttctcatcaaaattacaaaaacggatttgatatacaactgtcgccagattttttttttccctgaataaaactcttagtttgtcagtcatcagatgagtgttacgattcgtgctagggcatggaatggaaaaaatatcggaattgctaaatgtcatccaatagaaaactaaggtcaaaatcttgtaaatttaatttctaaccttgagatttgctttgtgattcatgctccagcaaccctacctcctccatatccgacgaagctcggtgaccggcaacaactgtaacaaccctccctcccgtaccgcgtagccagcctatcggacaggcgggcccacttacacataccactccgcttaattacactttcgtcctcccgccagaaccgcgtagctgtcgatgcgaaaaatacgcgctagcctaagaggtttgctttactctagtgcaagtccaaagagatcgctttcgagttcagggcgttccagttggtttgatcctacaaccaacaagaaacaaagaaaccaaagaagttgtaattgatttaactcctgcacgactaggctaacctcttgaaaattagtctttctttccacattaaataccactagtaatatgcacatactaacgctacgatgatatttggaatgcaaaccaaacataaatgtaatataacgagcttgaataagatatatttaagattgatgaaaaatgaacgacatagaattattatattgtgaattacatagccacaagtgtctaaaataacatccccattttttttatcttttgaaaccatatatatgttcttgatgcgcttcttttttgagaacgcgcaaaaggattgcacgtcaatatattagcaagaaaagagtttttgttacacaaagtaatcggccagactggcttatgcaaagggaggaggggagaaaaagcaaaataaaaaaacttgaagctaggaactactacgacggttaaaaacgcaactccaaacaacgggaggggacagagccacgctacactcctaagagatccccaaaaaaagcaacgtcggctaaagaccacagctggccctccgagcgggtggactccataaccactgcgaccgaagcgagcgcagagtcgaaaaccctggagtttcgttccttccacagctgccaggagactaggagtaccaaggagtcgaagccgctgcagtggtgctcaggtaaacaggccctggaggatgaccaccaatcctggagccagctgccacgaaggggagagagggcagcccagccaggaggggacatcacacggagccagacctgccgagcgaacacgcaatcgatgaggatgtggttcgccgtctcaagcttctgagcgcaaaaggggcaagcagagtggctatcgataccacgcttttggagaagatcggcagtccagcagcgctgctgaaatgcaaaccaaaggaagaacttgcatttagcagggcccttcgcgtgccagagtaggtcggcacaggcaaaagagtgctggccaaggaagaacgcccgatacgtcgattgcgttgagtagcactggtcacccgtccaacgccaggcgaggtgatcctcaacacccgatgagagctgggtaggaagcaccgcatcccagactaacaggaactgagagatgaccgggacagtgagggcgccacatatgtcaccaacccaggagttgttcgctaacccaacggcaaccgtgcgcgatccccgaaagcgtggaggcacggcgtggaggaggtcaggagctatagaagctatcgagcgaccatcgatccatcggtcagtccagaagagcgtggactgaccatctcccaggatagagaaggtggatgctgcaaacatgtcgaagacgctccactcaacaggggccttcagaacaaaccagtagtgatgtcccgagtgctgaagccagagccaacgaactctcaaggcaaagccagccatcatgagatccataatgcccagtccactgagatccctaggacgacaaaccctcgtccaggacacccggcactatcccccattggccgagtccgtacccgtccacaagaaggcgcaacgcttcttgtcaatggctttgataacccagcttggcaagccgatcgccatagaaacatggactggaatggaagagagaaccgactggactagaaccgagcgacccgccagagtggtgagacggcccttccaggagggagccgatgggagactttatccacaagcggttgcagggccgcttttggcagcttgcgaactgacagtggaatgccgaggtaggtgcagggaaactccgagattgagcaaggaaaagaggactgaaccagtttcaggtcaagaaccgagcagcggatcggagtaatcgagcacttggtgaagttggtccgaagcccagaagcggcaccgaagacagagaggatgccttggatgaactcaaggtcttgccgaacgggggaaaggaagagaactagatcatcggcgtagagggatgcacgatgtcgaatagcacgatcattgaggggaagaaaaccacccgagtcaaaggctttgcggagcatcgcattgagcacatccatgactagaatgaaaagcatgggggaaagaggatctccttggcgaagacctctccgatgggggaaccgtggacctggcaccccattaaccagcacccgggaagaggaggcactgagaatgagggagatccaatcacgccaacgttgactgaagccaagttgggctagcacctcaagcaagaaaggccagctgaccgtgtcaaaggccttcgcgatatccaccttgagaagaagtcagggaacgcgtttggcgtggagcgcccttgccgcaagcttgacatagcggaagttgtcatgaagagagcggcccttgatgaaagcgctctggttagacgccacaagctcgtccaggcgaggggagagacgagaggccaagatcttggagaacagcttcccaaagctgtggataaggctaatcagcctaaaatccttaatgtcaacagcctcgtccttcttcggcaagagggagatcagggcgttcttaaattactgtatgactataggtgtaatgtcttcaaataaattctcattgtaattcaataagttaatgaatctgcaaatagttcacgtaaatggaacataatgcttgatctcaaatgacaaagaaacatatatagtatgggcatcttatccctgatcaacatcacaaagaaggattcatcattttacagtgttaaatgaaaacatgcagcatcaaatctattgcagccggattatgagccacccctgcaacatgaaaattcacatttatatttgcatggatctatgactcgtacagatttgaaaggcatgaacaatctaacctgtgaagtaattccagtagtaaaatggaatgcattgtcaataaattgtagtaaaaaaacaaaaaaactgtaccaactgaaaacctttcaaaagaggaaggagtcaaaccatatcaagcaacgaggtttcaaaatgaaatcattttgtgtaatactccctccgtttcaaaatgtttgacaccgttgactttttagcacatgtttgaccgtttgtcttattaaaaaaatttgtgaaatatgtaaaactatatgtgtacatgaaagtatatttaacaatgaatcaaatgatatgaaaagaataaataattacttaaattttttgaataagacgaatggtcaaacatgtactaaaaagtcaatagcgtcaaacattttaaaacggatagagtagtatatatactactgaaatagtgagagcagagcactatatgagttggcatcaataccccagatattatgcagtgaatcaggcatcaagaatagccaaagttaatcagaaagttgaaaaatagtatatacaccttatgaatttgtctgcaatttagatattcttttacaagattgctccatcactcttttatggtcaatattctcaacatgattgaagaacaatgttcaatattgttatacttatcctacctattgtgtgataatccacaatcatttctgacacaatgtgatatatgtctaaagaagtggtccttctaagatcatatgccaccaaaccactattgaattcatcactgagaatagatattttgtggcacagctcaggttattagaagggagctatttacctgaaatgcttttggacatctaccatttgacgctgcaaagcaaccaaggtaacatgataattcctgccaaaaaaaaaattgactgaataagcaactgaatatcagagacaggatgcaggaaacaaagaaatttcaacaactgttatgtcatccttgttgaattgttgagatgaacctcaacaatctgacccctgcgatagattcaaaagcatatggagtgcaattttttctttgtattttattccatgatagtgaataagtcggcagcgatggaacgatgggcggaggtcaatggcgaggaagcgggatcaggcggtgatgtagtcttcgagatgataatatcgctgagatggatgtatacggcaagatcagcttaccaagctcagatcagttcataattctctcactgtcccactttgatctggaaagttccaagtgctgaatttatgtgtggcttggctactgatttcaaaacaggatatggacagctgatcgcctgcaactacggggctggtaaaacaacaacatgagatggcattctgggaggctgtggaagcacgaatgaagtattcacaactcaaagcgtgccccgggaatccttgttggataattaaccacggaccaagaaaacgaacaagggcagagtcaaatctctttcaatcccggtttcttgggagtttttttatcgctgagatggatagctat

SEQ ID NO: 49172 - DNA, 2027 bp, Oryza sativa
tcctgtagggtccaacaaatctacggtatctctctatctgtagtagagccataccgtcagtcgttggtagccctccgatgtcaatgattacatccagcaccctgtcagatttcccaccactttcctgtgaccaggcattcctcttaaggcattcttttctgagttttgcagggggtgattctaccctccatgcaaaggatcctctcccatggattctctcaaacgcaagccggtcgatacatacactgcacgccgagagcgagcagcctcctgcaccatgcatacaatacatacacagagagatcagtcagtgagagggtggagaaattagtcaatcaatgagagagcaggtattactattccagttaggagcttcacctgcgtattgaataattggtgagcccattacttcttcccaactgtattcattcggtactaatgcttggtgaatccctgccactactttccacttaaaatttcttaagctgcaaacccagtcagatagaaactttgtgcagtacacaggttttgcatcagccttctgcactgaggcctcctccaagagtgatatgttcattccctcatattcctcttcattcctatccttgtaatctgcaagcattgtgcaatttgttcgtcatgtgactagaagcagaagcatgaacaaacataacaatgtactactactactacaaattaacctggtagatctgcaagacccatgcagctaacagcctcaattactacttctagttttggacttgagcttgttggagctagcgaggacaaaaactacctgaacgaattgctacactactagcttcatgctaaactcaatctctcaggcagacatggagcaatgagcgaatacattttttaaggtactagctgctattccctccattctaaaatataaacacatgtagcatttgagatctgtaccaaattacaagtacttctaaagcactcaatttagaagtgctcttcagtgaaatgtttgtttactgaaatataaacacatgcaacaaccttatttcagtgaacatacaagaaaaacaaaacgctggacaatggggaaggacccaatgtggaatttatcaagaaagagggtgagcgtgtccggccagagtcgaacgcgggtcgcggggagcacaacggctgcaccatgccatctgcgctacacgcagtctccagtgaacatataagcattcactcagtttcagttaacatatggagctaatttcagaaatatgaggagcaggctatgggctgttttcaatgatgataccagttaataagagagagccagtgtttagactgaaaacatctatcagaacaatcatgataataaatattggttatatcgttacctgatacaatgtgatgtatatggagcccactgcttctgagaagcagacgaagggagatgaacgtctgcaacggaaaacacacaagggaagcacatgatcaacaattgaatcaggaatttcacatcaagatgtagctacccccaggcatgatgaaagaatttgttttttaggcggaaaaggggaataaccagaagaaacacggcgcaagagagggggtgcaagaaaccccatgagaatgacatggcggtggcaatgttgagcgaatcaagaacaagaaacagacttaattacccgaggacgccgcttgcacacggatgtcctgttcttgacgccgggttcgcggccaggcgacactgacacctgctcgcggatggccagcgtcttcttgttgttgtgcacatgtagaaggccggcgtcaccgccgtagatggggttcggaatcacaaccctgcaccggcggaagtcgcggcacaaggagaagaggctggtgacgtcgtggcccagtgagaggggttcttaatcgccgatgggcgaatccgatagcgtcgtcgtgtgccagcgcagtacgccggtgacgccctcgccgccgtggaagggggtcggcatcgcgcccccgcgctggctgacgtcgtggcccaggggcgcctgctcgagctc

SEQ ID NO: 49173 - DNA, 4562 bp, Oryza sativa
aaaataaataaatcatgtttattgcttctgcaaatttcctttttctagccaaatacacaactactgcagcagatatctcagaatacagcatcagggctggttcaatatcccaatttgcagcaactgggtaaaagggcttttgtcaccagtctcaagtcagtgcacctccagagtccagagtgacaaagaggtgtttgatctgagcaggttcttcatggagaactttgctccgcatatactgcttcacttggtcttcctgctacctcaaagattcattttgttagccacacaaagaatgtgccaaacaagtatattggggacatcgatgtgaaaacaagttccaaacctcaagctatagaaattaatccacaggtcaacagtaacttaattgtggatgatggagatggaaatatcctttattccaaggagtcttgggtgatggtcttgatgatgtcctttatcctcagggagtcaactgcagacacaaatattgaaccagagaaagtcacacagtacatcccgggaattacttccaccttccaactttcagcccaccattctttttgtagatattgctttgtgctgttctattctaaacctattgtcattgtcagattgagaaataagcccataaaaatcactttcagcttgaatggtaaagatgttgattaacaaaaacaagtctcacattcaagtgattctcaagagtaccaggtatctgtggtgatactaaaaaatgacttaatgagtcgtttaaggacaatggatgataactcatggcatcgtccacatgacaagacttctgcaacaactcaagaaaacaccactcgagttcatgcgagtgtactccctggtaatccggttgcactctgaaagttgtactgtcaccatggtcactgcataatgaggttttgtaatggctgcaagaactcagttgacaattgcagctcacaaagcagatgtacatcaatgcttcttcgctcatttgaagtttaaaaagtgaactatggtgtatgttatgatgagaaaaatgtcgatgattgactgggctttcaatgtcatacctgctgtgggagtcctgctgatgttgtgtctgctcctgctgctgctcatgattgccattatcacatattcaaagtagttttgcgtgctaggatgctgtgcatttggtgcaccatagtatgcatcacagcccgtatccttagtagttgccattccactggctgggatcctgctggggaggcctgaaattcagtcagctggcattacaggttttggggttaacctatgcacatgcatgctgcagctcgcataaacaaccaaggattaaactctgtacagaaacctgtttgttctgatgaggagagcagccccatgaaagccgaacttggtacccacctatcggagatacactccaaacacggatggatggtttctttagcggatgacctgaaagtagaataatataaccaaagcaacaaagaatcatatgtactgatagtattaggtgaagatgattacaaagaaagcttgaagaattcattaatctgctgctagtaaattgggcaaatccacggagctttgcctagagaaatcttcacatgaccaatttcagcacatgattgagatggttctcatttacattggaatctatgggggcagcacaatacgaaaaatcagttgcgtcaaaaaaaaaaaggaaaaaaaatcaggaaacagcaagtcgtagaattaaataatgagaaagttaatgattctcgaaattgtttccttgggagctccagctctggtaagctgcaattagaaaacatatataataagcaccataagttgagaaagatcaccataggatgctgatgctatatagtaaaaaagtatggaaaacccgaaatcaaagttagcaaccatgtttgctagccagacgcccagacccaaaacaaacaggccactgaagacaacagattcagtgttaccatgttgataagtaaactaaatttcttccttaataatctatgggatgatgaaaggaatacaagcaatccttacttgatgaaggtgatttgacaaactagtgaatgtattgtatcagcttggctgaaaaaacaagaaaagactgaatgcatttagtaattagccaatattgtgaccgaatctgaattgtcgtgcctggttgcgggcttgtgatgtgctttgaagaggtggcgggggccgggaggaggaggacgcggccagcgcgccccgtcctccgccgccgagcgccgactcctccccacttccacaaccacatggcgccgccggagttggaggcgccgaggcagccggagcaggagtggtcgcggtcggagccgacggcaagaggggcgcacgaagtacgcccgcggcggaacaaccaggactgagaaggcgatgcaggcggcggcggcggcggcggcggcgaggaataggaagctaggagcataattttcaacttctgagccgttggatctgacaagtgacgaggcctccctcaccctaccactcttctgcgcaagtctttttctttttcttttaacagaaaaaaaaaaccctactggaagggaccgatcgcacaaacagaagggtgtatgtccgcgtgtaaaaaaaaaaaagtatactccctccgtcaaaaaaaaaaaaactcaccctaggactaatatgtgacataatctaatacaacgaatctagacagaagcatgtccagatacgacagaagcatatccagatacgttgtactagattatgttacatctcattcctaggttgatttttttttggacggagagagtaggcggggatgattcacacatgttgggggagtggctccggttgacggagctggcctccgtcagtggggaaactctactcggagccatccaccaagggagaatgaccgaaggtttcggaaccaaccgagagctccggagcacatcaccagctccggagcagactagccgccctgaagcctgtcataggctccggagcatatcaacgacgctggagctaaccaatagctccgaagcagatcaagggctccggaatatccggggacccaaagtatccaagcatgaaggaatggcgcacgagcgtagtggggcgccataaatacgcattacgcgtccgccaaccacctctgacattctgacaggggcagggcggcatccactatcatccgggggcatgcctttacccggataatagccatcaccctcggaaagcgtcaccgcatccttaatgggcgcagcctttcctgtcacttgggattttaacgattgcccaagggctagcccatcggccggccacactacatctgttttagttagagcaaagatgtaactttctcttgtatccctagtatatgtaagcattgcccacagttaagggcaaattgaatacagaatacacattgaatacattgtttggactttgtcccaacaacacgtctaatatcattagtggaactagttgcctctattggaattaatctcacatataatatgatcatggcatataacttatacatgtgagaaacatcaagatgtcttccgggtaattccacaaggcggtgggctagccagccttttatttgatattagattcttccctaatatttatttttttttactcgtacatgtgtgttagagaccattatatcatggactcatgtaagtgattaactgaaccatgtaatcgtggttgatgacatggttcaaatgttgtaaaccgttagatcacagccaatcaacgaatattaggcattccaagcattctagaaaatctcttgatatacgagaatgcatgtgtcagggactcggtttgtgccatccaatgggccagttctcaccgagcagtgtcccaaaccagcccaaaagagagaactataagagcaacagcagctggtcctctaaggacgaacagaccagaagctctcggggaattttaactatttgctacttttaggtttgtcaattatctaaatatccctcttaggttcgtatttaataatttgccattggagagaggtgatttcttaactatttgccacttttgcctacgtggcgagccatcgtggcatgtccgcgtggaaaacgacgtggaccccacccgtcagcccctcccatctccttcttctccacctccggccatcatttctccacccatcagtcgaaatccgcaccatggggaggttgggtgggcattggtgccagcgcacgagcttgacgcggtagagggaggcctgccagtgcggcgtgagattggcgagtgtggtggggtcgcagcagtagacggcgagcgaggtcaccgccggcaagcaacccacgagacgggcggcgatggaggcgttctgctcggagatcgcctcggggtggtacaggttcatcctcgacgacgtcgatgtcaacgacggcgcgccgccgccgccaggccggacgaaggagaggagcgggtgcccccacagcgagacaagtgagaggtcgaggcggtccagcatcgggaagcagaacgtcggcgagaggaacaggaaccccggcgagccgaggtggagg

SEQ ID NO: 49174 - DNA, 4256 bp, Oryza sativa
  unsure (1)..(4256): unsure at all n locations
acgggtggggtccatgttattttccatgcgggcacgccacgatggctcaccacgtaggcaaaagtggcaaatagttaaaaaaaatcacctctctccagtggcaaattattaagcgcgaacctaaaaggagcatttgaataattgacaaatctaaaagtggcaaataattaaattccccgaagctctcggtggcggcggtgacctgggtggccggtgggtacccttgtcgatctcttcctacctcccttcttccctacttgttctagaagcgccggtgggcacccttgtcgatctcttcctacctcccttctttcctgcttgttctagaagcttctggtgccttctaccacttgcatctatttagttttccctcttccaactctcccaaaatatactagacttgcactggtagattaccaattgagttggtgttaagattgctgattgggttgctaacagcatgcaggatgaatataatatttacgacaataacttaagtttctgaagcgacaaatcaagctcatccttgtgctgctgctttccacagtagaattcggtggggtgcagaacacgtccgggcgggcagaaggcacagccgccattagcggcggcggtggtgagatcggcatcggccggccgctgctggagcacggtgcatgtgtcgacgaagaagctgtgtacgtagggggtgaagcggatcgagctcagcgaaaaccaggcccgatggtcacgcccgcaccgacagcttcgctgctgcctgccatgtccggcctcctctccttcgcctcgtgcccttcctagccttcccttcccgcgccgagaaccgccgccgctcccaggccgcgcctccgcatcgcaggctccgccgccgtgtcccaccgggcatcttcctcctccagagatcgcctccgctagctcgtccgccatggggagctcgacaaggcgctccgcctcgtcgggtgcgcgcggaggcctgatgcgggcaccttcgccgcgctcatcaagaagctaagcgcgtcggggcgcaccgaggaggctcgccgcgtggagccgatcgctggatcaactctgctccggccgacgcctcctcgttctcctcggcgccgaggaggccgtacctgtcggaggcgtgggacgaggaggaggaagagctgaggaggatgctacgcatcaaggaggatcccaccgccggcgacggtgacggttgtggtcagtactggttgttgcacatactgtgtttttgttgttgcagtcagcgttctcgagtgttgcattcaattgcaacattttcgataaagcggtgaaacatttttcagtgaaagatgaaacatcaagaaacaattcatattgaaacattttttcaagcaatgaaacattgcaacattttttaacgtacagtgcgacatcgtccggagatttgcaaatttcgatatacttagtgaaacattttttatcaacttagtgaaacaattccgatatacttggcgcaacaacgtacaacatttaaaaataattcaataataaactaattttttttcatcagattatattcatatgtggtcttgttttaaagattcaattgtaacggatttaatggtataatcggatcatgatttggataaatattttaagagaaaaaaatagttaaagttcgcttgatccatacatgatggatggctggcgcgcacgtgcgtggatccgacggtcgtgcgaggcgtccgatttttcgtctcgcgccgtacgtccgacgcgtagcacgctccccttaattgtgggccacacaggcgcgcatgcacgtgggccggagaaaaggactgtgctgcacaaactttgagtccgagcaggccttcttcaccttcgcgggccgaatgcactacacttgtttctcacagctccaagagaaccaaatctataactaactaatataaatattcggatttttcctatcgtcacaagtgggacgaaaggcgccttcgtccctcacggtgcgccttcaaaaccccccgaatccctattgcactcagaatcgatacaaggaacacatcccaaaatcggcacaaccaaatcggatgaacacaccgcaaaaaaaaacaaaattcaaccaatctttgcccaaaattacaaaatattacaaaaataatcatccaacatacatacatcacaaaacttcactccctaccaccggatccaccctcggccgtcgccgtagccaccgaatccatccgcggcagccgccgatgccgccaccgtcgccggatccatcgtcgcggatctggagcgggagggaggcgagaggggaggagcgagccgacgccggatcaggagggagcggagaggggaggagggagccgccgccggcccgccgccgccgccaccgccaacggactcacccgccgacgcacagacatcgcaatcgccgtcggatctggggcaggagggagacgagagggcaggagagagccgccactgtcgtatccgcccgcagccgccgccaccacttacggatccatctgtggctaccgccgccgccgccccaccggcggatctgccgcgggagggaggctagagnggatggagggagctgctgtcgccgccgccaacgctgcctccaccctcggatccgccgcggccgccaccaacccgcagccgcttaggtgagagggataggaggagggggggcgctgccgccgttgctttgagagaggggatcaggggcaccgctcgccggtcgttgctccgagccgccgcagccgctcgggggaggagggtgccaccaccatcgtcgctcgggggagattgggggcagggggatggggaaatgaatcctagggttagggttagggttttggtatatttatttaggttaggattaatctggaccgtccattcgatcgaacggctccagatgctcccgtgtcgggccgccgacctattgggccaccgaatggaggatgcaaaatggacttcaacggagaaaggaaacaggccagacacatagaatagacgaagggagggaaacttttctttattcggcccaaacctataagggaggattttgattcctttttccaattaaataattgttaaatgatgtttgtattattaaaaattagcaattaagctctgataattttaataaaattctaaagagcgtaattaatcatggagaatttaataaaattaaatttaaccatgtcattttatttctcacacttgatttacttataaattgatttaattatacacctatctacttaaaaatactaaatatttcagcaaatttgtattttaattgattacataatgtaatttttttcttaacttttcctcaattttctggtctatacacttcccgttgtaacgcacgggcatttttgctagtaatccaaattttgtgaccaaaatgttaatttttctaaagcagtataatttttgtggaaaattagtacacactactgtaagtgaactcgtgctcgatctgttctgttttctgaacaggggaaattaaagagcatgcactgttgttacccagggcccatttagttacctaaatttttttcccaaaaacatcacatcgaatctttaacacatgcataaagcattaaatatagataaaaagaaaaactaattgcacagatatgggagaaatcgcgagacaaatcttttaagcctaattagtccgtgattagccataagtgctacagtaacccacatgtgctaatgacggcttaattagtctcagaagattcatctcgcggtttccaggcgagttctgaaattagtttttccattcgtatccgaaaacctcttccaacatccggtcaaacgttccatgtgacacccaaaaattttcttttccccaactaaacacacctccagtatttgtgacttgatagaccaacacaatatggtaagtttagattagatcagaggtgtttgtcaatagtgtctatatgaaaaataaggagacagataaaggtggctcctcaaagagttgcatgtgttagggtctttgcctattctatactatactatatattccatgactcaaaagggagctctagcatatcaacaatgtaatgtctcgtcaaagtgatatatcgatcgaggaaagcagagaattaagctagcaaacgatctgtcagggcaaacacagcgtcctctgcccctacaaattaaagaactgccctgctccttcttgcttttagtttagggctgtatttttttacctaattgaagcattattaacagtgtta

SEQ ID NO: 49175 - DNA, 1086 bp, Oryza sativa
caatatccattcgggaaagggttctcatctctcaagtggatatccctcattttttttacatgtcatctaaaatagtcataaataatttaaaaagatagattaatatgaactatatcactccacaaacatacaaattcaaatccaacttttacaagttgtaacaaaaacaaaaaaatatataactatgaatgcacgttaattattttcagtttaatttgttcttttttttacatgtaaaagttgaatttagatttgcatgtttgtagagtgatatttcatattaatctattttgtcatttttgtcaaaaatttgatgacatgcaagaaatgagaggaatctcctgtccattctacttctttttcagactcagtatattaattatcgtctggattattattacagaagaaaaagctcagaacggtggagtactggaactgaaagttttcaacttgatgaagataaggttcaatattgttgagatgaaatgaataaatcccttggagtgaatcatatgattctgcatgcagttgaaagatattactgtccattttaaatttgaagacagcatgaaagcccacagcatatgcttcaactgtgtgatctgatcatttactaatatatatatatagaccaaagacgtcgtttcaggaggggtgctagctaattcccctttgtgtttctttttgtacaattgcagctaattaaagagcagtagcatcagatccttttctcatgtcaactgaaactgagagagagaggcagcaaaatgaagaacagccagtgcatgcatgtgttactgtagtacatatagatgaccagaccacatgggtgtgcatgcatgctactccccttacttcacttcacttcacttcatcacttccatgggagaaagaaagaacattaaagaaatggtttcaagtgactgattctttcatgcactaggaaaagtcccatcaaattttcatttcaggtcatctcagacacaaagtgataaggtcatcgcttttcctctcccctaccattcttttctcaccttctcatctcaatcaacagttgagaggacaactggcctcttgcattgcctt
